United States Patent 8,541,208 (PROCESS FOR THE PRODUCTION OF FINE CHEMICALS) - sequence listing, part 14

SEQ ID NO: 72447 - DNA, 1002 bp, Rhizobium meliloti
  CDS (1)..(1002)
atgtttgagggttcgattaccgcgcttgtcacgccttttgctgatgatcgcatcgatgaggttgcattgcacgacctcgtcgagtggcagatcgaagagggatccttcggtctcgttccatgcgggacaacaggggaaagcccgacgctcagcaaatccgagcatgagcaggtggtcgagatcacgatcaaaaccgcaaacgggcgtgtgcccgtcatcgcgggcgccggatcaaacagcacggcggaagcgatcgccttcgttcgccatgcgcagaacgccggcgccgatggagtactgatcgtttcaccctattacaacaagcccacccaggaggggatctaccagcatttcaaggcgatcgatgctgcgtctactattccgatcatcgtctacaatatccctggccgtagcgccattgaaattcacgttgaaacgttggcccgcatttttgaagattgcccgaatgtgaagggcgtcaaggatgcaaccggcaacctgttgcgcccgtccctcgagcgcatggcctgcggggaagacttcaatctcttgaccggtgaagacggcacggcgcttggctatatggcgcatggcggacatggctgcatctcggtgacggcgaatgtcgcaccggccctctgcgctgacttccagcaggcctgcctgaacggcgactttgccgccgccttgaaactgcaggaccgtctgatgccgctgcaccgggcgctttttcttgaaaccaacccggcgggggcgaaatacgcgctccagcgtcttggccgaatgcgtggggatttgcgcctaccactcgtcacgatcagtccttcctttcaagaagagatcgatgacgcgatgcgccacgcgggggatccttttatgatggacaacgcaagatttgctgaacgcatcgagatggatcttatcggtgcgaacaaccagcgaaggaaacaaggtggcacctgcatgggattggattctggagaagcaccatgcacctcgtag

SEQ ID NO: 72448 - protein, 333 aa, Rhizobium meliloti
MFEGSITALVTPFADDRIDEVALHDLVEWQIEEGSFGLVPCGTTGESPTLSKSEHEQVVEITIKTANGRVPVIAGAGSNSTAEAIAFVRHAQNAGADGVLIVSPYYNKPTQEGIYQHFKAIDAASTIPIIVYNIPGRSAIEIHVETLARIFEDCPNVKGVKDATGNLLRPSLERMACGEDFNLLTGEDGTALGYMAHGGHGCISVTANVAPALCADFQQACLNGDFAAALKLQDRLMPLHRALFLETNPAGAKYALQRLGRMRGDLRLPLVTISPSFQEEIDDAMRHAGDPFMMDNARFAERIEMDLIGANNQRRKQGGTCMGLDSGEAPCTS

SEQ ID NO: 72449 - DNA, 885 bp, Thermotoga maritima
  CDS (1)..(885)
atgttcagaggagtaggaactgctatcgttacaccattcaaaaatggtgagcttgatcttgagtcttacgagaggcttgtcaggtatcagctcgaaaacggcgtcaacgcgttgatcgtccttggaacgacaggtgaatcaccaaccgtcaacgaagacgagagagaaaagctcgtttccagaactctcgagatcgtcgatgggaaaatccctgtgatcgtgggagcgggaacgaattccaccgaaaaaacgctgaaactcgtcaagcaggcggaaaaactcggagcgaacggagttcttgtggtcaccccgtattacaacaagcccacacaggaaggactctatcagcactacaagtacatctctgagagaacggatctcgggatcgttgtttacaacgtgcccggaagaaccggtgtgaacgttctcccggaaactgctgcaaggatcgctgcggacctcaagaacgtggtgggaataaaagaggcgaacccggatatagaccagatagacaggacggtatcactgacaaaacaggcaagaagcgatttcatggtgtggtccggcaacgatgatagaacgttctatctcctctgcgcgggtggagacggcgtcatctctgttgtgtcgaacgtggcaccgaaacagatggtagaactctgcgcagagtacttcagcggaaacctcgaaaaatcgagggaggttcacagaaaactcagacctctcatgaaggcactgttcgtggaaacaaatccgataccagttaaagccgctttgaatctcatgggattcatcgagaacgagctgagactaccgcttgtacctgccagtgaaaagacggtggaacttctcagaaacgttctcaaggagagtggattgctatga

SEQ ID NO: 72450 - protein, 294 aa, Thermotoga maritima
MFRGVGTAIVTPFKNGELDLESYERLVRYQLENGVNALIVLGTTGESPTVNEDEREKLVSRTLEIVDGKIPVIVGAGTNSTEKTLKLVKQAEKLGANGVLVVTPYYNKPTQEGLYQHYKYISERTDLGIVVYNVPGRTGVNVLPETAARIAADLKNVVGIKEANPDIDQIDRTVSLTKQARSDFMVWSGNDDRTFYLLCAGGDGVISVVSNVAPKQMVELCAEYFSGNLEKSREVHRKLRPLMKALFVETNPIPVKAALNLMGFIENELRLPLVPASEKTVELLRNVLKESGLL

SEQ ID NO: 72451 - DNA, 915 bp, Sinorhizobium meliloti
  CDS (1)..(915)
atggcacctgcggttctgtttgaaggcctgtcagcgttcccgccgacacccgccgatatggacggcaaggtttcggaagatgcgctgtcgcgactgctcgagcgtatccgcgtagcacgcgcggactcgattggattgctcggcagcacaggcgcttacgcatttctctcgcgcggtgaacggcgaagggcagtggagaccgctgtcgaatgtgtgggaggcagagttcccctcatcgtcggcgtcggcgcactcaggaccgacgaggctcaggcgctcgcgcgcgacgcgaaggaggccggggcagacggactcctcctggctcccgtatcctacacgcctctgaccgaggaggaggtttatcagcatttcgttgccgttgccggcgcttccgacttgccgctctgcatctacaataatccgggcacgaccaagttcgtcttcagcgaggaactgatcgtacggctctcgcaagtgccgaatattgccgcggtgaagatgccgttgcccgccgacggcgatttcgagggtgagatcgctcgactgcgtgcgaagacgtctgcagcttttgctatcggctacagcggcgattggggcgcagcagatgcgctcctgtcgggtgccgatgcgtggttcagcgtcgtcggcggtctcttgcctgcacccgcatcgaaactcgcccgggcggcgaaagcgggcgatcgcgcggaagcgcatcggatcgacatggcattccaaccgctatgggccctgtttaaggagttcggcagtttccgcgtgatgtacgctatcgggagcatcctgggcctctttcaggccttgccaccgcggccgattttgccgctcggacctggtgacagcgtacgggtaaaacaagctgttcaggaactgatcgacattcaagagtgctcttga

SEQ ID NO: 72452 - protein, 304 aa, Sinorhizobium meliloti
MAPAVLFEGLSAFPPTPADMDGKVSEDALSRLLERIRVARADSIGLLGSTGAYAFLSRGERRRAVETAVECVGGRVPLIVGVGALRTDEAQALARDAKEAGADGLLLAPVSYTPLTEEEVYQHFVAVAGASDLPLCIYNNPGTTKFVFSEELIVRLSQVPNIAAVKMPLPADGDFEGEIARLRAKTSAAFAIGYSGDWGAADALLSGADAWFSVVGGLLPAPASKLARAAKAGDRAEAHRIDMAFQPLWALFKEFGSFRVMYAIGSILGLFQALPPRPILPLGPGDSVRVKQAVQELIDIQECS

SEQ ID NO: 72453 - DNA, 882 bp, Clostridium acetobutylicum
  CDS (1)..(882)
atgagtattttcaaaggatcagctgttgcacttattacaccttttacacaagatggagtaaacttcgatgaattaaaaaaattattagaatggcatataaaaaacaaaacagatgctattgttatatgcggaactacaggtgaagcttctactatgtccttaaatgaaagaaaagagacaataaaatatacagtagaaacagtaaataagagaatacctgttatcgctggtactggaagcaataatacaaaatcttctgtagaaatgagtatatgggcagaaaagataggcgtagatggtgttttagttataacaccttattataacaaaactactcaaaaaggtcttattgaacacttcaaatctataaatgataatataaatattcctataatattgtacaatgtaccaggaagaacaggattaaatatacttcctgaaactttgtatgcaatgagagaccttaagaatatatgcgcaataaaagaagcaagcggaaatataagtcaaatagcaaaaatcaaagctctttgtagagatcggtttgatatttattctggaaatgacgatcaaatagtacctatactttctctcggaggctccggtgttatatcagtactcgctaatataattcctcaaactgtccatgatatgtgtttctcttattttcaaggaaaaaccactgatgccttaaatcttcagttggataccctttcccttacaaatagtttatttatagaaacaaatcctataccaataaagacagctatgaacctattaaattttaatgcaggtccccttagacttcctttatgtagtatggatgaaaagaacttaaatacattaaaaacagatttaaaaggctatggtcttataaaataa

SEQ ID NO: 72454 - protein, 293 aa, Clostridium acetobutylicum
MSIFKGSAVALITPFTQDGVNFDELKKLLEWHIKNKTDAIVICGTTGEASTMSLNERKETIKYTVETVNKRIPVIAGTGSNNTKSSVEMSIWAEKIGVDGVLVITPYYNKTTQKGLIEHFKSINDNINIPIILYNVPGRTGLNILPETLYAMRDLKNICAIKEASGNISQIAKIKALCRDRFDIYSGNDDQIVPILSLGGSGVISVLANIIPQTVHDMCFSYFQGKTTDALNLQLDTLSLTNSLFIETNPIPIKTAMNLLNFNAGPLRLPLCSMDEKNLNTLKTDLKGYGLIK

SEQ ID NO: 72455 - DNA, 906 bp, Corynebacterium glutamicum
  CDS (1)..(906)
atgagcacaggtttaacagctaagaccggagtagagcacttcggcaccgttggagtagcaatggttactccattcacggaatccggagacatcgatatcgctgctggccgcgaagtcgcggcttatttggttgataagggcttggattctttggttctcgcgggcaccactggtgaatccccaacgacaaccgccgctgaaaaactagaactgctcaaggccgttcgtgaggaagttggggatcgggcgaagctcatcgccggtgtcggaaccaacaacacgcggacatctgtggaacttgcggaagctgctgcttctgctggcgcagacggccttttagttgtaactccttattactccaagccgagccaagagggattgctggcgcacttcggtgcaattgctgcagcaacagaggttccaatttgtctctatgacattcctggtcggtcaggtattccaattgagtctgataccatgagacgcctgagtgaattacctacgattttggcggtcaaggacgccaagggtgacctcgttgcagccacgtcattgatcaaagaaacgggacttgcctggtattcaggcgatgacccactaaaccttgtttggcttgctttgggcggatcaggtttcatttccgtaattggacatgcagcccccacagcattacgtgagttgtacacaagcttcgaggaaggcgacctcgtccgtgcgcgggaaatcaacgccaaactatcaccgctggtagctgcccaaggtcgcttgggtggagtcagcttggcaaaagctgctctgcgtctgcagggcatcaacgtaggagatcctcgacttccaattatggctccaaatgagcaggaacttgaggctctccgagaagacatgaaaaaagctggagttctataa

SEQ ID NO: 72456 - protein, 301 aa, Corynebacterium glutamicum
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAALRLQGINVGDPRLPIMAPNEQELEALREDMKKAGVL

SEQ ID NO: 72457 - DNA, 903 bp, Helicobacter pylori
  CDS (1)..(903)
atgcaatttcattcatctagtgcgttaattacgccttttaaaaaagatttgagcgttgatgaggccgcttatgaaaccttgatcaagcgccaaatttttcagggcatggacgcatgcgtgcctgttggcacgacaggagaatccgccacgctcacccataaagaacatatgcgttgcattgaaatcgccatagagacttgcaaaagcactaaaacgccttccaattcacgcatgaaagtgttagccggcgtgggcagtaacgccacgagcgagtcgctttctttagcaaagttcgctcaaaaaatcggcgcggatgcgattttatgcgtaagcccttattataaccgccccacccaacaaggcttgtttgaacattataaaactatcgctcaatcggtggaaatccctgtcatgctttatgatgtgccaagccgaacgggcgtgtctattgaagtcccaaccgccctcaaactctttagggaagtccctaacattaaagccattaaggaagcgtctggctctttgaaaagagtcacagaattgcattactatgaaaaagattttaaaatttttagcggggaagattcgctcaaccactctatcatgttttcaggggggtgtggcgtgatttcagtgaccggtaatttaatgcccaatttgatttcacaaatggtcaattgcgcgctcaaatttgaataccaacaagccctagaaatccaaaataagctttttgatttgcatcaagccctttttgtggaaacgaaccctatccctattaaaatggccatgcatttagccggcttgattgaaaacccaagttacagactgcctttagtggctccaagcaaagaaacgatcaaacttttagaaaaaaccctacaacaatatgaggtaattgcatga

SEQ ID NO: 72458 - protein, 300 aa, Helicobacter pylori
MQFHSSSALITPFKKDLSVDEAAYETLIKRQIFQGMDACVPVGTTGESATLTHKEHMRCIEIAIETCKSTKTPSNSRMKVLAGVGSNATSESLSLAKFAQKIGADAILCVSPYYNRPTQQGLFEHYKTIAQSVEIPVMLYDVPSRTGVSIEVPTALKLFREVPNIKAIKEASGSLKRVTELHYYEKDFKIFSGEDSLNHSIMFSGGCGVISVTGNLMPNLISQMVNCALKFEYQQALEIQNKLFDLHQALFVETNPIPIKMAMHLAGLIENPSYRLPLVAPSKETIKLLEKTLQQYEVIA

SEQ ID NO: 72459 - DNA, 879 bp, Pseudomonas aeruginosa
  CDS (1)..(879)
atgattgcgggcagtatggtggcactggtcacccccttcgatgctcagggtcgactggactgggacagcctcgccaagctggtggacttccacttgcaggaaggcaccaacgccatcgtcgccgtcggcaccaccggtgaatcggccacgctggacgtggaagagcacatccaggtgatccgtcgcgtggtcgaccaggttaagggccgcatcccggtgatcgccggcaccggcgccaactccacccgcgaggcggtggcgctgaccgaggccgcgaaaagcggcggcgccgacgcctgcctgctggtgacgccgtactacaacaagccgacccaggaaggcatgtaccagcacttccgccatatcgccgaagccgttgcgatcccgcagatcctctacaacgtaccgggccgcacctcctgcgacatgcttccggagaccgtcgagcgcctgtccaaggtgccgaacatcatcggcatcaaggaggccaccggcgacctgcaacgcgccaaggaagtcatcgagcgcgtcggcaaggacttcctcgtctattccggcgacgacgccacggccgtcgagctgatgctgctgggtggcaagggcaacatctcggtgaccgccaacgtcgcgccgcgcgccatgagcgacctgtgcgccgccgccatgcgcggcgacgccgcagccgcgcgcgccatcaacgatcgcctgatgccgctgcacaaggcgctgttcatcgaatccaaccccattccggtgaagtgggccctgcatgagatgggtctgatccccgagggcatccgcctgcccctgacctggctcagcccgcgttgccacgagccgctgcgtcaggccatgcgccagaccggcgtattggcttga

SEQ ID NO: 72460 - protein, 292 aa, Pseudomonas aeruginosa
MIAGSMVALVTPFDAQGRLDWDSLAKLVDFHLQEGTNAIVAVGTTGESATLDVEEHIQVIRRVVDQVKGRIPVIAGTGANSTREAVALTEAAKSGGADACLLVTPYYNKPTQEGMYQHFRHIAEAVAIPQILYNVPGRTSCDMLPETVERLSKVPNIIGIKEATGDLQRAKEVIERVGKDFLVYSGDDATAVELMLLGGKGNISVTANVAPRAMSDLCAAAMRGDAAAARAINDRLMPLHKALFIESNPIPVKWALHEMGLIPEGIRLPLTWLSPRCHEPLRQAMRQTGVLA

SEQ ID NO: 72461 - DNA, 903 bp, Mycobacterium leprae
  CDS (1)..(903)
atgaccactgtcggattcgacgtccccgcacgtttggggaccctgcttactgcgatggtgacaccgtttgacgctgatggttctgttgacactgcggctgcgacgcggctggcgaaccgcctggtcgacgcgggttgtgatggtctggtgctctcgggcaccaccggcgagtcgccgaccactactgacgacgagaaactccaactgttgcgtgtcgtacttgaggcggtaggtgaccgagctagagtcatcgccggcgcaggtagttatgacacagctcatagtgtccgactcgtcaaggcctgtgcgggtgagggcgcgcacggacttctggtggttaccccttactactcgaagccgccgcagaccgggctgtttgcgcacttcaccgctgtggccgacgcgactgagctaccagtgttgctctacgacattcccgggcggtcggtcgtgccgatcgagcctgacacgattcgcgcgctggcgtcgcatcccaacatcgtcggagtcaaagaggccaaggctgatttatacagcggtgcccggatcatggctgacaccggcctggcctactattccggcgacgacgcactgaacctgccctggctggcggtgggtgccatcggcttcatcagtgtgatttctcatctagccgcaggacagcttcgagagctgttatccgcttttggttctggggatattaccactgcccgaaagatcaacgtcgcgatcggcccgctgtgcagcgcgatggaccgcttgggtggggtgacgatgtccaaggcaggtctgcggcttcagggtatcgacgtcggtgatccgcggttgccgcagatgccggcaacagcggagcagatcgatgagttggctgtcgatatgcgtgcagcctcggtgcttaggtga

SEQ ID NO: 72462 - protein, 300 aa, Mycobacterium leprae
MTTVGFDVPARLGTLLTAMVTPFDADGSVDTAAATRLANRLVDAGCDGLVLSGTTGESPTTTDDEKLQLLRVVLEAVGDRARVIAGAGSYDTAHSVRLVKACAGEGAHGLLVVTPYYSKPPQTGLFAHFTAVADATELPVLLYDIPGRSVVPIEPDTIRALASHPNIVGVKEAKADLYSGARIMADTGLAYYSGDDALNLPWLAVGAIGFISVISHLAAGQLRELLSAFGSGDITTARKINVAIGPLCSAMDRLGGVTMSKAGLRLQGIDVGDPRLPQMPATAEQIDELAVDMRAASVLR

SEQ ID NO: 72463 - DNA, 888 bp, Staphylococcus aureus
  CDS (1)..(888)
atgacacatttatttgagggtgttggcgttgcacttacaaccccttttacaaataacaaagttaatcttgaagctttgaaagcacacgttaattttttactagaaaataatgcccaagcaatcatcgttaatggaactactgctgagagccctactttaacaacagatgaaaaagaacgcattctaaaaacagttattgatcttgtagataaacgtgttcctgtcatagctggaactggaactaatgatactgaaaagtcaatccaagcttcattccaagctaaagccttaggggctgatgcaattatgttaattacgccctactacaacaaaacgaaccaacgtggtttagtcaaacactttgaagcgattacagatgctgtgaaattaccagtcgtgctgtacaatgttccttcaagaacgaacatgacaattgaaccagaaactgtagaaatattaagtcaacatccttatatagttgctttaaaagatgctacgaatgattttgagtatttagaagaagtgaaaaagcgaattgatacaaattcatttgcattatatagtggcaatgatgacaacgtcgtcgaatactatcaacgtggcggtcaaggggttatctctgttattgccaatgtcattcctaaagaatttcaagcgttatacgatgctcaacaaagtggattagatattcaagatcaatttaaaccaatcggcacactgttatcagccctatcagttgatattaacccaattcctattaaagctttaacaagttatttagaatttggaaactatgaattacgtttaccattggttagcctagaagatacagatactaaagtgcttcgtgaagcatatgacacatttaaagcgggtgaaaatgagtga

SEQ ID NO: 72464 - protein, 295 aa, Staphylococcus aureus
MTHLFEGVGVALTTPFTNNKVNLEALKAHVNFLLENNAQAIIVNGTTAESPTLTTDEKERILKTVIDLVDKRVPVIAGTGTNDTEKSIQASFQAKALGADAIMLITPYYNKTNQRGLVKHFEAITDAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLEFGNYELRLPLVSLEDTDTKVLREAYDTFKAGENE

SEQ ID NO: 72465 - DNA, 930 bp, Escherichia coli
  CDS (1)..(930)
atgattcagcaaggagatctcatgccgcagtccgcgttgttcacgggaatcattccccctgtctccaccatttttaccgccgacggccagctcgataagccgggcaccgccgcgctgatcgacgatctgatcaaagcaggcgttgacggcctgttcttcctgggcagcggtggcgagttctcccagctcggcgccgaagagcgtaaagccattgcccgctttgctatcgatcatgtcgatcgtcgcgtgccggtgctgatcggcaccggcggcaccaacgcccgggaaaccatcgaactcagccagcacgcgcagcaggcgggcgcggacggcatcgtggtgatcaacccctactactggaaagtgtcggaagcgaacctgatccgctatttcgagcaggtggccgacagcgtcacgctgccggtgatgctctataacttcccggcgctgaccgggcaggatctgactccggcgctggtgaaaaccctcgccgactcgcgcagcaatattatcggcatcaaagacaccatcgactccgtcgcccacctgcgcagcatgatccataccgtcaaaggtgcccatccgcacttcaccgtgctctgcggctacgacgatcatctgttcaataccctgctgctcggcggcgacggggcgatatcggcgagcggcaactttgccccgcaggtgtcggtgaatcttctgaaagcctggcgcgacggggacgtggcgaaagcggccgggtatcatcagaccttgctgcaaattccgcagatgtatcagctggatacgccgtttgtgaacgtgattaaagaggcgatcgtgctctgcggtcgtcctgtctccacgcacgtgctgccgcccgcctcgccgctggacgagccgcgcaaggcgcagctgaaaaccctgctgcaacagctcaagctttgctga

SEQ ID NO: 72466 - protein, 309 aa, Escherichia coli
MIQQGDLMPQSALFTGIIPPVSTIFTADGQLDKPGTAALIDDLIKAGVDGLFFLGSGGEFSQLGAEERKAIARFAIDHVDRRVPVLIGTGGTNARETIELSQHAQQAGADGIVVINPYYWKVSEANLIRYFEQVADSVTLPVMLYNFPALTGQDLTPALVKTLADSRSNIIGIKDTIDSVAHLRSMIHTVKGAHPHFTVLCGYDDHLFNTLLLGGDGAISASGNFAPQVSVNLLKAWRDGDVAKAAGYHQTLLQIPQMYQLDTPFVNVIKEAIVLCGRPVSTHVLPPASPLDEPRKAQLKTLLQQLKLC

SEQ ID NO: 72467 - DNA, 885 bp, Rickettsia prowazekii
  CDS (1)..(885)
atgtataatatatttaaaggtttaattaccgcactgataacaccttttaaagataataaactagacttatatgctttagagaatattctaaaccagcaaataaagcataaaatcgatgcagtattaattgcaggatcaacaggagaagctaatagtttaagttttgaagaatataaattattactgaaaactagtgtagatattgttaataatcgtatgcctataatcagtggatgttcttcaaataatactgcttatgcaatagagcttgcaatagaatctaaaaaaattggtgttgattgttttatggctagtcccccatcttatgtaaaaccgactcaacacgggatttataagcattttgaggccttacatgaagcgtgtaatctacctataatgttatattcagctccaactagaagcggagtagatttttctgatgagacaatattgagacttagcaaattaccacgtattttagcattaaaagattgtggggtagatttagagcgtcctatgcgcattagagcaatagttaaaggggattttaatattttaaccggtaatgatgaagtagttttagcatttcatgcacaaggtgtagtagggtggatttctgtaacttctaatattgcccctaaactatgcaaagagttattagaaaagtggtataacaatgatactcaaggtgcattagagattcatcagaaattactgcctttatataaagcattatttttagaatctaatccaattccagtaaaatatgctgcatattatttaggtttatgtgaaaatgaaattagattacccttgactgaagcaagtgatagtgcaaaaaaacaaattaaaaaaatcataacatcactatctataaaaatatga

SEQ ID NO: 72468 - protein, 294 aa, Rickettsia prowazekii
MYNIFKGLITALITPFKDNKLDLYALENILNQQIKHKIDAVLIAGSTGEANSLSFEEYKLLLKTSVDIVNNRMPIISGCSSNNTAYAIELAIESKKIGVDCFMASPPSYVKPTQHGIYKHFEALHEACNLPIMLYSAPTRSGVDFSDETILRLSKLPRILALKDCGVDLERPMRIRAIVKGDFNILTGNDEVVLAFHAQGVVGWISVTSNIAPKLCKELLEKWYNNDTQGALEIHQKLLPLYKALFLESNPIPVKYAAYYLGLCENEIRLPLTEASDSAKKQIKKIITSLSIKI

SEQ ID NO: 72469 - DNA, 876 bp, Neisseria meningitidis
  CDS (1)..(876)
atgttacaaggtagcttggttgccctgattaccccgatgaatcaagacggcagcatccattacgaacaactccgcgacttaatcgactggcacattgaaaacggcacggacggcatcgttgccgtcggcacgacaggcgaatccgccaccctctccgtcgaagaacacaccgccgtcatcgaagccgtcgtcaaacacgttgccaaacgcgtccccgtcatcgccggcacaggggcaaacaacaccgtcgaagccatcgccctttcccaagccgccgaaaaagccggggcggactacaccctctccgtcgtcccctattacaacaagccctcccaagaaggcatttaccaacatttcaaaaccatcgccgaagccacttcgattccgatgattatctacaacgtgcccggccgtaccgtcgtcagcatgactaacgacactatcctgcgccttgccgaaatccccaacatcgtcggcgtgaaagaagccagcggcaacatcggcagcaacatcgaactcatcaaccgcgcgcccgaaggcttcgtcgtcctttccggcgacgaccacaccgccctgccgttcatgctctgcggcggacacggcgtgattaccgtagccgccaacgccgcgcccaagctctttgccgatatgtgccgcgccgcgcttcaaggcgatatcgcccttgcacgcgaactcaacgaccgactgattccgatttacgacaccatgttctgcgaacccagccccgccgcaccgaaatgggcggtatccgccctgggcagatgcgaaccgcacgtccgcctgccgctcgttccgctgacggaaaacggacaagcaaaagtccgcgccgccctgaaagcctcaggacaactttaa

SEQ ID NO: 72470 - protein, 291 aa, Neisseria meningitidis
MLQGSLVALITPMNQDGSIHYEQLRDLIDWHIENGTDGIVAVGTTGESATLSVEEHTAVIEAVVKHVAKRVPVIAGTGANNTVEAIALSQAAEKAGADYTLSVVPYYNKPSQEGIYQHFKTIAEATSIPMIIYNVPGRTVVSMTNDTILRLAEIPNIVGVKEASGNIGSNIELINRAPEGFVVLSGDDHTALPFMLCGGHGVITVAANAAPKLFADMCRAALQGDIALARELNDRLIPIYDTMFCEPSPAAPKWAVSALGRCEPHVRLPLVPLTENGQAKVRAALKASGQL

SEQ ID NO: 72471 - DNA, 918 bp, Pseudomonas aeruginosa
  CDS (1)..(918)
atgagcaagcacgtcaactggagcggcgtattccccgcggtcaccacccaattcaacgccgatttctcggtgaacctggaggaaacccacacggtcatctccaacctggtgcgcgacggcgtgtccgggctggtggtatgcggcagcgtcggcgagaacacctcgctgaccatcgaggagaagatggccgtcaccgaggtcgccaaggatgcctccggcggccgcgtgccggtgatctgcgggatcgccgagttcaccagcgccggcgcggcgaaggtggccaaggcggtggagcgggtcggcgtcgacggcatcatggtgatgccggcgctggtctattcctccaagccgcacgagaccgccgagcatttccgcagcgtggccagcggcaccgacctgccggtgatggtctacaacaacccgccgatctaccggaacgacgtcaccccggacatcctggtttccctggccgactgcgagaacatcgtctgcttcaaggacagctccggcgacacccgccgcttcatcgacgtacgcaaccaggtgggcgagcgcttcatcctcttcgccgggctcgacgacgtggtcctggaaagcgtggcggtgggtgcccagggctggatctcgggaatgtccaacgtgtttccgaaggaaggcgagaccatcttccgcctggccagggccgggcgcttcgccgaggcgatgccgatctacgagtggctgatgccgatcctccatctcgacgcccgtcccgacctggtgcagtgcatcaagctctgcgagcaactcgccggtcgcggcagcgccctcacccgtccaccgcgcctggccctgcgcggcgccgatcgcgagcacgtcgagcggatcatggccaaggccctggccagccggccggcgctgccggacgtcggcttgtag

SEQ ID NO: 72472 - protein, 305 aa, Pseudomonas aeruginosa
MSKHVNWSGVFPAVTTQFNADFSVNLEETHTVISNLVRDGVSGLVVCGSVGENTSLTIEEKMAVTEVAKDASGGRVPVICGIAEFTSAGAAKVAKAVERVGVDGIMVMPALVYSSKPHETAEHFRSVASGTDLPVMVYNNPPIYRNDVTPDILVSLADCENIVCFKDSSGDTRRFIDVRNQVGERFILFAGLDDVVLESVAVGAQGWISGMSNVFPKEGETIFRLARAGRFAEAMPIYEWLMPILHLDARPDLVQCIKLCEQLAGRGSALTRPPRLALRGADREHVERIMAKALASRPALPDVGL

SEQ ID NO: 72473 - DNA, 894 bp, Lactococcus lactis subsp. lactis
  CDS (1)..(894)
atgtcagcaaaagaaacaattgaaaaattacaaaatgcacgtatcatcacggccctagtgaccccttttaaagaaaatggccaaattaattttggagcatttcctaagctcattgaggatttacttgctaatcatacggaaggccttatcttagctggaacaacggctgaatcgcctactcttactcatgatgaagaattggcaatttttgctgcggttaataaaatagtggatggccgtattccattgattgcaggtgttgggactaatgacacacgtgattcggttgaatttgtcaaagaagttgctgaacttggttacatcgatgcgggacttgcagtgactccttattacaacaaaccttctcaagaaggaatttatcaacattttaaagccattgctactgcgagtgatttgccaattattttgtataatattccaggaagggtggtcactgaaattcaggtagagaccatcttacgattagcagaactggaaaatgtaattgccatcaaagaatgtacaaatactgataatctggcttatctcattgaaaagctacccaaagactttttagtttatactggagaagatgggctagcttttcacactaaagctttgggaggtcagggtgtaatctcggttgccagtcatatcctaggtcaagaattttttgaaatgtttgcagaaatagaccagggctctattcaaaaagcagcggctatccaaagaaaaatattacccaaaataaatgcactttttagtgtcacaagtccggctccaatcaaaacggttttgaatgcaaaaggatatgaagttggtggcttacgtttaccacttgtagcttgtactactgaggaaagtaaaataattcttgaaaaaattggaaattaa

SEQ ID NO: 72474 - protein, 297 aa, Lactococcus lactis subsp. lactis
MSAKETIEKLQNARIITALVTPFKENGQINFGAFPKLIEDLLANHTEGLILAGTTAESPTLTHDEELAIFAAVNKIVDGRIPLIAGVGTNDTRDSVEFVKEVAELGYIDAGLAVTPYYNKPSQEGIYQHFKAIATASDLPIILYNIPGRVVTEIQVETILRLAELENVIAIKECTNTDNLAYLIEKLPKDFLVYTGEDGLAFHTKALGGQGVISVASHILGQEFFEMFAEIDQGSIQKAAAIQRKILPKINALFSVTSPAPIKTVLNAKGYEVGGLRLPLVACTTEESKIILEKIGN

SEQ ID NO: 72475 - DNA, 882 bp, Sinorhizobium meliloti
  CDS (1)..(882)
atgtccaagaaagccttcgtcgccctcgtcacctgcttcaacgaggacgagaccatcaattacgacgcgacccgcgcccaggtacgccggcaggtcgccgccggcaacaatatcatgtgcgccggcaccaatggcgacttcaccgcgctcacgcacgaggagaagatccgcctcaccgaggaagtggtcgacgaggtcggcggccgcgtcgatgtcatcgtcaatgccggcatgcccgcgaccttcgagacgctgcagctcgcgcgcgccttcgaccgcatcggcgtcagcggcattgccgtcatcacccccttcttcatcgcctgtacgcaggacggcctgatccggcacttctcgacggtcgccgatgccgtggagacccccgtctatctctatgacattccctcccgcacccagaaccatatcgagccggagacggcgttgaagctttctgcgcacggcaatatcgccgggatcaaggattccggcggtgcgcaggatacgctcgaggcctatctgcaggtagcgcgcgacgtgccgggcttcgaagtctattccggccccgaccatctggttctctggtcgctgcagaacggtgcggccggctgcatttccggcctcggcaatgccatgccggaggtgctggccggcattctcagcgcgttcaacagcgggaacattgcggaggcggaacgccggcaggcaatctacaccgccttccgcaccgagctttacgccctcggcttcccgccggccctcgtcaagcgctcgctctacctgcaggatccctccgtcggcgcctcccgccagccggcactgcttccgagcgaggagcaggacgcaaaaatccgggaaattctggtgcggcaccggctgctgtga

SEQ ID NO: 72476 - protein, 293 aa, Sinorhizobium meliloti
MSKKAFVALVTCFNEDETINYDATRAQVRRQVAAGNNIMCAGTNGDFTALTHEEKIRLTEEVVDEVGGRVDVIVNAGMPATFETLQLARAFDRIGVSGIAVITPFFIACTQDGLIRHFSTVADAVETPVYLYDIPSRTQNHIEPETALKLSAHGNIAGIKDSGGAQDTLEAYLQVARDVPGFEVYSGPDHLVLWSLQNGAAGCISGLGNAMPEVLAGILSAFNSGNIAEAERRQAIYTAFRTELYALGFPPALVKRSLYLQDPSVGASRQPALLPSEEQDAKIREILVRHRLL

SEQ ID NO: 72477 - DNA, 873 bp, Bacillus subtilis
  CDS (1)..(873)
atgaatttcggaaatgtgtctacagcgatgattacaccctttgacaataaagggaacgtagactttcaaaaactgtctacactgattgattacttgttgaaaaacggaacggattctttagtagtagcgggaacaactggagaatctccgaccctttcaactgaagaaaaaattgcgctttttgaatatacggtaaaagaagtaaacggacgggtgcccgttatcgctggtactgggagcaacaacacgaaagattccattaagctgacaaaaaaagctgaggaagcgggcgtggacgctgttatgcttgttaccccgtattacaataaaccttctcaagaaggaatgtaccagcattttaaagcaattgcggcagagacatctcttccggttatgctctataatgttcctggccgtacggttgcttctcttgctcctgaaacgacgatccgtttggcggcagacattccgaatgtggttgcgattaaagaagcgagcggagacctcgaagcgattacaaaaattattgctgaaacacctgaagacttctatgtctattcaggggatgatgctctaacgcttccaattctttcagttggaggtagaggagttgtgtcagtggcgagccatattgcaggcactgatatgcagcaaatgatcaaaaattatacgaatgggcaaacagctaatgcggcactgattcatcagaaactgctgccgattatgaaggaactgtttaaagcgcctaatcctgctccagtcaaaacagcgcttcagctgagaggtcttgatgtcggttctgtgcgtctgcctctagtcccattaactgaggatgaacgtctgagcttaagcagcacgatcagcgaactgtaa

SEQ ID NO: 72478 - protein, 290 aa, Bacillus subtilis
MNFGNVSTAMITPFDNKGNVDFQKLSTLIDYLLKNGTDSLVVAGTTGESPTLSTEEKIALFEYTVKEVNGRVPVIAGTGSNNTKDSIKLTKKAEEAGVDAVMLVTPYYNKPSQEGMYQHFKAIAAETSLPVMLYNVPGRTVASLAPETTIRLAADIPNVVAIKEASGDLEAITKIIAETPEDFYVYSGDDALTLPILSVGGRGVVSVASHIAGTDMQQMIKNYTNGQTANAALIHQKLLPIMKELFKAPNPAPVKTALQLRGLDVGSVRLPLVPLTEDERLSLSSTISEL

SEQ ID NO: 72479 - DNA, 870 bp, Methanococcus jannaschii
  CDS (1)..(870)
atgtttaagggggtctatcccgccatcattactccttttaaaaataaagaagttgattttgatggattagaggagaacataaactttttaattgaaaatggagttagcggaattgtagctgttggaactactggagaaagccctactctatcccacgaagagcataaaaaagttattgaaaaagtggtagatgttgttaatgggcgagttcaggttattgcaggagctgggtcaaactgcacagaggaggcaatagagctttctgtttttgctgaagatgtgggagcagatgctgtattgtcaataactccctattataataaaccaacacaggaaggtttaagaaagcattttggaaaggttgctgaatctataaatcttccaatagttttatataatgttccatcaagaacagctgttaatttagaaccaaagacagtaaagcttttagctgaagaatacagcaatatttcagcagttaaagaggcaaatccaaatctttcccaagtttctgagctaatacatgatgctaagataacagttctttcagggaatgatgaactaaccctcccaataatcgccttaggaggaaaaggggttattagcgtagtggccaacatcgtcccaaaagagtttgttgaaatggttaattacgcattagaaggagatttcgaaaaagcaagggaaattcattataaattgttcccattaatgaaggcgatgttcattgaaaccaacccaattcctgttaaaactgccttaaatatgatgggaagacctgctggcgagttaagattgccattatgtgagatgagtgaagagcataaaaagattttggaaaatgttttaaaagatcttggtttaatttaa

SEQ ID NO: 72480 - protein, 289 aa, Methanococcus jannaschii
MFKGVYPAIITPFKNKEVDFDGLEENINFLIENGVSGIVAVGTTGESPTLSHEEHKKVIEKVVDVVNGRVQVIAGAGSNCTEEAIELSVFAEDVGADAVLSITPYYNKPTQEGLRKHFGKVAESINLPIVLYNVPSRTAVNLEPKTVKLLAEEYSNISAVKEANPNLSQVSELIHDAKITVLSGNDELTLPIIALGGKGVISVVANIVPKEFVEMVNYALEGDFEKAREIHYKLFPLMKAMFIETNPIPVKTALNMMGRPAGELRLPLCEMSEEHKKILENVLKDLGLI

SEQ ID NO: 72481 - DNA, 885 bp, Aquifex aeolicus
  CDS (1)..(885)
atgtttcaaggctcaatagttgctctgattactcccttcaaggaaggagaagtggactacgaagccctcggaaacctaattgagtttcacgtggacaatggtacagacgcaattttggtttgcggaactacgggagaatccccgacccttacctttgaagagcacgaaaaggttatagagtttgccgtaaaaagggcggcgggaaggattaaggtaatcgcaggaacgggcgggaacgcaacccacgaagcggttcacctgacagcccatgcgaaagaagtaggagcggacggagccttagtggtcgttccatactacaacaagcccacacaaagaggtctctacgagcactttaaaacggttgctcaggaagtggacattcccataatcatttacaacataccctcaagaacctgcgtggaaatttccgtggacaccatgttcaagctcgcgagcgagtgcgaaaacatagtcgcttcaaaggaatccactcccaacatggatcgcatttcggaaatagtaaagaggctgggagaaagtttcagcgtcctttcgggagatgacagcctgactcttcccatgatggccctcggtgctaagggagttatatcggttgcgaacaacgtaatgccaagagaagtaaaagaactcatacgggccgctttggaaggagactttagaagggcgagggaaatccattactaccttcacgacctatttaaggttctctttatagaaacgaatcccattcccgtcaaaaccgcctgctggatgctgggtatgtgtgaaaaggaattcagacttcccttaacggaaatgtctccagagaatgaaaacaagctgagagaagtcctaaagaagtacaacctacctctgaaaaactaa

SEQ ID NO: 72482 - protein, 294 aa, Aquifex aeolicus
MFQGSIVALITPFKEGEVDYEALGNLIEFHVDNGTDAILVCGTTGESPTLTFEEHEKVIEFAVKRAAGRIKVIAGTGGNATHEAVHLTAHAKEVGADGALVVVPYYNKPTQRGLYEHFKTVAQEVDIPIIIYNIPSRTCVEISVDTMFKLASECENIVASKESTPNMDRISEIVKRLGESFSVLSGDDSLTLPMMALGAKGVISVANNVMPREVKELIRAALEGDFRRAREIHYYLHDLFKVLFIETNPIPVKTACWMLGMCEKEFRLPLTEMSPENENKLREVLKKYNLPLKN

SEQ ID NO: 72483 - DNA, 870 bp, Sulfolobus solfataricus
  CDS (1)..(870)
atgaaagagaatatttccgctcttgttacaccctatgacgataaggaaaatataaatactgaagcgttacaacagctattggactttttaattaaaaaaggaattaaggacttttgggttcttggcactagtggagagtttaatatgctttctcaagatgagagaatattagtagttagtaaaatacgtgagatggttaaaggtaaaatatatgtaggtgtcaatgagaactcaaccagaaatagtctaatattagctaaaaaatactatgatctaggtgttgattatattttttcagttccacctatttatcataaaccttcagaaaaaggactaatatcgtattttagcgagttgcgtaatgctatagatttaccattattcatatataatataccctcctttacaggatataatgttcctcttcatataattgagaagctagcgagagagtacgtattagatggtatgaagtactcaactacagattttgtctcttttctaaagtatttaaaggcactaaaaggagtaaataagaacttcaaagtattcattggcgaggataggatgatcctttccgctcttattttagatactgatggtgcagtttctggtatttccaatttagttcctgaattagtcaccaatttattcttggaatttgatagaggtaacattcagagggctatagagattcagagaattttgaacaaattggtagacgtggtaagtttaggcgattatcccagtggtattaagataggtttaaggtataggggaattaatgtcggtagtgttaggaaacctttattagaggatagtagagccgaaggtgaaatatataatgtactgaaagaattaggtatatag

SEQ ID NO: 72484 - protein, 289 aa, Sulfolobus solfataricus
MKENISALVTPYDDKENINTEALQQLLDFLIKKGIKDFWVLGTSGEFNMLSQDERILVVSKIREMVKGKIYVGVNENSTRNSLILAKKYYDLGVDYIFSVPPIYHKPSEKGLISYFSELRNAIDLPLFIYNIPSFTGYNVPLHIIEKLAREYVLDGMKYSTTDFVSFLKYLKALKGVNKNFKVFIGEDRMILSALILDTDGAVSGISNLVPELVTNLFLEFDRGNIQRAIEIQRILNKLVDVVSLGDYPSGIKIGLRYRGINVGSVRKPLLEDSRAEGEIYNVLKELGI

SEQ ID NO: 72485 - DNA, 870 bp, Archaeoglobus fulgidus
  CDS (1)..(870)
atgtttgagggcgtgattcccgcaatggtaacgcccttcaaggaggacttcagcgttgactacgaggggatagcgaagaatctcgactaccttgagaagcacgtcaacgctctggttcctgctgggacaacaggagaggctgcaacactcagctacgaggagcacatcgatgttgtgaggtatgttgcagagacgtcaaagcttcctgtaattggtggtgcaggttcaaactcaacgagggaggcaatttggcttgcaaaggaagttgagaaggctggtgcagaggctgcaatgctcgtcactccctactacaacaagcccaacgctgaggggctctaccagcactacaaggctgttgcgtctgaagtttccattccaatcatagtttacaacgttcccagcaggacgggcataaacacaactcccgaactcgtaagaaggctggcggagattgacaacatttttggcattaaggaggcgagcgggaacctcaagcagatctccgagattataagaacaacaccagacgactttgtcctgctttctggcgatgattttctcaccctgcccattctctgccttggaggaaagggcgtaatcagcgttgccgccaacgtcgccccccacctgatgaaggagatgtacgaagctttcgttgaggggaacatagaaagggcgagggagatgcaccacaggcttacgccactcttcgacgtgctcttcatcgacaccaatcctattccggttaagaaggctttgcagcttatggggcttgcagcgggaaagccgaggctgcctctggtcgagctctctgaagagaaaactcagaaggttaaagaagttctcaagagtcttgagctgattagctga

SEQ ID NO: 72486 - protein, 289 aa, Archaeoglobus fulgidus
MFEGVIPAMVTPFKEDFSVDYEGIAKNLDYLEKHVNALVPAGTTGEAATLSYEEHIDVVRYVAETSKLPVIGGAGSNSTREAIWLAKEVEKAGAEAAMLVTPYYNKPNAEGLYQHYKAVASEVSIPIIVYNVPSRTGINTTPELVRRLAEIDNIFGIKEASGNLKQISEIIRTTPDDFVLLSGDDFLTLPILCLGGKGVISVAANVAPHLMKEMYEAFVEGNIERAREMHHRLTPLFDVLFIDTNPIPVKKALQLMGLAAGKPRLPLVELSEEKTQKVKEVLKSLELIS

SEQ ID NO: 72487 - DNA, 897 bp, Campylobacter jejuni
  CDS (1)..(897)
atggataaaaatattatcattggggcgatgacggctcttattacaccatttaaaaatggaaaagttgatgagcaaagttatgcaagattgattaaaagacaaatagaaaatggcatcgatgcagtagttccagtaggaacaacaggagaaagtgcaactttaacccatgaagaacatagaacttgcatagaaatagccgttgagacttgtaaaggaactaaagttaaggttttagcaggtgcgggaagtaatgcaactcatgaggcagtgggtttggctaaatttgctaaagagcatggtgctgatgggattttaagtgtggcaccgtattataataaacctacgcaacaaggactttacgagcattataaggctattgcgcaaagtgtagatattcctgtgcttttatataatgttccaggaagaacaggttgtgaaatttcaacggatactattatcaagctttttagagattgtgaaaatatttatggagtaaaagaagcgagtggaaatatcgataagtgtgtggatttgcttgcacacgaacctagaatgatgcttatttcaggggaagatgcgatcaattatcctatactttcaaatggtggaaagggagtgatttcagtaacttcaaatttattacccgatatgattagcgctttaactcattttgctttagatgaaaattataaagaagctaaaaaaatcaatgatgagctttataatatcaataaaattttattttgcgaaagtaatcctattcctattaaaacggctatgtatttagctggattgatagaaagtttggaatttagacttcctctttgttctccaagtaaggaaaattttgctaaaattgaagaagtgatgaaaaaatataagatcaaaggattttaa

SEQ ID NO: 72488 - protein, 298 aa, Campylobacter jejuni
MDKNIIIGAMTALITPFKNGKVDEQSYARLIKRQIENGIDAVVPVGTTGESATLTHEEHRTCIEIAVETCKGTKVKVLAGAGSNATHEAVGLAKFAKEHGADGILSVAPYYNKPTQQGLYEHYKAIAQSVDIPVLLYNVPGRTGCEISTDTIIKLFRDCENIYGVKEASGNIDKCVDLLAHEPRMMLISGEDAINYPILSNGGKGVISVTSNLLPDMISALTHFALDENYKEAKKINDELYNINKILFCESNPIPIKTAMYLAGLIESLEFRLPLCSPSKENFAKIEEVMKKYKIKGF

SEQ ID NO: 72489 - DNA, 888 bp, Bacillus halodurans
  CDS (1)..(888)
atgaatatcggacggattgttacagcgatggtcacaccgttcaacgaacaggaccaagtgaacctagaagcgacctgtcaacttgtaaatgaattaattgccaatgggagcgatgcccttgtcgttggtggaaccactggcgaatcgcccacgttaacgacagatgaaaaaatggcccttttccacaccgtagtggaagccgcaggtggccgagttcccgtcatcgcaggaacaggctccaacaatacgagggcttcgattgagctgagtaaaaaagtagaagatttaggtgtggacggtatcatgctcgtgaccccttactacaacaagccatctcaggaaggcttatttcaacactttaaagccatttccgaatccacttccttaccaatcatgctttacaacattcccggaagaagcggtgtcaacttggatgcggaaacgacgctacgcctcgctgaactaagaaatattgtttcgattaaagaagcaagcggcaatcttgatcagattgctgaaattattgaacattctcctgcagactttagcgtctacagtggggatgattcattgacattaccgctcttatcgatcggcgggacaggagtcgtctctgttgcttcgcacattatcggtaatgaaatgcaggaaatggtgcaattatttttgtcaggacaagtagagcgggcagcagcgatccatcggaaactactaccgctcatgaaaactttatttatgacacccaacccaacggcagtgaaagctgctcttgaactaaaagggcttcctgttgggcatgtacgccttcccctcgttccgctaacggctgaagaacagcggcaattagagctagcgatcaacccacagttcaatatgtttgttagctaa

SEQ ID NO: 72490 - protein, 295 aa, Bacillus halodurans
MNIGRIVTAMVTPFNEQDQVNLEATCQLVNELIANGSDALVVGGTTGESPTLTTDEKMALFHTVVEAAGGRVPVIAGTGSNNTRASIELSKKVEDLGVDGIMLVTPYYNKPSQEGLFQHFKAISESTSLPIMLYNIPGRSGVNLDAETTLRLAELRNIVSIKEASGNLDQIAEIIEHSPADFSVYSGDDSLTLPLLSIGGTGVVSVASHIIGNEMQEMVQLFLSGQVERAAAIHRKLLPLMKTLFMTPNPTAVKAALELKGLPVGHVRLPLVPLTAEEQRQLELAINPQFNMFVS

SEQ ID NO: 72491 - DNA, 885 bp, Caulobacter crescentus
  CDS (1)..(885)
atggtccagtctcacttcaagggcgtcattccggccctcgtcacgccgttccgggacggtgaggtggacgaaaaagcgttcgtggcgctggtcgagcgccagatcgccggcggtgtgcatggtctagtccccgtcggtacgacgggcgagacctcgaccctgtcgcacgaggagcaccgccgcgtcgtcgagttgtgcgtgaagaccacggcgggccgcgtcccagtgatcgcgggcgcgggcagcaattcgaccgatgaagccatcgaactggcccgtcacgccaagaccgtcggcgccgacgcctgtctggtggtgacgccgtattacaaccgccccagccaggagggcatgtatcagcactacaaggcgatcaacgacgccgtggagctgccgatctttgtttataacgtgccgggtcggaccggcgtcgacatcagcaacgacacccttgagcgtctcgccaagctgccgaacatcgtcgggatcaaggacgccacgggcgacctgacccgcatcagcttccagcgcctgatgtgcggccccgaatgggtgatgctgtcgggcgatgatccgaccgcgctcggctacatggctcatggcggccacggtgtgatctcggtgacgtccaacgtcgcgccagacgcctgctcggccttcatgaacgcctgcatgcagggcgaatgggagaagggtctctactggcaggaccgcctggtgcgcctgcacaaggccctgttcctggattcctcgcccgccccgaccaagttcgccatggcgcaactgggcctgtgcacggaagatgtgcgcctgccgatcacggcctgcgccgaaggggtgcgccccgcgatccttgaggccatgcgcgaggctggtctgcgctga

SEQ ID NO: 72492 - protein, 294 aa, Caulobacter crescentus
MVQSHFKGVIPALVTPFRDGEVDEKAFVALVERQIAGGVHGLVPVGTTGETSTLSHEEHRRVVELCVKTTAGRVPVIAGAGSNSTDEAIELARHAKTVGADACLVVTPYYNRPSQEGMYQHYKAINDAVELPIFVYNVPGRTGVDISNDTLERLAKLPNIVGIKDATGDLTRISFQRLMCGPEWVMLSGDDPTALGYMAHGGHGVISVTSNVAPDACSAFMNACMQGEWEKGLYWQDRLVRLHKALFLDSSPAPTKFAMAQLGLCTEDVRLPITACAEGVRPAILEAMREAGLR

SEQ ID NO: 72493 - DNA, 882 bp, Pseudomonas aeruginosa
  CDS (1)..(882)
atgtccgcatccatccacggcatcatcggctacaccatcacccccttcgccgccgacggaggtctcgacctgccggccctcggccgctccatcgagcgcctgatcgacggcggcgtgcacgccatcgccccgctcggcagcaccggcgaaggcgcctacctgagcgacccggaatgggacgaggtggtcgacttcaccctgaagaccgtcgcccatcgcgtgccgaccatcgtcagcgtctccgacctgaccaccgccaagaccgtgcgccgcgcgcagttcgccgaatccctcggcgccgaggcggtgatggtcctgccgatctcctactggaagctcaacgaggcggaagtgttccagcactaccgcgcggtgggcgaagccatcggcgtgccggtgatgctctacaacaacccgggcaccagcggcatcgacatgtcggtggaactgatcctgcgcatcgtccgcgaagtggacaacgtgaccatggtcaaggagagcaccggcgacatccagcgcatgcacaagctgcgcctgctcggcgaaggccgggtgcccttctacaacggctgcaacccgctggcgctggaggccttcgtggccggcgcgaaaggctggtgcagcgccgcgccgaacctgatcccgacgctcaacggccagctctaccaggcggtgctcgacggcgacctggagaaggcccgcgcgctgttctaccggcagttgccgctgctcgacttcatcctccgccggggcctgccgaccaccatcaaggccggcctgggcctctccggcctggaggtgggggcgccgcgccttccggtgcaggcgctggataccgagggctgtcggtatctgcaggggttgttggaagagctgcgctga

SEQ ID NO: 72494 - protein, 293 aa, Pseudomonas aeruginosa
MSASIHGIIGYTITPFAADGGLDLPALGRSIERLIDGGVHAIAPLGSTGEGAYLSDPEWDEVVDFTLKTVAHRVPTIVSVSDLTTAKTVRRAQFAESLGAEAVMVLPISYWKLNEAEVFQHYRAVGEAIGVPVMLYNNPGTSGIDMSVELILRIVREVDNVTMVKESTGDIQRMHKLRLLGEGRVPFYNGCNPLALEAFVAGAKGWCSAAPNLIPTLNGQLYQAVLDGDLEKARALFYRQLPLLDFILRRGLPTTIKAGLGLSGLEVGAPRLPVQALDTEGCRYLQGLLEELR

SEQ ID NO: 72495 - DNA, 879 bp, Bacillus halodurans
  CDS (1)..(879)
atggactttggccacgtccttacagccatggtcaccccttttgatgcaaagggaaatgttgatctagaaaaagtggaacgacttgtggaatttttgcttgccaatgggacagagggtctcgttgtagcaggtacgactggtgaatcaccaacattgagagaagaagaaaagctagccctatttgaaaaagttgtcacggttgtgaacaaacgagttccagtgatcgcagggacaggttcgaacaatacgtacgtctccgcccaactgacgaagaaagcgacggctcttggagttgatggcattatggctgtcacaccttattacaataaaccgtctcaggaagggatgtacgctcactttgcagcgatcgcagaagcgacacacttgccggttatgttgtacaatattccgagccgttccgttgtgaatttatcagcggaaacaattgtgaaactctcttatatcccgaatattacctcattaaaagaagcgaacggtgatttggatcatatggtgtcggtcatcgagcaaacccctgatacgtttcatctatatagtggggatgattcgctaacactcccggccttatccatcggagcaaaaggggtcgtgtcggtcgcctcccacataataggacctgaaatgcagcaaatgatgatggcgtttcggggtggagatgtggagcatgcagcaaatctccaccggaagcttttgccgatcatgaaaggcttatttactgcgccaaatcctacatgtgtgaaagccgccttgcagatcaaaggattcgatacaggtggtgttcgcttaccactcgtgccacctacatctgagcaacggcaacatttacagtttttaattgaacagttgaaagtctcgtaa

SEQ ID NO: 72496 - protein, 292 aa, Bacillus halodurans
MDFGHVLTAMVTPFDAKGNVDLEKVERLVEFLLANGTEGLVVAGTTGESPTLREEEKLALFEKVVTVVNKRVPVIAGTGSNNTYVSAQLTKKATALGVDGIMAVTPYYNKPSQEGMYAHFAAIAEATHLPVMLYNIPSRSVVNLSAETIVKLSYIPNITSLKEANGDLDHMVSVIEQTPDTFHLYSGDDSLTLPALSIGAKGVVSVASHIIGPEMQQMMMAFRGGDVEHAANLHRKLLPIMKGLFTAPNPTCVKAALQIKGFDTGGVRLPLVPPTSEQRQHLQFLIEQLKVS

SEQ ID NO: 72497 - DNA, 876 bp, Chlamydophila pneumoniae, Chlamydia pneumoniae
  CDS (1)..(876)
atgcatttacttacagcaactgttacaccttttttccctaatggcactatagattttgctagcttagaacgtcttttatcttttcaagatgcagttgggaatggagtggttcttttagggagcactggagaaggcctttcgctaacaaaaaaggaaaaacaagcactgatttgctttgcttgtgatctacagcttaaagttcctctttttgttgggacttcgggaacccttctagaggaagtcttagattggattcatttttgcaatgacttgcctatctcgggattcttaatgacaactcccatctatacgaagcctaaactatgcggtcaaatcttatggttcgaagcagtactcaatgctgcaaaacatcccgcgattctttataacattccatctcgtgcagccacgcccttatatttagatactgtaaaagccttggctcatcatccacaatttttgggaatcaaagattctggaggctctgtagaagagttccagagttataagagcatcgctcctcatatccaactttattgtggagacgatgttttttggagcgagatggcggcatgtggagcccatggtttaatctctgtcttatcgaatgcttggcctgaagaagcccgagagtatgtgctgaaccctcaagaacaagactatcgttctttatggatggagacgtgtcggtgggtatataccacaacaaatcctattggaattaaagcgatccttgcctacaaaaaagctattactcacgctcagctgcgcttgcccttgtctatagaagattttgatttggagaatgtatctcctgctgtagaaagtatgcttgcctggccgaagttacgtacctctgtgttctcctattcttaa

SEQ ID NO: 72498 - protein, 291 aa, Chlamydophila pneumoniae, Chlamydia pneumoniae
MHLLTATVTPFFPNGTIDFASLERLLSFQDAVGNGVVLLGSTGEGLSLTKKEKQALICFACDLQLKVPLFVGTSGTLLEEVLDWIHFCNDLPISGFLMTTPIYTKPKLCGQILWFEAVLNAAKHPAILYNIPSRAATPLYLDTVKALAHHPQFLGIKDSGGSVEEFQSYKSIAPHIQLYCGDDVFWSEMAACGAHGLISVLSNAWPEEAREYVLNPQEQDYRSLWMETCRWVYTTTNPIGIKAILAYKKAITHAQLRLPLSIEDFDLENVSPAVESMLAWPKLRTSVFSYS

SEQ ID NO: 72499 - DNA, 936 bp, Streptococcus pneumoniae
  CDS (1)..(936)
atgtcttatcaagatttaaaagagtgtaaaatcatcacagcctttattactcccttccacgaggatggttccatcaactttgatgctattccagccttgattgagcatttattggaccatcatacggatggaattcttctcgcagggaccactgctgagagtccaactttgacccacgatgaggagttggagttatttgcggctgtacaaaagattgtcaatggacgagttcctttgattgcgggtgtaggtactaatgatacgcgtgactctatcgagtttgtcaaagaagtagcggaattcggcggttttgctgctggtcttgctattgttccttactacaacaaaccttctcaagaaggaatgtatcagcattttaaagccattgcagatgcttctgacctaccaattattatctataacattccagggcgtgtggttgttgaattaactccagaaaccatgcttcgcttggctgatcatccaaatattatcggtgtcaaagaatgtactagcttggctaatatggcttacttgattgagcacaaaccagaagagttcttggtctatactggtgaggatggagatgctttccatgccatgaaccttggggcggatggggttatttctgttgcctctcatacaaatggggatgaaatgcacgagatgtttattgccattgcagaaagtgatgtgaagaaagccgcagctattcaacgtaaattcattcctaaggttaatgctctcttctcttatccaagtcctgctccagttaaggcagttttgaactacatgggatttgaagctggaccaactcgtctacctcttgttccagcaccagaagaagatgctaaacgcattatcaaggttgtcgtagatggcgactacgaagcgaccaaggcaactgtaacaggtgtcttaagaccagattactaa

SEQ ID NO: 72500 - protein, 311 aa, Streptococcus pneumoniae
MSYQDLKECKIITAFITPFHEDGSINFDAIPALIEHLLDHHTDGILLAGTTAESPTLTHDEELELFAAVQKIVNGRVPLIAGVGTNDTRDSIEFVKEVAEFGGFAAGLAIVPYYNKPSQEGMYQHFKAIADASDLPIIIYNIPGRVVVELTPETMLRLADHPNIIGVKECTSLANMAYLIEHKPEEFLVYTGEDGDAFHAMNLGADGVISVASHTNGDEMHEMFIAIAESDVKKAAAIQRKFIPKVNALFSYPSPAPVKAVLNYMGFEAGPTRLPLVPAPEEDAKRIIKVVVDGDYEATKATVTGVLRPDY

SEQ ID NO: 72501 - DNA, 903 bp, Mycobacterium tuberculosis
  CDS (1)..(903)
atgaccaccgtcggattcgacgtcgcagcgcgcctaggaaccctgctgaccgcgatggtgacaccgtttagcggcgatggctccctggacaccgccaccgcggcgcggctggccaaccacctggtcgatcaggggtgcgacggtctggtggtctcgggcaccaccggcgagtcgccgaccaccaccgacggggagaaaatcgagctgctgcgggccgtcttggaagcggtgggggaccgggcccgtgttatcgccggtgccggcacctatgacaccgcgcacagcatccggctggccaaggcttgtgcggccgagggtgcgcacgggctgctggtggtcacgccctactattccaagccgccgcagcgggggctgcaagcccatttcaccgccgtcgccgacgcgaccgagctgccgatgctgctctatgacatcccggggcggtcggcggtgccgatcgagcccgacacgatccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatcaacattgcggtcgccccgctgtgcaacgcgatgagccgcctgggtggggtgacgttgtccaaggcgggcttgcggctgcagggcatcgacgtcggtgatccccggctgccccaggtggccgcgacaccggagcagatcgacgcgttggccgccgacatgcgcgcggcctcggtgcttcggtga

SEQ ID NO: 72502 - protein, 300 aa, Mycobacterium tuberculosis
MTTVGFDVAARLGTLLTAMVTPFSGDGSLDTATAARLANHLVDQGCDGLVVSGTTGESPTTTDGEKIELLRAVLEAVGDRARVIAGAGTYDTAHSIRLAKACAAEGAHGLLVVTPYYSKPPQRGLQAHFTAVADATELPMLLYDIPGRSAVPIEPDTIRALASHPNIVGVKDAKADLHSGAQIMADTGLAYYSGDDALNLPWLAMGATGFISVIAHLAAGQLRELLSAFGSGDIATARKINIAVAPLCNAMSRLGGVTLSKAGLRLQGIDVGDPRLPQVAATPEQIDALAADMRAASVLR

SEQ ID NO: 72503 - DNA, 885 bp, Pyrococcus abyssi
  CDS (1)..(885)
atggagggtgtgatagttccactcgtaactccgtttagggaagactattcaatagatttcgaggccctagagtggcacataagattcctggaggaaaaaggagttcacgggatattcgtaaattcaacgactggcgagttcaccagtttgaacacagatgaaaggaaaatgttagcggaaaaaggaagggagatcacatcgggaatgtacttggtaggaactggatccacgagcactttagaggttatagagctaagcaggcacgctgaagatattggagcggatggcatcgttatagtggccccatattactgtaagcttaaggacgaagagattcttaagcatttctcaatggtagccgagagggtagatataccaattatagtctatgcaatcccatcgtgcgcgaatccagtaccagtcgacattataagaaaggtctcactagagtattcgaacataataggagtcaaagcgagcgttgatagcctaacttatctccaagaattgatagaggtaaaggaagaaagaaaggactttagggttttcactggattagatcagtactttttatcgactttactccttgggggagacggaggaataatggcgtgtgcaaactttgcaccggaaattcaccttcaaatttggaactcattcaagagaaggaactttgaagaggcaataaaactatcaagagtccttggagagatatctaggatatacaatgtagcttcatcctttgcatcggcggtaaagttagctatgatagccaaaggattcccgataaaaccagttcttaggccacctcacgtaatcgatggagaggaagtttttaacgaaataaagggaatattaaggtcattagagaacgtcaagccgtga

SEQ ID NO: 72504 - protein, 294 aa, Pyrococcus abyssi
MEGVIVPLVTPFREDYSIDFEALEWHIRFLEEKGVHGIFVNSTTGEFTSLNTDERKMLAEKGREITSGMYLVGTGSTSTLEVIELSRHAEDIGADGIVIVAPYYCKLKDEEILKHFSMVAERVDIPIIVYAIPSCANPVPVDIIRKVSLEYSNIIGVKASVDSLTYLQELIEVKEERKDFRVFTGLDQYFLSTLLLGGDGGIMACANFAPEIHLQIWNSFKRRNFEEAIKLSRVLGEISRIYNVASSFASAVKLAMIAKGFPIKPVLRPPHVIDGEEVFNEIKGILRSLENVKP

SEQ ID NO: 72505 - DNA, 879 bp, Vibrio cholerae
  CDS (1)..(879)
atgttttcaggaagtatcgttgcgttaattaccccatttactccggacggtgaagtcgattatatcagcctgaaaaagctggtcgatttccatgttgatgcaggaaccgatgcgattgtttccgttggcaccaccggtgaatccgcgacgctaacggtcgaagaacacgtgaaagtagtagcaaaaacggtggagttcgctgaaggtcgtctgcctattattgctggaacaggcgcaaatgcgacccatgaagcggtcacttttagccgcctgctgaacaacacaggtattgcagggtatttgagtgtcacgccttattacaataagccgacccaagaaggtctgttcctgcactacaacgcgattgcgcaagaaaccgatattcccgtgattttgtacaacgtgccgggacgtaccgctgtggatatgcgtccagaaaccgttgcccgtttatctgaaatcaagaacattgtcgcactgaaagatgcaaccggtgatttaagccgtgttgcgaagcaccgtgagatgtgtaaagaaggttttgtcctactcagcggtgatgatgccacaggccttgagttcgtcaaactcggggggcaaggtgtgatttcagtgaccaacaatatcgctgctgccgacatggcgaagatgatgcatttggcgctggatggtaagtttgatgaagcggcgatcatcaaccaacgtttgatgactctgcataaaaatctgtttatcgaatcgagcccaattccagtgaaatgggcagcccataagatgggattgattgcaaatggtgatctgcgtctacctttgacgcaactttcggaaccagcacgcccaatcgttgcccaagccctgtctgaagcctgtatttattaa

SEQ ID NO: 72506 - protein, 292 aa, Vibrio cholerae
MFSGSIVALITPFTPDGEVDYISLKKLVDFHVDAGTDAIVSVGTTGESATLTVEEHVKVVAKTVEFAEGRLPIIAGTGANATHEAVTFSRLLNNTGIAGYLSVTPYYNKPTQEGLFLHYNAIAQETDIPVILYNVPGRTAVDMRPETVARLSEIKNIVALKDATGDLSRVAKHREMCKEGFVLLSGDDATGLEFVKLGGQGVISVTNNIAAADMAKMMHLALDGKFDEAAIINQRLMTLHKNLFIESSPIPVKWAAHKMGLIANGDLRLPLTQLSEPARPIVAQALSEACIY

SEQ ID NO: 72507 - DNA, 861 bp, Clostridium acetobutylicum
  CDS (1)..(861)
atgaaaatcgaaggtgttttaataccattaattactccttttaaggatggcaaagtagatttagcttcttatgaaaaacttattaggcactattcaaaaaaaggagtcgctggctttatgcctcttgcaaccacaggcgaaactcctacattatcagattatgaataccaaagcatattagaaaaaactgttgaatgcaatgaacttaatcttcctatatatgttggttttggcggaaataataccgaaaaaatgaccaaggatatcaaaatgcttgataaatataatattaaaggtattttatcagtatgtccttattataatagacctgaccaaaggggaatatacgaacattttaaaagaatatctgaatcaacttccttagatatagtattatacaatataccttacagaaccggaagaaacatagaaaatgacactataagaaggctttctgaattagataatatagttggagtaaaggatgcttgtggtgattttactcaaaccacagagcttttattaaatcgtccagataacttttcaatacttactggcgaagatgccttcttctacagcacactaatgcttggaggagatggcggtataatggcatccgctcacttaaatactgaaaaatacgttgaagtatttaataaatctaagcaaaatgactataaatctgctctagaaatctggaaacaagtagctaacatgattcctctgctatttgaagagccaaatcctgcaccaataaagtactgtctctcaaaaacaggagttatagcttctgaagctttaaggttgcctctagtacctatctcagaaaatctaaaagaaaagttaaataaatttttataa

SEQ ID NO: 72508 - protein, 286 aa, Clostridium acetobutylicum
MKIEGVLIPLITPFKDGKVDLASYEKLIRHYSKKGVAGFMPLATTGETPTLSDYEYQSILEKTVECNELNLPIYVGFGGNNTEKMTKDIKMLDKYNIKGILSVCPYYNRPDQRGIYEHFKRISESTSLDIVLYNIPYRTGRNIENDTIRRLSELDNIVGVKDACGDFTQTTELLLNRPDNFSILTGEDAFFYSTLMLGGDGGIMASAHLNTEKYVEVFNKSKQNDYKSALEIWKQVANMIPLLFEEPNPAPIKYCLSKTGVIASEALRLPLVPISENLKEKLNKFL

SEQ ID NO: 72509 - DNA, 1469 bp, Arabidopsis thaliana (mouse-ear cress)
  CDS (205)..(1299)
gaattcggcacgagctgacgtcagcatacctgctaccacttccagagttcaatcgatcttcgcctcgttgaaacgttttccctcttcgattatcaacagtgtctccactcgtatcatcaccgcctccaactaattttgccatctctctcgttgttccaatttgattctactagtgagctccgatttaatttagggttttgaaagatgtcagctttgaaaaattacggcttgatctccattgattctgccctccattttcctcgatcaaatcaattgcagagctataagaggaatgcaaaatgggtctctccaatagcagctgttgtacctaacttccatcttcctatgcgcagtctcgaggataaaaacaggacaaacacagacgacataaggtcccttagagtgatcacagccattaagacaccgtatctacctgatggaagattcgacctccaagcatacgatgacttagtcaacacgcagatagaaaacggtgctgaaggtgtgattgttggtggtacaactggtgaaggccaattgatgagctgggatgagcacataatgcttatcggccatactgtaaattgttttgggggaaggatcaaagtcattggaaacactggaagtaactcgactagggaagctattcatgccactgagcaaggattcgccatgggaatgcacggggcactgcacattaacccttactatggaaaaacatccattgaaggcatgaatgcgcattttcaaaccgttcttcatatgggaccgactattatatacaacgtgccaggtcgaacgtgccaggatatacctccccaggttatctttaaactctctcagaaccctaatatggctggggttaaggaatgcgttggtaataaccgagttgaagagtatactgagaagggaattgtcgtttggagtggaaatgatgatcagtgccatgattctagatgggatcacggtgccactggagtgatatcggttactagcaatttagttccgggtttgatgaggaagttgatgtttgaaggtagaaactcagcgttgaacgaaaagcttcttcctttaatggattggctattccaagaaccgaatcccattggtgtaaacactgctttggctcagttaggagttgcgaggccggtttttcggttaccttatgtgccattgcctctgtccaaaaggattgagttcgttaaactggtgaaggaaatcggaagggagcattttgtaggagacagagatgttcaggtacttgatgatgatgacttcatcttaatcggtcgatattagagtctcttccctgaagattggttgtgtttatactttcttcgttcagttgttagttatttagctgatgagaaactcacagatggatcaagacttctacttgttgtaatgtttggtctgttacttttggtgatgaatctaatggcttttgcttaaaaaaaaaaaaactcgag

SEQ ID NO: 72510 - protein, 364 aa, Arabidopsis thaliana (mouse-ear cress)
MSALKNYGLISIDSALHFPRSNQLQSYKRNAKWVSPIAAVVPNFHLPMRSLEDKNRTNTDDIRSLRVITAIKTPYLPDGRFDLQAYDDLVNTQIENGAEGVIVGGTTGEGQLMSWDEHIMLIGHTVNCFGGRIKVIGNTGSNSTREAIHATEQGFAMGMHGALHINPYYGKTSIEGMNAHFQTVLHMGPTIIYNVPGRTCQDIPPQVIFKLSQNPNMAGVKECVGNNRVEEYTEKGIVVWSGNDDQCHDSRWDHGATGVISVTSNLVPGLMRKLMFEGRNSALNEKLLPLMDWLFQEPNPIGVNTALAQLGVARPVFRLPYVPLPLSKRIEFVKLVKEIGREHFVGDRDVQVLDDDDFILIGRY

SEQ ID NO: 72511 - DNA, 1177 bp, Populus trichocarpa x Populus deltoides (western balsam poplar x cottonwood)
  CDS (44)..(1144)
gaattcactttcaataaacaaggaaaggaaaataagcttaaaaatggctgctatgaagagctatagcatgtgctcgagggagtctgatctccactttccgcaccataattgcgttgataattacaagaggaggagtggaaaatggaggcctccccaagctgctgtaaaacctaatttgcatcttccgatgcgcagctttgaagttaaaaacatgacatcagcagaggatatgaaatctcttagattgataacagccatcaaaaccccatatctgcctgatggtagatttgatcttgaagcgtatgatgcgttggtgaatatgcagattgctaacggcgctgaaggtgttgtagttggtggcacaactggtgaaggtcagctgatgagcagggatgaacacataatgcttattggccacaccgtcaactgttttggtagctcaatcaaggtgatcggaaacactggaagtaactctacaagggaagcgattcatgccacagagcaaggttttgcggtcggaatgcatgctgctcttcatatcaatccatactacggaaaaacctccgtggagggcatggtttctcattttgacagcgtgctccctatgggccctactattatatacaatgtgcctggcaggactggccaagatatccccccacgcgttattcatactatagctcagagtccgaacttggcaggcgttaaggaatgtgccggtaatgaccgggttgaacagtatacagataaaggaattgtggtgtggagtgggaatgatgatcagtgccatgatgcaaggtggaaccatggggcaactggagtggtttctgttactagcaacttggttccgggtttaatgcgcagacttatgtttgaggggaataatactgaactaaattcaaaactcctgccccttatcgactggctatttcaggaccggaaccccattgcattaaacacagctcttgctcaacttggggttgttagaccagttttcagactgccatatgtgcctcttccttcggctcagagggtagaatttgtgaatttggttaagaaaattggccgggagaattttgtaggagaagaagacgttcaggttcttgaagacgatgacttcatcttgatagctcgtctgtgttagtcagtttctcttgttgagggcatgcaagcttgg

SEQ ID NO: 72512 - protein, 366 aa, Populus trichocarpa x Populus deltoides (western balsam poplar x cottonwood)
MAAMKSYSMCSRESDLHFPHHNCVDNYKRRSGKWRPPQAAVKPNLHLPMRSFEVKNMTSAEDMKSLRLITAIKTPYLPDGRFDLEAYDALVNMQIANGAEGVVVGGTTGEGQLMSRDEHIMLIGHTVNCFGSSIKVIGNTGSNSTREAIHATEQGFAVGMHAALHINPYYGKTSVEGMVSHFDSVLPMGPTIIYNVPGRTGQDIPPRVIHTIAQSPNLAGVKECAGNDRVEQYTDKGIVVWSGNDDQCHDARWNHGATGVVSVTSNLVPGLMRRLMFEGNNTELNSKLLPLIDWLFQDRNPIALNTALAQLGVVRPVFRLPYVPLPSAQRVEFVNLVKKIGRENFVGEEDVQVLEDDDFILIARLC

SEQ ID NO: 72513 - DNA, 999 bp, Glycine max (soybean)
  CDS (1)..(999)
atgattacgaattcggcagccgtgaagcccaatttccatctcccaatgcgcagttttgagttaaaaaataggacttctccagaggacataaaggctctgagattgataactgccattaaaactccatacctacctgatggtcgttttgatcttgaagcatatgatgacttggtgaatatgcagattggacaaggggctgaaggtgttattgttggtgggacaactggtgaaggccaattaatgagctgggaagagcacataatacttattgctcatacagtcaactgttttggtgggaaaattaaggttattggaaatactggaagcaactccaccagggaagcaattcatgccactgagcagggttttgctgttggaatgcatgctgcccttcacataaacccttactatggcaaaacctccttggatggtatggttgctcactttcgaagtgtgctttccatgggacccacaataatctacaatgtgcctgcacggaccggacaagacattcctccgcatgtaattcaaaccttagctgaaagtgttaacctggctggtgtcaaggagtgtgtgggaaatgaccgaatcaaacagtatacagatgatggaattgttgtgtggagtgggaatgatgatcaatgtcatgatgctagatggggttatggggctaccggagtggtatctgttgcgagcaacctggttcccggtttaatgcgagaactcatgtttggcggtgtaaaccctactctaaattctaaactcttgcctctgattgactggcttttccacatgccaaaccccattggtttgaacactgctcttgctcaacttggggtcatcagacccgtttttaggctaccttttgtacctctccctgtggacaaaaggatagagtttgccaatttggtgaaggaaattggtcgagagcattttgttggaaataaagttgttgaggttcttgatgatgatgacttcttcttggttagtcgttattaa

SEQ ID NO: 72514 - protein, 332 aa, Glycine max (soybean)
MITNSAAVKPNFHLPMRSFELKNRTSPEDIKALRLITAIKTPYLPDGRFDLEAYDDLVNMQIGQGAEGVIVGGTTGEGQLMSWEEHIILIAHTVNCFGGKIKVIGNTGSNSTREAIHATEQGFAVGMHAALHINPYYGKTSLDGMVAHFRSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 72515 - DNA, 960 bp, Escherichia coli
  CDS (1)..(960)
atgggctgggatacagaaacgaaaatgagcacttacgaaaaggaaactgaggtaatgaaaaaattcagcggcattattccaccggtatccagcacgtttcatcgtgacggaacccttgataaaaaggcaatgcgcgaagttgccgacttcctgattaataaaggggtcgacgggctgttttatctgggtaccggtggtgaatttagccaaatgaatacagcccagcgcatggcactcgccgaagaagctgtaaccattgtcgacgggcgagtgccggtattgattggcgtcggttccccttccactgacgaagcggtcaaactggcgcagcatgcgcaagcctacggcgctgatggtatcgtcgccatcaacccctactactggaaagtcgcaccacgaaatcttgacgactattaccagcagatcgcccgtagcgtcaccctaccggtgatcctgtacaactttccggatctgacgggtcaggacttaaccccggaaaccgtgacgcgtctggctctgcaaaacgagaatatcgttggcatcaaagacaccatcgacagcgttggtcacttgcgtacgatgatcaacacagttaagtcggtacgcccgtcgttttcggtattctgcggttacgatgatcatttgctgaatacgatgctgctgggcggcgacggtgcgataaccgccagcgctaactttgctccggaactctccgtcggcatctaccgcgcctggcgtgaaggcgatctggcgaccgctgcgacgctgaataaaaaactactacaactgcccgctatttacgccctcgaaacaccgtttgtctcactgatcaaatacagcatgcagtgtgtcgggctgcctgtagagacatattgcttaccaccgattcttgaagcatctgaagaagcaaaagataaagtccacgtgctgcttaccgcgcagggcattttaccagtctga

SEQ ID NO: 72516 - protein, 319 aa, Escherichia coli
MGWDTETKMSTYEKETEVMKKFSGIIPPVSSTFHRDGTLDKKAMREVADFLINKGVDGLFYLGTGGEFSQMNTAQRMALAEEAVTIVDGRVPVLIGVGSPSTDEAVKLAQHAQAYGADGIVAINPYYWKVAPRNLDDYYQQIARSVTLPVILYNFPDLTGQDLTPETVTRLALQNENIVGIKDTIDSVGHLRTMINTVKSVRPSFSVFCGYDDHLLNTMLLGGDGAITASANFAPELSVGIYRAWREGDLATAATLNKKLLQLPAIYALETPFVSLIKYSMQCVGLPVETYCLPPILEASEEAKDKVHVLLTAQGILPV

SEQ ID NO: 72517 - DNA, 906 bp, Synechocystis sp
  CDS (1)..(906)
atggctgattttgtaagcacttccccctttggccctgtgttaactgcgatggttacccccttcaatgccgatggtggggtggattatggggtagcggaaaaattggctgaccatctcatcacccatggcagtgacggcctggtggtctgtggcaccacgggggaatctcccaccctttcctgggaggaggagcatgagctatttcgggtggttaaacaaaccgtcggcgatcggggttccgtcattgccggcactgggtctaactgtacccgggaggccatggaagcaacccagattgcggccaagttgggagtggatggttccctccaggtagtgccctactataacaagcctccccaggaaggtttattggcccatttccaggcgatcgccaattgtgcgccggagttgcccctgatgttgtacaacattcccggcagaacgggccagagcctagccccggaaacggtttaccgtttagcggaagtggaaaacattgtggccatcaaagaagccaccggcagtttggagcaggcttccctaattcgggcccatacccccgatgattttgccatctatgccggggatgatgtgctgactcttcctttattggccgtgggaggggccggggtggtcagtgtggccagtcatctggtcggcgatcgcctgcaggccatggtgcagcattttgcccagggagcaacggcccaagccctcgaaatccatttacagctaatacccctatttaaaattcttttctgcgccaccaatcccatcccagtcaaaacagccctgggactccagggttggcccgtaggatcgttcagacctcccctttgtgctctgtcccctggccacaccgaacagttacgagacgtactaagggatttagccttacttccctag

SEQ ID NO: 72518 - protein, 301 aa, Synechocystis sp
MADFVSTSPFGPVLTAMVTPFNADGGVDYGVAEKLADHLITHGSDGLVVCGTTGESPTLSWEEEHELFRVVKQTVGDRGSVIAGTGSNCTREAMEATQIAAKLGVDGSLQVVPYYNKPPQEGLLAHFQAIANCAPELPLMLYNIPGRTGQSLAPETVYRLAEVENIVAIKEATGSLEQASLIRAHTPDDFAIYAGDDVLTLPLLAVGGAGVVSVASHLVGDRLQAMVQHFAQGATAQALEIHLQLIPLFKILFCATNPIPVKTALGLQGWPVGSFRPPLCALSPGHTEQLRDVLRDLALLP

SEQ ID NO: 72519 - DNA, 1366 bp, Nicotiana tabacum (common tobacco)
  CDS (41)..(1120)
tctcatttcatctctccatttacgtctccgggaaggagaaatgtcatcatcaattataggtcgctgccatttcgtagcagatagcattgaagctgccggaacgaagaggaggactacaagatggaggtccccgagagcagcagtaattccaagttttcatctcccaatgcgcagtaatgaagttaaaaataggacgttcgccgatgacataaaagcacttcgattgatcactgcaatcaaaaccccatatctaccggatggcagattcgatcttgaggcttatgacacgttagtaaatttgcaaatcgaaaatggcgctgagggtgtgatagttggtggcactacaggtgaaggtcaattgatgagctgggatgaacacatcatgctcattggtcacacagtcaattgttttggagggtccatcaaagtcatcgggaacactggaagcaactccacaagggaagcaatccatgcaactgaacagggatttgctgtaggtatgcatgcagctcttcacattaatccctactatggcaagacctccttagagggtttgatttctcactttgaaagcgtgctccctatgggccctactatcatttataatgtgccatcacgaactggtcaagacatccctccacgtgtaattcagacaatggcaaagagccctaaccttgctggtgtcaaagagtgtgttggaaatgatagggtggagcagtatacaagtgatggggttgtcgtttggagtggcaatgatgatgaatgccatgtttcaaggtgggattatggtgctacaggagttatttctgttaccagcaacttggttcccggtctgatgagagaactgatgtttggaggaaagaaccctgctttgaactcaaagctgatgcctttgatggaatggctgtttcatgaaccaaaccccattgctctaaatacagctttagctcaacttggggttgtgaggccagtctttcgccttccatacgttccacttacaaaggcaaagagagaggagtttgtgaaaattgttaaggaaattggacgagagaactttataggggagagagatgtccaaattttggatgacaatgatttcattttggtgggtcggtattagcttttcccatgtagtgttgagaagtaggtttttgttgttagctgctttgcttgaaattttcttgacatgaaggtatctttcttttatgttgtatttcaccatgcattgacacgtttaatacttctttttccgctttctcttgggaggcatgtatattatatctactagcttatggactaaaaagaaaggtcaatggcttccaggcttagcctctcctacttatcttcgatggcagtctcccaggag

SEQ ID NO: 72520 - protein, 359 aa, Nicotiana tabacum (common tobacco)
MSSSIIGRCHFVADSIEAAGTKRRTTRWRSPRAAVIPSFHLPMRSNEVKNRTFADDIKALRLITAIKTPYLPDGRFDLEAYDTLVNLQIENGAEGVIVGGTTGEGQLMSWDEHIMLIGHTVNCFGGSIKVIGNTGSNSTREAIHATEQGFAVGMHAALHINPYYGKTSLEGLISHFESVLPMGPTIIYNVPSRTGQDIPPRVIQTMAKSPNLAGVKECVGNDRVEQYTSDGVVVWSGNDDECHVSRWDYGATGVISVTSNLVPGLMRELMFGGKNPALNSKLMPLMEWLFHEPNPIALNTALAQLGVVRPVFRLPYVPLTKAKREEFVKIVKEIGRENFIGERDVQILDDNDFILVGRY

SEQ ID NO: 72521 - DNA, 900 bp, Streptomyces coelicolor
  CDS (1)..(900)
atggctccgacctccactccgcagacccccttcgggcgggtcctcaccgccatggtcacgcccttcacggcggacggcgcactcgacctcgacggcgcccagcggctcgccgcccacctggtggacgcaggcaacgacggcctgatcatcaacggcaccaccggcgagtccccgaccaccagcgacgcggagaaagcggacctcgtacgggccgtcgtggaggcggtcggcgaccgggcgcacgtggtggccggagtcggcaccaacaacacccagcacagcatcgagctggcccgcgccgccgagcgcgtcggcgcccacggcctgctgctcgtcacgccgtactacaacaagcccccgcaggagggcctgtacctgcacttcacggccatcgccgacgccgccgggctgccggtcatgctctacgacatccccggccgcagcggcgtcccgatcaacaccgagaccctggtccgcctcgcggagcacccgcggatcgtcgccaacaaggacgccaagggcgacctcggccgggccagctgggccatcgcgcgctccggcctcgcctggtactccggcgacgacatgctcaacctgccgctgctcgccgtgggcgcggtcggcttcgtctccgtcgtgggccacgtcgtcaccccggagctgcgcgccatggtggacgcgcacgtcgccggtgacgtacagaaggccctggagatccaccagaagctgctccccgtcttcaccggcatgttccgcacccagggcgtcatgaccaccaagggcgcgctcgccctccagggactgcccgcgggaccgctgcgcgcccccatggtcggcctcacgcccgaggaaaccgagcagctcaagatcgatcttgccgccggcggggtacagctctga

SEQ ID NO: 72522 - protein, 299 aa, Streptomyces coelicolor
MAPTSTPQTPFGRVLTAMVTPFTADGALDLDGAQRLAAHLVDAGNDGLIINGTTGESPTTSDAEKADLVRAVVEAVGDRAHVVAGVGTNNTQHSIELARAAERVGAHGLLLVTPYYNKPPQEGLYLHFTAIADAAGLPVMLYDIPGRSGVPINTETLVRLAEHPRIVANKDAKGDLGRASWAIARSGLAWYSGDDMLNLPLLAVGAVGFVSVVGHVVTPELRAMVDAHVAGDVQKALEIHQKLLPVFTGMFRTQGVMTTKGALALQGLPAGPLRAPMVGLTPEETEQLKIDLAAGGVQL

SEQ ID NO: 72523 - DNA, 954 bp, Streptomyces coelicolor
  CDS (1)..(954)
atggagctacactgtctggccgccgacactactcccatgacgacagacgacgactccgcccccttcggccgcagcctgtgcgccatggtcacgcccttcaccggctccggcgctctcgacctcgacggtgcccagcggctcgccgaccggctggtcgcgcggggctgtgacggcctggtgctgtccggcaccacgggcgagtcgccgaccaccacggacgccgagaaggcggccctggtgacggcggtcagggaggcggtcggggaccgcgcggcactcgtcgccggggtcggcaccgcggacacccggcacaccgtggaactggccctggcggccgagaaggccggcgcggacggactgctggtggtcgcgccgtactacagcaggccgccgcaggacgccctggaggcgcacttccgcgaggtcgccgacgcgagcggcctgcccgtgatgctgtacgacatcccgggccgcaccggcacccgtatcgaacccgacaccgtcgtccggctcgccgcgcacccgcgcatcgtcgccgtcaaggactgcgcctacgacctcctcggcacccagaaggtgctgtcccgcaccggtctggcctactacgcgggctgcgacgaacagatcctccccctctacgcgatcggagcggcggggtacgtcagcaccgtcgccaacgtcgtgccggagctgttccgggccgtcctcgacgccttcgacgcgggcgacaccggccgggccgcgctgctccagcggcgggcggtcccgctcgtcgagtcgatgatggcggccggtctgcccggcacggtcaccgccaaggccctcctcggcgcgctgggcctgccggcgggcccggtccgcgcaccgctgcggtccgcggaccgggagaccaccgccggtctgctggcggcctacggagaactggccgccgacgccggtcagtcccaggcgtag

SEQ ID NO: 72524 - protein, 317 aa, Streptomyces coelicolor
MELHCLAADTTPMTTDDDSAPFGRSLCAMVTPFTGSGALDLDGAQRLADRLVARGCDGLVLSGTTGESPTTTDAEKAALVTAVREAVGDRAALVAGVGTADTRHTVELALAAEKAGADGLLVVAPYYSRPPQDALEAHFREVADASGLPVMLYDIPGRTGTRIEPDTVVRLAAHPRIVAVKDCAYDLLGTQKVLSRTGLAYYAGCDEQILPLYAIGAAGYVSTVANVVPELFRAVLDAFDAGDTGRAALLQRRAVPLVESMMAAGLPGTVTAKALLGALGLPAGPVRAPLRSADRETTAGLLAAYGELAADAGQSQA

SEQ ID NO: 72525 - DNA, 1361 bp, Triticum aestivum (common wheat)
  CDS (52)..(1185)
caaattccaaaaccctcgcctggttcgctggttttcactcgaaggacgacaatgatggcggcgcagccgacggctaacccgggggtccgcctcggctggaaggcccccggcgctctagcatccccgccgcgcctggctctgtctcgctccgccgcggccccgctcgcgtcacacagggttggcagaggaaagttttcagctgcggccatcactactgatgattatcttccaatgcgaagtactgaagtgaaaaatcggacatcagtagatggaatcaaaagtctcagactaatcacagcggtcaaaaccccctatttgccagatggaagatttgatcttgaagcatatgattctttgataaacacgcaaataaacgggggcgccgaaggtgtaattgttggtggaacaacaggagaaggtcatcttatgagctgggatgaacacatcatgctcatcgggcacactgttaactgctttggaactaacattaaagtgataggcaacacgggaagtaactcaactagagaagcgattcacgcttcagagcagggatttgctgttggcatgcatgcagctctccatgtcaatccttactatgggaagacctcaactgcaggactgatctctcatttcgacgaagtcctcccgatgggtccaacaatcatttacaatgtgccatccaggactggtcaggacatacctcctgcagtcattgaggcactctcaacttatccaaacatggcaggagtgaaagaatgtgttggacatgaacgagtgaagtgctacacagacaaaggtataacaatatggagtggcaatgatgacgaatgccatgattcaaggtggaagtatggtgctactggagtcatttctgtgactagcaaccttgttcctggtctcatgcgcagtctcatgtttgaaggggagaatgcggccctaaatgagaagctactgcctctgatgaaatggttattttctgagcctaatccgattggtctcaacactgccctggctcagctcggtgtagtgaggcctgttttcaggagaccgtatgcccctctctctcttgaaaagaggaccgagtttgtccggattgttgaagcaatcgggcgggagaactttgtgggacagaaagaggtgcgggttctggatgatgatgattttgtgttgatcagtaggtattaaataagtgagttcattgtgcgctatgtacgttacgaacagcggcggttctccttttagacatttcatcagttgttcaacagccatatgttttatcttttctgtgattggaagttaacttggaaccctgtggggtttctttgcaccctataatgccagttctagtgagaaatgaggat

SEQ ID NO: 72526 - protein, 377 aa, Triticum aestivum (common wheat)
MMAAQPTANPGVRLGWKAPGALASPPRLALSRSAAAPLASHRVGRGKFSAAAITTDDYLPMRSTEVKNRTSVDGIKSLRLITAVKTPYLPDGRFDLEAYDSLINTQINGGAEGVIVGGTTGEGHLMSWDEHIMLIGHTVNCFGTNIKVIGNTGSNSTREAIHASEQGFAVGMHAALHVNPYYGKTSTAGLISHFDEVLPMGPTIIYNVPSRTGQDIPPAVIEALSTYPNMAGVKECVGHERVKCYTDKGITIWSGNDDECHDSRWKYGATGVISVTSNLVPGLMRSLMFEGENAALNEKLLPLMKWLFSEPNPIGLNTALAQLGVVRPVFRRPYAPLSLEKRTEFVRIVEAIGRENFVGQKEVRVLDDDDFVLISRY

SEQ ID NO: 72527 - DNA, 1458 bp, Triticum aestivum (common wheat)
  CDS (88)..(1254)
ccaaaccaaagccctaaatccctctttcggaagataggagccgccccctttcgtcgtcgccgccatcgccgttctacagctgccgccatgccgtacctccagcccccgcgcccccacccccacccccacccgacctcccgcctctcgcgcgcgtcgccgccgtcgccgttcccgttcttccccgccgggacatcgcgctccggtcgtctccaacccgtcccagtctccggccactcggcctcgagggttagtaaaggaaagtttgcagttgcagccgtcactctagatgattatcttccgatgcgaagtactgaagtgaaaaaccggacatcaacagatggaatcaaaagcctcagactaatcacagcggtcaaaaccccctatttgccagatggaagatttgatcttgaagcatacgattctctgataaacacgcaaataaatggcggtgcggaaggtgtaatagttggaggaacaacaggagaaggtcacctcatgagctgggatgagcacatcatgctcatcgggcatactgttaactgctttggagccaacattaaagtgataggcaacacgggaagtaactcaaccagagaagctgttcacgcgacagagcagggatttgctgttggcatgcatgcagctcttcatgtcaatccttactacgggaagacctcaactgaaggcctgatctctcattttaaggaagtcctcccgatgggcccaacaatcatttacaacgtgccatccaggacaagtcaggacatacctccaccagtcattgaggcgctttcatcttactcaaacatggcaggagtgaaagaatgtgtcggacatgagcgggttaagtgctacaccgacaaaggcatatcaatatggagcggcaacgatgatgaatgtcatgactcaaggtggaagtatggcgctactggagtcatttctgtggcgagcaaccttgttcccggtctcatgcatagcctcatgtttgaaggggagaatgcggcgctaaatgagaagctactgcctctgatgaaatggctgttctgcgagcctaacccgatcggtctcaacaccgccctggctcagctcggcgtggtgagacctgttttcaggttgccgtacactccccttcctcttgagaagagggtggagtttgtccggattgtcgaagccattggacgtgagaactttgtgggacagaaggagtcccgggttctggatgacgatgatttcgtgttgatcagcaggtattgaatatgtgtgtgagttctttgtgtccagtgtatgctgacgaacagcggtagtgtcacagtgttgtttgcggatcgtttagacgcttcgtttgttcaccagtcatttgttgatctttttctctgactgcatgttaatttggaacccgtttggtttcttggcaccttgtgataccagttccagtaagatatgagaatagcttgagac

SEQ ID NO: 72528 - protein, 388 aa, Triticum aestivum (common wheat)
MPYLQPPRPHPHPHPTSRLSRASPPSPFPFFPAGTSRSGRLQPVPVSGHSASRVSKGKFAVAAVTLDDYLPMRSTEVKNRTSTDGIKSLRLITAVKTPYLPDGRFDLEAYDSLINTQINGGAEGVIVGGTTGEGHLMSWDEHIMLIGHTVNCFGANIKVIGNTGSNSTREAVHATEQGFAVGMHAALHVNPYYGKTSTEGLISHFKEVLPMGPTIIYNVPSRTSQDIPPPVIEALSSYSNMAGVKECVGHERVKCYTDKGISIWSGNDDECHDSRWKYGATGVISVASNLVPGLMHSLMFEGENAALNEKLLPLMKWLFCEPNPIGLNTALAQLGVVRPVFRLPYTPLPLEKRVEFVRIVEAIGRENFVGQKESRVLDDDDFVLISRY

SEQ ID NO: 72529 - DNA, 1400 bp, Zea mays (maize)
  CDS (40)..(1182)
aattccacgaccacgccctccgtgctccagccattccccatgatttcgccgacgaatctcctcccggcgcggaagatcacccctgtctcaaatggcggcgcagcgacggcgagcccctcttctccctcggtggccgcacggccacggcgactcccttcaggcctccaatctgtgactggtagagggaaggtttccttggcagccatcactctagatgattaccttccaatgcgaagcactgaagtgaagaaccggacatcaacagatgacatcacaaggctgagactaatcacagcagttaaaaccccctatttgccagatgggaggttcgatctggaagcatatgattctctcataaacatgcagatagagggtggtgccgaaggcgtaatagttggaggaacaacaggagagggtcacctcatgagctgggacgaacatatcatgctcattgggcacacagtgaactgctttggctctagaatcaaagtgataggcaacacaggaagcaactcaaccagagaagccgtccacgcaacagaacagggatttgctgttggcatgcatgcggctctccacatcaatccttactacgggaagacctcagctgaaggaatgatctctcatttcgaggctgtcctcccgatgggtccgaccatcatctacaacgtgccatccaggagcgcccaggacatcccccctgaagttattctagcgatttctggctacacaaacatggcgggtgtcaaggaatgtgttgggcacgagagggttaagcactacgctgacaaaggcataacaatttggagcggtaacgacgacgagtgccacgattctaagtggaaacatggcgctactggggtcatttccgttaccagcaaccttgttcccgggctcatgcacagcctcatgtacaaaggcgagaacgccacgctgaacgagaagctgtcgcccctgatgaaatggctgttctgccagccaaatcctattgccctcaacactgctctggctcagctcggcgtggcaaggcctgtcttcagactgccgtacgttccgctccctcttgaaaagagggccgagttcgtccggattgttgagtcaattggacgggaaaatttcgtggggcagaaggaggcaccggttctagatgatgacgatttcgtgttgatcagtaggtactaggaaaatgagtttgctagtctatgtatcttggcgaataaactagtagtttgtaccttgcgttcagacttcgttctgttgttcatcagtcgttggtttcgtctatctatttattaattgcctactttggccgcattgtataatgtatatgtatcgcgtttatagttttttacgtgaattgacctaggtacaaggaaaaaatgatcacttcttttttggct

SEQ ID NO: 72530 - protein, 380 aa, Zea mays (maize)
MISPTNLLPARKITPVSNGGAATASPSSPSVAARPRRLPSGLQSVTGRGKVSLAAITLDDYLPMRSTEVKNRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEAPVLDDDDFVLISRY

SEQ ID NO: 72531 - DNA, 1190 bp, Solanum tuberosum
  CDS (14)..(1078)
ccgatagggagaaatgtcatcctcaattacaaattgctgccatttctatgttgaacgtgccagaacaaacaggagaactgcaacatggaagtcaccaagagcagcagtaattccatgtatccacctcccgatgcgcagtaatgaagttaaaaataggacatttgctgaggacataaaaaaacttcgattgattactgcaattaaaaccccatatctaccagatggaagattcgatcttgaggcttatgatgccttagtaaatttgcaaattgaaaatggtgtcgagggtgtgattgttggtggcactacaggtgaaggtcaattgatgagctgggatgaacacatcatgctcattggtcataccatcaattgttttggtggatcaattaaagtcattggaaacacaggaagcaactccacgagggaagcaatccatgcgacagaacaaggatttgctgtaggtatgcatgcagctcttcacattaatccttactatgggaagacctccatagagggtttgatttctcactttgacagtgtgctccctatgggccctactatcatttacaatgtgccatcacgaactggtcaagacattccccctcatgtaatccagacattagcaaagagccctaaccttgctggtgtcaaagagtgtgtaggaaatgatagagtggagcagtatacaagtaatgggttggttgtgtggagtgggaatgatgatgaatgccatgactcaaggtggcatcatggtgctacgggagttatttctgtcaccagcaacttggttcctggtctgatgcgtgaactaatgtttggaggaaataaccctgttttgaactcaaagctaatgcccttggttgaatggttgtttcatgagccaaaccccattgctctgaatacagctttagctcaacttggggttgtgaggcctgtttttcgccttccctatgttccacttacaaaggcaaagagagaggagtttgtgaagattgttgagaaaattggacaggaaaactttattggggaaagagatgtccaagttttggatgatattgattttttttttggttggtaggtattagtttttccccaattggtattgagaagtaagtttttgttgttagcggcttaatttgaaaaatttcttgacatgaagatatcttctttatgttgttttttaaaaaaaa

SEQ ID NO: 72532 - protein, 354 aa, Solanum tuberosum
MSSSITNCCHFYVERARTNRRTATWKSPRAAVIPCIHLPMRSNEVKNRTFAEDIKKLRLITAIKTPYLPDGRFDLEAYDALVNLQIENGVEGVIVGGTTGEGQLMSWDEHIMLIGHTINCFGGSIKVIGNTGSNSTREAIHATEQGFAVGMHAALHINPYYGKTSIEGLISHFDSVLPMGPTIIYNVPSRTGQDIPPHVIQTLAKSPNLAGVKECVGNDRVEQYTSNGLVVWSGNDDECHDSRWHHGATGVISVTSNLVPGLMRELMFGGNNPVLNSKLMPLVEWLFHEPNPIALNTALAQLGVVRPVFRLPYVPLTKAKREEFVKIVEKIGQENFIGERDVQVLDDIDFFFGW

SEQ ID NO: 72533 - DNA, 873 bp, Bacillus methanolicus
  CDS (1)..(873)
atggtttcttttggtcgaatatcaacagctatggttacaccatttgataacaaaggtcatattgattttgcaaaaacaacgcaactcgtgaatcatttaattaataatggttcagattctttagttgttgtcggtactactggagagtcagccacacttacaaaagaagaaaaattggcgctttttcagcatgtagtaaaagtagttgaaaaaagagtccctgttattgcaggcaccggaagcaataatacttatgattcaatcgaaatgacaaaaaaagcagaaaaaatgggcgtcgatgcgattttggcagttgctccgtattataacaaaccaaaccaggaaggattatatcaacattttaaggcaattgctgaaagtacatcccttcctgttatcatttataacattcccggaagatctgttgtgaatatcgagcctgaaacggtcatccgtttgtccaagattccgaacattgttggtatcaaagaagcaggcgggaatcttagtgcgatgacgcaaattattgccaatacagatgacgattttcttttgtatagcggagacgacggtttaaccttgccagtactgtccattggcggaaccggggttatttctgtggcatcccatgttatcggaaatgaaatgcaagaaatgatcagtgcatttttaaatggagattatgaacgtgcggcaaaaattcatcaaaagctgcttccgcttatggatggattatttatcgctccaaaccctgtaccggttaaaactgctttgcaaattaaaggcatggatgtcggttcggttcgcttgcctcttgttccgcttactgaacaagagcgaaatacagtggcagcattattaaatgctttataa

SEQ ID NO: 72534 - protein, 290 aa, Bacillus methanolicus
MVSFGRISTAMVTPFDNKGHIDFAKTTQLVNHLINNGSDSLVVVGTTGESATLTKEEKLALFQHVVKVVEKRVPVIAGTGSNNTYDSIEMTKKAEKMGVDAILAVAPYYNKPNQEGLYQHFKAIAESTSLPVIIYNIPGRSVVNIEPETVIRLSKIPNIVGIKEAGGNLSAMTQIIANTDDDFLLYSGDDGLTLPVLSIGGTGVISVASHVIGNEMQEMISAFLNGDYERAAKIHQKLLPLMDGLFIAPNPVPVKTALQIKGMDVGSVRLPLVPLTEQERNTVAALLNAL

SEQ ID NO: 72535 - DNA, 921 bp, Burkholderia mallei ATCC 23344
  CDS (1)..(921)
atgagccgtcacgcgattcaatggagcggggtcttccccgccgtcagcacccagttcaagccggatttctccctcgatgtcgacgcgacgcaccgcgtcgtgaagaacttggtgaacgacggcgtgtcgggcctcgtcgtctgcggcacggtgggcgagaacacgtcgctcggcacggccgagaagctcgcggtgatcgaagcggcgcgcgacgcggcgggcggcaaggtgcccgtgatcgccggcgtcgcggagttcacgaccgagttcgcgcgcaacaccgtgcgcgaggcgcagcgcgtgggcgtggacggcgtgatggtgatgcccgcgctcgtctactccgcgaagccgcacgagacggccgcgcactttcgcgcggtcgcgtcgagcaccgatctgccggtgatggtctacaacaacccgccgatctacaggaacgacgtgacgcccgacgtgctgatcgcgctgcaggactgcgagaacatcgtctgcttcaaggattcgtcgggcgacacgcgccgcttcgtcgacctgcgcaacgcggtcggcgatcgcttcgtgctgttcgcgggcctcgacgacgtcgtcgtcgagagcatcgccgttggcgcgcagggctgggtgtccggcatgtccaacgcgttcccgaaggaaggcgagacgctgtttcgcctcgcgaagcaaaagcgcttcgacgaggcgctcgcgctgtatcgctggttcatgccgctcctgcacctcgatgcgcgcccggacctcgtccagtgcatcaagctgtgcgaggagctcgtcggccgcggcagcgcgctcacgcgcccgccgcgcctcgcgctgcaaggcgacacgctggcgcacgtgaaggcgatcgtcgcgaaggcgctcgaaacgcgtccgacgctgcccgacgtcggcctttga

SEQ ID NO: 72536 - protein, 306 aa, Burkholderia mallei ATCC 23344
MSRHAIQWSGVFPAVSTQFKPDFSLDVDATHRVVKNLVNDGVSGLVVCGTVGENTSLGTAEKLAVIEAARDAAGGKVPVIAGVAEFTTEFARNTVREAQRVGVDGVMVMPALVYSAKPHETAAHFRAVASSTDLPVMVYNNPPIYRNDVTPDVLIALQDCENIVCFKDSSGDTRRFVDLRNAVGDRFVLFAGLDDVVVESIAVGAQGWVSGMSNAFPKEGETLFRLAKQKRFDEALALYRWFMPLLHLDARPDLVQCIKLCEELVGRGSALTRPPRLALQGDTLAHVKAIVAKALETRPTLPDVGL

SEQ ID NO: 72537 - DNA, 897 bp, Burkholderia mallei ATCC 23344
  CDS (1)..(897)
atgtccaacctcttgcaaggcatcatcgcctaccccgtcacgcccttctcgccggacggccggctcgacacggccgcgctcggcgcgctcatcgaacgcctgatcgcgagcggcgtgcacggcatcgcgccgctcggcagcaccggcgaaagcgcctatctgtccgacgccgaatgggaagccgccgcgtcggcctcgattcgcgcggtcgagcgccgcgtgccgaccgtcgtcggcatttccgatctcaccaccgcgaacgcggtgcgccgcgcgaaattcgccgaacaggcgggcgcggacgcggtcatggtgctgcccgtgtcgtactggcggctcgacgacgaagcgatcgtcggccactaccgcgcgatcggcgacgcgatcggcattccgatcatgctgtacaacaacccggcgacgagcggcatcgacatgtcgcccgagctgatcgcgcgcatcttccgcacggtcgacaacgtgacgatggtcaaggagagcacgggcgacatcaagcgcatgcaccggctcgcgcaactgggcgacggcgcgatcccgttctacaacggcagcaatccgatggcgctcgccgcgctcgctgccggcgcggccggctggtgcaccgccgcgccgaacctgaacgcgcgcctgccgctcgcgttatacgacgcgatgcgcgcaagcgatctcgacacggcgcgcgccgtctttcatcggcagttgccgctgttgcagttcatcgtctcgggcgggctgcccgtcacggtgaaggccgggctgcggctcgcgggcttcgacgcgggcgagccgcgcaagccgctgcgcccgctcgacgaagcgcgcacgcgcgagctcgccgcgattctcgacgcgctgcgcgacaccgcgcacgcgtga

SEQ ID NO: 72538 - protein, 298 aa, Burkholderia mallei ATCC 23344
MSNLLQGIIAYPVTPFSPDGRLDTAALGALIERLIASGVHGIAPLGSTGESAYLSDAEWEAAASASIRAVERRVPTVVGISDLTTANAVRRAKFAEQAGADAVMVLPVSYWRLDDEAIVGHYRAIGDAIGIPIMLYNNPATSGIDMSPELIARIFRTVDNVTMVKESTGDIKRMHRLAQLGDGAIPFYNGSNPMALAALAAGAAGWCTAAPNLNARLPLALYDAMRASDLDTARAVFHRQLPLLQFIVSGGLPVTVKAGLRLAGFDAGEPRKPLRPLDEARTRELAAILDALRDTAHA

SEQ ID NO: 72539 - DNA, 903 bp, Burkholderia mallei ATCC 23344
  CDS (1)..(903)
atggctaacggcactcaagacggcattcaaatccgcggcagcgtccccgcgatcgtcaccccgatgctcgaggacggcggcctcgatctggcggccttccgcaagctgatcgactggcatatcgaagaggggacggatgccctcgtcgtggtcggcacgagcggcgaatcggcgacgctttccgtcgacgagcacgtgctcatgatcgagaccgcggtcaagcacgcggcgaagcggattccgatcgtcgcgggcgcgggcggcaactcgacgaccgaggcgatcgaactgtcgaagcatgcgaaggcggtgggcgccgatgcgacgctgcaagtggtgccgtactacaacaagccgacgcaggaagggatctaccgccacttcaaggcgatcgccgaggcggtggaccttccggtgatcctgtacaacgtgccgggccgcactgtcgcggacatgtcgaacgagacgaccctgcggcttgcgcaagtgccgggcatcatcggcgtgaaggacgcgacgggcaatatcgatcgcgccgcgcaactgatcaaggcggcgcccgcgcacttctcgatctacagcggcgacgatccgaccgcgatcgcgctgatgctcctcggcggccacggcaacatctcggtgacggcgaacgtcgcgccgcgcgcgatgagcgagctttgccgcgcggcgcttgccgccgacgtgaagacggcgcgcgagatccacatgaagctcctgtcgctgcacaagcatctgttcatcgaggcgaacccgattccggtgaagtgggcgctgcaacagatgggcaagatcgcgggcggcatccgcctgccgctcacgccgctcgacgagcgctgccatgaaaccgtgcgcggcgcgcttcgcgaggccggcctcctgtga

SEQ ID NO: 72540 - protein, 300 aa, Burkholderia mallei ATCC 23344
MANGTQDGIQIRGSVPAIVTPMLEDGGLDLAAFRKLIDWHIEEGTDALVVVGTSGESATLSVDEHVLMIETAVKHAAKRIPIVAGAGGNSTTEAIELSKHAKAVGADATLQVVPYYNKPTQEGIYRHFKAIAEAVDLPVILYNVPGRTVADMSNETTLRLAQVPGIIGVKDATGNIDRAAQLIKAAPAHFSIYSGDDPTAIALMLLGGHGNISVTANVAPRAMSELCRAALAADVKTAREIHMKLLSLHKHLFIEANPIPVKWALQQMGKIAGGIRLPLTPLDERCHETVRGALREAGLL

SEQ ID NO: 72541 - DNA, 894 bp, Bacillus licheniformis DSM 13
  CDS (1)..(894)
atgaatcatgatgaggtgaaaaaaatgaacttcggaaatatcgcaaccgcgatggttacgccctttgacaaaaatgaaaatatcgattttcaaaaactgtcaaagctgatcgattatttactaaacaatgggacggattccctggtcgttgccggaacaaccggagaatcgccgacgctttccgaagaagaaaaggtagcgctcattcaatactctgtcaaggaagcggcaggccgtgccccaatcatcgccggcacgggaagcaacaacacgaaggcgtcgatcaagctgacgaaaaaagctgaagaagccggcgctgacgctgtcatgctcgtcactccgtactacaacaagccttctcaggaaggcatgtaccgccatttcagagcgattgcggaggaaacatcgctgcctgtcatgctttataatgtgccgggaagaacggctgcttcgctcgcaccagagacgacaatccgccttgcggagatcccgaatattatcgccattaaagaagcgagcggcgacctagatgcgataacaaaaatcgtagccgaaacccctgaggactttgcagtttattcaggagatgacagcctgacactgccggcgctgtccgtgggagcgagaggaatcgtttccgttgcatcacacatcatcggaccggaaatgcaggaaatgatcaaacattataccgaggggaacacggctcaggctgctttgatccatcaaaagctgcttccgctgatgaaagggctttttgccgcaccgaacccgtctccattaaagacggctcttcagctgaagggtcttgacgtcgggtccgtccggctccctttgattccgctaaatgaagatgaacgactccgtttaagcagcctgatgaacggcctgtaa

SEQ ID NO: 72542 - protein, 297 aa, Bacillus licheniformis DSM 13
MNHDEVKKMNFGNIATAMVTPFDKNENIDFQKLSKLIDYLLNNGTDSLVVAGTTGESPTLSEEEKVALIQYSVKEAAGRAPIIAGTGSNNTKASIKLTKKAEEAGADAVMLVTPYYNKPSQEGMYRHFRAIAEETSLPVMLYNVPGRTAASLAPETTIRLAEIPNIIAIKEASGDLDAITKIVAETPEDFAVYSGDDSLTLPALSVGARGIVSVASHIIGPEMQEMIKHYTEGNTAQAALIHQKLLPLMKGLFAAPNPSPLKTALQLKGLDVGSVRLPLIPLNEDERLRLSSLMNGL

SEQ ID NO: 72543 - DNA, 897 bp, Bacillus cereus ZK
  CDS (1)..(897)
atgaaaaaaattcaaggggcatttccagtattaatcacaccaatggatgagtttcaagaaattaattggaacggtgtaaaacaaaacgtaaactactttattgagcaaaaagtggctggcattattataaacggaagcacaggagagtttgttagtttgttaaaagaagaacgatttaaaatggtagaaacagtattaaaagaagttaatggccgtattccggttattgttggaactgcagcagaaacgacgaaagaaacgattgaatttacaaaacatgcagaaacgcacggagcggactgcgcattaattattaactcatactattgtaagccaaaagaagaggaaatttattttcactttaaagaaatctcaaatgctgtaaatataccaattatgttatataataacccgtttacatctggtgttgatatgagtacagaactcatgctacgtatcgggaaagactgtgaaaatgttacacatattaaagaatctagcggagatattcgaaaagcgagagatttagtaagacaaggcgaaggtgcttttcaagtattctgcggatctgaagatttagttatggaatcttatttagttggtgcgacgggatgggtttcagtagcagggaatatcgtaccggggcttgttacgaaaatgtatgagcattttcaaaatggtgaattagaaaaagcttgggaaataaacgatgcgattttacctctttgcgagtttcttgaaggatcaggaaagtatgtacaaatcgtgaaacgctcaatggaattatacgggcaagctggaggaccttcacgttatccgagactcggattaactgaagaagaagatcaaaaacttcaaacgattttatcaaaaattgcagcacatgcggctgtttaa

SEQ ID NO: 72544 - protein, 298 aa, Bacillus cereus ZK
MKKIQGAFPVLITPMDEFQEINWNGVKQNVNYFIEQKVAGIIINGSTGEFVSLLKEERFKMVETVLKEVNGRIPVIVGTAAETTKETIEFTKHAETHGADCALIINSYYCKPKEEEIYFHFKEISNAVNIPIMLYNNPFTSGVDMSTELMLRIGKDCENVTHIKESSGDIRKARDLVRQGEGAFQVFCGSEDLVMESYLVGATGWVSVAGNIVPGLVTKMYEHFQNGELEKAWEINDAILPLCEFLEGSGKYVQIVKRSMELYGQAGGPSRYPRLGLTEEEDQKLQTILSKIAAHAAV

SEQ ID NO: 72545 - DNA, 903 bp, Burkholderia pseudomallei K96243
  CDS (1)..(903)
atgcacatgcaatcacgtttcgaaggtatctggcttccgatcgtcacgccgttccatgcccgggaaaccggcacggtcgaccacgcggcgctcgcgcgcctcgcgcggcactattcggatgaagggatcgcgggcttcgtcgccggcgcgacgacgggcgaaggcgcactgctgaacgctggcgaacaggaagcgattttcgcgacgctgcgcgacgccgcaccggcgcggccgatcgtgctcggcatcaccgcaagcgcgacgcacgcggcagccgaacgcgcacgcgcgctcgctgcgctgcgcccggacggcttgctcgtcacgccgcccgtctacgtccgcccgacgcaagcgggcgtgcagcggcacatcgaggcggtcgtcgaagcggccgatctgcccgtgctcgtctacaacatcccgtaccgcaccggcgtgaacgtcgaactcgatacgctgaaggcgctgtcgcgcgatgcgcgcgttgccggcgtgaaggaatgcggcggcacgatggagcgcatgctgcgcctcgtgcacgaaacgccgctgcgcatcctctccggcgacgacaatcagaatttcgcagcgctgtgcgcgggcgcgcacggcgcgatcgcaagcgccgcacacgtattgcccgcgtggcacgtgcgtgtgtacgcactgctgcgcgaaggccggctcgacgatgcgcgacggatcgcggtcgcgttgcagccgctcgtcgccgatctgttcgcggaaccgaatcccgcgcccgtgaaggcgctgctcgccgcgcagggctggtgcgataacgcgttgcggctgccgttcctgccggttgaagaagcgctcgcgacgcggctggtcgcacattgggaatcgctgcgccaaagcgaagcagcgggcgcttga

SEQ ID NO: 72546 - protein, 300 aa, Burkholderia pseudomallei K96243
MHMQSRFEGIWLPIVTPFHARETGTVDHAALARLARHYSDEGIAGFVAGATTGEGALLNAGEQEAIFATLRDAAPARPIVLGITASATHAAAERARALAALRPDGLLVTPPVYVRPTQAGVQRHIEAVVEAADLPVLVYNIPYRTGVNVELDTLKALSRDARVAGVKECGGTMERMLRLVHETPLRILSGDDNQNFAALCAGAHGAIASAAHVLPAWHVRVYALLREGRLDDARRIAVALQPLVADLFAEPNPAPVKALLAAQGWCDNALRLPFLPVEEALATRLVAHWESLRQSEAAGA

SEQ ID NO: 72547 - DNA, 888 bp, uncultured archaeon GZfos9D1
  CDS (1)..(888)
atgttgaagatagaaggtgtgtatccggcgcttataacgccgtttacaaaggatgacgaagtagataaggaaggactgaggaggctcgtggaatacatgatagagggcggcgtagcgggaatagtcccgtgcggcacgaccggcgaatccgcaacgctctctcataaagagcatgaggaagtgatagacgtggtggtggactgctcaaaggtgcctgtgattgcagggaccgggtcgaacaacacaaaggaagcggttgaattcacgaaacatgcggcggatgcaggtgctgatgcttgccttttaattactccttattacaacaaaccgaacgtaaaaggtttgaaggagcatttcaagcggattggcgattcggtggagatacctttgattttgtataacataccttcaagaacgggacaaaatgtaagtgcagggacgatggtggagcttgcttcagagattactaatataaagggagtgaaggaagcttcgggtgatttgaaacaggtaggcgcgattataaggtcggttgcggaacggggtttggactttacggttgtcgcgggtgatgattttcttacgctgccgataatgagtttaggtggtaaaggcgtgatttccgtagcggcgaatatcgcgccgcgggagatgaccgagatggtggctgcgatgttgaaaagcgaggtggagaaggcgaaggagattaatatcaggctgttttctctgttcgagtcgatgtttctggagacgaatccgatacccgtgaagaaggcggcggagatgatggggttgtcggcaggacacgtccggcttccgctgggtgcattgagtgaagggaatgaggagaggttgaggaaggtattggaagggttggggatggtataa

SEQ ID NO: 72548 - protein, 295 aa, uncultured archaeon GZfos9D1
MLKIEGVYPALITPFTKDDEVDKEGLRRLVEYMIEGGVAGIVPCGTTGESATLSHKEHEEVIDVVVDCSKVPVIAGTGSNNTKEAVEFTKHAADAGADACLLITPYYNKPNVKGLKEHFKRIGDSVEIPLILYNIPSRTGQNVSAGTMVELASEITNIKGVKEASGDLKQVGAIIRSVAERGLDFTVVAGDDFLTLPIMSLGGKGVISVAANIAPREMTEMVAAMLKSEVEKAKEINIRLFSLFESMFLETNPIPVKKAAEMMGLSAGHVRLPLGALSEGNEERLRKVLEGLGMV

SEQ ID NO: 72549 - DNA, 891 bp, uncultured archaeon GZfos37B2
  CDS (1)..(891)
atggtgcttatggacctcaaaggcgttatgcctgcgctgatgactccgttcacgcctgatcgtaagattgacgggactgggtttaaggataacatcaggtatatgatcgagcatggagtctccagcatcgttccctgtgggacgactggcgaatcagcaacgataacgcttgaagagcataaacaactgatcgatatcgcggttgactgttccactgttcccgtgatcgcgggaaccggatcgaacaacaccagtgaggcaatcgaacttaccagacatgcgacagatgcgggcaccgatgcatcgctgctgatcacaccgtattacaacaggccgaaccaaaacgggattatcgcgcactttgatgcgatcgcgtctgctgttgatatcccgatcatactctacaacatcaaatcgagaaccggcatcaatctcgaacctgagctgatagcaaaactcgcagagatcccgaatatcatcggagtcaaagaggcgagcggcaatctggggcaggtatcgcgcatcatcgaactgaccagggactctgattttatagtgatctcgggcgatgatgccttgacgctgccgatcatgtcacttgggggcgttggtgtgatatcagttattgcaaacattgttcccgcgcagactgttgctttcgtaaacgcgatacttgcgaacgaccgcgatgaggcaaggcgtctgcactaccagcttgctccgcttgtgcgtgcgatgtttatcgagacgaacccgatccctgtgaagaccgccgccggcatgatcggtcgtgcagccggacccttacgccttccgcttgcaccgatgagcgcgcagaacgagcagaaactgcgaagcgcgctcgtgtcggctggactgcttaagggctga

SEQ ID NO: 72550 - protein, 296 aa, uncultured archaeon GZfos37B2
MVLMDLKGVMPALMTPFTPDRKIDGTGFKDNIRYMIEHGVSSIVPCGTTGESATITLEEHKQLIDIAVDCSTVPVIAGTGSNNTSEAIELTRHATDAGTDASLLITPYYNRPNQNGIIAHFDAIASAVDIPIILYNIKSRTGINLEPELIAKLAEIPNIIGVKEASGNLGQVSRIIELTRDSDFIVISGDDALTLPIMSLGGVGVISVIANIVPAQTVAFVNAILANDRDEARRLHYQLAPLVRAMFIETNPIPVKTAAGMIGRAAGPLRLPLAPMSAQNEQKLRSALVSAGLLKG

SEQ ID NO: 72551 - DNA, 888 bp, uncultured archaeon GZfos19A5
  CDS (1)..(888)
atgttgaagatagaaggtgtgtatccggcgcttataacgccgtttacaaaggatgacgaagtagataaggaaggactgaggaggctcgtggaatacgtgatagagggtggtgtagcggggatagtcccgtgcggcacaacaggcgaatccgcaacactatctcataaagagcatgagaaagtgatagacgtggtggtagactgctcaaaggtgccggtgatagcggggaccgggtcaaacaacacaaaggaagcggttgaattcacgaaacatgcagcggatgcaggtgctgacgcttgccttttgattactccttattacaacaaaccgaacgtaaaaggtttgaaggaacatttcaagcggattggcgattcggtggagatacctctgattttgtataacataccttcgaggacgggacaaaatgtaagtgcagggacgatggtggagcttgcttcagagattgctaatataaagggtgtgaaggaggcgtcaggtgatttgaaacaggtaggcgcgattataaggtcggttgcggaacggggtttggactttacggttgtcgcgggtgatgattttcttacgctaccgataatgagtttagggggtaagggcgtgatttcagtagcggcgaatgtcgcgccgcgggagatgaccgagatggtggatgcgatgttgaaaggtgaggtggagaaggcgaaggagattaatatcaggctgttttctctgttcgaggcgatgtttttggagacgaatccaatacccgtgaagaaggctgcggagatgatgggattgtcggcagggcacgtccggcttccgctgggggcgttgagtgaagggaatgaagtgaagttgaggaaggtgctggaagggctggggatggtgtag

SEQ ID NO: 72552 - protein, 295 aa, uncultured archaeon GZfos19A5
MLKIEGVYPALITPFTKDDEVDKEGLRRLVEYVIEGGVAGIVPCGTTGESATLSHKEHEKVIDVVVDCSKVPVIAGTGSNNTKEAVEFTKHAADAGADACLLITPYYNKPNVKGLKEHFKRIGDSVEIPLILYNIPSRTGQNVSAGTMVELASEIANIKGVKEASGDLKQVGAIIRSVAERGLDFTVVAGDDFLTLPIMSLGGKGVISVAANVAPREMTEMVDAMLKGEVEKAKEINIRLFSLFEAMFLETNPIPVKKAAEMMGLSAGHVRLPLGALSEGNEVKLRKVLEGLGMV

SEQ ID NO: 72553 - DNA, 894 bp, Bacteroides fragilis
  CDS (1)..(894)
atgatacagactagattgaaaggaatgggggtagcgctgattactcctttcaaagaggatgaaagcgttgattacgatgcgttaatgcgactggtagactatctgctgcaaaataatgcagattttctgtgtgtgctgggaactacagccgaaactccgaccttgagtgaagaagaaaaaaagaaaatcaaaaagatggtaatcgaccgtgtcaacggaaaaatccccatcctgctgggagtcggaagtaacaatacacgcgcagttgtagagacactcaaaaacgacgatttcaccggagtagatgctatcttatccgttgtcccttactacaataaaccctcacaagaaggaatttatcaacactataaagcaattgcaagcgctacagagcttcccatcgtattatataatgttccgggacgtacaggagttaatatgaccgcagagaccactttgcgcattgctaaggactttcagaatgttatagccattaaagaggcttctggtaatatcacccagatggatgatatcattaaaaacaaaccggctaactttgacgttatttccggagatgacggtattactttcccgctgattacattgggagccgtaggagtcatttcggttattggaaacgcctttccacgtgaattcagcagaatgactcgtttggcgctgcagggcgactttgccaatgcactgaccatacaccataaatttacggaactgtttaacctcttatttgtagacggaaacccagccggagtaaaatccatgttgaacgctatgggaatgatcgagaataaactccgtttaccactagtaccgacacgcatcaccacatttgaagcgattcgtaaagtactcaatgaactgaatataaaatgttaa

SEQ ID NO: 72554 - protein, 297 aa, Bacteroides fragilis
MIQTRLKGMGVALITPFKEDESVDYDALMRLVDYLLQNNADFLCVLGTTAETPTLSEEEKKKIKKMVIDRVNGKIPILLGVGSNNTRAVVETLKNDDFTGVDAILSVVPYYNKPSQEGIYQHYKAIASATELPIVLYNVPGRTGVNMTAETTLRIAKDFQNVIAIKEASGNITQMDDIIKNKPANFDVISGDDGITFPLITLGAVGVISVIGNAFPREFSRMTRLALQGDFANALTIHHKFTELFNLLFVDGNPAGVKSMLNAMGMIENKLRLPLVPTRITTFEAIRKVLNELNIKC

SEQ ID NO: 72555 - DNA, 888 bp, Bacillus licheniformis DSM 13
  CDS (1)..(888)
atgggattcgtaccaaaggggatttatcctgctatgctgacaccgctcacaaaagatcaaagcattgatgaatcggcattgaaacagctgacaaaccatttgatcgatgctcatgtacacgggctttttgcgttgggtaccaacggggaatttcatatgttcaacatcgaagacaagctgaaagttgcagaaatcatcattcaagaaacggccgaacgcgttcccgtcatggtagggagcggaggaaacagcacagaagaagcgatctggctttctaaggaaatagagaggcttggagcagatgcgctgtcggtcatcacgccattctttattccaccgacacaggaagaagcggcggtgcattataaaacaatcgcggcatccgtttcacttccgatccttttgtacaatatcccttcaaaaacaggtttccatttagaaccagaaacagtggcagagcttgcaaaagtggacaatatcgttggaattaaggacagcagcggaaactttgaaaacatacaacagtatatcgagcagacgaaaaatgacgacttttccgtttttgcaggcaccgattcgctcatattgaaaacgcttcaagcgggaggagcgggagcagtcgcagcaacagcaaatatgcttccggatatcgtaacgtctatttaccaccattgggcagagggtgagactgaaaaggcggaggctgcccagatggagcttcagccgcttcgcgatacgtttcgtttaggtacgatcccggcggcactgaaaaaagcggttgagctttattcgatccctgtaggcccgccgaaagcgcccgtcaaagaactgaccggtccggcgcttttggaggtcgaaaaaatggttgcttcctatcaatcaaaatag

SEQ ID NO: 72556 - protein, 295 aa, Bacillus licheniformis DSM 13
MGFVPKGIYPAMLTPLTKDQSIDESALKQLTNHLIDAHVHGLFALGTNGEFHMFNIEDKLKVAEIIIQETAERVPVMVGSGGNSTEEAIWLSKEIERLGADALSVITPFFIPPTQEEAAVHYKTIAASVSLPILLYNIPSKTGFHLEPETVAELAKVDNIVGIKDSSGNFENIQQYIEQTKNDDFSVFAGTDSLILKTLQAGGAGAVAATANMLPDIVTSIYHHWAEGETEKAEAAQMELQPLRDTFRLGTIPAALKKAVELYSIPVGPPKAPVKELTGPALLEVEKMVASYQSK

SEQ ID NO: 72557 - DNA, 903 bp, Bacillus licheniformis DSM 13
  CDS (1)..(903)
atgaaagtagagggaattatccctgccatactgacaccgcttacaaaagaacaggcctttcatccgggcgcagccgaaaagctggtgaatcgtctaattgattcaggcgtccatggcatttttgctttagggacaaatggcgaatttcatttattctcgcaagaggaaaagcttcaaattgccgaaacagttgtaaaagcggttaataaacgagtgcctgttttcatcggagcaggtgaaaacagtactgaggcgaccatttctttattcaatcaaatggcggatcttggagcggatgttctttcgattattacgccatactttgttgcaccttcgcaggaggaattgtatcagcatttccgcacgatttccgaaaatgtcgcgcttcctgtcctgctctacaacattccgtcgagaacaggcgtatcattggagcccgaaacagttgaaaggctggcggcattgccgaacatcatcggcattaaggacagcagcggaagcttcgccaatattaaggcgtatcttgagcgtacaaaagaacagtccttttccgttctggcaggaactgattcgctgatcttagacacattgaaggcgggagggacaggagctgtggctgccacagccaatgtgtttccgcacaccgttgtttcaatctatgaatcttttaaacaaggaaacattgaagagagcgagcactatcaacagcagctgcagccgctccgtgatacgttttcactcggttcactgccggcgccgctaaaaaaagcagcggagcttgccggcatcgacgtcggaccgcctaaacgtccgattgcagaactgtcgggagagccgctgctaaaagtgaaaaagatgctggaaggctacggaattgaagcaaaactggcaaaggagcagtaa

SEQ ID NO: 72558 - protein, 300 aa, Bacillus licheniformis DSM 13
MKVEGIIPAILTPLTKEQAFHPGAAEKLVNRLIDSGVHGIFALGTNGEFHLFSQEEKLQIAETVVKAVNKRVPVFIGAGENSTEATISLFNQMADLGADVLSIITPYFVAPSQEELYQHFRTISENVALPVLLYNIPSRTGVSLEPETVERLAALPNIIGIKDSSGSFANIKAYLERTKEQSFSVLAGTDSLILDTLKAGGTGAVAATANVFPHTVVSIYESFKQGNIEESEHYQQQLQPLRDTFSLGSLPAPLKKAAELAGIDVGPPKRPIAELSGEPLLKVKKMLEGYGIEAKLAKEQ

SEQ ID NO: 72559 - DNA, 897 bp, Mannheimia succiniciproducens MBEL55E
  CDS (1)..(897)
atgtcatcaacacgtcctttattttacggtagtatcgttgcgcttattacgcctatggatggccatggcgaagttaattatgacgaattaaaaaaattagttgaataccatattgccagcggcactcatgctattgtttcggtgggaacaacaggggagtccgctactttaagtattgatgaaaatgtaaaaaccattcaaaagaccgttgagttcgcggcaggccgtattcccgttatcgcgggtacgggcgctaatgcaaccagcgaagccattacgatgacgaaattattgaataacagcggtgttgccggctgcttgtctgttgtgccttactataataaaccgactcaagaagggatgtatcaacattttaaagctattgccgagtgtacggatcttccgcaaattctttataacgtaccgggacgtaccggtagcgatatgaaacctgaaaccgtgggtcgtttatctaaaattgaaaatattgtggcaattaaagaagctacgggtgatgtgagtcgtgtaaaacaaattaaagaattagccggcgaagattttattttcctgagcggcgatgacgctaccggattagaaagcattaaattaggcggacagggcgtgatttccgtaactaataacctcgcagcggcggatatggctaaaatgtgtgaattggcgcttgccggcaattttgatgaagcggaggcgattaatcagcgcttaatgggattacatcatgatttatttattgaaggtaatccgattccggtaaaatgggcggcctataaattaggtttgatcaaagaacctgtattgcgtctgccgttaaccacattgagcgaagcggcgcagccgaaagtgcttgaagcattaaaacaagcgggcttgatttaa

SEQ ID NO: 72560 - protein, 298 aa, Mannheimia succiniciproducens MBEL55E
MSSTRPLFYGSIVALITPMDGHGEVNYDELKKLVEYHIASGTHAIVSVGTTGESATLSIDENVKTIQKTVEFAAGRIPVIAGTGANATSEAITMTKLLNNSGVAGCLSVVPYYNKPTQEGMYQHFKAIAECTDLPQILYNVPGRTGSDMKPETVGRLSKIENIVAIKEATGDVSRVKQIKELAGEDFIFLSGDDATGLESIKLGGQGVISVTNNLAAADMAKMCELALAGNFDEAEAINQRLMGLHHDLFIEGNPIPVKWAAYKLGLIKEPVLRLPLTTLSEAAQPKVLEALKQAGLI

SEQ ID NO: 72561 - DNA, 879 bp, Mannheimia succiniciproducens MBEL55E
  CDS (1)..(879)
atgtttaaacctcaaggtattatcgctccggttcttaccgcattagatgataacgaaaaatttaatcctgaagtatataaaaactatatcaattatctaattaaggcgggtattcacggtatttttccattaggtactaatggtgaattctatggatttaacgaagctgaaaaattagaaataattaaaaccgcaattgaagctgctgatggttgtgtaccggtttatgctgggacaggttgtgtaaccacgaaagaaacagttgagttttctaagaaagttgtagatttaggtgttgacgtactttctattgtttcaccttattatattgcggtcactcaggatgacctttatcgtcactacgctacaattgccgaaaatgttactgctccgattttgatgtataacattcctgcaagaactggtaacaatattgattacaaaaccattaagaaattagcccaatatgaaaatattattggtgtaaaagatagtagtggtaattttgataatacattgaaatatattgaaaataccgattctcgtttaagtatcatggcgggtagcgactccttaattctttggactttattagctggtggtacaggcgctatcagcggttgttcaaatgtgttccctgaattaatggtttccatatatgaatattggaaacaaggtgactttgaaaaagcaaacgaagcgcagaaaaaaatccgtgatttccgtaatgtgatgcaaatgggtaatccaaattccgtagtaaaacgtgccgcacaattacgcggattaggtaccggacctgcgaaagagccatctaactgtgcgaataaccccgtaattgataaagcgctacaagatgtttttaaattatatgactaa

SEQ ID NO: 72562 - protein, 292 aa, Mannheimia succiniciproducens MBEL55E
MFKPQGIIAPVLTALDDNEKFNPEVYKNYINYLIKAGIHGIFPLGTNGEFYGFNEAEKLEIIKTAIEAADGCVPVYAGTGCVTTKETVEFSKKVVDLGVDVLSIVSPYYIAVTQDDLYRHYATIAENVTAPILMYNIPARTGNNIDYKTIKKLAQYENIIGVKDSSGNFDNTLKYIENTDSRLSIMAGSDSLILWTLLAGGTGAISGCSNVFPELMVSIYEYWKQGDFEKANEAQKKIRDFRNVMQMGNPNSVVKRAAQLRGLGTGPAKEPSNCANNPVIDKALQDVFKLYD

SEQ ID NO: 72563 - DNA, 882 bp, Symbiobacterium thermophilum
  CDS (1)..(882)
atgccgacatttggacggctcctgaccgccatggtgactccgatgacccccgacggtgcggtggactaccagcgggcgggggagctcgcgaaacacctggtggcggcggggtccgagggcctggtggtctccggcaccaccggcgaatcgcccacgctgtcgcacgaggagaagctgcggctgttcgagaccgtggtcgacgcggtgggcggccaggtgtcggtcatcgccggaaccggctcgaacaacaccgcggagtcgatccgcttctcgcgggaggcggcgcgcaccggcgtccacggcctcctgctggtcacgccctactacaacaagcccccgcaggaggggctctaccgccacttccgggccgtggccgaggcggtggaccttccgtgcatcctctacaacgtgccgtcgcgcacgtcggtgaacatgctgccggccaccacgctgcgcctcgcccgggacgtgcccaacatcgtcggcatcaaggagtgtgccgacgtggggcagctcgccgacattctgtccggggcgcccgaaggcttccgggtctggtcgggggacgacgccaacctgctcccgtacctgaccgtcggcgcctacggcatcatcagcgtcgcgtcccacgtggtcggcccgcagatgcgggagctgatcgacgccttcctcgccggcgacaccgcccgggccgccgcctggcaccggcggctcctgccggtcttccgcgggctgttcgccgtcacgaacccgatcctggtgaaggcggccctgcggctcaccggcttcccggtggggcccgtccggctgccgctggtggacgcgacggaggagcaggaggaggccctgcgggaggtgctggcggaggcgggggtgctctga

SEQ ID NO: 72564 - protein, 293 aa, Symbiobacterium thermophilum
MPTFGRLLTAMVTPMTPDGAVDYQRAGELAKHLVAAGSEGLVVSGTTGESPTLSHEEKLRLFETVVDAVGGQVSVIAGTGSNNTAESIRFSREAARTGVHGLLLVTPYYNKPPQEGLYRHFRAVAEAVDLPCILYNVPSRTSVNMLPATTLRLARDVPNIVGIKECADVGQLADILSGAPEGFRVWSGDDANLLPYLTVGAYGIISVASHVVGPQMRELIDAFLAGDTARAAAWHRRLLPVFRGLFAVTNPILVKAALRLTGFPVGPVRLPLVDATEEQEEALREVLAEAGVL

SEQ ID NO: 72565 - DNA, 921 bp, Propionibacterium acnes
  CDS (1)..(921)
atgaccacgaagttccacggcgtcattcccccggtcgtcaccccactaacccccaacggtgacctggacgtcgcctcctacgaaaagctcatcaaccgcctcatcgggcaaggggtggacggtctgttcgtcctcggttccacgtccgaggtggccttcttcgacgacgagatgcgtggacgtgtcctgtccgaggccaagcggatcatcgacggtcgggttccgctgctggctggcgtcattgacacagagaccttgcgcgtcatccgtcacatcggtcaggccgaggagattggggtggacgccgttgtcgccaccgcgccgttctacgccatcaccgggccgaccgagatcgagaaccacttccgcgctttgcacgaggccaccgatctgccgttgttcgtctacgacatcccggtgtgtgtgcacgtcaaggtgcccgtcgacctcatgatgaagttggggcgcgagggggtcatcgcaggctgcaaggactcctcggctgacgacgtgtccttccgccgtctcgccttggcaaaccgtgctgccggctccccgctgtccctgttcaccggccacgaggttgtcgtcgacggggcctttatgtcgggtgctgacggcgtcgtgcctgggctggctaacgttgatgcgaccagctacgtcgccatgtacaaggcctaccgtgagggggattgggagacggtccgcattgaacaagacaaggctgccgagctgatggagatcgcgttcgcaccgcagggtgtcgtcggtccggccgctggtgtgggcgctttcaagacggccatgcagcttctcggcattatcgaaaccaacactatgagtgtgccactgccaaccctcactggggacaacgtggagagagttgccgaagtgctgcgtcgtgttggccagctcgcgtga

SEQ ID NO: 72566 - protein, 306 aa, Propionibacterium acnes
MTTKFHGVIPPVVTPLTPNGDLDVASYEKLINRLIGQGVDGLFVLGSTSEVAFFDDEMRGRVLSEAKRIIDGRVPLLAGVIDTETLRVIRHIGQAEEIGVDAVVATAPFYAITGPTEIENHFRALHEATDLPLFVYDIPVCVHVKVPVDLMMKLGREGVIAGCKDSSADDVSFRRLALANRAAGSPLSLFTGHEVVVDGAFMSGADGVVPGLANVDATSYVAMYKAYREGDWETVRIEQDKAAELMEIAFAPQGVVGPAAGVGAFKTAMQLLGIIETNTMSVPLPTLTGDNVERVAEVLRRVGQLA

SEQ ID NO: 72567 - DNA, 882 bp, Propionibacterium acnes
  CDS (1)..(882)
atgtccgctcccgtttttggccgtctgcttacggccatggtgactccgatgacgttcgacggggcggtggacctgcgtcggactggcgagttggcgcacaagctcgttgaggaacaaaacaatgacggcattgtcgtcaacggcacgacgggggaatcgccgaccacgactgattctgagaaggctgagatcgttaaggctgtcgtcgaggctgtcggatcggatgctgcggttgtagccggagtcggaaccaatgacaccgctcacaccatcgaactggctcaccaggctgccgaggctggagctgacggtctacttgtcgtcaccccctactactccaagccctcacaggctgggatcattgagcacttcaccgctgttgccgatgccaccgacctgccgatcatgctttatgacattccgggacgcaccggtactccgattgagacgaagaccctcattgaactggccgaccatgcacggattgtggccgtcaaggacgccaaggggcttgtggttgagtcagcgacggtgatggccagcaccactctggcctactactccggtgacgatgccatcactccggcattgctgtcagtgggtggagttggcctcgtcggcacgtcaacccatttcaccggtcgacgcatgcacgaggtcatcgacgcatatgttgacggccgaattgacgaggcattgtcgacctaccgggagatcctgccagtgcttaccggtgtctttgcagctcagggggccaccatggttaaggcgggactggctcaccaggggtttaccgtcggtagggtgcgtccccctcagacgatgccgactcctgagcaggctgagactttcttcggtgtgttggatcgcactcagctgtga

SEQ ID NO: 72568 - protein, 293 aa, Propionibacterium acnes
MSAPVFGRLLTAMVTPMTFDGAVDLRRTGELAHKLVEEQNNDGIVVNGTTGESPTTTDSEKAEIVKAVVEAVGSDAAVVAGVGTNDTAHTIELAHQAAEAGADGLLVVTPYYSKPSQAGIIEHFTAVADATDLPIMLYDIPGRTGTPIETKTLIELADHARIVAVKDAKGLVVESATVMASTTLAYYSGDDAITPALLSVGGVGLVGTSTHFTGRRMHEVIDAYVDGRIDEALSTYREILPVLTGVFAAQGATMVKAGLAHQGFTVGRVRPPQTMPTPEQAETFFGVLDRTQL

SEQ ID NO: 72569 - DNA, 894 bp, Desulfotalea psychrophila
  CDS (1)..(894)
atgggaggtgttatggaaaagtttcacggtgcctatgtggcaattattacaccgtttatcaacggtgaggtggatgaacagagttttgttgatctgatagagtttcagatagccaatggcacccacggtattgttccctgtggaaccacgggtgaatcggcaaccctcagttttgatgagcataagcaggtgatggaccttgccattaagacggtggctggtcgggttccagttattgccggagcaggggctaataatacccttgaggcgatagatctctccgagagtgccaaggagagcggtgcggatgcaatactctccgttgccccctactataacaaaccgagtcaggagggtatttatcagcattttaaggccattgccgaggctgttgatatcccgatgtttctctataatgtgccaggacggacggtggttaatattgctccggaaaccacggcccgacttgctgggattgataatatcatcggtataaaagaggcctgtggttgtcttgagcagatctccgatgtgattcgtaaatgcccggaggatttcattgttctctcaggcgatgatttcacctctatgcccaccaatgttattggcggcaagggcgttatttctgttatctccaatgtcttccctaaggggatggcggagatgcaggaggccacctttgccggcgactgggatcgcgcccgtcagcttcactatcagatgtatgatatgatgaagcagatgttcgccgctccaagtcctgctcctgctaagaaggctttggagctgatgggtgttatccgagagggactgcctcgtattcccatgacccccattgatgatgataatcttgccaatcttaagcttgccatgaagggtctcaacttgatttaa

SEQ ID NO: 72570 - protein, 297 aa, Desulfotalea psychrophila
MGGVMEKFHGAYVAIITPFINGEVDEQSFVDLIEFQIANGTHGIVPCGTTGESATLSFDEHKQVMDLAIKTVAGRVPVIAGAGANNTLEAIDLSESAKESGADAILSVAPYYNKPSQEGIYQHFKAIAEAVDIPMFLYNVPGRTVVNIAPETTARLAGIDNIIGIKEACGCLEQISDVIRKCPEDFIVLSGDDFTSMPTNVIGGKGVISVISNVFPKGMAEMQEATFAGDWDRARQLHYQMYDMMKQMFAAPSPAPAKKALELMGVIREGLPRIPMTPIDDDNLANLKLAMKGLNLI

SEQ ID NO: 72571 - DNA, 888 bp, Debaryomyces hansenii CBS767
  CDS (1)..(888)
atgactaaacttcaaggtatatttgctgctgttccaactcctctcactacggatgctaaaggaattgatattccaaatattgcaaagcaagttgacagacttgctgatgctggaattcatggtatcgtaacaacgggcactactggtgaatttccagctcttacaacggaagaacacaagagtgtcattaaggcttatattgatgctgcgaaaggaagaatcccagttgtggcaggtcttggtagtaacagcactcaacacgctattgaaatggctcagttttctgaaaaaatgggcgctactgcagttatgattgtccctccattctacgatcctctttctttcaaggctctttataaattttataaagatgtctgtggatccatctcaattcctgtcatgtactataatttgccaggtgcgactggggttcaccttactgctgatcaagttagacaattaggtgagattaaaggctttgattatatgaaggatacttctggtaatgccaaggaacatgcagatcttcttaccaacccttctgataagattactgttttcaatggatgggatactttaactttcttttccatgtcccatggggctcaagctattgtctggggtattgcatctattgttccaaaggaatgtgttgagctttggaacactttctcaagggagaagaacattgatgaggctagagagcagtggaaattcctttgggaagtcagtgatttcttggagagcgttaattatccagctggtattaagacaggtcttgatattattggacaatccgctggacccctcagactcccaactctcccgttagaggatgaagatattgaaaaactctcaaagattcttgaaaagagaaagtacaaatag

SEQ ID NO: 72572 - protein, 295 aa, Debaryomyces hansenii CBS767
MTKLQGIFAAVPTPLTTDAKGIDIPNIAKQVDRLADAGIHGIVTTGTTGEFPALTTEEHKSVIKAYIDAAKGRIPVVAGLGSNSTQHAIEMAQFSEKMGATAVMIVPPFYDPLSFKALYKFYKDVCGSISIPVMYYNLPGATGVHLTADQVRQLGEIKGFDYMKDTSGNAKEHADLLTNPSDKITVFNGWDTLTFFSMSHGAQAIVWGIASIVPKECVELWNTFSREKNIDEAREQWKFLWEVSDFLESVNYPAGIKTGLDIIGQSAGPLRLPTLPLEDEDIEKLSKILEKRKYK

SEQ ID NO: 72573 - DNA, 885 bp, Erwinia carotovora
  CDS (1)..(885)
atgaatacgtttagcggtgtttttccctatctggtgtcacccgtcaggcccgatggtcaggtcgataagcccgtgctggcgcaactcactgagcatttgattcaatgtggtgtgcatggcgtcgtgccgttaggtagcaccggtgaatttgcctatctctctgcgactcagcgtctggatgtggtcaaaaccgtgattgagacgacggcgggtcgcgtgccagtgatcgccggtgtcgcttccacaacgattcaggatgccgttgagcaaacgaaacgctacgttgaactcggtgcggatggcattcttgcggtactcgaagcctatttcccactgaaagacgaaggcgtcgaacagtatttccgcgccattgccgaagctgcacagggcaaaccggtcgtgctctacaccaatcctcagttccagcgctccgatttgagcttgcccgttatcgaacgcctgagtcatgtcagtaatatccgctatatcaaagacgcctcgacgaataccgggcgtttgctgtccatcattgaacgtacccgtggccggatggaagtgttctccgcgtccgctcatattcccgcctgtgtgatgctgattggcggcgtgggttggatggctggcccggcgtgtatcgttcccaaacagagtattgctttgtatgaagccgcccgcgcgggtgactggaacagagcaatggagcttcagcgtccgctgtggcgtatcaatgaaatctttgcccgttattccattgctggctgtattaaagcggcgctgcaattgcagggatttgccgttggcgacccgttgccgcctcagcaaccgttggatgaaaaggcgcgtaaggagatcgctgacgttttggcgtctgtcgattccctttaa

SEQ ID NO: 72574 - protein, 294 aa, Erwinia carotovora
MNTFSGVFPYLVSPVRPDGQVDKPVLAQLTEHLIQCGVHGVVPLGSTGEFAYLSATQRLDVVKTVIETTAGRVPVIAGVASTTIQDAVEQTKRYVELGADGILAVLEAYFPLKDEGVEQYFRAIAEAAQGKPVVLYTNPQFQRSDLSLPVIERLSHVSNIRYIKDASTNTGRLLSIIERTRGRMEVFSASAHIPACVMLIGGVGWMAGPACIVPKQSIALYEAARAGDWNRAMELQRPLWRINEIFARYSIAGCIKAALQLQGFAVGDPLPPQQPLDEKARKEIADVLASVDSL

SEQ ID NO: 72575 - DNA, 885 bp, Erwinia carotovora
  CDS (1)..(885)
atgagtaagaacattaccggcgtcctgaccgccatcgtcacgccgtttgataaccagggcgaatttaaccccgctgccatgcgtcttcaggttcaacgccagatgcgctatggcaacggtattttctgtaacggcaccaacggtgagtttttcgttctgcacaccgatgagaaagtcgccgtcacggaaacctgcgttgatgaagttgccggaaaagtgccggttgtcggccacatcggtgaaatctccacgcgggaaaccatcaagctcggcaagcgcatcgccgcgctgggtgtcgatgccgtttctgtcatcaccccgtatttcattccactaaaacaggaagagctgatcgcccactacaccgccgtcgccgatgcgctgaccgtgccggtgtttctctacaacattcctgcacgcacgggaaatacgctggcaccggaaaccgtccgcacgctggcggatcacccgaacatcatcggcatcaaagacagcgcaggcagctatgaaagcctgagcggttatgtgcaagcggtgaaaggtgtgcagggctttaacgtactgaatggcccagactcgctcattcaccagggctttgttgacggctgctccgcctgtatttccgggctggctaacgtggcaccggaagcgatcagccagatttggcaccgtttccatgccggtgacattgaaggctcccgtcaggcacaagaacaggtcgccgaattgcgtaagacactgtacgccatcgcattctcaccggctgtggtgaagaaagcgctggcaatcatgggtgaagacgtcggcgtcagccgctatccgatccagttttccgcacaggatgaagacaacatccgcaacatacttagtcaattctcgcagtaa

SEQ ID NO: 72576 - protein, 294 aa, Erwinia carotovora
MSKNITGVLTAIVTPFDNQGEFNPAAMRLQVQRQMRYGNGIFCNGTNGEFFVLHTDEKVAVTETCVDEVAGKVPVVGHIGEISTRETIKLGKRIAALGVDAVSVITPYFIPLKQEELIAHYTAVADALTVPVFLYNIPARTGNTLAPETVRTLADHPNIIGIKDSAGSYESLSGYVQAVKGVQGFNVLNGPDSLIHQGFVDGCSACISGLANVAPEAISQIWHRFHAGDIEGSRQAQEQVAELRKTLYAIAFSPAVVKKALAIMGEDVGVSRYPIQFSAQDEDNIRNILSQFSQ

SEQ ID NO: 72577 - DNA, 879 bp, Erwinia carotovora
  CDS (1)..(879)
atgtttacgggaagtattgttgcgctagttacgccgatggacgccaaaggcgccgttgaccgggcgagcttgaaaaaactgattgattatcatgtcgctagcggtacatcggcgattgtctctgtcggcacgacgggtgagtctgccacgctgagccatgacgaacatggcgatgtcgtgctgctgacgctggaactgagcgacggacgtattcctgttatcgctggaacgggtgctaatgctactgccgaaggcgtttctctgaccaaacggtttcatggcacgggtgttgttggctgcctgacggtcacaccgtactacaataaaccgacgcaagaaggtctataccagcacttcaaagcgatcgccgagcataccgatctgccgcaaatcctgtataacgtaccttcccgtactggctgcgacatgttgccggaaactgttgcccgtttgtccgaagtgaaaaatattgtcgcaattaaagaagcgacggggaacttaagtcgggtaagtcagatccaagagctggttagtgaagacttcattttgctgagcggcgatgacgccagcggtctggattttatgcaactcggcggtaaaggtgtgatttccgtgacagcgaatatcgctgcgcgtgaaatggctgaactttgcaggctggcggcgcagggcaattttgtcgaagcgcgccgtttaaatcagcgcctgatgccactgcatcagaaattatttgttgaacccaatcctatcccagtgaaatgggcttgtaaggaattgggactcatggcgaccgatacgctgcgcctgccgatgacaccgttgactgattccggtcgtacggtgatggggcaagcacttaagcaagcgggtttgctgtaa

SEQ ID NO: 72578 - protein, 292 aa, Erwinia carotovora
MFTGSIVALVTPMDAKGAVDRASLKKLIDYHVASGTSAIVSVGTTGESATLSHDEHGDVVLLTLELSDGRIPVIAGTGANATAEGVSLTKRFHGTGVVGCLTVTPYYNKPTQEGLYQHFKAIAEHTDLPQILYNVPSRTGCDMLPETVARLSEVKNIVAIKEATGNLSRVSQIQELVSEDFILLSGDDASGLDFMQLGGKGVISVTANIAAREMAELCRLAAQGNFVEARRLNQRLMPLHQKLFVEPNPIPVKWACKELGLMATDTLRLPMTPLTDSGRTVMGQALKQAGLL

SEQ ID NO: 72579 - DNA, 918 bp, Erwinia carotovora
  CDS (1)..(918)
atgagcagagaaaaaattgaagggtcatttgttgccctcatcacaccgtttaatgacgatggtagcgtggatttcggcgcatttgaggcgctattaaaattccaggaagacaacggcacggctgccgttttgattatgggatcaaccggggaagtttccatgctgtccccagatgagagaaaagcgatcatccgccgtaccgcacaatacagcaccagtaaaatgaagctgttctacggctgcaccggtaacaataccgataccaccattgactatgttcgctatgcgcatgacaacggcgcagacggtgccattatcgccgcaccggcttatatctgcgccagcgagagcgatatcgaaagctactttctggaaattgcagacgcgaccgatttaccgttagggatttataacaatccaccacgcgtgaaaacagacctgcactggacgtcgctgctgcgtattttcaaacacccgaactacgttattcataaagaatctacgactcgcgtgggtcaggtcgcacaagttctggcaggaaatcctgatgtttcggtgatgtgctgcgactcgcccaatctaggcttagtggtgccaacgatgtcgctaggaggccatggaacagccaacatgacgggcaatatcgcgccggcagaactggcagaaatttctcgcccgtggaaaaacggcgaggatgcagaacgcttccgtcaagcctatcagcatttgctaccgctgctgcattacacctattcggcaatcaatccggtggcggtgaaatcattgatgaaagcggtgggtttaccggcgggcagtctgcgccgtccactgagaggattacagggtgaagccttagattccggcgttcgcatcgttaacgaattagggctgagcagcaaatacggctttaaaagctga

SEQ ID NO: 72580 - protein, 305 aa, Erwinia carotovora
MSREKIEGSFVALITPFNDDGSVDFGAFEALLKFQEDNGTAAVLIMGSTGEVSMLSPDERKAIIRRTAQYSTSKMKLFYGCTGNNTDTTIDYVRYAHDNGADGAIIAAPAYICASESDIESYFLEIADATDLPLGIYNNPPRVKTDLHWTSLLRIFKHPNYVIHKESTTRVGQVAQVLAGNPDVSVMCCDSPNLGLVVPTMSLGGHGTANMTGNIAPAELAEISRPWKNGEDAERFRQAYQHLLPLLHYTYSAINPVAVKSLMKAVGLPAGSLRRPLRGLQGEALDSGVRIVNELGLSSKYGFKS

SEQ ID NO: 72581 - DNA, 963 bp, Acinetobacter sp
  CDS (1)..(963)
atgcagaccgtccacttttcgtttttactatttcattcggatggaaaaataggatatttttttaaaatgactcagcaagcaccgaccattcaaggctcaattgtcgcaatcgtcacccctatgcatcaagatggcagtgtagattggaagggtcttgagaagctcgttgagtggcacatacaacaaggtacaaacagtattgtcgccgtcggaaccactggcgaagcgtcaacattgagcatggaagaacacacaaaagttattcaagaaatcattcgtgtggccaacaaacgtattccaattattgctggtactggtgcaaactcaactcacgaagcaatcgagctgactcaggctgctaaagatcttggcgctgatgcagcacttctcgtgacaccttattataataaacccacacaagaaggcctctaccaacactataaagcgattgctgaagcagttgatattccgcagattctttataacgtaccaggtcgtactggtgtcgatttatccaatgaaactgcaattcgtctggctgatcttaccaatattattggtattaaagatgcaactggcgatattccacgtggtcaggcactcattgaaggcctaaatggtaaaatggcggtatattctggtgatgatgaaactgcatgggaactgattacactgggtgcaaaaggtaatatttcggtaactgcaaatattattcctaaagcaatgagtgagttatgtgcaactgcattgcaaggtcaaaaagagcaggcaaaggtgctcaatgatcaagttgcaaatgtacacaatattctattttgcgaatcgaacccaattcctgtgaaatgggcgctacatgagatgggattagttgatacaggtattcgtctaccattaacacctctcgctgaacaatatcgtgaacctctccgtcatcagctaaaagctgcgggaattattcaataa

SEQ ID NO: 72582 - protein, 320 aa, Acinetobacter sp
MQTVHFSFLLFHSDGKIGYFFKMTQQAPTIQGSIVAIVTPMHQDGSVDWKGLEKLVEWHIQQGTNSIVAVGTTGEASTLSMEEHTKVIQEIIRVANKRIPIIAGTGANSTHEAIELTQAAKDLGADAALLVTPYYNKPTQEGLYQHYKAIAEAVDIPQILYNVPGRTGVDLSNETAIRLADLTNIIGIKDATGDIPRGQALIEGLNGKMAVYSGDDETAWELITLGAKGNISVTANIIPKAMSELCATALQGQKEQAKVLNDQVANVHNILFCESNPIPVKWALHEMGLVDTGIRLPLTPLAEQYREPLRHQLKAAGIIQ

SEQ ID NO: 72583 - DNA, 885 bp, Bartonella quintana
  CDS (1)..(885)
atgctcaagggagctgtgaccgcgcttatcacaccatttgacgataatggtgctattgatgagaaagcattttgcaattttgtcgagtggcagattacacaaggtattaacggtgtaagccctgttggtacaacaggtgaatcaccaactttaagtcatgaagaacgtaagcaggttgtagaattatgtgttgagcaggttgctaagcgtgttcctgttgttgctggagcgggatcaaatagcacaagtgaggctgtagagcttgcacagcacgcagaaaaagcaggtgcagatgcaatcttggttgtaactccctattataacaagcctaatcagaagggattatacacacatttttcttccattgcgaaagcaatttctatcccggttataatttataatattcccggtcgttctgttatcgatatggccgtggaaaccatgagagatctctgtcaggattttaaaaatatcattggtgtgaaggatgcaacgagcaaaattgggcgtgtcagtgaacaacgtgaaaagtgtggcaaggattttatacagctttcgggtgatgattgtatagcattaggttttaatgcacatggcggtgtggggtgtatttcggtttcgtccaatgttgctccaaaactttgtgcagagcttcatgctgcttgttttcgtggtgattatgaaacagcattaaaattaaatgatcttctgatgcctcttaatcgtgcagtgtttattgaaccaagtcctgcaggtattaaatatgctgctgcaaaattggggctttgtggtagtcttgttcgttcaccgattgttccattagcggagaccacaaagaagattattgatgcggctttgcatcatgctggtcttcttaaagaataa

SEQ ID NO: 72584 - protein, 294 aa, Bartonella quintana
MLKGAVTALITPFDDNGAIDEKAFCNFVEWQITQGINGVSPVGTTGESPTLSHEERKQVVELCVEQVAKRVPVVAGAGSNSTSEAVELAQHAEKAGADAILVVTPYYNKPNQKGLYTHFSSIAKAISIPVIIYNIPGRSVIDMAVETMRDLCQDFKNIIGVKDATSKIGRVSEQREKCGKDFIQLSGDDCIALGFNAHGGVGCISVSSNVAPKLCAELHAACFRGDYETALKLNDLLMPLNRAVFIEPSPAGIKYAAAKLGLCGSLVRSPIVPLAETTKKIIDAALHHAGLLKE

SEQ ID NO: 72585 - DNA, 885 bp, Bartonella henselae
  CDS (1)..(885)
atgctcaagggagctgtgaccgcgcttatcacaccgtttgatgataatggcgctattgatgagaaagcattttgcaattttgtcgagtggcagattacacaaggtattaatggcgtaagccctgttggtacaacgggtgaatcaccaactttaactcatgaagaacataagagaattatagaattatgtgtcgagcaggttgctaagcgtgttcctgttgttgctggagcaggatcaaatagcacaagtgaggctgtagagcttgcaaagcatgcagagaaagcaggtgcagatgcagttttagttgttacgccttattataacagacctaatcagaggggattatacacacatttttcttccattgcaaaagcaatttctatcccgattataatttataatatccccagtcgttctgtgattgatatggcagtggagacgatgagagacctttgtcgtgattttaaaaatatcattggtgtaaaggatgcaaccggtaaaattgagcgtgccagtgaacaacgtgaaaagtgtggtaaagattttgtacagctttctggtgatgattgtacagcattgggttttaatgcacatgggggtgtagggtgtatttcggtttcgtccaatgttgctccaaagctttgtgcacagcttcatgctgcttgtttatgtagtgattataaaacagccctcaaattaaatgatcttctgatgcctctcaatcgtgcggtgtttattgaaccaagtcctgctggtattaaatatgccgctgcaaaattagggctttgtggcactattgttcgctcgccgattgttccgctttcggataccacaaagaagattattgatgaagctttataccatgcgggtttgcttaaagaatga

SEQ ID NO: 72586 - protein, 294 aa, Bartonella henselae
MLKGAVTALITPFDDNGAIDEKAFCNFVEWQITQGINGVSPVGTTGESPTLTHEEHKRIIELCVEQVAKRVPVVAGAGSNSTSEAVELAKHAEKAGADAVLVVTPYYNRPNQRGLYTHFSSIAKAISIPIIIYNIPSRSVIDMAVETMRDLCRDFKNIIGVKDATGKIERASEQREKCGKDFVQLSGDDCTALGFNAHGGVGCISVSSNVAPKLCAQLHAACLCSDYKTALKLNDLLMPLNRAVFIEPSPAGIKYAAAKLGLCGTIVRSPIVPLSDTTKKIIDEALYHAGLLKE

SEQ ID NO: 72587 - DNA, 888 bp, Staphylococcus aureus
  CDS (1)..(888)
atgacacatttatttgagggtgttggcgttgcacttacaaccccttttacaaataacaaagttaatcttgaagctttgaaagcacacgttaattttttactagaaaataatgcccaagcaatcatcgttaatggaactactgctgagagccctactttaacaacagatgaaaaagaactcattctaaaaacagttattgatcttgtagataaacgtgttcctgtcatagctggaactggaactaatgatactgaaaagtcaatccaagcttcaatccaagctaaagccttaggggctgatgcaattatgttaattacaccctactacaacaaaacgaatcaacgtggtttagtaaaacattttgaagcgattgcagatgctgtgaaattaccagtcgtgctgtacaatgttccttcaagaacgaacatgacaattgaaccagaaactgtagaaatattaagtcaacatccttatatagttgctttaaaagatgctacgaatgattttgagtatttagaagaagtgaaaaagcgaattgatacaaattcatttgcattatatagtggcaatgatgacaacgtcgtcgaatactatcaacgtggcggtcaaggggttatctctgttattgccaatgtcattcctaaagaatttcaagcgttatacgatgctcaacaaagtggattagatattcaagatcaatttaaaccaatcggcacactgttatcagccctatcagttgatattaacccaattcctattaaagctttaacaagttatttaggatttggaaactatgaattacgtttaccattggttagcctagaagatacagatactaaagtgcttcgtgaagcatatgacacatttaaagcgggtgaaaatgagtga

SEQ ID NO: 72588 - protein, 295 aa, Staphylococcus aureus
MTHLFEGVGVALTTPFTNNKVNLEALKAHVNFLLENNAQAIIVNGTTAESPTLTTDEKELILKTVIDLVDKRVPVIAGTGTNDTEKSIQASIQAKALGADAIMLITPYYNKTNQRGLVKHFEAIADAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLGFGNYELRLPLVSLEDTDTKVLREAYDTFKAGENE

SEQ ID NO: 72589 - DNA, 897 bp, Bacillus thuringiensis
  CDS (1)..(897)
atgaaaataattaaaggggcatttccagtattaatcacaccgatggatgagtttcaagaaattaattggaacggtgtaaaacaaaacgtaaactactttattgagcaaaaagtggctggcattattataaacggaagcacaggagagtttgttagtttgtcaaaagaagaacgatttaaaatggtagaaacagtattaaaagaagttaatggccgtattccggttattgttggaactgcagcagaaacgacgaaagaaacgattgaatttacaaaacatgcagaaacgcacggagcggactgcgcattaattattaactcatactattgtaagccaaaagaagaggaaatttattttcactttaaagaaatctcaaacgctgtaaatataccaattatgttatacaataatccgtttacatctggtgttgatatgagtacagaactcatgctacgtattggaaaagagtgtgaaaatgttacacatattaaagaatctagcggagatattcgaaaagcaagagatttagtaagacaaggcgaaggtgcgtttcaagtattctgtggatctgaagatttagttatggaatcttatttagttggtgcgacgggctgggtttcagtagcaggtaatatcgtaccgggacttgttacgaaaatgtatgagcattttcataatggtgaattagaaaaagcttgggaaataaacgacgctattttacctctttgcgagtttcttgaaggatcaggaaagtatgtgcaaattgtgaaaagatcaatggaattacacgggcaagctggaggaccttcacgttatccgagactcggattaactgaagaagaagaccaaaaacttcaaacgattatttcaaaaattgcagctcatgcagctgtttaa

SEQ ID NO: 72590 - protein, 298 aa, Bacillus thuringiensis
MKIIKGAFPVLITPMDEFQEINWNGVKQNVNYFIEQKVAGIIINGSTGEFVSLSKEERFKMVETVLKEVNGRIPVIVGTAAETTKETIEFTKHAETHGADCALIINSYYCKPKEEEIYFHFKEISNAVNIPIMLYNNPFTSGVDMSTELMLRIGKECENVTHIKESSGDIRKARDLVRQGEGAFQVFCGSEDLVMESYLVGATGWVSVAGNIVPGLVTKMYEHFHNGELEKAWEINDAILPLCEFLEGSGKYVQIVKRSMELHGQAGGPSRYPRLGLTEEEDQKLQTIISKIAAHAAV

SEQ ID NO: 72591 - DNA, 888 bp, Photobacterium profundum
  CDS (1)..(888)
atggacatgttttcaggaagcatggtagcgctaataacaccattaggcgaggctggagaagtcgattacgcaagtctcgctaacttggttgaatatcatattgcagcagggactgatgcaattgttgctgtaggtacttctggcgagtcagccactctgaccgttgatgagcatgtgaaggttgttttaaagacgttagaatatgctaaaggccgtattcaagtacttgcaggtacaggagctaatgcaacgcatgaagccatcatttttagtaaactattttccggtactggtgttgcgggttgtttaaccgtcacgccgtattacaataaaccgacgcaagaaggtttataccagcattataaagccatcgcagaagccactgatctaccgcaacttctctataatgtacctggtcgtacagcggtggacctattacctgaaacggttgctcgtcttgctaaattcgagaatattgttggtattaaagatgcgacaggtgatttatcccgagttaaaaaaacaagggaactttgtggtgaagacttcatccaactaagcggtgatgatgcaacaggtctcgattttgttgctcagggtggccatggtgttatttctgtaactgctaatattgcagcagcagatatggcaacaatgtttaaattggcattaagtggccaatttgaagcagcgcaaaagatcaatgcgcgcttaatgccgttgcacagagacctttttgttgaatctaatccaattccggttaaatgggcagctcatcaattagggttgattaagcatggctatttgcgtttaccgttaactgagttaagtgaatcagcacatccagttgttcttcaggctttgaaagatgccaatgtattactgtga

SEQ ID NO: 72592 - protein, 295 aa, Photobacterium profundum
MDMFSGSMVALITPLGEAGEVDYASLANLVEYHIAAGTDAIVAVGTSGESATLTVDEHVKVVLKTLEYAKGRIQVLAGTGANATHEAIIFSKLFSGTGVAGCLTVTPYYNKPTQEGLYQHYKAIAEATDLPQLLYNVPGRTAVDLLPETVARLAKFENIVGIKDATGDLSRVKKTRELCGEDFIQLSGDDATGLDFVAQGGHGVISVTANIAAADMATMFKLALSGQFEAAQKINARLMPLHRDLFVESNPIPVKWAAHQLGLIKHGYLRLPLTELSESAHPVVLQALKDANVLL

SEQ ID NO: 72593 - DNA, 870 bp, Methanococcus maripaludis
  CDS (1)..(870)
atgcaaggtgtatatcctgcgattattactccattaaaagaaaataaagtagactatgatggtttacgaaacaatattgactttttaattgaaaatggagttagtggagttattcctgttggaactactggtgaatcaccaacattaacgccattagaacacgaaaaagtcgttgaaaaggttgttgaattcgtagacggtagagttgaagtaattgcaggtacaggttctaattcaacttctgaagcactggaattttcgcaatatgcagaagatgtcggtgttgatggagttttgttgataaccccatattataacaaaccaactcaggaaggtttgaaaaggcattttggagagattgcaaattccatcaatgtgccaatagttctatacaatgttccctcaagaactgcgctaaacatagaaccagaaacaattaaatatttatttaacgaatatagtaatatatcagctgtaaaagaagctaatccaaatttatctcaggtttctgaagtattggattcttgcgacattgacatattatctggaaatgatgaattgactttaccaataatttcccttggtggaaaaggtgttgtcagcgttattgcaaatatcgcaccaaaagaattcgttcagatggttgattttgcaaatgcaggcaaatttgataaggcaaaagaaattcactacaagttgtttccgctaatgaagttaatgtttgttgagacaaatccaataccgatcaaaactgcgatgaatatgcttggaatgccttcgggcgagttaagattgccactttgcgaaatggcagaaagcaataaattaaaattgcagaatgcacttaacaatttaggcctcttaaaataa

SEQ ID NO: 72594 - protein, 289 aa, Methanococcus maripaludis
MQGVYPAIITPLKENKVDYDGLRNNIDFLIENGVSGVIPVGTTGESPTLTPLEHEKVVEKVVEFVDGRVEVIAGTGSNSTSEALEFSQYAEDVGVDGVLLITPYYNKPTQEGLKRHFGEIANSINVPIVLYNVPSRTALNIEPETIKYLFNEYSNISAVKEANPNLSQVSEVLDSCDIDILSGNDELTLPIISLGGKGVVSVIANIAPKEFVQMVDFANAGKFDKAKEIHYKLFPLMKLMFVETNPIPIKTAMNMLGMPSGELRLPLCEMAESNKLKLQNALNNLGLLK

SEQ ID NO: 72595 - DNA, 903 bp, Parachlamydia sp
  CDS (1)..(903)
atgtatttaaaaggtctttatacagccttaattaccccttttaccccaactggtcaattagatgaagaagggttaaaaaagcttattcagattcaacttcaccatcaagtagatggggttgtcgtcttaggaacaactggggaatcccctacgttaacacaaattgaaaaaagacggattattgaaatagcattagaagaaattcaaggccgaataaaagtgattgttggcactggaagctattcaacgcaacaagcaattgaacaaactcttcaagccaaacaaatgggtgctgatgctgcgttgattgtcaccccttattataataaaccaactcaagaaggaatattcaaacactttgaagcgattaatcaagcagtctcttttccgatttgtctctataacattcaaggtcgaacgggacaaaatattcaaacgcatacgcttaaacgaatcagcactctttcttcgattattggcgtaaaagaaacatccggagatatcaatcaaatcatggatgtcatcgaagcgtttcgccaatctcatcctaactttgctattttatctggtgatgatgctttaactcttcctatgattgctttgggagggcatggcattatttctgttgtcagcaatttagttcctgccgcaatgaaatctctagtgaatgcggcactaaatggaaatttcaaaaaagcacgaataatacataaccaactttattctttcatcaaagctgcttttatcgaaaccaatccgattccgattaaagcggccttatctttaagtaaactgccagcaggttcctgccgtctccctttatgtgatctcagtcagaatcattcccaaaagctagctcaaattcttaatgaacttcctcaagagtggatctctcatggttaa

SEQ ID NO: 72596 - protein, 300 aa, Parachlamydia sp
MYLKGLYTALITPFTPTGQLDEEGLKKLIQIQLHHQVDGVVVLGTTGESPTLTQIEKRRIIEIALEEIQGRIKVIVGTGSYSTQQAIEQTLQAKQMGADAALIVTPYYNKPTQEGIFKHFEAINQAVSFPICLYNIQGRTGQNIQTHTLKRISTLSSIIGVKETSGDINQIMDVIEAFRQSHPNFAILSGDDALTLPMIALGGHGIISVVSNLVPAAMKSLVNAALNGNFKKARIIHNQLYSFIKAAFIETNPIPIKAALSLSKLPAGSCRLPLCDLSQNHSQKLAQILNELPQEWISHG

SEQ ID NO: 72597 - DNA, 882 bp, Bdellovibrio bacteriovorus
  CDS (1)..(882)
atgaaaaatttcaaaggcacgttcaccgcactggtaacgccatttaaaaacggaaagatcgacttcgcttcgctggataagcttctgaagcaacaactggctggcggcgtggatggttttgtcgtcaacggcacgacgggtgaaagtcctgtattgacctcctcagagaaggccgagcttttcaaacacatccgcaatgtctgcggagacaaagttgttttgatcatgggaaccggttccaacaacacggcccaaaccattgaagattcccgcaaggcggaagaaatgggtgcggatgcgattttggttgtggttccctactacaacaaaccaccacagcgtggactgtatgaacactttaaagccgtggcgtcttctgtgaagattccaaccattctttacaatgttccgggtcgcaccatcacctcgcttgaaactggcaccatccgtgatcttgccaaagtcaaaggtgtggttggcatcaaagaagccaccggcaaaattgatctggccagtgaaatcatcaaagcctgcggcagcgaatttgtgatgctgtccggggatgacggcacttacgttgaattcctgggcgttggtggccatggggtgatttcagttgcgtcacatgtgattccggcacaaatggtgcagtggaaaaaatgggtgtctgaaggcgcgctggataaagcccgcgcggatatcgcaaaatacaacgacctgatcaatcttcttttcgttgaagccaatccgatcccggtgaaaaaggcgttgcagttgatgggcattctggagtccgcagaactgcgtctgccattggtggagctgggtgctgaaaacaccgcaaaacttcaggccgagatgaaaaaagtgggtgtgctgtga

SEQ ID NO: 72598 - protein, 293 aa, Bdellovibrio bacteriovorus
MKNFKGTFTALVTPFKNGKIDFASLDKLLKQQLAGGVDGFVVNGTTGESPVLTSSEKAELFKHIRNVCGDKVVLIMGTGSNNTAQTIEDSRKAEEMGADAILVVVPYYNKPPQRGLYEHFKAVASSVKIPTILYNVPGRTITSLETGTIRDLAKVKGVVGIKEATGKIDLASEIIKACGSEFVMLSGDDGTYVEFLGVGGHGVISVASHVIPAQMVQWKKWVSEGALDKARADIAKYNDLINLLFVEANPIPVKKALQLMGILESAELRLPLVELGAENTAKLQAEMKKVGVL

SEQ ID NO: 72599 - DNA, 924 bp, Rhodopseudomonas palustris
  CDS (1)..(924)
atggccaagctctgctccacgaccgattggctgaccggttacatccccgatctgccaacgccgttcaacgaagccggcgacatcgacctggtctcactggctcgcttgatcgcgcgggcgatcagttcgggcgcatctgcggttgtgatctgcggaaccgccggcgaggcatcaacactcacaccagccgagcagacagccgttatcagcgaggccgtcgggatcgcaggcagacggatcagggttatcgccggcgccggctcgaacgcgacgagccaggcgatcgaactggccgcgcgggcgcaatccgccggtgcggacgccgttctttcggtcgtgccctactacaacaagccgacgcaggacggcattcgcgcacacttcgacgccatcggtcgcgcgatcgaactgccggtcctgcttcacgatgtcccctctcgcaccgctcgtcctctggcagacgatacgatcgtccgccttgcacgatccggccggttcacgggcctggtcgacggctcgggcgacgtgctgcggccgcttcggcttcggccccggttaccagccggttttcaaatgctgtccggcgacgacacaacgtcctttggatttcttgcgagcggcggcgacggggcggtctcagaggtggccaacattgcctccgacctttgccgcacgattcacacctattgtcgccaaggccgcctgcaatcggcgcgctatctccagaagcgtctgctaccgctggcatccagcctcgatcaggactcgcctgcgtctctcaaatacgcgctgaatttgctcggtctgatccggcccgatacacgcctgccgatcgtcccgctggctggcggttccgccgcgcatcttgccgccgtgttggcagcaatggccgacgaggatctcgccgagacgctgggcgcgtga

SEQ ID NO: 72600 - protein, 307 aa, Rhodopseudomonas palustris
MAKLCSTTDWLTGYIPDLPTPFNEAGDIDLVSLARLIARAISSGASAVVICGTAGEASTLTPAEQTAVISEAVGIAGRRIRVIAGAGSNATSQAIELAARAQSAGADAVLSVVPYYNKPTQDGIRAHFDAIGRAIELPVLLHDVPSRTARPLADDTIVRLARSGRFTGLVDGSGDVLRPLRLRPRLPAGFQMLSGDDTTSFGFLASGGDGAVSEVANIASDLCRTIHTYCRQGRLQSARYLQKRLLPLASSLDQDSPASLKYALNLLGLIRPDTRLPIVPLAGGSAAHLAAVLAAMADEDLAETLGA

SEQ ID NO: 72601 - DNA, 894 bp, Rhodopseudomonas palustris
  CDS (1)..(894)
atgatggcagccaagacgaaatttcgggggtcgtttaccgccttggtcacgccgttcaaaaatggcgccctcgacgaacaggcgtttcgcagcctggtgaactggcagatcgagcagggcacccacggtctggtgccggtcggaaccaccggcgagagcccgacgctgagccacgaggaacaccacaaagtggtggagtggtgcatcgcggaggccaagggccgcgtgccggtgatcgccggcgccggttccaattcgacccgcgaagccgtcgagcttgcgcgccacgccgagaaggcgggcgccgatgcggtgctggtggtgacgccgtactacaacaagccgacccaggaaggcatgtatcagcacttcaaggcggtgaacgacgcgatcgggattccgatcatcatctacaacattccgccgcgctcggtcgtcgacatgtcggtcgacaccatgagccggctgtatgagctcgacaacatcgtcggcgtgaaggacgcgaccgccaatctcggccgggtgtcgcagcagcgccacgcgatgggcccggacttcatccagctctccggcgaggacatgaccgcgctggcctatatggcggccggtggccacggctgcatctccgtggtgtcgaacatcgcgccgaagctgtgttcggatctgatgggcgcggtgttcgcgggcgactatcctggcgcgctgaagatccaggaccgtctggtgccgctgcacgacgccgtgttcaaggagccgggcgtcgccggtgccaagcatggcttgacgctgctcggccgtattcaggaagatgtccggctgccgctgatgacggtgaccgaaccgaccggcaaggcgatccgtgcggcgatggtgcacgcaggagtgatcaactga

SEQ ID NO: 72602 - protein, 297 aa, Rhodopseudomonas palustris
MMAAKTKFRGSFTALVTPFKNGALDEQAFRSLVNWQIEQGTHGLVPVGTTGESPTLSHEEHHKVVEWCIAEAKGRVPVIAGAGSNSTREAVELARHAEKAGADAVLVVTPYYNKPTQEGMYQHFKAVNDAIGIPIIIYNIPPRSVVDMSVDTMSRLYELDNIVGVKDATANLGRVSQQRHAMGPDFIQLSGEDMTALAYMAAGGHGCISVVSNIAPKLCSDLMGAVFAGDYPGALKIQDRLVPLHDAVFKEPGVAGAKHGLTLLGRIQEDVRLPLMTVTEPTGKAIRAAMVHAGVIN

SEQ ID NO: 72603 - DNA, 879 bp, Rhodopseudomonas palustris
  CDS (1)..(879)
atgatggcggattttcacggcgtattcccttatctggtgtctccggtcgatgcggagggccgcgttcgcgccgatgtgatgggacggctgtgcgacgatctgatccaggccggcgtgcacgggctgacgccgctcggctcgaccggggaatttgcctatctcggcaccgcgcagcgcgaggccgtggtgcgggcgacgatcgaagccgcgcagcgccgggtgccggtggtggcaggcgtcgcgtcgacctcggtggcggacgccgtggcgcaggccaagctgtacgagaagctcggcgccgacggcattctggcgattctcgaagcgtattttccgctgaaggatgcgcagatcgaaagctatttccgcgccattgcggatgcggtcgagatcccggtggtgatctacaccaacccgcaattccagcgctcggatctgacgctcgacgtgatcgcgcggctcgccgagcatccgcggattcgctacatcaaggatgcctcgaccaataccgggcggctgttgtcgatcatcaaccgctgcggcgacgcgctgcaggtgttctcggcctcggcgcacatccccgcggcggtgatgctgatcggcggcgtcggctggatggccggccccgcctgcatcgcgccgcgccagagcgtcgcgctgtacgaactgtgcaaggcgcagcgctgggacgaagccttgatgctgcagcgcaagctgtggcgggtcaacgaagccttcgccaaattcaacctcgccgcctgcatcaaggccggtctggccctgcagggttacgacgtcggcgaccccatcccgccgcaagccgcgctgacggccgaggagcggaaagcggtcgagaaggtgctggcggagattgcgtag

SEQ ID NO: 72604 - protein, 292 aa, Rhodopseudomonas palustris
MMADFHGVFPYLVSPVDAEGRVRADVMGRLCDDLIQAGVHGLTPLGSTGEFAYLGTAQREAVVRATIEAAQRRVPVVAGVASTSVADAVAQAKLYEKLGADGILAILEAYFPLKDAQIESYFRAIADAVEIPVVIYTNPQFQRSDLTLDVIARLAEHPRIRYIKDASTNTGRLLSIINRCGDALQVFSASAHIPAAVMLIGGVGWMAGPACIAPRQSVALYELCKAQRWDEALMLQRKLWRVNEAFAKFNLAACIKAGLALQGYDVGDPIPPQAALTAEERKAVEKVLAEIA

SEQ ID NO: 72605 - DNA, 918 bp, Rhodopseudomonas palustris
  CDS (1)..(918)
atggagacatccctggacgcgacagccgaacagccacgcgggctgtggctgccgctgatcacgccgtttcgcgacggtgagctcgacgccgcatctctgcgccggctgatcgcgcactacgcgcgagctccgctcgacgggctgatcttaggtgccaccaccggcgaagggctgacgctcgacgaggccgagctcgaacgcctggtgatgctgaccgccgatgcattggcggcgagcgaccgcaagctgccggtgtatctcgggctgtccggcagcgacacgcgcaagctggtgaagacgctggcgcggaccgcacactggccgatcgacggcgtgctgatcgcctgcccgtactacacccgtccgtcgcagcggggattggtgctgcatttcgaagccgcagccgacgccaccgcaaggccgatcctgatctacaacataccgtatcgcaccggcgtcaatctgcagaacgaggcgatgctgcggctcgccgaacgcgccaacatcgtcggcgtcaaggattgctgcgccgatcctgcgcagactgccgagctgctgcggctgcggccgccgggctttgcggtgctcaccggcgaggatgcgctcgctttcgatgcgctgagccgcggctgcgacggcgcgatcctggcctcggcgcatctggagaccgaggcgttcgccgcgatgatgcatcggctgcaggccggcgatcggctcggcggggcgaccgaatggcaacgactcgccgacctgccgaagctgctgttcgccgagccatccccggcgccggtgaaatatgcgctgtggcggcgcgggttgatcgacagcccagaagtgcggctgccgatgacaccggtgtcacccacgctcgccgccgccattgatgcgcggatgctgcccggcctatccgcggcttga

SEQ ID NO: 72606 - protein, 305 aa, Rhodopseudomonas palustris
METSLDATAEQPRGLWLPLITPFRDGELDAASLRRLIAHYARAPLDGLILGATTGEGLTLDEAELERLVMLTADALAASDRKLPVYLGLSGSDTRKLVKTLARTAHWPIDGVLIACPYYTRPSQRGLVLHFEAAADATARPILIYNIPYRTGVNLQNEAMLRLAERANIVGVKDCCADPAQTAELLRLRPPGFAVLTGEDALAFDALSRGCDGAILASAHLETEAFAAMMHRLQAGDRLGGATEWQRLADLPKLLFAEPSPAPVKYALWRRGLIDSPEVRLPMTPVSPTLAAAIDARMLPGLSAA

SEQ ID NO: 72607 - DNA, 906 bp, Corynebacterium diphtheriae
  CDS (1)..(906)
atgagcacaggtttgacagcgaacaacggaatcgaagagtttggaactatcgcagtggcgatggtaactccttttgatgctaatggagctcttgacataaaagctggtcaaaagctggcagctcaccttgtgagcaatggcattgattccttagtactcgccggtacgacgggcgagtcacccactacatcgttggaagaaaaaatcgacctgctcaaggccgtcaaagcggaggtaggggatagcgccaagcttatagccggcgctggaaccaataacaccgcagcttcggtcgagatggctcgggcctcagcagaggccggagctgatgctttgctggttgttaccccttactactctaagccgagtcaagaaggtatctatcagcatttccgcacagtttcggaggcgacagacctgccgatttgtgcgtatgacatccctccacgttctgtggtacccatcgcaccggataccttgtgtcgattggctgcgttgccaatgattaaagctgtgaaggatgctaaaggagatattacagctgccacgacgcttattgcagagactggactggcgtggtactcgggtgatgatccgcttaatttgccatggttgtcggtaggtgcaactggttttatttcggtgattggtcacttggcaccgcagttgctgcgagagatgtacacaaactttaatcagggcaatcttgagaaagctcgagagattaatgcccaactagcaccattagttgctgctcaagctcgtttgggtggcgtttctttggcaaaagcaggtttgcgtttgcaaggaattgaggttggagatccccgtcttcctattgtggctcctagtgagtccgagattgaggatcttcgccgtgatatgaataaaactggagtattgtaa

SEQ ID NO: 72608 - protein, 301 aa, Corynebacterium diphtheriae
MSTGLTANNGIEEFGTIAVAMVTPFDANGALDIKAGQKLAAHLVSNGIDSLVLAGTTGESPTTSLEEKIDLLKAVKAEVGDSAKLIAGAGTNNTAASVEMARASAEAGADALLVVTPYYSKPSQEGIYQHFRTVSEATDLPICAYDIPPRSVVPIAPDTLCRLAALPMIKAVKDAKGDITAATTLIAETGLAWYSGDDPLNLPWLSVGATGFISVIGHLAPQLLREMYTNFNQGNLEKAREINAQLAPLVAAQARLGGVSLAKAGLRLQGIEVGDPRLPIVAPSESEIEDLRRDMNKTGVL

SEQ ID NO: 72609 - DNA, 921 bp, Corynebacterium diphtheriae
  CDS (1)..(921)
atgccttccatcgttaagggcatcatcccaccagtactcacccccatgaagtccgatcgcagcatcgatttcgaagctctcgagcgcctcgttgagcacctcattgctggtggtgttgacggcctgttcgctctgggttcttccggcgaggttgccttcttgtctgacgaagaccgcgcaaccgtcatccgcgaaattgtccgtatcgcagctggtcgtgtgcctgtctacgccggtgtgatcgatatgcaggtcaaccgcatgctcggccacatcaaggctgctgaagaagcaggtgtagacgccatcgttgccaccgcccccttctacgccatctgcggacctgcagaggtagaggctcacttccgcgcggtagctgcagcaacgtctcttcctgtcatcgcttacgacatcccagtgtgcgtacacactaagctctcccctgagctgctggtcaagttgggctctgagggggttctggcaggcgttaaggattcctctggcgacgacgtctccttccgccgccttgtcatgctgaacaagaaggcaggctccccgctaaccctgctcaccggccacgaggcagtagtcgacggcgcattcatcgcaggtgccgacggctgtgtcccaggtcttggcaacgtcgatcccgccggctacgtccgcatgtggaaggctgcagaggccggcgactgggctaccgtccagaaggaacaagatcgcctcgctgccctgttcgagatcgtcttccagcccatcggcaaggttggcccagcagcaggtgtcggttctttcaagaccgccctcgagctcatgggtattttctcctccaacctgatgtccatgccattggcacctatcgacgacgccccatcccgcgatgcaatcgctgaaattctgaaggccactgatatgctctaa

SEQ ID NO: 72610 - protein, 306 aa, Corynebacterium diphtheriae
MPSIVKGIIPPVLTPMKSDRSIDFEALERLVEHLIAGGVDGLFALGSSGEVAFLSDEDRATVIREIVRIAAGRVPVYAGVIDMQVNRMLGHIKAAEEAGVDAIVATAPFYAICGPAEVEAHFRAVAAATSLPVIAYDIPVCVHTKLSPELLVKLGSEGVLAGVKDSSGDDVSFRRLVMLNKKAGSPLTLLTGHEAVVDGAFIAGADGCVPGLGNVDPAGYVRMWKAAEAGDWATVQKEQDRLAALFEIVFQPIGKVGPAAGVGSFKTALELMGIFSSNLMSMPLAPIDDAPSRDAIAEILKATDML

SEQ ID NO: 72611 - DNA, 1370 bp, Brachydanio rerio
  CDS (170)..(1144)
caagatatgttttgcagcagattacaacgctggaccgcttttagataaaacaacaaaatcataacaaacgagacttgttgacactgttgttgttgttgttgacgtgtttataagcttgtgtgcgattgtttggacatctacagctaccagacggatcaaatccatcggcatgtttgcgcaccgcagtttcagtcttctgtgcagaagatcagctgttacatcatggagaagtcagagtcacactgcagggaagcggctggatataagtggcatttatcctcccattgccactccatttactgagcctgaagatgtggactatcaaaaacttgatgacaatattaggaaatatggacgtttaccttttagaggtctagtagtgcagggctctaatggcgaatacccatatctgacggcggaggagagggttgaggtggtgaagagagtgaaacaggccctgccaaaagacaagctagttatggctggatctggatgtgaatccaccagagccacaatccaaatgagccaaagaatggcagacgcgggtgctgattgtgttttagtggtaacaccgtgtttttaccgcggccgaatggacagccgagctcttataaaccactactctaaggtggcagattcctgttcagtgccagttgtgttgtacagcgtgccagcaaacactggtcttgacctgcctgtggatgctgtaattcagctctctaagcatcccaatattgtcggcctcaaagacagtggtggagacatcaccagaatagctctgatggtgcagaaaaccagatcgcaggattttcaggtgctggcaggatcagctggtttcctcatggctgcgtacgccgtaggcgctgtaggaggcgtctgcgccctggccaatgtcctgggtcagcaggtgtgtgaactagcgcagctgtgtgtttccggacgctgggacgaagccaaagagctccagtatcgcctcatcgaacccaacacagcagtgacgcgtgggtttggcgttccagctttaaaactagcgatggactggtttggatatcacggtggcatttgccggtcgcccctacagccactgtcgaaagcagatttagaggcgcttcggggaaaattctcctccaatggttggctgtagtagttaaaagggcaacagaaatcaaagagttacagtatcaaggggttacgattggcctgtttaattattccgctagcattaatgtccaatgattttctgacaacacgagaattaatgggattaaaacatgtttttgtgactgaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 72612 - protein, 324 aa, Brachydanio rerio
MFAHRSFSLLCRRSAVTSWRSQSHTAGKRLDISGIYPPIATPFTEPEDVDYQKLDDNIRKYGRLPFRGLVVQGSNGEYPYLTAEERVEVVKRVKQALPKDKLVMAGSGCESTRATIQMSQRMADAGADCVLVVTPCFYRGRMDSRALINHYSKVADSCSVPVVLYSVPANTGLDLPVDAVIQLSKHPNIVGLKDSGGDITRIALMVQKTRSQDFQVLAGSAGFLMAAYAVGAVGGVCALANVLGQQVCELAQLCVSGRWDEAKELQYRLIEPNTAVTRGFGVPALKLAMDWFGYHGGICRSPLQPLSKADLEALRGKFSSNGWL

SEQ ID NO: 72613 - DNA, 882 bp, Listeria monocytogenes
  CDS (1)..(882)
atggatttagggaaagtaattacagcaatggtgacaccaattcacccagagaaagataaagtatgcaaaaaaagaattcatcatctcgtgaatcacttaatcaaaaatggctcagacggtttagtaatcgctggaacaactggcgaatctccaactttatcccatgatgaaaaaataaaattattccgccaagtaattgaaacaaatgacggacgtgcaaaattaattgctggaacaggctccaataacacagctgaaacaattgcttttacaaaagaagttgctgaactcggtggaattgacgctgttttaatcgttgcaccgtattacaataaaccaaatcaagatgggttatacgcgcactttgctgcggtttctgaagcttctgatttacctgtagttatctataatattccgggtcgtagtgttgttaatatcgagccagaaacaattatccgcctagcaaaattacctaatattgttggtgtaaaagaatctagcggtaacttggataatataagtaaaatcattgctgaaacctcagacgatttccaagtatacagtggggatgatagcttaactttaccaatccttgcagttggtggaaacggcgttatttctgttgctagccatgttgtaggaaatgaaatgcaagaaatgattcaagcatttgagcgtggagaagttcaaaaagctgctcaaatccaccgagaattattgccactcatgaacggtttattctctgtaccaaacccagcaccgacaaaatatttactcaatcaacaaggcattagcgttgggcctgtaagactaccacttgtagatttgaatgctgaacaaggaacgaaattacaagctatattagaaggactttctaaatag

SEQ ID NO: 72614 - protein, 293 aa, Listeria monocytogenes
MDLGKVITAMVTPIHPEKDKVCKKRIHHLVNHLIKNGSDGLVIAGTTGESPTLSHDEKIKLFRQVIETNDGRAKLIAGTGSNNTAETIAFTKEVAELGGIDAVLIVAPYYNKPNQDGLYAHFAAVSEASDLPVVIYNIPGRSVVNIEPETIIRLAKLPNIVGVKESSGNLDNISKIIAETSDDFQVYSGDDSLTLPILAVGGNGVISVASHVVGNEMQEMIQAFERGEVQKAAQIHRELLPLMNGLFSVPNPAPTKYLLNQQGISVGPVRLPLVDLNAEQGTKLQAILEGLSK

SEQ ID NO: 72615 - DNA, 879 bp, Desulfovibrio vulgaris
  CDS (1)..(879)
atgcagttcactggagcctttaccgccatcgtcactccgttccgcaatggtcgcgtcgatgaagagcgatttcgcgaactcatcgaatggcagatagaacagggcatcaacggccttgttccctgcgggactacgggcgaatccgccactctcagccatgacgagcatcgcgacgtcatccgcatctgtgtcgagcaggtcaagggccgcattcccgtactggcaggcgcgggttcgaacaacacgcgcgaggccatcgacctcacccgcttcgccaaggaagccggtgccgacggcgcgctgctcatcaccccctattacaacaagcccacacaggaaggactgtacctgcacttcaaggccatcgcctccgaggtgtcgatgcccttcatcgtgtacaacgtcccaagccggacgggcacgaacatctgccccgagactctggcgcgcctcaaccgtgacattcctgaagttgtgggcgtgaaagaggccacgggcaacctcattcaggtctccgagattctcgaatactgcggaaccgacttccaggtactctccggcgacgacttcaccgtgctgcccctgctttccgttggcggctgcggggtcatctccgtcacgtccaacgtcgttcccgccaagatgtcggacatgtgccgggccttcaaggcgggcgaccttgccactgcacggcggctgcacttcgagctttcgcccatcaatcgcgccatgttcctcgaaaccaaccccatcccggtcaagacggcccttgcactcatgggccgcatcgacctcgagatgaggctccccctctgccccctgcaacaggtcaaccagtcgcgtctgcgggacatccttgcggcagcgggcatcctgtaa

SEQ ID NO: 72616 - protein, 292 aa, Desulfovibrio vulgaris
MQFTGAFTAIVTPFRNGRVDEERFRELIEWQIEQGINGLVPCGTTGESATLSHDEHRDVIRICVEQVKGRIPVLAGAGSNNTREAIDLTRFAKEAGADGALLITPYYNKPTQEGLYLHFKAIASEVSMPFIVYNVPSRTGTNICPETLARLNRDIPEVVGVKEATGNLIQVSEILEYCGTDFQVLSGDDFTVLPLLSVGGCGVISVTSNVVPAKMSDMCRAFKAGDLATARRLHFELSPINRAMFLETNPIPVKTALALMGRIDLEMRLPLCPLQQVNQSRLRDILAAAGIL

SEQ ID NO: 72617 - DNA, 900 bp, Thermus thermophilus
  CDS (1)..(900)
atgttccgcggttccataccgcccctacccacaccctttcggcgcggccggttggacgaggaggccctaaggcgcctcgtggagcgggtcgtccaggggggctcccacggcgtgagcgtggggggcaccacgggcgagcccggcacccagaccctggaggagaggaagcgggccatagaggtcgtcctggaccaggtggcgggccgcgttcccgtgatcccggggaccggggcgcttcgcctggaggagaccctggagctcacccgcttcgccaaggaggccggggcccagggggccatggtcatcgtcccctactacgtcaagcccaaccaggaggggctttaccgctacttcgccgaggtggcgagggccgtccccgactttcccctcctcatctacaacatcccgggaagggccggggtggagatcgcccccaagaccgtggggcgcttgaggcgggacttccccaacatcgtgggcctcaagcactcctccaaggacctggagtacctctcccacctctttttggaggcggggcgggactttttggtcttctgcggcctggaaagcctcaccctccccatgatgagcctgggggcggtggggaccatcgccgccaccgccaactggcttcccaaggaggtggccctcctctgcgaaaaggccctcgccggggactaccagggggcgcgggaactccacttctacctcctcgaggccaacgaggccatcttctgggacacgaaccccattcccctaaagaccgtcctctcctggatggggctattggaaaaggagtggcggccccccttgggccccaccaccccggaggtggaggagaggcttaggcggatggccgagcgctacggcctcctccccaaggagaaggaggcggcgtga

SEQ ID NO: 72618 - protein, 299 aa, Thermus thermophilus
MFRGSIPPLPTPFRRGRLDEEALRRLVERVVQGGSHGVSVGGTTGEPGTQTLEERKRAIEVVLDQVAGRVPVIPGTGALRLEETLELTRFAKEAGAQGAMVIVPYYVKPNQEGLYRYFAEVARAVPDFPLLIYNIPGRAGVEIAPKTVGRLRRDFPNIVGLKHSSKDLEYLSHLFLEAGRDFLVFCGLESLTLPMMSLGAVGTIAATANWLPKEVALLCEKALAGDYQGARELHFYLLEANEAIFWDTNPIPLKTVLSWMGLLEKEWRPPLGPTTPEVEERLRRMAERYGLLPKEKEAA

SEQ ID NO: 72619 - DNA, 897 bp, Bacillus cereus
  CDS (1)..(897)
atgaaaaatattaaaggggcatttccagtattaatcacaccgatggatgagtttcaagaaattaattggaacggtgtaaaacaaaatgtaaactactttattgagcaaaaagtggctggcattattataaacggaagcacaggagagtttgttagtttgtcaaaagaagaacgatttaaaatggtagaaacagtattaaaagaagtggatggtcgtattccggttattgttggaactgctgcggagacgacgaaagagacgattgaatatacgaaacatgcagaagcgtatggagcggattgtgcattaattataaattcgtattattgtaaaccgaaagaagaggaaatatattttcattttaaagaaatttcaaacgctgtaaatattccaattatgttatacaataacccgtttacatctggtgttgatatgagtacagaactcatgctacgcattggaaaagagtgtgaaaatgttacacatattaaagaatctagcggagatattcgaaaagcaagagatttagtaagacaaggcgaaggtgcgtttcaagtattctgtggatctgaagatttagttatggaatcttatttagttggtgcgacgggctgggtttcagtagcaggtaatatcgtaccgggacttgttacgaaaatgtatgagcatttccaaaatggtgaattagaaaaagcttgggaaataaacgatgcgattttacctctttgtgagtttcttgaaaggtccggaaaatatgtacaaatcgttaaacgctcaatggaattacacgggcaagctggagggccttctcgctatccgagactcggattaactgaagaagagaatcaaaagcttcaaatgattatttcaaaaattgctgctcatgcagctgtttaa

SEQ ID NO: 72620 - protein, 298 aa, Bacillus cereus
MKNIKGAFPVLITPMDEFQEINWNGVKQNVNYFIEQKVAGIIINGSTGEFVSLSKEERFKMVETVLKEVDGRIPVIVGTAAETTKETIEYTKHAEAYGADCALIINSYYCKPKEEEIYFHFKEISNAVNIPIMLYNNPFTSGVDMSTELMLRIGKECENVTHIKESSGDIRKARDLVRQGEGAFQVFCGSEDLVMESYLVGATGWVSVAGNIVPGLVTKMYEHFQNGELEKAWEINDAILPLCEFLERSGKYVQIVKRSMELHGQAGGPSRYPRLGLTEEENQKLQMIISKIAAHAAV

SEQ ID NO: 72621 - DNA, 882 bp, Wolbachia pipientis wMel
  CDS (1)..(882)
atgaaatctacatttttatggactgcttgtgttactccttttaattgcaatggagatagtatagattatagcagtttgcagcgtttactgacaatgcaagttaaagctgaaaatggcgtagtgttgctgggtagcacaggtgagagcctatcgcttactgattctgaaaagcgtacattagttgaattcgtatgtaagctaaaattaaatacggaaattataattggcgtaccaggagtgaatctatatcagactcttgaatggcttgatttttgcaagggtatgcctattcatggctatctaatgacaactcccatttatgcaaagcccggaattatggggcagactttatggtttgaaaagctgcttgagaaagcacatgtgccggttatgttttacaatattccatcaagagcaggaataaatcttcacgctgaaactgtacgcaacttatccagccacgaaaaattttgggctatcaaagattcaagtggcactgttgatactttagctcagtataagaaagttgcaccaaatattgaggtcttttgtggagatgataatatgatatccgatatggccgcttatggtgcggctggcctggtttccgttgcttccaatgtttggccatatgtagcacatgaatatgttaagaagtgcctcaatggcaggaaccctcaggcagatatctggcaacaggcttgcgaagccctatttattgccagcaacccaatacccactaaagcacttttgcatgatattgggctcatagaacatcaaactgtccgcctaccgctcagcacagaagacttgccttctgttgaaaaattgaggcaagtcaataaaatgattcttggatggaaagaattggctactctctaa

SEQ ID NO: 72622 - protein, 293 aa, Wolbachia pipientis wMel
MKSTFLWTACVTPFNCNGDSIDYSSLQRLLTMQVKAENGVVLLGSTGESLSLTDSEKRTLVEFVCKLKLNTEIIIGVPGVNLYQTLEWLDFCKGMPIHGYLMTTPIYAKPGIMGQTLWFEKLLEKAHVPVMFYNIPSRAGINLHAETVRNLSSHEKFWAIKDSSGTVDTLAQYKKVAPNIEVFCGDDNMISDMAAYGAAGLVSVASNVWPYVAHEYVKKCLNGRNPQADIWQQACEALFIASNPIPTKALLHDIGLIEHQTVRLPLSTEDLPSVEKLRQVNKMILGWKELATL

SEQ ID NO: 72623 - DNA, 903 bp, Mycobacterium paratuberculosis
  CDS (1)..(903)
atgagcacggtcggattcgacgccccagcgcggttgggaaccgtgctgaccgcgatggtcacgccgttcgcggccgacggctcgctggacaccgccgccgccgcgcggctggccaatcatctcgtcgactccggctgtgacgggctggtggtgtccggaaccaccggcgaatcgccgaccaccaccgacgacgagaagcgcgagctgctgcgggtggtgctggaagcggtcggcgaccgggcccgcgtcatcgccggcgccggcacctacgacaccgcgcacagcgtccggctggccaaggcctgcgcggctgagggcgcgcacggtctgctggtggtcacgccctactactcgaagcccccgcagcgcgggctgatcgcgcatttcaccgccgtcgccgacgcgaccgaactgccggtgctgctctacgacattcccggacgctcggtggtgcccatcgagtcgagcaccatccgcgcgctggcgtcgcaccccaacatcgtcggcgtcaaggacgccaaggccgacctgcacgccggcggccagatcatcgccgagaccggactggcctactactccggagacgacgcgctgaacctgccgtggctggccatgggggccaccggtttcatcagcgtgatctcgcacgtcgccgccaatcagctacgggagttgttgtccgccttcacttccggggacatcgccaccgcccgcaagatcaacgcgaccgtcacgccgctgtgcgacgcgatggcccgcctgggcggggtgacgatgtcgaaggcggggctgcggctgcagggcatcgacgtcggcgacccgcgactgccgcaggtgccggcgacgcccgagcagatcgaggcgttgaccgccgacatgcgtgcggcctcggtgctcaggtga

SEQ ID NO: 72624 - protein, 300 aa, Mycobacterium paratuberculosis
MSTVGFDAPARLGTVLTAMVTPFAADGSLDTAAAARLANHLVDSGCDGLVVSGTTGESPTTTDDEKRELLRVVLEAVGDRARVIAGAGTYDTAHSVRLAKACAAEGAHGLLVVTPYYSKPPQRGLIAHFTAVADATELPVLLYDIPGRSVVPIESSTIRALASHPNIVGVKDAKADLHAGGQIIAETGLAYYSGDDALNLPWLAMGATGFISVISHVAANQLRELLSAFTSGDIATARKINATVTPLCDAMARLGGVTMSKAGLRLQGIDVGDPRLPQVPATPEQIEALTADMRAASVLR

SEQ ID NO: 72625 - DNA, 876 bp, Mycobacterium paratuberculosis
  CDS (1)..(876)
atgaccgaacccaagatccacggcatcatcgcctatccggttacgcccttcgccgacaacgggattgacaccgagcggctggccgcgctggtcgagcgggtggtgtccgccggcgtgcacgcgatcgcgccgctgggcagcaccggcgagctcgcctacctggaggagcccgaagtcgacgccgtgatcgacaccaccctgagcgccgtcgccggccgggtgccggtgatcgtgggggtgtcggatgtgaccaccgccaagacgattcggcgcgcccaatacgcgcagcgggccggggcggacgcggtgatgatcctgccggtgtcctactggaagctcaccgagcgggagatcttccgtcactaccgcagcatcagcgacgccatctcgattccgatcatggcctacaacaacccggccaccagcggcgtggacatgccgccggagctgctggtgcggatgttcgaatccatcgacaacgtggccatggtcaaggagtccaccggcgacctgacccggatgcagcgcatcgccgagctgtccggcaaccggctgcccttctacaacggcagcaacccgctggtgctcgacgcgctgaaggccggggcgtccggatggtgcacggccgcaccgtgtttgcggccgcaaccatgcatcgacctgtacggcgcggtgcgcgcgaacgacctcgacgccgcgcagcgactctacgacgacctcaagccgctgctcaccttcatcgtggccggcgggctggccaccaccgtcaaggccggcctggagttgctcgatttcaaagtcggcgacccgcgcgcgccgttgctgccgctcgacgagcagggccgcgccgagttgcgcaaactgcttgcggcctaa

SEQ ID NO: 72626 - protein, 291 aa, Mycobacterium paratuberculosis
MTEPKIHGIIAYPVTPFADNGIDTERLAALVERVVSAGVHAIAPLGSTGELAYLEEPEVDAVIDTTLSAVAGRVPVIVGVSDVTTAKTIRRAQYAQRAGADAVMILPVSYWKLTEREIFRHYRSISDAISIPIMAYNNPATSGVDMPPELLVRMFESIDNVAMVKESTGDLTRMQRIAELSGNRLPFYNGSNPLVLDALKAGASGWCTAAPCLRPQPCIDLYGAVRANDLDAAQRLYDDLKPLLTFIVAGGLATTVKAGLELLDFKVGDPRAPLLPLDEQGRAELRKLLAA

SEQ ID NO: 72627 - DNA, 873 bp, Geobacter sulfurreducens
  CDS (1)..(873)
atgttcaagggaagcattgtcgccatcgtcaccccgttcaccaacggcgcggtggaccaggagaaactgcgggaactcgtggagttccagatcaccaacggcaccgacgccatcgttccgtgcggcaccaccggcgaatcatcgacgctggactatgacgagcacatggacgtggtgaagatcgtcatcgagcaggtgaacaagcgggttccggtcatcgccggcaccggctccaattccaccgccgaggccatcgagctctcccgcaaggccaaggaggccggggccgacggcgtgctgctggtcaccccctactacaacaagccgacccaggaggggctcgtccgccactacaccgccatcgctgatgccgtggccatcccccagatcctctacaacgtgccgggccgcaccggggtcaacatgctccccgagaccgtcgcccggctggcgccccacaagaacatcgtcgccataaaggaggccaccggttcgctccagcaggcctcggagatcctggccctctgcggcgaccagatcgatgtcctctcgggcgacgacttcatcaccttccccatgatggcgtgcggcgccaagggggtcatctcggtgctggccaacatcatgcccaaggccgtggccgacctgaccgacgccttctttgccggtgatctggagacggcgcgtcggctccacctgaacaccctcaagatcagcaacgccatgttcatcgagtcgaacccgatcccggtgaagacggcgctcggtctcatgggcaagtgctccgacgaggtccgcctcccgctctgccccatgtccgaggggaacaaggcgaaactgaccgccatcatgaaagagtaccagctgatttaa

SEQ ID NO: 72628 - protein, 290 aa, Geobacter sulfurreducens
MFKGSIVAIVTPFTNGAVDQEKLRELVEFQITNGTDAIVPCGTTGESSTLDYDEHMDVVKIVIEQVNKRVPVIAGTGSNSTAEAIELSRKAKEAGADGVLLVTPYYNKPTQEGLVRHYTAIADAVAIPQILYNVPGRTGVNMLPETVARLAPHKNIVAIKEATGSLQQASEILALCGDQIDVLSGDDFITFPMMACGAKGVISVLANIMPKAVADLTDAFFAGDLETARRLHLNTLKISNAMFIESNPIPVKTALGLMGKCSDEVRLPLCPMSEGNKAKLTAIMKEYQLI

SEQ ID NO: 72629 - DNA, 1500 bp, Methylophilus methylotrophus
  CDS (214)..(1104)
aaatagccgtttaagatgggttgctaagagttttattataaccgaaaccttgcttttcctttggccgggagctaggcggaaaaagcttgccgcagttgggtgccagtgattttgccgccgtcttgcgcttgtatccgtccagatacagcaagtaggcgcgttctttggcgttagaccggataatcagttaaaatattcgctttattcttaaagatggcgctaggtatgttaacgggcagtttggtcgcaatcgtgacccccatgtttgaagatggacgtttggatctggacgccctcaaaaagctggtcgactttcatgtagaggcagggacagatggtattgtcatcgttggcacgactggcgagtcgcccacggtggatgtagatgagcattgtctgctgatcaaaaccacgatcgagcatgtcgccaagcgcgtgccagtcattgccggtactggcgcaaattccactgctgaagccattgaactgactgccaaggccaaggcgcttggcgcagacgcctgcctgctggtggcaccgtattacaacaagccctcgcaagagggtttgtaccagcactttaaagccgtggctgaggcggtcgatattccgcaaattctctataatgtgccaggccgcaccggttgcgacttgtctaacgacaccgtattgcgcctggcgcagattcgcaacattgtcgggattaaggatgcgactggagggattgagcgcggtaccgatttgttgttgcgtgcaccagctgatttcgccatttacagcggggatgatgccactgcgctggccctgatgttattaggggggaaaggcgtgatttcggtcacggccaatgtcgcgcccaaattaatgcatgaaatgtgcgagcatgctttgaatggcaacctggccgcagccaaagcggccaatgccaaactgtttgcattgcaccagaagttgtttgtagaagcgaacccgattccagtgaaatgggtattacaacaaatgggaatgattgccactggcatccgtttgccgctggtcaatttatccagccaatatcatgaagtattgcgcaacgccatgaagcaggcagaaattgccgcttgatcggctaaaactaatttagggtgaaacaagtgaaatacatgagtcatgtttggttacaacgtttggtgctggccagtctggtcacagcgctttcagcgtgcgattccatcccgtttattgataatagttctgactacaagggcgcaggtcgctccaggccacttgaagtgccgccagacctgaccgcggtgcgtaccagcagtacttacaatgtgcctggtagcaccagttactctgcctatagccagaaccaggaagtgcaagagcagaatggtccacagcctgtgctcgcagatatgaaaaacgtgcgcatggtgaaagcaggccagcagcgttggctggtggtcaatgcgcctccggaaaaaatctggccgattgtgcgtgatttctggctgg

SEQ ID NO: 72630 - protein, 296 aa, Methylophilus methylotrophus
MALGMLTGSLVAIVTPMFEDGRLDLDALKKLVDFHVEAGTDGIVIVGTTGESPTVDVDEHCLLIKTTIEHVAKRVPVIAGTGANSTAEAIELTAKAKALGADACLLVAPYYNKPSQEGLYQHFKAVAEAVDIPQILYNVPGRTGCDLSNDTVLRLAQIRNIVGIKDATGGIERGTDLLLRAPADFAIYSGDDATALALMLLGGKGVISVTANVAPKLMHEMCEHALNGNLAAAKAANAKLFALHQKLFVEANPIPVKWVLQQMGMIATGIRLPLVNLSSQYHEVLRNAMKQAEIAA

SEQ ID NO: 72631 - DNA, 897 bp, Agrobacterium tumefaciens
  CDS (1)..(897)
atgatgaccaagaaagccttcgtcgcgatcgtgacctgctttaacgatgacgagaccatcaactacgaagccacccgcgcgcaggttcgccgtcaggtgacggctggcaacaacatcatgtgcgcaggcaccaacggtgattttaccgctctcacccattccgaaaaaatcaggattctggaagaggttgtcgatgaagtcggcggaaaggtcgatgtcatcgtcaatgcgggcatgccggcaacattcgagacgctgcaacttgccaaggaattcgaccgcatcggcgtcaagggcattgccgtcatcacaccattcttcatcgcctgcacgcaagatggtctgattcgccacttttctacggtggcagatgaggtgaacacgccggtctatctttatgacattccagcgcgcacccagaaccacatcgaacccgaaacggcacgaaagctggcgacccatggcaatattgccgggatcaaggattccggcggcgcgcaggagacattggaagcttacttgcaggtctcaaaggaggtcgatggcttcgaggtctattccgggcccgatcatctcgtcctctgggcactgcaaaatggagccgcgggctgcatctccggtctcggcaacgcgatgcccgacgttctcgcaggcatcgtcaatggcttcaactctggagatatcacgtacgccgaacgccaacagtccgtctacacagctttccgcaccgatctctacgcccacggctttcctccagccatggtcaaacgcgcgctttatttacaggacccctctgtcggagccagtcggcagccagcattacttcccgatgcagaacaggatcaaaagattgaggaaatcctcagaaaatatggccttctagtaacaaaggcgtga

SEQ ID NO: 72632 - protein, 298 aa, Agrobacterium tumefaciens
MMTKKAFVAIVTCFNDDETINYEATRAQVRRQVTAGNNIMCAGTNGDFTALTHSEKIRILEEVVDEVGGKVDVIVNAGMPATFETLQLAKEFDRIGVKGIAVITPFFIACTQDGLIRHFSTVADEVNTPVYLYDIPARTQNHIEPETARKLATHGNIAGIKDSGGAQETLEAYLQVSKEVDGFEVYSGPDHLVLWALQNGAAGCISGLGNAMPDVLAGIVNGFNSGDITYAERQQSVYTAFRTDLYAHGFPPAMVKRALYLQDPSVGASRQPALLPDAEQDQKIEEILRKYGLLVTKA

SEQ ID NO: 72633 - DNA, 888 bp, Wolinella succinogenes
  CDS (1)..(888)
atgaatactgtaacgggtgcgatgagcgccctaatcacgccctttagaaatgggcgactggacactgaaacctacgaaaaattaatacagcgacagatccgccatggcatggatgctctcgttcctgtgggaaccacaggcgaatcagccactctctcgcactcagagcacaaagagtgcattgagattgccgtgaaggtctgccaaggcacaggcatcaaagttctcgcgggtgcaggaagcaactccacactagaggcaattgatttggccaaatttgccgagaagatgggggctgatgggattttgtgtgtcacaccctattacaacaaacccagtcaagaggggcttttccagcactacaaggcggtcgctgaatccgttggaattcccctcatgctctacaatgtccctggacgcacgggggtcaatctagagacctgcaccattcaacgactctttaatgaagtcaaaaatatctacggaatcaaggaagcctcaggctcgatggagaggattgtcgagcttaataccaagattcccgactttgccattcttagcggcgaagatgcgatcaactaccccgtccttgccaatcacggcgtaggcgtcatctccgtgatagggaatcttctccctgataaaatctctgcgctcgttcataaagcgctccaaggggagctagatgagagtcgccgcatcaataactcgctctacaaaatcaataaagccctctttgtggagagcaaccccattcccatcaaggcggccatgtatttagcggggctcaccccgaccctagagtatcgtctccctctagtgtcccccagccaagaaaatatgagaatgattgaagaaactttaaaagattatgaggtgaaagcgtga

SEQ ID NO: 72634 - protein, 295 aa, Wolinella succinogenes
MNTVTGAMSALITPFRNGRLDTETYEKLIQRQIRHGMDALVPVGTTGESATLSHSEHKECIEIAVKVCQGTGIKVLAGAGSNSTLEAIDLAKFAEKMGADGILCVTPYYNKPSQEGLFQHYKAVAESVGIPLMLYNVPGRTGVNLETCTIQRLFNEVKNIYGIKEASGSMERIVELNTKIPDFAILSGEDAINYPVLANHGVGVISVIGNLLPDKISALVHKALQGELDESRRINNSLYKINKALFVESNPIPIKAAMYLAGLTPTLEYRLPLVSPSQENMRMIEETLKDYEVKA

SEQ ID NO: 72635 - DNA, 894 bp, Vibrio vulnificus
  CDS (1)..(894)
atgagggagaaagacatgttatcaggaagtatcgttgcgttacttacgccgttcaaagccgatggagaagtagactttgatggtctgcaaaaattagttgaatatcacatcgctgctggtacgaacggtatcgtggctgtgggtaccacaggagagtcttcaacactgacggttgaagagcacgtaaaagtagtcaacaaaacggttgaatttgttaatggtcgaatcccagtgatcgctggcacgggagcaaatgctacccatgagtcggtgaccttcagccgtctgctgaatgattcaggtatcgatgcatgcctgagtgttactccatactataataagccaacgcaagaaggcctattccagcattacaaagcgattgctgaagtgagtaacgttccccaaattctatacaatgtgcctgggcgtactgcggttgaccttttgccagagaccgttgctcgtttggctgagctcgaaaacatcgttgcactaaaagatgcgacaggtgatttaaatcgagttgcaattcatcgtgaactttgtggcgaagattttatcttactaagtggtgatgatgcgacaggcctagatttcgtcaaacttggcggtcaaggcgtgatttcggttaccaacaatattgctgcaaaagatatggcggatatgttccgtttggcccttgaaggccgttttgaagaagcggaagtgatcaatcaacgtttgatgccactgcataaaaacttgtttatcgaatctagtccaattccagtgaaatgggcagcgacacaacttggtttgattgaatgcgggcatttacgtctaccgttgactgagttatcggaaaaatgtcatccgatcgttgcacaagcaatgaccgacgcagggatttactaa

SEQ ID NO: 72636 - protein, 297 aa, Vibrio vulnificus
MREKDMLSGSIVALLTPFKADGEVDFDGLQKLVEYHIAAGTNGIVAVGTTGESSTLTVEEHVKVVNKTVEFVNGRIPVIAGTGANATHESVTFSRLLNDSGIDACLSVTPYYNKPTQEGLFQHYKAIAEVSNVPQILYNVPGRTAVDLLPETVARLAELENIVALKDATGDLNRVAIHRELCGEDFILLSGDDATGLDFVKLGGQGVISVTNNIAAKDMADMFRLALEGRFEEAEVINQRLMPLHKNLFIESSPIPVKWAATQLGLIECGHLRLPLTELSEKCHPIVAQAMTDAGIY

SEQ ID NO: 72637 - DNA, 870 bp, Porphyromonas gingivalis
  CDS (1)..(870)
atgggggttgccctgattacccctttcgacgaaaagggcggggtagaccacgaatcgcttcgacttttagcggattatcaggtagcgggaggtgccaactacatcgtagtacttggcacaacgggtgaatcgcccaccatcgaggatgccgagcgctctgcgatattgcaaacagtcagagaggcggtggcaggacggtgtccgatcatcgttggagccggaggcaactacaccgaacgcctcgtcaatcggattcaagccatggacaagaccggtgtagatgccatcttatccgttgctccttactacaacaaacccacgcaagaaggcatttatagacattataggactttggccgaatctactgatacgtccatcatcctctacaatgtccccgggcgaacgggtgtgaatattaagtccgaaaccactctcagattggctacagactgtccgaatatcatcggcatcaaagaagcttcgggcaatgtggatcaagtgcgtgcaatagtgctggaaaaacccgatcctttcattgtcctatcaggcgacgatcatctctccctttcctttataaaggaaggagccgagggagttatttccgtgatcggaaatgcctatccggagcttttcagtcgtttgatacatctgtgtttggaaaaccgatttgaagaagccgaaaccatccaacaacgactggaaggaatgtactacctgatgtttgtcgatggtaatccggccggaatcaaggaattgctctatcaaaagggtctcatccgtcacaatatactaaggctgccgcttgtatctgcatcggactctacctctactttgattgccagagttcgcaatcagatcgaacagcggtaa

SEQ ID NO: 72638 - protein, 289 aa, Porphyromonas gingivalis
MGVALITPFDEKGGVDHESLRLLADYQVAGGANYIVVLGTTGESPTIEDAERSAILQTVREAVAGRCPIIVGAGGNYTERLVNRIQAMDKTGVDAILSVAPYYNKPTQEGIYRHYRTLAESTDTSIILYNVPGRTGVNIKSETTLRLATDCPNIIGIKEASGNVDQVRAIVLEKPDPFIVLSGDDHLSLSFIKEGAEGVISVIGNAYPELFSRLIHLCLENRFEEAETIQQRLEGMYYLMFVDGNPAGIKELLYQKGLIRHNILRLPLVSASDSTSTLIARVRNQIEQR

SEQ ID NO: 72639 - DNA, 900 bp, Photorhabdus luminescens
  CDS (1)..(900)
atgtctagcgggagatttgaatttacaggtagcattgttgcgctggtaacaccaatggatgcgagtggtcaggttgataaggccagtttgaaaaagttaatcgattaccatgttgctagtgggacatcagcgatagtctcggtagggacaaccggagaatctgccacattgagtcatgatgagcacggtgatgttgttttgacaaccatagaattggctgatgggcgtattccggttattgccggaacaggtgcaaatgcgactgctgaggcaatatccctaacgaaacgttttgaaaacagtggcgttgttggttgcctaacggtaacgccttattataataagccgtcgcaggaaggtttatatcagcattttaaaacgattgctgaaaatacggatttaccacaaattttgtataatgtgccttctcgtaccgggtgtgatctgctgccattaactgtagcgcgtttggcgaagattaaaaatattgtcgcaattaaagaagctacagggaacttaaatcgtgttagtcaaatccaagaattggttaatgatgatagtttcatcttattaagtggtgatgatgcaagtgggttggattttattcagctcggtggtaaaggggttatttctgttactgcaaacattgcagcgcctgacgttgctaagttttgtgaattggcattaaacggccagtttgcagaggcgcgtaagttaaataatcgcctgatggatttacaccgtcagctatttgttgaacctaatccgattccagttaaatggggatgtcaaaaattgggtttgattgctgatgacaccgtgcgtctgccgatgacgccattgacggatgcaggaaaagtctcagttgaaaaagccttgaaaatggccggattattgtaa

SEQ ID NO: 72640 - protein, 299 aa, Photorhabdus luminescens
MSSGRFEFTGSIVALVTPMDASGQVDKASLKKLIDYHVASGTSAIVSVGTTGESATLSHDEHGDVVLTTIELADGRIPVIAGTGANATAEAISLTKRFENSGVVGCLTVTPYYNKPSQEGLYQHFKTIAENTDLPQILYNVPSRTGCDLLPLTVARLAKIKNIVAIKEATGNLNRVSQIQELVNDDSFILLSGDDASGLDFIQLGGKGVISVTANIAAPDVAKFCELALNGQFAEARKLNNRLMDLHRQLFVEPNPIPVKWGCQKLGLIADDTVRLPMTPLTDAGKVSVEKALKMAGLL

SEQ ID NO: 72641 - DNA, 921 bp, Photorhabdus luminescens
  CDS (1)..(921)
atgaacaagagaaaagttaattggcatggtgtttttccagcagtgacaacacaatttaactccgatttttccattaatttggatgccacacagaaggtaatgaccaacctgattaaagatggggtttccggtttagtcgtcaatggttctgtgggggaaaatacatctctgtctatgaaagagaagcgtactatcgttgaactcgcattagatgttgctggtggaaaagttcccgttctttcgggtatcgcagaattgacaaccgataatgcgtgcaaaatggtctctgaatgccgtcaggcaggggctaatggagtgatgatcatgccgccactggtttatacgccaacaccgaaagaaaaccgagcgtatttccgtacaatagcggcctctaccgatttacccgtcatgctatataacaaccctctgctgtataaaaatgatattacgccgaaaattctgacctctctggccgattgcgaaaatatcgtggcatttaaagattcatcaggcaatacccgtccttttagtgatattcccaatgaagcgggtgatcgcttcattctttttgctggtttggatgacgtcgttttagagtcagtcgcagtgggcgcggaaggttggatttcaggtatgtcgaatgcttttccacgggaaggggagactttattccgtctggctaaacagaaacgttatgaagaagctcgggaattatatcgctggtttatgcctctgttgcatttggatttccgtcctgatttggtgcaatgcatcaagttgtgtgaagagatggttggccgtgggagtgccattacccgtccaccgcgtctacctctcgaaagggaaacattggctgaagttcgcgccattgtagaacaagcccttgctaatcgtccttcactgcctgatgtcggtctctga

SEQ ID NO: 72642 - protein, 306 aa, Photorhabdus luminescens
MNKRKVNWHGVFPAVTTQFNSDFSINLDATQKVMTNLIKDGVSGLVVNGSVGENTSLSMKEKRTIVELALDVAGGKVPVLSGIAELTTDNACKMVSECRQAGANGVMIMPPLVYTPTPKENRAYFRTIAASTDLPVMLYNNPLLYKNDITPKILTSLADCENIVAFKDSSGNTRPFSDIPNEAGDRFILFAGLDDVVLESVAVGAEGWISGMSNAFPREGETLFRLAKQKRYEEARELYRWFMPLLHLDFRPDLVQCIKLCEEMVGRGSAITRPPRLPLERETLAEVRAIVEQALANRPSLPDVGL

SEQ ID NO: 72643 - DNA, 882 bp, Gloeobacter violaceus
  CDS (1)..(882)
atgagcttcggtcgggtgctcacggcgatgatcacacccttcgacggcgagggtaatgtccattacgccgaggccgaaaaactggccgactatctggcggcccacggcagcgataccctggtcgtctgcggcaccaccggcgaatcgccgaccttgagttgggaagaagagtacgagttgttcgatgtggtgcgccgggcggtggccggccgcgccaaggtggtggcgggcaccggctccaacgccacccgcgaagcggtcgtcgccacccgcaaagccgcagccctgggtctcgacggcacgctgcaggtgtgcccctactacaacaaacctacccaggacgggctttttgagcactttcgcgccgtcgcccaggcgggcgatctgccggtgatcctctacaatgtgccggggcgcaccggcgtgcacctcgcccctgagaccgtcgcccgccttgccgaggtaccgggaatcgtcgccatcaaagaagcgagtggttccctagaccaggtgagtgccgtccgggcgctcacctgcgaggattttgtgatctactgcggcgacgactcgctgaccttgccgatgcttgccgtcggggcgacgggtgtggtcagcatcgcctcgcacctggtgggagagcccatccagcagatgatccgggccttcgagaacggccacaacgacaaagcccgccggattcacctgcacctgttgccgctttttcgagggcttttttgggagaccaatccgattcccgtcaagctggccctcgccctgcagggctgggatgtcaaccatctgcgcctgccgctcgtcgccgggagcgaggaactcggctcccggcttgaaaagcttttgcaccagcttgaactgctggtctga

SEQ ID NO: 72644 - protein, 293 aa, Gloeobacter violaceus
MSFGRVLTAMITPFDGEGNVHYAEAEKLADYLAAHGSDTLVVCGTTGESPTLSWEEEYELFDVVRRAVAGRAKVVAGTGSNATREAVVATRKAAALGLDGTLQVCPYYNKPTQDGLFEHFRAVAQAGDLPVILYNVPGRTGVHLAPETVARLAEVPGIVAIKEASGSLDQVSAVRALTCEDFVIYCGDDSLTLPMLAVGATGVVSIASHLVGEPIQQMIRAFENGHNDKARRIHLHLLPLFRGLFWETNPIPVKLALALQGWDVNHLRLPLVAGSEELGSRLEKLLHQLELLV

SEQ ID NO: 72645 - DNA, 876 bp, Chromobacterium violaceum
  CDS (1)..(876)
atgcttaccggcagcttggtagcgctcgtaacaccgatgtcgaacgatggggcggtggattttgcggcgttgcaacgattggttgagttccacatcgaaaacggcaccgccggcatcgtcgccgtcggcaccaccggcgaatcagccaccctgtcggtggaagagcacatcgccgtggtgaaagcggtggtcgactacgccaagggccgggtcaaggtaatcgccggcgcaggcggcaacgccaccagcgaggcgatcgagctgggcaggctgtcggccgaggtcggcgccgacatggtgctgtcggtggtgccctactacaacaagcccacccaggaaggcatctaccagcacttcaaggccatcgccgacgcaagcccgctgccggtcatcctttataatgtgcccggccgcaccgtggccgacatgagcaacgacaccgcgctgcgcctggctgctcatccgaacatcgtcggcctgaaggacgccaccggcgacatcggccgcgcctgcgatctggcgctgcgcgcgccggaaggcttcgcgctgtactcgggcgacgacgccaccggcatggccttcatgctgtgcggcggccatggcgtgatctcggtcaccgccaatatcgcgcccaaacaaatgagcgagctgtgcgcggccgccacctccggcgacgcccgcaaggcccgctcgatcaacgacaagctgcagggcctgcacaagcagctgttcgtcgaacccaaccctatcccggccaagtgggcgctggagcggatgcagcgcatccccgccggcatccgcctgccgctgaccccgctgagcgccgtctcccgccccctggtggaagcggcgctgaaacaagccgaagtcatttga

SEQ ID NO: 72646 - protein, 291 aa, Chromobacterium violaceum
MLTGSLVALVTPMSNDGAVDFAALQRLVEFHIENGTAGIVAVGTTGESATLSVEEHIAVVKAVVDYAKGRVKVIAGAGGNATSEAIELGRLSAEVGADMVLSVVPYYNKPTQEGIYQHFKAIADASPLPVILYNVPGRTVADMSNDTALRLAAHPNIVGLKDATGDIGRACDLALRAPEGFALYSGDDATGMAFMLCGGHGVISVTANIAPKQMSELCAAATSGDARKARSINDKLQGLHKQLFVEPNPIPAKWALERMQRIPAGIRLPLTPLSAVSRPLVEAALKQAEVI

SEQ ID NO: 72647 - DNA, 903 bp, Chromobacterium violaceum
  CDS (1)..(903)
atggcaaaacactggggcaaggtgctgaccgcgatggtgacgccgttcgacggcgacggccggctcaacctcgacgcggcgcgcgcgctggcgcgccacctggcggataacggcagcgacgcgctggtgctggccgccaccaccggcgaggcgcccacgctggacgacgccgagcgcttcgacctgatccgcgcggtcagcgacgcagtgaccattccggtgctggcaggcaccggcagcaacgacacccgccacgcgctggcgatgaccgcccgggccgaggcggccggcgccgccggcgtgttcctggtctctccgtactacaaccgcccgccgcaggccggcatcgaggcccacttccgcgcgctggccgccgccacccggctgccggtgatgatctacgacgtccccggccgcaccggccgccgcatcgcccacgacgtgctgctgcggctgttccgcgaggtggacaatatcgtcgccttcaaggacgccacctgcgaccccgccgccgccgcgcggctggtggccgaggccggagagcatttcgagctctactccggcgacgacgcgctgaccctgcccctgctggcggtcggcgcggtgggcgtggtgggcacctccacccactggaccggcccggagttcgccgagatgatcgccgccttcgagcggggcgacgcgggccgcgcccgcgagatcaacgccgcgttgatgccgtcctatgcctattccaacaccgacgattcggtgtactcgatgtcggtgaaggcgatgctgcgcgccctgggcctggctgtcggcgaatgcaggctgccgctgccggcgacgcctgccggcgtcgaggcgcgcgccgcggaaatatggcgcgagctggaggcctggcgcgccgcccagcgctga

SEQ ID NO: 72648 - protein, 300 aa, Chromobacterium violaceum
MAKHWGKVLTAMVTPFDGDGRLNLDAARALARHLADNGSDALVLAATTGEAPTLDDAERFDLIRAVSDAVTIPVLAGTGSNDTRHALAMTARAEAAGAAGVFLVSPYYNRPPQAGIEAHFRALAAATRLPVMIYDVPGRTGRRIAHDVLLRLFREVDNIVAFKDATCDPAAAARLVAEAGEHFELYSGDDALTLPLLAVGAVGVVGTSTHWTGPEFAEMIAAFERGDAGRAREINAALMPSYAYSNTDDSVYSMSVKAMLRALGLAVGECRLPLPATPAGVEARAAEIWRELEAWRAAQR

SEQ ID NO: 72649 - DNA, 909 bp, Synechococcus sp
  CDS (1)..(909)
atgacttcccccgctgccctgtctcccacaccctttggccgcgttgtcacggcgatggtcacgccgtttgatgattcgggtgcggtggatcttcccctggcgggacgcttggctcgtcatcttgtggagcagggttccgatggcctggtggtgagcggtaccaccggtgaatctcccaccctgagctggcaggagcagttgcagttgctgcaggccgtgcgtgaggcggtgggttcggatgcccaggtgctggctggcaccggcagcaactgcaccgctgaggcggtcgaggccacccggcaagctgccgccgccggtgccgatggcgcgctggtggtggttccgtattacaacaaaccccctcaggacggcctggctgctcatttccgtgccatcgccgaggcagcaccagaactgccactgatgctctacaacattcctgggcggacgggatgcagcatggcgccggagacggtggcgcagctgatggactgccccaacgtcgtcagtttcaaggccgccagtggcaccaccgaggaggtcacggccctgcggctggcctgcagttcgaagcttgcgatctacagcggtgacgacggcctcaccctgccgatgatctccgttggagccgtgggtgtggtgagtgtggccagtcatgtggtcggcccccagatccgcgccatgattgatgcctacatgcagggcgacgcagccgtcgcccttgcccttcacgaacagctgcagcctgtgttcaaggccctgttcgccaccaccaatccgattccggtcaaagccgcgcttcaactcaacggctggtccgtcggcgatccccgtccacccttgtctcccttacctgacgacatgagatcaacccttgcccaaaccatggctgcccttcgtcagacctga

SEQ ID NO: 72650 - protein, 302 aa, Synechococcus sp
MTSPAALSPTPFGRVVTAMVTPFDDSGAVDLPLAGRLARHLVEQGSDGLVVSGTTGESPTLSWQEQLQLLQAVREAVGSDAQVLAGTGSNCTAEAVEATRQAAAAGADGALVVVPYYNKPPQDGLAAHFRAIAEAAPELPLMLYNIPGRTGCSMAPETVAQLMDCPNVVSFKAASGTTEEVTALRLACSSKLAIYSGDDGLTLPMISVGAVGVVSVASHVVGPQIRAMIDAYMQGDAAVALALHEQLQPVFKALFATTNPIPVKAALQLNGWSVGDPRPPLSPLPDDMRSTLAQTMAALRQT

SEQ ID NO: 72651 - DNA, 960 bp, Rhodopirellula baltica
  CDS (1)..(960)
atgaaatcttcctcccccatagccgacgctcgcgatatgtcccgtctgttcactgcaggcaatcgcttgcaaggcatcgtgcctccattgatcactcctttgcgtgctcgtgacgagcttgaccaagagggttgggagcgtttgatcgagcacgtcatcgacggtggcgtttcaggaatcttcattctcggaacgacgggtgaggcgcccagtttgagttaccgattgcgccgtgagttgatcaccgccacaactcacttggtcgcgaaacgcgttcccgtgttggtcggagtgacggacacggcatttgttgaatcggtatcgatcgcccatcatgccgccgatgcgggagcggacgcagcggtcctgacgacgccctattattttccggcaggacaaacggagctgaccgcttacgtccagaacatcgcaccggaaattccgttgccgttgatgctgtacaacatgccgggtttgaccaaggtttggtttgaaatcgaaactctgaagacgctttctgagatccaatcgatcgtgggtgtcaaagatagcagcggtgacctggactacttccgccgtttgtgcgatttgcgaaatgaggtgcgagaggattggtcaatcttgatcggtcccgaggccatgttgccggaagctcatcagttgggtggcgacggaggagtggccggcggcgccaacgtgatgacgcgttgctttgtcgattgctacgaaggcttgacggcgaacgactcagcgaaaacggaagctgctatttcgaagattcgtcgtttccaagacatctacgatgtgggcaagtatgcatctcgtcacatcaaggcgaccaaatgtgccgcgtcgttgctaggaatttgcagcgaccttcctgcggatccttttcaccggttctttgaacctgagcgggagagagtggctgcgattcttcgtgatctggacattctatga

SEQ ID NO: 72652 - protein, 319 aa, Rhodopirellula baltica
MKSSSPIADARDMSRLFTAGNRLQGIVPPLITPLRARDELDQEGWERLIEHVIDGGVSGIFILGTTGEAPSLSYRLRRELITATTHLVAKRVPVLVGVTDTAFVESVSIAHHAADAGADAAVLTTPYYFPAGQTELTAYVQNIAPEIPLPLMLYNMPGLTKVWFEIETLKTLSEIQSIVGVKDSSGDLDYFRRLCDLRNEVREDWSILIGPEAMLPEAHQLGGDGGVAGGANVMTRCFVDCYEGLTANDSAKTEAAISKIRRFQDIYDVGKYASRHIKATKCAASLLGICSDLPADPFHRFFEPERERVAAILRDLDIL

SEQ ID NO: 72653 - DNA, 984 bp, Rhodopirellula baltica
  CDS (1)..(984)
atgaatcgacgcatctccggcattttgactcccaacatcacgccggtggatgaccggggacgcgttgatgaagacaagctgcgtgggtatgtcgattggttgatcgaccatggcgtcgatggtttgtaccccaatggcagcacgggtgagttcgttcgtttcaccgcggaggaacgccgtcacatcgttcggattgtcgttgatcaagcagccggacgggttcccgtattggcgggggcggcggaggccaacgtcgaagaaacgatcgaggcctgcaatgcttatggcgacatgggggttcgagcggtcgcgatcgtcgcgcctttttattatccgatcagcagcgaaggcgttcacgcttactacgcccacatcgctcgcggcgtgcgggtcgacgtgacgctgtacaacattcctttgtttgcgtcgccgatcgaagtcgatgtggtgatccgattggcggaagagtacccgcgaatcatcggtttgaaagacagttccggtgatctaccgaacttgatgcgaatgatggccgcgatccgaccgatgcgagacgatttttcgtttctgacagggtgggatgctgcactcgcgcccatgttgatcgcgggagcagatggtggaacgaacgcgaccagtggcgtattgcctgagctgacgcgtgcgattcatcgggcttgcgccgacggtgatcacaaactagcgatggagttgcagtacatgttgctgccgttgttcgacgcgatgatcggcctgggagagtttccggcgggcttccgcgcgggagcgcgagcgcgtggatgggaccttggtcgaggccgcgttccattgtcggacaagcaacaagcattgatcgtgacggcggaacgagagatcaatgcgatggttcgatccacccaagcaaagatgaccggttcgtcggagttgccattggaagcgatccaagtgatcgctcgccgcgtgatggaacaactcgaaaagtag

SEQ ID NO: 72654 - protein, 327 aa, Rhodopirellula baltica
MNRRISGILTPNITPVDDRGRVDEDKLRGYVDWLIDHGVDGLYPNGSTGEFVRFTAEERRHIVRIVVDQAAGRVPVLAGAAEANVEETIEACNAYGDMGVRAVAIVAPFYYPISSEGVHAYYAHIARGVRVDVTLYNIPLFASPIEVDVVIRLAEEYPRIIGLKDSSGDLPNLMRMMAAIRPMRDDFSFLTGWDAALAPMLIAGADGGTNATSGVLPELTRAIHRACADGDHKLAMELQYMLLPLFDAMIGLGEFPAGFRAGARARGWDLGRGRVPLSDKQQALIVTAEREINAMVRSTQAKMTGSSELPLEAIQVIARRVMEQLEK

SEQ ID NO: 72655 - DNA, 945 bp, Rhodopirellula baltica
  CDS (1)..(945)
atgttccggacgtgcttgatgtctcccagaaaaggcagcgatttcgctggtctgtccaccgccattgtgactccctttcgtgatggacaagtcgacgagaaacgtttggctgagcagatcgattttcaaatcgactcgggtgtcacgtgcatcgtgccatgcggaacgactggtgagtcaccgacgttgacgcatgacgagcacgaacgtgtgatctcgttgacgattcaacacgtcgccggccgcgtcaaagtcatggctggcacgggcagtaacagtacagcggaagcgttgcgactgactcgtcgagctgccgatgaaggcgcggatgcgactttgcaagtcgccccgtattacaacaagccaactcaagaaggcatgtatcaacacttccgcgcagttgcggaagctgtcgacattccagtctgcgtctacaacattcctgggcgttcagcgaagaacatcgaagtcgacacgattgtgcgattggcagaattgccgaacatcacgatggtcaaagaagcgaccggatcactggatcaatgcaccgcggtcttgggtgcaaccaatctgaccgttctatcaggcgatgattcgctgacattgccaatgatgagcgtcggagccgaaggcgtgatctccgtggcggccaacttggtgccatcggtgttgttggaaatggtccaaacggcagcggcaggtgattacacgaaggctgccgaactgcaccatcgtttgtattctttgtgcagtaagatgctggggctcgctacgaacccgatcccggtcaaagcagcgatgcaaatggtcggtcgtgacaccggcgaaatgcgtttgccgatggttccgcttgacgatgccgatcgagcgatcttgcaagagacgctgatgaagtttggcatggaatcggccattgctggtcaattgcaagccagcggcgcgtga

SEQ ID NO: 72656 - protein, 314 aa, Rhodopirellula baltica
MFRTCLMSPRKGSDFAGLSTAIVTPFRDGQVDEKRLAEQIDFQIDSGVTCIVPCGTTGESPTLTHDEHERVISLTIQHVAGRVKVMAGTGSNSTAEALRLTRRAADEGADATLQVAPYYNKPTQEGMYQHFRAVAEAVDIPVCVYNIPGRSAKNIEVDTIVRLAELPNITMVKEATGSLDQCTAVLGATNLTVLSGDDSLTLPMMSVGAEGVISVAANLVPSVLLEMVQTAAAGDYTKAAELHHRLYSLCSKMLGLATNPIPVKAAMQMVGRDTGEMRLPMVPLDDADRAILQETLMKFGMESAIAGQLQASGA

SEQ ID NO: 72657 - DNA, 909 bp, Prochlorococcus marinus subsp
  CDS (1)..(909)
atgattcccaacaatactaaattttctaatccattattcggaagaattttgacagctatggttactccatttaaaaaaaatggtgcagttgattatgaattagctattaaactttctaattacctttgtgaaaatggctctgatggaattgtgctatgtgggaccacaggagagtctccaactcttacatgggctgaacaacataatttgtttgttgcagtaaaaggttctttaaattctagatctaaagttattgttggtacaggtagtaactgtaccagtgaggctatagaagctacccaaaaagcttatgaatttggtgcggatggtgctttagttgttgtcccttactacaataagccccctcaagaaggtctttataaacactttagttctatagctaatgcagctagtgatttgcctttaatgttgtataacatccctggaagaactggttgtaatttattacccaccactgtaaataaacttatgaatttcccaaatattctcagtattaaagcagcaagcggtagaatagaggaagtgacagagttaagggcggcgtgcggctctaaactttcaatatatagtggcgatgattcattgttgcttcctatgttatctgttggtgctgttggtgtagtaagcgtagctagccacattgttgggttgcagcttaaaactatgattgaatcatttcaaaaaggtgaaatatctattgctcttgatattcatgaaaaactgcaaccacttttcaaggcactctttgaaacgacaaatccaattcccatcaaagcagctttagaactacgaggttggcaagttggttctcctaggaatccattaacgcctcttattaaagaaaagagagaaagcttacttcagataattcaaaatctgtctttgtaa

SEQ ID NO: 72658 - protein, 302 aa, Prochlorococcus marinus subsp
MIPNNTKFSNPLFGRILTAMVTPFKKNGAVDYELAIKLSNYLCENGSDGIVLCGTTGESPTLTWAEQHNLFVAVKGSLNSRSKVIVGTGSNCTSEAIEATQKAYEFGADGALVVVPYYNKPPQEGLYKHFSSIANAASDLPLMLYNIPGRTGCNLLPTTVNKLMNFPNILSIKAASGRIEEVTELRAACGSKLSIYSGDDSLLLPMLSVGAVGVVSVASHIVGLQLKTMIESFQKGEISIALDIHEKLQPLFKALFETTNPIPIKAALELRGWQVGSPRNPLTPLIKEKRESLLQIIQNLSL

SEQ ID NO: 72659 - DNA, 909 bp, Prochlorococcus marinus
  CDS (1)..(909)
atgagctctgctgctgagttgtctccaactccttttggccgtttgctgacggccatggtcacaccttttgacgctgatggatgcgttgatctggctttggctggtcgtcttgctcgctatctcgtggatgagggatctgatgggctggttgtctgcggcacaactggggaatcgcccactctgagctggcaggagcagcatcaattgcttggggtggtccgtcaggcagtggggccaggcgtgaaggttcttgccggtactggtagcaatagcaccgctgaggcgatagaggccaccactcaggcagctgcggtgggtgctgatggggcattggtggttgttccttattacaacaagcctccgcaggaaggtcttgaagcccatttcagggctattgcccaggctgcccctgagttgccgctgatgctttacaacattcctgggcggactggctgttcgcttgctccagcaacagttgcaaggttgatggaatgtccgaatgtggtgagtttcaaagccgccagtggcaccacggatgaagtgacgcagttgaggttgcagtgtggttcaaaattggctgtttacagcggcgacgatggcttgcttttgcccatgttgtcggtgggggctgttggggtggtgagtgtcgcaagtcaccttgtaggtcgtcggctgaaggcgatgattgaggcctatctcaatggtcagggtgctcttgccctcagttatcacgagcagttgcaacctttgttcaaggctctatttgttaccaccaatccgattcctgttaaagcagccctcgagctcagcggttggccggtcggatccccccgcctccctttgcttcctcttgatcccgtgatgcgagatgctctttcaaacaccttgactgccttgtgtcagacctga

SEQ ID NO: 72660 - protein, 302 aa, Prochlorococcus marinus
MSSAAELSPTPFGRLLTAMVTPFDADGCVDLALAGRLARYLVDEGSDGLVVCGTTGESPTLSWQEQHQLLGVVRQAVGPGVKVLAGTGSNSTAEAIEATTQAAAVGADGALVVVPYYNKPPQEGLEAHFRAIAQAAPELPLMLYNIPGRTGCSLAPATVARLMECPNVVSFKAASGTTDEVTQLRLQCGSKLAVYSGDDGLLLPMLSVGAVGVVSVASHLVGRRLKAMIEAYLNGQGALALSYHEQLQPLFKALFVTTNPIPVKAALELSGWPVGSPRLPLLPLDPVMRDALSNTLTALCQT

SEQ ID NO: 72661 - DNA, 882 bp, Helicobacter hepaticus
  CDS (1)..(882)
atggtttttggggcaatgagtgcattaatcacaccatttataaatcataaggttgattttgaaacatatgaaacactcattaagcggcaaattacctatggtatggacgcttgtgtgccagtaggcacgacaggagaatcggctacactttcgcataaagaacatatggaatgtattgaagttgccgtagcggtatgtaggggtagtaaagtaaaagtgcttgcaggtgcagggagtaattctacaagcgaggcaaaagaacttgcactttttgcccaaaaatgcggtgcagatgcgctattatgtgttacaccttattataataaacctacacaagagggtttgtttgagcattataaggctgtggctaatgcggtggagattcctgtaatgctttataatgttccatcacgcacaggagtaagtatagagatagaaactgctaaacgtctgcgtgatgcttgtaaaaatatttatgcaattaaggaggcagctggacttatggaaagagtagtggcttttggtgcagaagtgcctaatcttgcacttttaagtggagaagatgtaatcaattaccccatacttgcaaataatggcaaaggcgttatatctgtaaccggtaatcttttcccacaagagattgctgatttaacgcattatgctttacaaggtaatatggaaaaaagctatgaaattaatacaaggctttatgagatgaataggatacttttttgtgaaagtaatcctgtgcccattaaagcggcaatgtttttagcaggattattaaaaaacttggaatatcgtttgccattagtgccaccttctaaggaaaatatggctaaaatacaacaaatcttagaaaaatacgaggtgaaagaatga

SEQ ID NO: 72662 - protein, 293 aa, Helicobacter hepaticus
MVFGAMSALITPFINHKVDFETYETLIKRQITYGMDACVPVGTTGESATLSHKEHMECIEVAVAVCRGSKVKVLAGAGSNSTSEAKELALFAQKCGADALLCVTPYYNKPTQEGLFEHYKAVANAVEIPVMLYNVPSRTGVSIEIETAKRLRDACKNIYAIKEAAGLMERVVAFGAEVPNLALLSGEDVINYPILANNGKGVISVTGNLFPQEIADLTHYALQGNMEKSYEINTRLYEMNRILFCESNPVPIKAAMFLAGLLKNLEYRLPLVPPSKENMAKIQQILEKYEVKE

SEQ ID NO: 72663 - DNA, 894 bp, Haemophilus ducreyi
  CDS (1)..(894)
atgattatgtccgtcccactctttcacggcagtattgttgctttattaacgccgatgacgcatggcgaagttaattaccaagagataaaaaatttagttgaatatcatattcaagcgggttcacatggcattgtggcaatggggacgaccggtgaatctacaaccctcagtattgatgaacacgtgaaagtaattaagaaaaccgtagagtttgctgatggaagaattcccattattgctggttccggctcaaatgcaacgagtgaagcggtaaccattactaaattattgaatggtgttggcgttgtgggctgtctaagtgttgtgccgtattataataaacctactcaagaaggattatatttacattataaagcgattgccgaaagcaccgaactacctcaaattttatataatgtgccaagtcgaacaggctgtgatttaaaacccgaaacaatcgggcgtttgtcagaaattcctaatattatcggggtaaaggaagcgacaggcgatttaactcgcttgcctttaattaaaacattagcgggcgaagatttcatttttttaagtggtgatgatgccactggcttagagtcaatgaaattaggcggacaaggtgtaatatcggtgactaataatctggcagcagcggatatggctaaaatgtgtgaattagttttagcaggcaattttgctgaagcagaagcaattaatcaacgtttgattgatttacatcacgatttatttattgaagcaaatccaatcccagtaaaatgggcggcttataaattagggttgattagtgagcctagcttacgcttgccgcttacaccactttctgaaaccgcacaacccactatattaaaagcgctacaaaaagcaggtttaatttag

SEQ ID NO: 72664 - protein, 297 aa, Haemophilus ducreyi
MIMSVPLFHGSIVALLTPMTHGEVNYQEIKNLVEYHIQAGSHGIVAMGTTGESTTLSIDEHVKVIKKTVEFADGRIPIIAGSGSNATSEAVTITKLLNGVGVVGCLSVVPYYNKPTQEGLYLHYKAIAESTELPQILYNVPSRTGCDLKPETIGRLSEIPNIIGVKEATGDLTRLPLIKTLAGEDFIFLSGDDATGLESMKLGGQGVISVTNNLAAADMAKMCELVLAGNFAEAEAINQRLIDLHHDLFIEANPIPVKWAAYKLGLISEPSLRLPLTPLSETAQPTILKALQKAGLI

SEQ ID NO: 72665 - DNA, 879 bp, Candidatus Blochmannia floridanus
  CDS (1)..(879)
atgtttacgggtagtatagtagcattgattacacctatggattcaaaaggttctatagatcgaatgggtttaaaaaaattggtagattatcatgtcgataatggtacatcagctattgtttccgtcgggactacgggagaaatgtctggacttactcattctgaacatgttgatgtagtgatgtggactatagaatttagtgatggaagattgccagtaattgctggaactggatcgaattcaacatcagaagcaatcttattaactaatcagtttaatgatagcgctgtatcagcatgtttaagtgtaactccttattataatagaccaagtcaagaaggtttgtttcagcattttagagctattgcggaaagtacaaatttacctcaaatattatataatgtccctatacgtacaggttgtgatttattacctattactgtaggtcgtttatcaacaataaaaaatatagttggaattaaagaggctactgggaatttaaatagggttaatcagttaaaacggctagtgaatgaggattttattttattgagtggggatgatataagtgctgtggattttatgagacttggaggtcatggagtcatttctgtaaccgcgaatgtggctccaaaagatatgtcaactctgtgtagttttgtacaaaaaaatgattttaaaagtgcatatgatattaataatcgtttaattccagtacatcaatctttattttttgattctaatcctattcccgtaaaatgggcatgtaaagaattagggttaatatcatatgatacccttcgattacctatgacttctatatctaaggagcatagtgtgttgattagaaaagcattagaggatgctgatttattataa

SEQ ID NO: 72666 - protein, 292 aa, Candidatus Blochmannia floridanus
MFTGSIVALITPMDSKGSIDRMGLKKLVDYHVDNGTSAIVSVGTTGEMSGLTHSEHVDVVMWTIEFSDGRLPVIAGTGSNSTSEAILLTNQFNDSAVSACLSVTPYYNRPSQEGLFQHFRAIAESTNLPQILYNVPIRTGCDLLPITVGRLSTIKNIVGIKEATGNLNRVNQLKRLVNEDFILLSGDDISAVDFMRLGGHGVISVTANVAPKDMSTLCSFVQKNDFKSAYDINNRLIPVHQSLFFDSNPIPVKWACKELGLISYDTLRLPMTSISKEHSVLIRKALEDADLL

SEQ ID NO: 72667 - DNA, 879 bp, Bordetella pertussis
  CDS (1)..(879)
atgcagttccaaggcagtttggtggccctggtcaccccgatgcagcccgatggcagcctcgactacgacgcataccggtccttgatcgactggcacgtggccgaaggcaccgatggcctggtggtggtcggcaccaccggagaatctccttccgtttcgatggaagagcacgccgagctcatccgcgtggcggtcgagcacgccgccggccgcattccggtcatcgccggcgtgggcgccaactccaccgacgaagccatccatctggcccgccacgccaaggcggtcggcgcgcaggccggcctgtcggtcgtgccgtactacaacaaacccaaccaggaaggcatctaccgccatttccgcgcggtggccgaggcggtcgatctgccgacggtgctgtacaacgtgccgggccgcacggtggccgacatgtccaacgacacggtgctgcgcctggccgaagtgccgggcatcatcggcatcaaggaagccactggcgacatcgcccggggcgccttgctgctgcgcgaggcgcccgccggcttccaggtgttcagcggcgacgatccgaccgccgcggccctgatcctgctgggcgcgcgcggtaatatttcggtgacggccaacgtggcgccgcgcctgatgcatgaactctgtacggcggcgcgcggcggtgacgtgccgcgcacgcgtgaactcaatgcacggttagcccgtctcaacaaggccttgttcatcgaggccaaccctatccctgtcaaatgggcgctggcccagatgggccacacagcgcttggttatcgtctgccgatggtcgagctgagcgagcagtaccactcgctggtacgtaccgccctgcaggaagtgggtctgctctaa

SEQ ID NO: 72668 - protein, 292 aa, Bordetella pertussis
MQFQGSLVALVTPMQPDGSLDYDAYRSLIDWHVAEGTDGLVVVGTTGESPSVSMEEHAELIRVAVEHAAGRIPVIAGVGANSTDEAIHLARHAKAVGAQAGLSVVPYYNKPNQEGIYRHFRAVAEAVDLPTVLYNVPGRTVADMSNDTVLRLAEVPGIIGIKEATGDIARGALLLREAPAGFQVFSGDDPTAAALILLGARGNISVTANVAPRLMHELCTAARGGDVPRTRELNARLARLNKALFIEANPIPVKWALAQMGHTALGYRLPMVELSEQYHSLVRTALQEVGLL

SEQ ID NO: 72669 - DNA, 891 bp, Bordetella parapertussis
  CDS (1)..(891)
atgttgatcagtgccaggactttgcgcggcatcatcacggccacgcccaccccgtttacgcgggaaggcggcgtggatcgtgaggtgctgcgatcgcatatcgagttcctcatcggccggggcgcggccgggctggcgccgctgggcggcaccggcgagtatcccgccctctgcgcgcgggagcgcgccgacgtggtgcgctggacggtggaggcggcccggggccgcgtgccggtcgtcgccggcgtgctggccaccggctacgaggacgccgtgcaggcgggcctggcggccagggaggccggcgccgacgcgctgatggtggtcacgccgtattacgcgctggccggcgacgcaggcgtgcgcgcctatttcgagcgctaccgcgcggccgtggacctgcccatcgtgctgtacgagattccgcgccgcacgaacgtggagctgcgcgccgaaaccatcgcggcgatggccggcgacgggaccatcgtcggcatcaagtacagcggttccgatttcgccaagctgacccgcctgatccacctggccggcgacacgctggccgtgctgtcgggcgaagagccgttgtttcccgccgcggtggcgctgggcgcggtcggcggcgtgctggcgatgtccaacctggatccggcgccctgggcgcgcatccagtcgctggtcgagtccggcgaaatggcgcaggccttgcagttgcatcaccgccagggcgcgctggccgatgcggtctattccgaaatgaaccccgtgggcctgaaggccgccctgcaactgaagggcttcgcgttcggcgaggcgcggctgccgttgcagccggccggcccgcaaaccctgctgcgcctgcagcaggcattcgaagcactggagtcctga

SEQ ID NO: 72670 - protein, 296 aa, Bordetella parapertussis
MLISARTLRGIITATPTPFTREGGVDREVLRSHIEFLIGRGAAGLAPLGGTGEYPALCARERADVVRWTVEAARGRVPVVAGVLATGYEDAVQAGLAAREAGADALMVVTPYYALAGDAGVRAYFERYRAAVDLPIVLYEIPRRTNVELRAETIAAMAGDGTIVGIKYSGSDFAKLTRLIHLAGDTLAVLSGEEPLFPAAVALGAVGGVLAMSNLDPAPWARIQSLVESGEMAQALQLHHRQGALADAVYSEMNPVGLKAALQLKGFAFGEARLPLQPAGPQTLLRLQQAFEALES

SEQ ID NO: 72671 - DNA, 900 bp, Bordetella parapertussis
  CDS (1)..(900)
atgcaatatcccgctcaatctccgttccaggatatctggattccgctcgtgacgccgttcgccgacggcgccgtcgacctgcctgccttgcgcaggctggtgcgcgactacaaagccgccggcgtcgatggcttggttgcctgtggcagcaccggggaggcagccgcgctggacgaggccgaacagctcgcggtgctcgacgccgtgctggaggaggctggcgcgctgcccgtggccatgggcctggccggcaatcaccagggccatgtcctgcggcgcctggcgcggctgggcgagcggccgctggccggcgtactggcgcccgcgccgtattacgtacggcccagccaggctggcgcgcaagcctatttctgcgcactggccgacgcctcggccgcgccgctcatcctgtacgacattccgtatcgcaccggcgcacagctggacaccgccaccttgctggcgctggccgagcatccgaacatcgccgccgtcaaggattgcggcggctcggtggacaagacgctggccttgatcgcccacggcggcgtggcggtcctggcgggcgaagacctgcaggggctgggcacgctgtgcctgggcggcaccggcatgatcgctgccgccgcccatgtacggccggacctgttcgtggcgatgcaccgcgcggtgcgcgcgcagcaactgggccaggcgcagcgcctgttcctggcgctggcgcccgtgatccggctgttgttcgccgaacccaatccggcgccgctgaaggcgctgctggccagccaggggcgcttgcgcaacgagatgcgcgcgccgatgctaccggccgcggaggccttgaccaggcggctgcaggccgaactcgacgtgctcgaccgggccttcgcgcctggcgcgtag

SEQ ID NO: 72672 - protein, 299 aa, Bordetella parapertussis
MQYPAQSPFQDIWIPLVTPFADGAVDLPALRRLVRDYKAAGVDGLVACGSTGEAAALDEAEQLAVLDAVLEEAGALPVAMGLAGNHQGHVLRRLARLGERPLAGVLAPAPYYVRPSQAGAQAYFCALADASAAPLILYDIPYRTGAQLDTATLLALAEHPNIAAVKDCGGSVDKTLALIAHGGVAVLAGEDLQGLGTLCLGGTGMIAAAAHVRPDLFVAMHRAVRAQQLGQAQRLFLALAPVIRLLFAEPNPAPLKALLASQGRLRNEMRAPMLPAAEALTRRLQAELDVLDRAFAPGA

SEQ ID NO: 72673 - DNA, 906 bp, Bordetella bronchiseptica
  CDS (1)..(906)
atgatcgacgctacctccctgcgcggcatcctgaccgcgttgcccacgcctgtcgacgcccagggcgtcgtggacacccgggccgcgcgcctgctggtggaataccagttgcgccacggcatcgatggcctggtgccgatcggcggcacgggcgagtacggctcgctcgcgcgcgccgaacgctgccgcatggtcgaggcgaccgcccaggccgcgcaaggcaaggttccggtggtcgctggcgtgctggacaccggctacttcgacgccttgcaatccgggcgcgaactggcggcggccggcgccgacgccctgatggtcgtgacgccttactacaccaatccgacccaggccggcctgctcgattacttcctgcgctacgccgacgagtcgcccgtgccgctcatcatctacgagattccgtaccgcacgcggatcgcgctggcgcccgaggtgctgcaccagctttccagccatgagcgcatcatcggcatgaaggcctgcaacaccgacatgtaccacttcctgcgcgtggtggccggggtatccgatacgttctccgtgctgagcggggaagacacgctgctgccgctgcatctgctgggcggcgcgcgcggcggcatcgtcgtgaccgccaccatgctgccggccgcctggctgcagctgttccagctggcgacgtcgggccgtggcgccgaggcgctggcgctgcaccgcgaactcatgccggtcatggaccttgctttcgccgagaccaaccccggcccgctgaaggcggtctgggacctgatcggcatcgaggcgccggacgtgctggcgccgctgcgcgaggcggcgcccgagctgcaggcggcgctgcgcgcgtgcatggcgtcgatggtccagcgcttcgggcaggttgcatga

SEQ ID NO: 72674 - protein, 301 aa, Bordetella bronchiseptica
MIDATSLRGILTALPTPVDAQGVVDTRAARLLVEYQLRHGIDGLVPIGGTGEYGSLARAERCRMVEATAQAAQGKVPVVAGVLDTGYFDALQSGRELAAAGADALMVVTPYYTNPTQAGLLDYFLRYADESPVPLIIYEIPYRTRIALAPEVLHQLSSHERIIGMKACNTDMYHFLRVVAGVSDTFSVLSGEDTLLPLHLLGGARGGIVVTATMLPAAWLQLFQLATSGRGAEALALHRELMPVMDLAFAETNPGPLKAVWDLIGIEAPDVLAPLREAAPELQAALRACMASMVQRFGQVA

SEQ ID NO: 72675 - DNA, 900 bp, Bordetella bronchiseptica
  CDS (1)..(900)
atgcaatatcccgctcaatctccgttccagggtatctggattccgctcgtgacgccgttcgccgacggcgccgtcgacctgcctgccttgcgcaagctggtgcgcgactacaaagccgccggcgtcgatggcctggttgcctgtggcagtaccggggaggcagccgcgctggacgaggccgaacagctcgcggtgctcgacgccgtgctggaggaggctggcgcgctgcccgtggccatgggcctggccggcaatcaccagggtcatgtcctgcggcgcctggcgcggctgggcgagcggccgctggccggcgtactggcgcccgcgccgtattacgtacggcccagccaggctggcgcgcaagcctatttccgcgcactggccgacgcctcggccgcgccgctcatcctgtacgacattccgtatcgcacgggcgcacagctggacaccgccaccttgctggcgttggccgagcatccgaacatcgccgccgtcaaggattgcggcggctcggtggacaagacgctggccttgatcgcccacggcggcatggcggtcctggcgggcgaagacctgcaggggctgggcacgctgtgcctgggcggcaccggcatgatcgctgccgccgcccatgtacggccggacttgttcgtggcgatgcaccgcgcggtgcgcgcgcagcaactgggccaggcgcagcgcctgttcctggcgctggcgcccgtgatccggctgttgttcgccgaacccaatccggcgccgctgaaggcgctgctggccagccaggggcgcttgcgcaacgagatgcgcgcgcccatgctgccggctgctgaggcgttggccgcgcggctgcgggccgaactcgacgcgctcgaccgggcctttgcgcctggcgtgtag

SEQ ID NO: 72676 - protein, 299 aa, Bordetella bronchiseptica
MQYPAQSPFQGIWIPLVTPFADGAVDLPALRKLVRDYKAAGVDGLVACGSTGEAAALDEAEQLAVLDAVLEEAGALPVAMGLAGNHQGHVLRRLARLGERPLAGVLAPAPYYVRPSQAGAQAYFRALADASAAPLILYDIPYRTGAQLDTATLLALAEHPNIAAVKDCGGSVDKTLALIAHGGMAVLAGEDLQGLGTLCLGGTGMIAAAAHVRPDLFVAMHRAVRAQQLGQAQRLFLALAPVIRLLFAEPNPAPLKALLASQGRLRNEMRAPMLPAAEALAARLRAELDALDRAFAPGV

SEQ ID NO: 72677 - DNA, 885 bp, Escherichia coli
  CDS (1)..(885)
atgaaagagctcaaagggattattaccgcaatggtaacgcctttcgatgaaacggaaaaaatggatatcactgcggcgaaaaaaatggcgcgctggttagtagataatggtgttcatggtttattcatttgcggaactaatggtgaattccatttgctttccgatgacgaaaaagttgagttaacaaaagccgtcgttgaagaggtcggtaatgaagttaccatttgtgcaggtgctgggtgctgcagcacaaaacaaaccatcgaattgactaaacggttagttgatgcgggtgccgattatatttctgttgtcacgccgtactatctggtaccaaatcaggaagatttataccgtcactattacgatattgcctttagcacaacagcccccatcattctctataacctgccgggccagacaggattaagcatcgaatacgaaacggcaaatcgtttagccgatatcaaaaatatcgtagcgataaaagacagtagcggtaaattcgaagtccagaaacagtatctggaaatcgctaaacataaaaactttaaggtattaaacggctctgactcgttaatgctggatgcatttaaagaaggttctgtggctgctgtcgctgcaacgtcgaatgttctgcctacgattgaagtcgatttatataattacttcatggccggtgaaatggagaaggcgcaggaagagcgtaataaaatggatgcactgcgcatgacgatcaagaaaatgaccgcgcctgcagtaatgaaggaagcattaaacctgatgggtgtgaaggcaggtattacacgtagaccaattcatatgccaaacgacgcgatcgttgaagacatcaaggaaatgttgaaaggctataatttcctgtaa

SEQ ID NO: 72678 - protein, 294 aa, Escherichia coli
MKELKGIITAMVTPFDETEKMDITAAKKMARWLVDNGVHGLFICGTNGEFHLLSDDEKVELTKAVVEEVGNEVTICAGAGCCSTKQTIELTKRLVDAGADYISVVTPYYLVPNQEDLYRHYYDIAFSTTAPIILYNLPGQTGLSIEYETANRLADIKNIVAIKDSSGKFEVQKQYLEIAKHKNFKVLNGSDSLMLDAFKEGSVAAVAATSNVLPTIEVDLYNYFMAGEMEKAQEERNKMDALRMTIKKMTAPAVMKEALNLMGVKAGITRRPIHMPNDAIVEDIKEMLKGYNFL

SEQ ID NO: 72679 - DNA, 1062 bp, Oryza sativa
  CDS (1)..(1062)
atggcgtcgctgctgatcgccagcacggggggcgcccaccgcctcgcgtggaaggacgccgccgccctgggacccgctccgcggctggcgcgaccttggcccgccgccgtggctgcaccggcgccgctgctcaggacatcaacagctgatatcactagtctcagagtaattacagcggtcaaaaccccatatctgcctgatggaagatttgatcttgaagcatatgattcactgataaatatgcagatagatggtggtgctgaaggtgtaatagttggaggaacaacaggagagggccaccttatgagctgggatgaacacatcatgcttattggacatactgttaactgctttggtgctaaagttaaagtggtaggcaacacaggtagtaactcaacaagagaggctattcatgcaacagagcagggatttgctgtaggtatgcatgcggctctccatatcaatccttactatgggaagacctctatcgaagggttgatatctcattttgaggctgtcctcccaatgggtccaaccattatttacaatgttccatctaggactggccaggatattcctcctgcagttattgaggctgtttcaagtttcacaaacttggcaggtgtgaaagaatgtgttggacatgagagggttaagtgctacactgacaaaggtataaccatatggagtggtaatgatgatgaatgccatgattctaggtggaaatatggtgccactggagttatttctgtggctagcaaccttattcctggtctcatgcacgatctcatgtatgaaggggagaataagacgctaaatgagaagctctttcccctgatgaaatggttgttttgccagccaaatccaattgctctcaacactgccctggctcagcttggagtggtaaggcctgttttcagattaccatatgtacctcttcctcttgaaaagagggtagagtttgtccgaatcgttgaatctattggacgggaaaactttgtgggtgagaacgaggcacgggttcttgacgacgatgattttgtgttggtcagtaggtactaa

SEQ ID NO: 72680 - protein, 353 aa, Oryza sativa
MASLLIASTGGAHRLAWKDAAALGPAPRLARPWPAAVAAPAPLLRTSTADITSLRVITAVKTPYLPDGRFDLEAYDSLINMQIDGGAEGVIVGGTTGEGHLMSWDEHIMLIGHTVNCFGAKVKVVGNTGSNSTREAIHATEQGFAVGMHAALHINPYYGKTSIEGLISHFEAVLPMGPTIIYNVPSRTGQDIPPAVIEAVSSFTNLAGVKECVGHERVKCYTDKGITIWSGNDDECHDSRWKYGATGVISVASNLIPGLMHDLMYEGENKTLNEKLFPLMKWLFCQPNPIALNTALAQLGVVRPVFRLPYVPLPLEKRVEFVRIVESIGRENFVGENEARVLDDDDFVLVSRY

SEQ ID NO: 72681 - DNA, 822 bp, Oryza sativa
  CDS (1)..(822)
atgcagatagaaggtggtgctgaaggtgtaatagtgggaggaacaacaggagagggccacctgatgagctgggatgaacacatcatgcttattgggcatacagttaactgctttggcactaaaattaaagtggtcggcaacacaggaagtaactcaacaagggaggctattcacgcaactgagcagggattcgctgtaggtatgcacgcggctctccacatcaatccttactacgggaagacctccgtcgaagggttgatctcccattttgaggctgttctcccaatgggtccaaccatcatttacaatgtgccatccaggactggccaggatattcctcctgctgttattgaggcggtttcaagtttttcaaacatggcaggtgtcaaagaatgtgttggacatgagagggttaagtgctatactgacaaaggtataaccatatggagtggtaatgatgatgaatgccatgattctaggtggaaatatggtgccactggagtcatttctgtagccagcaaccttattcccggtctcatgcgtaagctcatgtacgaaggggagaatacagcgctcaatgataagctacttcctctgatgaaatggttgttttgccagcctaatccgattgcgctcaacaccgccctggctcagcttggagtggcaaggcccgttttcagattaccttatgtacctctcccccttgaaaagagggttgagttcgtccgaattgtcgaatccattggacgggaaaattttgtgggtcagaaagaagcaagggttcttgatgatgatgattttgtgttgatcagtaggtattaa

SEQ ID NO: 72682 - protein, 273 aa, Oryza sativa
MQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRTGQDIPPAVIEAVSSFSNMAGVKECVGHERVKCYTDKGITIWSGNDDECHDSRWKYGATGVISVASNLIPGLMRKLMYEGENTALNDKLLPLMKWLFCQPNPIALNTALAQLGVARPVFRLPYVPLPLEKRVEFVRIVESIGRENFVGQKEARVLDDDDFVLISRY

SEQ ID NO: 72683 - DNA, 879 bp, Bacillus cereus
  CDS (1)..(879)
atgatagattttgggacaattgcaaccgcgatggtaacaccgtttgatataaacgggaatatcgattttgcaaagacaacgaaattggtaaattatttaattgataacggtacaacagcaatcgtggtaggaggaacgacaggagaatctcctacattaacttcagaagagaaagtagcgttatatcgccatgtcgtatctgttgtcgataaaagagtgcccgtaatcgctggaacaggtagcaataatacgcatgcttctattgacttaactaaaaaggcaacagaagttggtgtggatgcagtaatgctagtagcaccgtattataacaaaccgagtcaagaaggaatgtatcagcattttaaagcaattgctgaaagcacgccgcttccggttatgctatataacgttccaggacgatctattgtacaaatctccgttgatacagttgttcgtttatcagaaatagaaaacattgttgctattaaagatgccggcggcgatgtgttaacaatgacagaaatcattgaaaaaacagcggacgactttgcggtatacagcggtgatgacggtttaacgttaccagctatggcagttggagcgaaaggtatcgtttcggtagcctctcatgttatcggaaacgaaatgcaagaaatgattacagcatttcaagcaggagaatttaagaaggcacaaaaattacatcaattacttgtaagagtaactgattcattatttatggcgccaagtccaactccagtaaaaacagcgttacaaatggttggattagatgtaggttctgtacgtttaccacttcttccattaacagaagaagaaagagtaacgttacaatctgtaatgcaatctatccctcgttaa

SEQ ID NO: 72684 - protein, 292 aa, Bacillus cereus
MIDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMITAFQAGEFKKAQKLHQLLVRVTDSLFMAPSPTPVKTALQMVGLDVGSVRLPLLPLTEEERVTLQSVMQSIPR

SEQ ID NO: 72685 - DNA, 897 bp, Bacillus cereus
  CDS (1)..(897)
atgcaaaaaattaaaggggcatttccagtattaataacaccgatggatgaatttcaggaaattaattgggatggggtaaaacaaaatgtaaattactttatcgaacaaaaggttgcaggtattatcattaatggaagtacaggagagtttgtaagtttatcaaaagaagaacgatttaaaatggtagaaactgtgttgaaagaaattgatggccgtattcctgtcattgttggaactgcagcagagaccacaaaagaaacaattgaatatacgaaacatgcagaagcgcacggagcggattgtgcattaattataaactcttactattgtaaaccgaaggaagaggagatttattttcattttaaagaaatctcaaactctgtaaatataccaattatgctatacaataacccatttacttctggtgtcgatatgagtacagagctaatgctccgtattggaaaagagtgtgaaaatgttacacatattaaagaatctagcggagatattcgaaaagtaagagatttagtaagacaaagtgaaggggctttccaagtcttctgtggttctgaagatttagttatggaatcatatttagttggtgcctcgggatgggtttcagtagcaggaaatatcgttcccggtctcgttacaaaaatgtatgagcattttcaaaatggtgaattagaaaaggcgtgggaaataaacgatgctattttaccactttgcgagtttcttgaaggatcagggaaatatgttcaaatcgttaaacgttctatggaattacatgggcaagccggaggaccttctcgctatccaagactagggttaactgctgacgaagatcaaaagcttcaaatgattttatcaaatattgcagctcatgcagctgtttaa

SEQ ID NO: 72686 - protein, 298 aa, Bacillus cereus
MQKIKGAFPVLITPMDEFQEINWDGVKQNVNYFIEQKVAGIIINGSTGEFVSLSKEERFKMVETVLKEIDGRIPVIVGTAAETTKETIEYTKHAEAHGADCALIINSYYCKPKEEEIYFHFKEISNSVNIPIMLYNNPFTSGVDMSTELMLRIGKECENVTHIKESSGDIRKVRDLVRQSEGAFQVFCGSEDLVMESYLVGASGWVSVAGNIVPGLVTKMYEHFQNGELEKAWEINDAILPLCEFLEGSGKYVQIVKRSMELHGQAGGPSRYPRLGLTADEDQKLQMILSNIAAHAAV

SEQ ID NO: 72687 - DNA, 897 bp, Bacillus anthracis
  CDS (1)..(897)
atgaaaataattaaaggggcatttccagtattaatcacaccgatggatgagtttcaagaaattaattggaacggtgtaaaacaaaacgtaaactactttattgagcaaaaagtggctggcattattataaacggaagcacaggagagtttgttagtttgtcaaaagaagaacgatttaaaatggtagaaacagtattaaaagaagttaatggccgtattccggttattgttggaactgcagcagaaacgacgaaagaaacgattgaatttacaaaacatgcagaaacgcacggagcggactgcgcattaattattaactcatactattgtaagccaaaagaagaggaaatttattttcactttaaagaaatctcaaatgctgtaaatataccaattatgttatataataacccgtttacatctggtgttgatatgagtacagaactcatgctacgtatcgggaaagactgtgaaaatgttacacatattaaagaatctagcggagatattcgaaaagcaagagatttagtaagacaaggcgaaggtgcttttcaagtcttctgcggatctgaagatttagttatggaatcttatttagttggtgcgacgggatgggtttcagtagcaggaaatgtcgtaccgggacttgttacgaaaatgtatgagcattttcaaaatggtgaattagaaaaagcttgggaaataaacgatgcaattttacctctttgtgagttcctggagggatcagggaaatatgtgcaaatcgtgaaacgttctatggaattacaggggcaagctgggggaccttctcgttatccaagacttgggttaactgaagaagaagatcaaaaacttcaagcgattatttcaaaaattgcagctcatgcagctgtttaa

SEQ ID NO: 72688 - protein, 298 aa, Bacillus anthracis
MKIIKGAFPVLITPMDEFQEINWNGVKQNVNYFIEQKVAGIIINGSTGEFVSLSKEERFKMVETVLKEVNGRIPVIVGTAAETTKETIEFTKHAETHGADCALIINSYYCKPKEEEIYFHFKEISNAVNIPIMLYNNPFTSGVDMSTELMLRIGKDCENVTHIKESSGDIRKARDLVRQGEGAFQVFCGSEDLVMESYLVGATGWVSVAGNVVPGLVTKMYEHFQNGELEKAWEINDAILPLCEFLEGSGKYVQIVKRSMELQGQAGGPSRYPRLGLTEEEDQKLQAIISKIAAHAAV

SEQ ID NO: 72689 - DNA, 948 bp, Streptomyces avermitilis
  CDS (1)..(948)
atggagcttcacggtcgggctgccgagactgaccgtatgaccacacaaggaaccgcacagggaaccgctcccttcggccgtgcgctctgcgcgatgatcacgcccttcaccgcggcgggcacgctcgacctcgacggcgcgcggcggctcgccgaccggctggtctccgagggctgtgacgggctggtcctgtccggcaccacgggcgagtcgccgaccacgacggacgccgagaagtccgcgctggtgcgggcggtgcgcgaggcggtcggcgaccgggcgtcgatcgtggcgggcgtcggcacggccgacacacggcacaccgtggagctggccctggaggccgagaaggcgggcgcggacggcctgctggtggtcaccccgtactacagccggcccccgcaggaggcggtcgaggcacacttccgggacatcgccgacgcctccgggctgccgctcgtcctgtacgacatccccggccgcaccggcacacgcatcgagccggccacgatgatccggctcgcggaacatccccggatcgtggcggtcaaggactgcgcgtacgacctcctcggcacccagaaggtgctggcccgcacggagttggcgtactacacgggctgcgacgagtacgtcctcgcgctgtacgcgagcggcggggccggatatgtgagcacggtggcgaatgtggcgcccggccacttccggtcgattctcgacgcgttcgacgcgggcgacccggctctcgcggcccgtctccagcaacgggccgttccgctcatcgagtcgatgatggcggccggcctgccgggcacggtcacgtcgaaggccctgctcggccggctcggcctgccctcgggcccggtccgggcaccgctgcggcccgccggccgggagacggccgacgggctgctggcgctgtacgaggagttggtcagcgtgagctga

SEQ ID NO: 72690 - protein, 315 aa, Streptomyces avermitilis
MELHGRAAETDRMTTQGTAQGTAPFGRALCAMITPFTAAGTLDLDGARRLADRLVSEGCDGLVLSGTTGESPTTTDAEKSALVRAVREAVGDRASIVAGVGTADTRHTVELALEAEKAGADGLLVVTPYYSRPPQEAVEAHFRDIADASGLPLVLYDIPGRTGTRIEPATMIRLAEHPRIVAVKDCAYDLLGTQKVLARTELAYYTGCDEYVLALYASGGAGYVSTVANVAPGHFRSILDAFDAGDPALAARLQQRAVPLIESMMAAGLPGTVTSKALLGRLGLPSGPVRAPLRPAGRETADGLLALYEELVSVS

SEQ ID NO: 72691 - DNA, 900 bp, Streptomyces avermitilis
  CDS (1)..(900)
atggctccgacctccactccgcagacccccttcgggcgggtcctcaccgccatggtcacgcccttcgcggcggacggcgcactcgacctcgacggcgcgcagcggctcgctgcccacctggtggacgcaggcaacgacggcctgatcatcaacggcaccaccggcgagtccccgaccaccagcaacgcggagaaatcggatctcgtacgagccgtcctggaggcggtcggcgaccgagcccacatcgtcgccggcgtcggcacgaacgacacgcaccacagcatcgagctggcgcgcgcggcagagaaggccggcgcgcacggcctgctgaccgtcacgccgtactacaacaagcccccgcaggagggcctgtaccggcacttcacggcgatcgccgacgcgaccgagctgccggtgatgctctacgacatccccggccgcagcggcgtaccgatcagcaccgagacgatggtccggctcgccgagcacccgcggatcgtcgccaacaaggacgccaagggcgacctgggccgcgcgagctgggcgatcgcccgctcgggtctggcctggtactccggcgacgacatgctgaacctcccgctgctgtccgtgggtgccgtcggcttcgtctcggtggtcggccacgtggtcacgcccgagctgcgcgcgatggcggaggcgtacatcggcggggacgtccagaaggcgctggagatccaccagaagctgctgccggtgttcaccggtatgttccgcacccagggcgtcatgaccaccaaggccgccctcgccctccagggcctgcccgccggaccgctgcgcgcccccatggtcgagctctcgcccgaggagaccgctcagctcaagatcgatcttgccgccggcggggtacagctctaa

SEQ ID NO: 72692 - protein, 299 aa, Streptomyces avermitilis
MAPTSTPQTPFGRVLTAMVTPFAADGALDLDGAQRLAAHLVDAGNDGLIINGTTGESPTTSNAEKSDLVRAVLEAVGDRAHIVAGVGTNDTHHSIELARAAEKAGAHGLLTVTPYYNKPPQEGLYRHFTAIADATELPVMLYDIPGRSGVPISTETMVRLAEHPRIVANKDAKGDLGRASWAIARSGLAWYSGDDMLNLPLLSVGAVGFVSVVGHVVTPELRAMAEAYIGGDVQKALEIHQKLLPVFTGMFRTQGVMTTKAALALQGLPAGPLRAPMVELSPEETAQLKIDLAAGGVQL

SEQ ID NO: 72693 - DNA, 879 bp, Nitrosomonas europaea
  CDS (1)..(879)
atgttcacaggtagcctggtagctatcgttacacccatgctcgaagacggggcgctggatctcgacagattctgcgccctgatcgactttcatatcgaacagaaaacggatggtatcgtcgtggttggtaccacaggcgaatctcctaccgtggatttcgatgaacaccatctgctgatccgcacggctgtcacccacgcagccggacgcattccggtcattgccggcacaggcgccaattcgacgcgcgaagcaatcgagctgacggtattttcgaagaatgccggcgcagacgcctgcttatccgtagccccctattacaacaaacccacccaggaagggttgtaccaacacttcaaagcaattgccgaagcagtcgatatcccgatgattctgtacaacgtaccgggacgaaccgtagtagatatcagcaacgacactgcgttgcggctggcgcagattcccggtatcgtcggtatcaaagatgccactggcaacattgcgcggggatgtgatttattgcagcgtgtgcccgataatttcgcggtctacagcggagatgatgctactgcactggcactgctgctactcggcggtcatggcactatctcggtaacagccaatgtcgcaccccggctgatgcacgagatgtgcaccgctgcctttgccggtgacttggcccgggcacgggaaatcaatacccggctgttcaggctgcatattgatctgttcgtcgaagccaatccgattccggtcaaatgggccgtcgcaaggatgggattgatcaacgatagtctgcgcctgccattgacagctttatccagtcaatatcacgaactaatcagaaaagccatgctccaggctggcatcacggtttaa

SEQ ID NO: 72694 - protein, 292 aa, Nitrosomonas europaea
MFTGSLVAIVTPMLEDGALDLDRFCALIDFHIEQKTDGIVVVGTTGESPTVDFDEHHLLIRTAVTHAAGRIPVIAGTGANSTREAIELTVFSKNAGADACLSVAPYYNKPTQEGLYQHFKAIAEAVDIPMILYNVPGRTVVDISNDTALRLAQIPGIVGIKDATGNIARGCDLLQRVPDNFAVYSGDDATALALLLLGGHGTISVTANVAPRLMHEMCTAAFAGDLARAREINTRLFRLHIDLFVEANPIPVKWAVARMGLINDSLRLPLTALSSQYHELIRKAMLQAGITV

SEQ ID NO: 72695 - DNA, 906 bp, Enterococcus faecalis
  CDS (34)..(906)
aaggtttgtattgtatactcgggagggaatatgatggatttaacgaatgcaacaattattacggcaatggttacgccgtttcaagaatcgggagaaatagattttgataaactaccgcaattggtagactatttattggccaatcatacagaaggcgttattttagcaggaacaactggtgaatcacccacgttaactcatgaagaagaattacaattattccagcgaattattgaactgatcgatggacgtattccgattatttgtggtgtaggtacgaatgatacacgtgactcagtcgcttttgtgaaagagttagcgacaatcgctggtatcgatgctgttttggcggttgttccttattataataaaccaaatcaagaaggtatgtatcaacattttaaaaccatcgcagaagcaagtgaactgccaattattttgtacaatgttcctggtagaacggctgcatgtctagaagtggaaactactttgcgcttagcacaattggaaaaaattgtggcaattaaagaatgtgcagggttagatgcaattactgagttgattgaaagagcgccaaaagactttctagtgtatactggagaagacgggttggcttttgccaccaaggcacttggcggacaaggggttatttcggtagccagtcatgtcttcggttcgtcaatgtatgagatgtatcaagcgctggagcaggggaacttgccggaagcggctaaaattcaacgacagttattaccaaaaatgaacgcattgttttcagtgccttcgccggcacccgtgaaagcggccttaaatcatttaggtattcctgttggaaatttacgtttacctctagttgcttgtacaccagaagaagagcaaagaattattcgcacgttagagatttaa

SEQ ID NO: 72696 - protein, 290 aa, Enterococcus faecalis
MDLTNATIITAMVTPFQESGEIDFDKLPQLVDYLLANHTEGVILAGTTGESPTLTHEEELQLFQRIIELIDGRIPIICGVGTNDTRDSVAFVKELATIAGIDAVLAVVPYYNKPNQEGMYQHFKTIAEASELPIILYNVPGRTAACLEVETTLRLAQLEKIVAIKECAGLDAITELIERAPKDFLVYTGEDGLAFATKALGGQGVISVASHVFGSSMYEMYQALEQGNLPEAAKIQRQLLPKMNALFSVPSPAPVKAALNHLGIPVGNLRLPLVACTPEEEQRIIRTLEI

SEQ ID NO: 72697 - DNA, 870 bp, Coxiella burnetii
  CDS (1)..(870)
atgttcaatggcagtcttgtcgccttagtgacgccgatgcaggaaaatggagagattgattattccaatttgaaagaattggttgaatggcatctggaaaatgacaccgatggattggttattttggggaccacaggagagtcaccgacgatcaccgctgaggaacgccataaaattattcgacaagtcgttgaccaagtaaataaaaaaatcccgatcattgtgggaacgggtgcaaattctaccgttcataccattgaaatgacacagcaagcaatggaactcggcgcagatgctgctttaatagtaacgccttactacaataaacccacccaagaaggtctttttcaatactttaaaacaattgcagaagctgtacctattgcccaaatactttataatgtgccttcacgaactgcgtgtgatttgctgcctgaaaccgtaatacgaatagcgaagtgctccaatgtagtgggcctcaaagaggcgacaggcgatattcaacgggttaagcaattaaaagctgaggacttggatttattaagtggtgatgataaaacggcaatggattttatgctagcgggtggaaagggggttatttcagtggtggcgaatgtggttcccaaaccctatcacgcgttttgcataacggctgtttcgggtaacgtagagttggcgaaaaaagaaaatgatcaattgtcacctctctatgattcattgtttgttgaatccaatcctattccggtaaaatgggcattgtctcaaatgggggtaattcctaagggcattcgattgcctttaactccattgagcgagcgatatcacgctaaagtgagagaatctctgcaacaagtgggcattaaatgctag

SEQ ID NO: 72698 - protein, 289 aa, Coxiella burnetii
MFNGSLVALVTPMQENGEIDYSNLKELVEWHLENDTDGLVILGTTGESPTITAEERHKIIRQVVDQVNKKIPIIVGTGANSTVHTIEMTQQAMELGADAALIVTPYYNKPTQEGLFQYFKTIAEAVPIAQILYNVPSRTACDLLPETVIRIAKCSNVVGLKEATGDIQRVKQLKAEDLDLLSGDDKTAMDFMLAGGKGVISVVANVVPKPYHAFCITAVSGNVELAKKENDQLSPLYDSLFVESNPIPVKWALSQMGVIPKGIRLPLTPLSERYHAKVRESLQQVGIKC

SEQ ID NO: 72699 - DNA, 921 bp, Streptomyces cinnamonensis
  CDS (1)..(921)
atgaccctcgcatcgagcctcgaaccgaccaccgaaccgctcttcaacggcctgtacgtccccctggtaactccgttcaccgacgatctgcgcctggcccccgaggcgctggcccgactcgccgacgaggcgctgtcggccggcgcctccgggctcgtcgccctcggtacgaccgccgaggccgccacactgaccgccgaggagagagagacggtgatccgcgtctgctcggccgcgtgccgggcacacggggcaccgctcatcgtcggggtgggcaccaacgacaccgccaccgccatcacggccctgcgagagctggcggcccggggtgacgtcgccgccgcgctggtccccgcgccgccctacatccgccccggggaagcggggaccctggctcatttcgccgcgctggccgagcacggcggcctccccctggtcgtgtacgacatcccttaccgcaccgggcagacgctcggcgcgggcacgatcaccgcactcggccgcctgccggaggtcgtcggcatcaagcacgcgaccggctcgatcgacccgaccaccatggagttgctcgactcgcccctgcccggcttcgccgtgctcggcggtgacgacatcgtcctctcgccgctggtcgctgcgggcgcccacggcggaatcgtggcgtcggccaatctgcgtaccgccgactacgccgagatgatcgcgctgtggcgacgcggctccgccgcacccgcccgcgctctcggagccgacctcgcccgcctttccgccgccctcttcaccgaaccgaacccgacggtgatcaagggagtgctgcacgcccagaaccgcattcccagcccggccgtccgcatgccactgctggccgcctccgccgattcggtccgccgggcggcacccctggccgcgagccggaagtga

SEQ ID NO: 72700 - protein, 306 aa, Streptomyces cinnamonensis
MTLASSLEPTTEPLFNGLYVPLVTPFTDDLRLAPEALARLADEALSAGASGLVALGTTAEAATLTAEERETVIRVCSAACRAHGAPLIVGVGTNDTATAITALRELAARGDVAAALVPAPPYIRPGEAGTLAHFAALAEHGGLPLVVYDIPYRTGQTLGAGTITALGRLPEVVGIKHATGSIDPTTMELLDSPLPGFAVLGGDDIVLSPLVAAGAHGGIVASANLRTADYAEMIALWRRGSAAPARALGADLARLSAALFTEPNPTVIKGVLHAQNRIPSPAVRMPLLAASADSVRRAAPLAASRK

SEQ ID NO: 72701 - DNA, 879 bp, Vibrio parahaemolyticus
  CDS (1)..(879)
atgttttcaggaagtatcgtagcgctgattacaccattcaaagcagatggtgaagtagatttcgacggtctacaaaagctagtggagtaccacatcgaagcgggtacagacggtattgtggcagtaggcacgacaggtgagtcagcgacactgaccattgaagagcatgtaaaggtcgttaataaaactgttgagtttgccaacggtcgcatccctgtgattgccggcacgggtgcaaatgcaacccacgaagccgtgacatttagcaaattactcgcggattctggtatcgcaggtttcttgagtgtgacgccttattacaacaaaccaacacaagaaggtttgttccagcattacaaagcgatcgcagaagcgagtgacgtacctctaattttgtacaatgtaccgggtcgtactgccgtagatctgcaacctgagacagtggcacgcttgtcaaagcttgataatatcgttgctctaaaagatgcgacgggcgatttgagccgaattgcacttcaccgtgaactttgtggcaaagattttatcttactaagtggtgatgatgcgacgggcttggaattcgtgaaactgggcggcaatggtgttatctcggtaacgaacaatattgcagcgaaagacatggcagacatgttccatttggcaagtgaaggtaaattcgaagaggcagaaatcattaaccaacgtttgatgactctgcataaaaacctattcgttgaatcaagcccgatcccagtaaaatgggcagcgcataagctgggtttgattgaagaaggtggcttgcgtcttcctttaaccgcactttctgaaaaatcgcagccgatcgtggaacaggcgttgacagacgcaggtatttactag

SEQ ID NO: 72702 - protein, 292 aa, Vibrio parahaemolyticus
MFSGSIVALITPFKADGEVDFDGLQKLVEYHIEAGTDGIVAVGTTGESATLTIEEHVKVVNKTVEFANGRIPVIAGTGANATHEAVTFSKLLADSGIAGFLSVTPYYNKPTQEGLFQHYKAIAEASDVPLILYNVPGRTAVDLQPETVARLSKLDNIVALKDATGDLSRIALHRELCGKDFILLSGDDATGLEFVKLGGNGVISVTNNIAAKDMADMFHLASEGKFEEAEIINQRLMTLHKNLFVESSPIPVKWAAHKLGLIEEGGLRLPLTALSEKSQPIVEQALTDAGIY

SEQ ID NO: 72703 - DNA, 915 bp, Vibrio parahaemolyticus
  CDS (1)..(915)
atgaaagtagattggaaaggtgtttatccggcggtcagtacgcagtttcgtcaagatcagtccattgacctagacgcaacacaaaccgttatcgataaccaaattaaagatggtgtgaacggtattatttgccttggtacggtaggtgagaactgcgcgctatatccggaagaaaagcgtcaggtgctacaagctgccaaagaagtggttaatggtcgtgttcctcttattgctggtacggcagagtcaattaccacagcggctatcgattacatgcaagacgcgcacaaaattggtatcgacgggtgtatggtgatgcctgcgatggtctaccgcacgtctgaaagcgaaacatatgattactaccgcacgctggcagaagcgacaccagagatgcctatcatgatttacaacaaccctgttgcgtacggcgtcgatgtaaatctcgatatcatggcgaagctggctgagtttgacagcattgttgcaatcaaagagtcgactaccgacacgcgtcgtatcactgagctttacaacaagttcgatgatcgttttaccgtgttcagcggtgttgatgatattgcgcttgagtcgctgatgttaggagcgacaggctggatttctggcttaaccaatgcgttcccagaagaatcagttgcaatttacaagctggcgagccaaggccgttatgcagaagcgttagaaatttaccgttggttcttaccgctgctgcgtctcgacaccattcctacgctggttcaatgcattaagcttgctgaacaagtgtgtggccgtggttcagagcaagttcgtgcaccgcgccaactgcttaaaggtgaggagcgtcaacaagtgatccagatggtggagcacgcgcttgctacccgcttagacctatcaaaatacaatctgtaa

SEQ ID NO: 72704 - protein, 304 aa, Vibrio parahaemolyticus
MKVDWKGVYPAVSTQFRQDQSIDLDATQTVIDNQIKDGVNGIICLGTVGENCALYPEEKRQVLQAAKEVVNGRVPLIAGTAESITTAAIDYMQDAHKIGIDGCMVMPAMVYRTSESETYDYYRTLAEATPEMPIMIYNNPVAYGVDVNLDIMAKLAEFDSIVAIKESTTDTRRITELYNKFDDRFTVFSGVDDIALESLMLGATGWISGLTNAFPEESVAIYKLASQGRYAEALEIYRWFLPLLRLDTIPTLVQCIKLAEQVCGRGSEQVRAPRQLLKGEERQQVIQMVEHALATRLDLSKYNL

SEQ ID NO: 72705 - DNA, 867 bp, Pseudomonas putida
  CDS (1)..(867)
atgtcgaatttccgtggtatctggatcgccctcgtcacgccaatgcgcgccaatgaaatcgacttcccaggcctggaaaagctggtgaagaagctgctcgaagacggtgtggccggttttgtagtgtgcggtaccacgggtgaggcagcggcgttgtccaaggccgagcaactggcagtgctggatgccgtgctggcctgggttgagcctggcaggatggtgatgggcctgtcaggttacaacctgcgtgagttgctggccttccaggctgaaatccagcagcgtgacattggcgggctgctggtgcccgcaccttgctatatccgcccttcgcaggccggcatcgaagccttcttcgccaccgtggccgatgcggccagcgtgccagtgatcgtctacgacattccctaccgcacaggcgtacgcatcgaacgtgaaaccctgcgccgtatcgtgcgccatccacgcattgcagcggtgaaagactgtggcggtgacagcgagacgaccatggccctgatcgaggacggccacgcccaggtgctggccggtgaagacctgcagatcttcaacaacctgtgcctgggtggggcaggggccatttcagcctccgcacatgtgcgcgccgacctgtacgtacgcatggtgcggcaggttgacagcggtgattgggctgccgcgcgtggtacgttctaccagttgctgccctggatcaaagtggcctttgccgagcccaacccggccgtggtcaaggcggcattgcagctgcaaagcctgattgcagacgagctgcgcgagcccatgcagacgtgcacgaataccacccgagacaaactgcaaagcgtgctgtgttcactcggcgcctga

SEQ ID NO: 72706 - protein, 288 aa, Pseudomonas putida
MSNFRGIWIALVTPMRANEIDFPGLEKLVKKLLEDGVAGFVVCGTTGEAAALSKAEQLAVLDAVLAWVEPGRMVMGLSGYNLRELLAFQAEIQQRDIGGLLVPAPCYIRPSQAGIEAFFATVADAASVPVIVYDIPYRTGVRIERETLRRIVRHPRIAAVKDCGGDSETTMALIEDGHAQVLAGEDLQIFNNLCLGGAGAISASAHVRADLYVRMVRQVDSGDWAAARGTFYQLLPWIKVAFAEPNPAVVKAALQLQSLIADELREPMQTCTNTTRDKLQSVLCSLGA

SEQ ID NO: 72707 - DNA, 870 bp, Lactobacillus plantarum
  CDS (1)..(870)
atgaatttagcatccgcacacctgattaccgccatggtcaccccatttgatgaccaacaacacattgatttccaccgcttagagcaactgatcgaacacttacttgcaactggcacggacggcttattagtcgggggcacgactggcgaaggccccacgttgagcatcgctgagaaacgagatttatacacgcagacagctaggatcgttgctgggcgagttccaatcatcgctaatacggggaccaatgacactgccgccacaattcatttcactcacattgtcagtcaaatcgagggcatcgacgccgccctcgtcgttgtcccgccttataacaaacccaaccaaaccgggatgatggcgcattttacagccattgccgaaaaatcagacttgcccattataatttataatattcccggtcgcgtaggcgttaagatgacggtcacgacgattctcacgttggcccacaaccccaacattattgggatcaaacaatgtggttccgatgaagaactggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcgccttgaaccacggcgatatcacccaagcagggcaaattcaacgacgtttaatgccgaagatggcagcactattcacacaaccctcaccggcacccgtcaaagcggcgctgaacgcccaacactggttagtcggaagcacgcgcctaccaattttaccgttaaccaccaatgaacaaagtcaactactcaacagcttaaaataa

SEQ ID NO: 72708 - protein, 289 aa, Lactobacillus plantarum
MNLASAHLITAMVTPFDDQQHIDFHRLEQLIEHLLATGTDGLLVGGTTGEGPTLSIAEKRDLYTQTARIVAGRVPIIANTGTNDTAATIHFTHIVSQIEGIDAALVVVPPYNKPNQTGMMAHFTAIAEKSDLPIIIYNIPGRVGVKMTVTTILTLAHNPNIIGIKQCGSDEELAAIVEKAPKDFLVYTGEDAQSLTTLVLGGQGTISVASHLFGNEMATMRRALNHGDITQAGQIQRRLMPKMAALFTQPSPAPVKAALNAQHWLVGSTRLPILPLTTNEQSQLLNSLK

SEQ ID NO: 72709 - DNA, 873 bp, Lactobacillus plantarum
  CDS (1)..(873)
atgaactttgcaaacgttgatttgatgaccgcaatggtgacccctttcgatgatcaccaacaattggacgaaaagcggttagcaagtttgattgaacatttattggcacacggcacccaaggtattctggtgggtgggacaactggtgaagcaccaacgctaaccgaagatgaaaaattaaccttactaaagaaagcagctgagattgtcgatggtcgggtaccaatcgtggccgggaccggctcaaacagtaccgctgctaccatcgcatttactaagaaggttagtcagattaaggggattgatgcagctttagtggtggttccctactacaacaagcctgatcaagctggtatgattgcccactttacagcggttgctgatcaaggtggcttaccagttattatttataatattccgggccgggttattgtgaagatgaccgtggccacgatcttaacattagcacaaaatcccaatattattgggattaagcagtgtgcgacgatggaagagtttggcgcgattgtcgaaaatgcaccggctgattttcttgtttatactggtgaagattctcagagtttggctgccaaggaaattggtggtgctggggttatctcagtggcaagtcatatctatggtgacgaaatgacggcgatgtttagtgccatcgaccagggtgagattgccacggccgctaagtatcaacgggacttaacacccaagatgagtgccttgtttagtgcaccatcgccatcgccagttaaagcggccttaaatcatttgggtcagccggtgggtgaaccacggttaccaatcttaccattgagtactgaacaaacggctcagctttttaaaacattaaacatttag

SEQ ID NO: 72710 - protein, 290 aa, Lactobacillus plantarum
MNFANVDLMTAMVTPFDDHQQLDEKRLASLIEHLLAHGTQGILVGGTTGEAPTLTEDEKLTLLKKAAEIVDGRVPIVAGTGSNSTAATIAFTKKVSQIKGIDAALVVVPYYNKPDQAGMIAHFTAVADQGGLPVIIYNIPGRVIVKMTVATILTLAQNPNIIGIKQCATMEEFGAIVENAPADFLVYTGEDSQSLAAKEIGGAGVISVASHIYGDEMTAMFSAIDQGEIATAAKYQRDLTPKMSALFSAPSPSPVKAALNHLGQPVGEPRLPILPLSTEQTAQLFKTLNI

SEQ ID NO: 72711 - DNA, 885 bp, Clostridium tetani
  CDS (1)..(885)
atgagtatatttaaaggttctggagtagctatagtaacacccttttgtgaaaatggtgttaattttaaaaagcttgaggagcttattgaatggcatatagaaaatagtaccgatgctatagtaatatgtggaactactggagaagcatctactatgactgaagctgaaataaaagaaactattaagtttactgtggacaaggttcaaggacgaattccagtaatagctggtactggcagtaataacactagaaaagctattgagttaagtaagtgggctaaatccataggagtagatggtttactactcataacaccttattataataaaacaactcaaaagggcattgttgagcattttaaggcaattaacgatgatgttgatgtgcctataattctttataatgttccgggtagaactggacttaatatactacctaaaacactagttaaaatatgtgatacatgttcaaatgtagtagctataaaagaagctagtggtgatttaagtcaaattattgaaatgaaagctttgttaaaggatagaatagatatttattcaggtaatgatgaccaaattatccctatactttctataggtggtattggtgtaatttctgttttagcaaatattatgccaaaagaagttcatgatatgtgtgaactttatttaaaaggtaaaacaaaaaaagctttagaaattcaattaaataccctttctcttacgaactcattattcatagaaactaatcctattcctgtaaaaacagcaatgaatattatgggaatagatgtaggtgaactaaggcttccgctatgtaatatggatgaaagtaatttaaacctattaaaaaaagagctatcaaatcatgctcttattaagtaa

SEQ ID NO: 72712 - protein, 294 aa, Clostridium tetani
MSIFKGSGVAIVTPFCENGVNFKKLEELIEWHIENSTDAIVICGTTGEASTMTEAEIKETIKFTVDKVQGRIPVIAGTGSNNTRKAIELSKWAKSIGVDGLLLITPYYNKTTQKGIVEHFKAINDDVDVPIILYNVPGRTGLNILPKTLVKICDTCSNVVAIKEASGDLSQIIEMKALLKDRIDIYSGNDDQIIPILSIGGIGVISVLANIMPKEVHDMCELYLKGKTKKALEIQLNTLSLTNSLFIETNPIPVKTAMNIMGIDVGELRLPLCNMDESNLNLLKKELSNHALIK

SEQ ID NO: 72713 - DNA, 951 bp, Bradyrhizobium japonicum
  CDS (1)..(951)
atgccctccgtctcaggttttttcccgagaaggagactggacatgaccgacctgcgaacgcatctgcacggactctggctgccgctggtgacgccgtttcgagacggcaagctcgacgagacgtcgctgcggcggctgacgcgacattactgcggacaggccgtcgacggcttcatcctgggggcgacctcgggtgaaggcatgacgctgcgggacgccgagctcgaacgcctcgtcgccatcgtccgcgacgagatggcggccggccgccgaacgttgcctatctgcctcggaatgtcgggcgcggacacctcgcggctgaaggagcgccttgatgaaaccgcggactggccgatcgacggctatttgatcgcgagcccctattacgtgcggccgtcgcagcgcgggctcctggcgcatttcgaagcacttgccgaccacgccgcctggccgctcgcgctctacaacattccctatcgctgcgcggtcaacatcaccaaccagaccatgctgcggctcgccgagcaccccaacatcgtcggcctgaaggattgcggcgccagccgcgagcagtcgatcgcgctgctgcgcgaccggccggacggttttcgcgtgctcaccggcgaggacgcgaactacctcgaggcgctcaccgacggcgccgatggcggcatcgtgctgtcagcccatgtcgagaccgcgacgttcgcggccgtgtatgccgagctgaagcgcggcaaccgcgacgcggcgcaggcgcgctggcaggaggtcgccgagctgacgcgcctgttgttcaccgagcccagccccgcgccggccaagcactggctgtggcgcagcggcctgatcgacagccccgaagtgcgcctgccgatggtggaagtcagcagcgagctcgccgccacgatcgaccgcgagatcgagcggcggatgaaagtcgcggcgtag

SEQ ID NO: 72714 - protein, 316 aa, Bradyrhizobium japonicum
MPSVSGFFPRRRLDMTDLRTHLHGLWLPLVTPFRDGKLDETSLRRLTRHYCGQAVDGFILGATSGEGMTLRDAELERLVAIVRDEMAAGRRTLPICLGMSGADTSRLKERLDETADWPIDGYLIASPYYVRPSQRGLLAHFEALADHAAWPLALYNIPYRCAVNITNQTMLRLAEHPNIVGLKDCGASREQSIALLRDRPDGFRVLTGEDANYLEALTDGADGGIVLSAHVETATFAAVYAELKRGNRDAAQARWQEVAELTRLLFTEPSPAPAKHWLWRSGLIDSPEVRLPMVEVSSELAATIDREIERRMKVAA

SEQ ID NO: 72715 - DNA, 876 bp, Bradyrhizobium japonicum
  CDS (1)..(876)
atgtccgaattccacggcgtcttcccctacctcgtctcccccgtcgatgccgacggcacggtgcggacgagcgtgctcgcaaagctctgcgacgacctgatcggtgccggcgtgcatggtctgacgccgctcggctcgaccggcgagttcgcctatctcaatgccgcccagcgcacggcggtcgtgcagaccacgatcgaagccgcgaagggccgcgtgcccgtggtggccggcgtcgcctccacctcgaccgcggatgcggtgacgcaggcacggacgtatcagaagctcggcgccgacggcattttggcgatcctggaggcgtatttcccgctcgccgatacccaggtcgaatcctatttccgcgccatcgcggacgccgtggacattcccgtcgtcatctacaccaatccgcaattccagcgctccgacctcaccctcgaaatcatcgcgcgcctcgccgagcatccgcgcattggctacatcaaggacgcctcgaccaacaccggccggctgctctcgatcatgaaccgctgcggcgatcgcctgcgcgtgttctcggcctccgcccacattccggccgcggtgatgctgatcggcgggctcggctggatggcgggacctgcctgcatcatcccgcgccagagcgtcgcgctctacgacctctgccgggcgggccgctgggacgaggccatggcgctccagcgcaggctgtggcggatcaacgaagccttcgcccgcttcaacctcgccgcctgcatcaaggccggcctttcgatccagggctacgacgtcggcgatcccatcccgccgcaggccgcgctgacggccgatgcgcgcaaggtggtggagacagcgctccgggagctggcgtag

SEQ ID NO: 72716 - protein, 291 aa, Bradyrhizobium japonicum
MSEFHGVFPYLVSPVDADGTVRTSVLAKLCDDLIGAGVHGLTPLGSTGEFAYLNAAQRTAVVQTTIEAAKGRVPVVAGVASTSTADAVTQARTYQKLGADGILAILEAYFPLADTQVESYFRAIADAVDIPVVIYTNPQFQRSDLTLEIIARLAEHPRIGYIKDASTNTGRLLSIMNRCGDRLRVFSASAHIPAAVMLIGGLGWMAGPACIIPRQSVALYDLCRAGRWDEAMALQRRLWRINEAFARFNLAACIKAGLSIQGYDVGDPIPPQAALTADARKVVETALRELA

SEQ ID NO: 72717 - DNA, 918 bp, Bradyrhizobium japonicum
  CDS (1)..(918)
atgttcactcctcctgctgcctggttcacgggcttcattccagacctgccgacgccgttcgacgcggctgacacaatcgatctcaaggcgttcaccgcgctctgcgagcgccagatcgcggctggcgtccccgcgatcgtggtctgcgagacggccggcgaggcgccgacgctctccccggccgagcaggagctcgtcattcgcgccgcggtggacgtcgcccgcggccgggtgcggatcatcgccggcgcgatgtcgaacgcgaccagccaggccatcgcgctcgcgcggtgcgcggaggccgccggcgccgatgccgtgatggcggtggtgccggcctacaacaagccgatgcaggaggggatgctcgcgcatttccgggccatcgccggtgcaaccggcttgcccgtgatcctgcacgatattccctcccgcacgctgcgcccgctcgccgacgagacgctggtgcgtctcgtcgaatcccgccagttcgtcggcctgcgcgatggaagctgcgacatcgcccgaccgatgcgcctcgcccggttgctcccggccggctttcgcctgctctccggcgacgacgtcaccgcgttcggctacatcgcaagcggcggcgacggcgccatctcggaagtctccaacatcgcccccgatctgtgccgcatgatcttctcgcaggtcaggcaaggccgcttgcaatcggcacgctacctgcacaggcgcctcatcccgctcatcacatgcctctccaaggacagcccggcggcgctcaagagcgcgctgagcgtgctcggcctgatgtcaccggcgacgaggctgccgatcgtgccgctggacgcggccgcgcagcgggaggtgatacgcgccttcgccgcgatcgccgacgaggagctgatcgaccgcgtcggcgcctga

SEQ ID NO: 72718 - protein, 305 aa, Bradyrhizobium japonicum
MFTPPAAWFTGFIPDLPTPFDAADTIDLKAFTALCERQIAAGVPAIVVCETAGEAPTLSPAEQELVIRAAVDVARGRVRIIAGAMSNATSQAIALARCAEAAGADAVMAVVPAYNKPMQEGMLAHFRAIAGATGLPVILHDIPSRTLRPLADETLVRLVESRQFVGLRDGSCDIARPMRLARLLPAGFRLLSGDDVTAFGYIASGGDGAISEVSNIAPDLCRMIFSQVRQGRLQSARYLHRRLIPLITCLSKDSPAALKSALSVLGLMSPATRLPIVPLDAAAQREVIRAFAAIADEELIDRVGA

SEQ ID NO: 72719 - DNA, 927 bp, Bradyrhizobium japonicum
  CDS (1)..(927)
atgagccgccgcgtttcctgggaaggcgtcttcccggccgtcaccacgcaattccacgacgatctctcgctcgacatcgacgcgaccgcgaaggtgatggacggactgatccgcgacggcgtctccggcctgatcgtctgcggctccgtcggcgagaacacgtcgctggagcgcaaggagaaggtcgcgatcatggagacggcgaaatccgtcgcggccgggcgcgtgcccgtgctgtgcggcatcgccgagttcaccacggccttcgcggtcgagacggccaaggaagccgcgcgtgtcggcatcgacggcgtcatggtgatgccggccctggtctattcgtcgaagccgcacgagaccgccgcgcatttccgcgccgtcgccaccgcgacggaccttcccgtgatgctctacaacaacccgccgatctacaagaacgacgtcacccccgacatcctggcctcgctcgccgacgtcgagacggtcgtctccttcaaggattcctccggcgacacgcgccgcttcatcgacacaaggaacatggtcggcgaccgcttcgtgctgttcgcaggcctcgacgacgtcatcgtcgagagcgtcgccatgggcgccgtgggctgggtctccggcatgtcgaacgccttcccgcgcgagggcgagacactgtttcgcctggccaaggcgggacgctatgccgaggcgatgccactctacgaatggttcatgccgctcttgcatctcgatgcgcgcccggacctcgtccagtgcatcaagctgtgcgagcacatcatgggccgcggcacggtgctgacccgtccgccccgcctcgccctgctgccgcaggaaaaggccgaggtcgaggccatgatggtgaaggcgctcaagagccggccgcgtctgccggatgttgggctgaaggcggcctga

SEQ ID NO: 72720 - protein, 308 aa, Bradyrhizobium japonicum
MSRRVSWEGVFPAVTTQFHDDLSLDIDATAKVMDGLIRDGVSGLIVCGSVGENTSLERKEKVAIMETAKSVAAGRVPVLCGIAEFTTAFAVETAKEAARVGIDGVMVMPALVYSSKPHETAAHFRAVATATDLPVMLYNNPPIYKNDVTPDILASLADVETVVSFKDSSGDTRRFIDTRNMVGDRFVLFAGLDDVIVESVAMGAVGWVSGMSNAFPREGETLFRLAKAGRYAEAMPLYEWFMPLLHLDARPDLVQCIKLCEHIMGRGTVLTRPPRLALLPQEKAEVEAMMVKALKSRPRLPDVGLKAA

SEQ ID NO: 72721 - DNA, 906 bp, Bradyrhizobium japonicum
  CDS (1)..(906)
atgaagacgttccgcggcacctacaccgtcatgatcaccccgttcacggcagcgggggaggtcgatgtcgcagccttgcgcgccttcgtcgactggcagatcgcggagggcattcatgggctgatcccgctcggctcgaccggcgaattcctgtctctcgacgacgacgagaaggcgctggtggcggaggtcgtcatcggccaggccgcggggcgcgtgcccgtgctgatcggcaccggtgcggaggatacgcgcgaggtggttcgcctcagccgccgtgccgaaaagctgggcgccgacggcgtcatgatcattccgccgttctattcgacgccgaccgacgatgagctcgtccatcactacaagacggtggccgacgcgatcgcgctgccgatcatggtctacaacaacccggcgaccgccaatgtcgatctcaagccacagctcgtggcgcgcatcgccgagattgacaactgtctctatatcaaggagtcgacgctggaggtgacgcgggtgcgcgacatcatccggctctgcggcgacaggatgaccgtgttcggcggcatcctcggcttcgaatccttcgtcgagggcgcgcaaggctgggtcgcggtggcctccaatgtggtgccgtccgagatggcgcgcatcttcagcctcgtcgcagacgagggcgccatcaaggaggcgcgcgagctctatctgaaatatctgccggtgatcgagttcgtcggcggccaggcctatgtcgccggcagcaaggcgctgctcggccatatgggccttgcggtcggcggcccgcgcccgccgcgactgccgctgccggccgcacaggacgcggccgcgctggcgctggtcaagtcgttcggtctggcgtggcgcggcgcgtccattgcagccgcttaa

SEQ ID NO: 72722 - protein, 301 aa, Bradyrhizobium japonicum
MKTFRGTYTVMITPFTAAGEVDVAALRAFVDWQIAEGIHGLIPLGSTGEFLSLDDDEKALVAEVVIGQAAGRVPVLIGTGAEDTREVVRLSRRAEKLGADGVMIIPPFYSTPTDDELVHHYKTVADAIALPIMVYNNPATANVDLKPQLVARIAEIDNCLYIKESTLEVTRVRDIIRLCGDRMTVFGGILGFESFVEGAQGWVAVASNVVPSEMARIFSLVADEGAIKEARELYLKYLPVIEFVGGQAYVAGSKALLGHMGLAVGGPRPPRLPLPAAQDAAALALVKSFGLAWRGASIAAA

SEQ ID NO: 72723 - DNA, 930 bp, Bacteroides thetaiotaomicron
  CDS (1)..(930)
atgaataacaaaatgaatattcctttatcaggaattattcctccgttggtaactcccttgttggacgatgatgtgttggatgtggaaggtttgcaaagattgatcgaacatctgatagcagggggagtacatgctctttttgtgttgggaactaccggtgaatcacagagcctcagttataaattgaggatggaaatgattaaaaatacctgccgtatagcgaaaggacggttgccggtattggtatgtatttccgatacttcgattgtggagagtgtgaaccttgcctgccttgcggcagatcatggagccgatgccgtcgtttccgctcctccttactactttgcgacaggtcagcccgaactgatcgagttttatgagcatctgctgcctcagttgccgttaccattattcttgtataatatgccgactcatacaaaggtgaactttgcaccggctacgattcagcggatagcggagaatcccggcgtaatcggttttaaagacagttcggcaaatacggtttatttccagtcggtgatgtatgccatgaaagataatccggatttctcgatgctggtgggaccggaagaaattatggcggaatccgtactgctgggggctcatggcggcgtaaacggtggtgcgaatatgttccccgaattgtatgtgagcttatacaacgctgcgaagaatgcagatatggaagaagtgagacgtttgcaggaaaaagtaatgcaaatcagtgctacgatatatacggtagggcaacatgggtccagttacctgaaaggtctgaaatgtgctctcagtctactcggaatatgcagcgattatgtggctgcgcctttccataagttcgaacaacgggaaagaggaaaaatatggaaggcacttcaaaatttgggagttgatgtagtgctcaggtaa

SEQ ID NO: 72724 - protein, 309 aa, Bacteroides thetaiotaomicron
MNNKMNIPLSGIIPPLVTPLLDDDVLDVEGLQRLIEHLIAGGVHALFVLGTTGESQSLSYKLRMEMIKNTCRIAKGRLPVLVCISDTSIVESVNLACLAADHGADAVVSAPPYYFATGQPELIEFYEHLLPQLPLPLFLYNMPTHTKVNFAPATIQRIAENPGVIGFKDSSANTVYFQSVMYAMKDNPDFSMLVGPEEIMAESVLLGAHGGVNGGANMFPELYVSLYNAAKNADMEEVRRLQEKVMQISATIYTVGQHGSSYLKGLKCALSLLGICSDYVAAPFHKFEQRERGKIWKALQNLGVDVVLR

SEQ ID NO: 72725 - DNA, 894 bp, Bacteroides thetaiotaomicron
  CDS (1)..(894)
atgatacagactaaattgaaaggaatgggggtagcactgattactcctttcaaagaggatgaaagcgttgattatgatgcgttgatgcgtttggtagactatctattgcagaataatgcggatttcttgtgtgtgctggggactacagccgaaacaccgactcttaccgaagaagagaagaaaaccatcaaaaagatggtgattgaccgcgttaacggaagaattcctattttgctgggtgtaggcggtaacaatacacgtgcaatagtagaaacattgaaaaatgacgattttacaggagttgacgctatattgtctgtagtgccatattataataagccatcgcaagagggaatttatcagcattataaagccatatcggaagctacggaacttcctatcgtgttgtataatgtgccggggcgtacaggagtaaatatgactgctgagacgaccttgcgcattgctcgtaattttagtaatgtaatcgctattaaagaagcttccggtaatattactcaaatggatgacattatcaagaataaaccagataatttcaatgttatttccggtgatgacggtattacttttccgttaataaccttgggagctgttggagtgatctctgtaatcggcaatgctttcccgcgtgaattcagccgtatgacacgtttggcgcttcaaggtgattttgctaatgcactcactattcatcatcgatttactgagctatttgatcttttgtttgtggatggaaatccggcaggagtaaaatccatgctgaatgcaatggggatgattgaaaataaacttcgattgccgttggttccgactcgaattacgacatttgaggcaatacgtaaagtcttaaacgaactgaatattaaatgttga

SEQ ID NO: 72726 - protein, 297 aa, Bacteroides thetaiotaomicron
MIQTKLKGMGVALITPFKEDESVDYDALMRLVDYLLQNNADFLCVLGTTAETPTLTEEEKKTIKKMVIDRVNGRIPILLGVGGNNTRAIVETLKNDDFTGVDAILSVVPYYNKPSQEGIYQHYKAISEATELPIVLYNVPGRTGVNMTAETTLRIARNFSNVIAIKEASGNITQMDDIIKNKPDNFNVISGDDGITFPLITLGAVGVISVIGNAFPREFSRMTRLALQGDFANALTIHHRFTELFDLLFVDGNPAGVKSMLNAMGMIENKLRLPLVPTRITTFEAIRKVLNELNIKC

SEQ ID NO: 72727 - DNA, 927 bp, Oceanobacillus iheyensis
  CDS (1)..(927)
atgagtacgaaatacgatgctataaaaaaaagattgagaggttcaatcgcaccggtaatcacaccatttaaagtgaacggagatattgattttaaaaaacagtctgaattaatcgagtttcaaattgaaaatggaacacatgcgatttctgtaacgggtacttctggagaaccaagctcgcttactacagaagagcgtgttcaagtaatggaaaatgcaatcaaaactattaatggtagaattccgttcgctccgggaactggatctactaaccatgatgaaacaatgtacgtaacaaagaaagcggaagaaatgggcgcagatgccgcaatggttattgttccttattataataaaccaaaccaggaagcattgtatgatcatttcaaaacagtagctgattccgtagatattccgattatcatctataatataccaggacggactgcgcaaaatatggaagtgaaaacgatggcgcgtctagtaaaagattgtcctaatattgttggagcgaaggaatcaaataaagactttgaacatgttaatagagtattgcttaactgtggcagagacttcttattgttttcaggaattgaacttttatgctacccaatgctagcaattggaggagctggatccattagtgcaacagctaacgtggagcctaagaaggtagcagaaatgcataatgcttgggaagaaggggacatcaaacgagcgcaggatcttcactttgaattaatgaacctaaatgatgtgctgtttaaagatacaaaccctgccccagtgaaagctgcactcggaatgatgggcatgattgaacccgtattacgtagaccaatgggattgccttcagatgcattgcaagaagaaattcgtgacacccttgtgaaatacggaaaaatagaaaaaatagcttcggtttag

SEQ ID NO: 72728 - protein, 308 aa, Oceanobacillus iheyensis
MSTKYDAIKKRLRGSIAPVITPFKVNGDIDFKKQSELIEFQIENGTHAISVTGTSGEPSSLTTEERVQVMENAIKTINGRIPFAPGTGSTNHDETMYVTKKAEEMGADAAMVIVPYYNKPNQEALYDHFKTVADSVDIPIIIYNIPGRTAQNMEVKTMARLVKDCPNIVGAKESNKDFEHVNRVLLNCGRDFLLFSGIELLCYPMLAIGGAGSISATANVEPKKVAEMHNAWEEGDIKRAQDLHFELMNLNDVLFKDTNPAPVKAALGMMGMIEPVLRRPMGLPSDALQEEIRDTLVKYGKIEKIASV

SEQ ID NO: 72729 - DNA, 888 bp, Escherichia coli O6
  CDS (1)..(888)
atgccgaaaaccattgaaggtgtattaaccgccattgtcaccccgtttaccgcgaccggcagtctgaatatcccggcgttaaaagtgcaggtgaatcgtcaactggaagcgggtaacgcgattttttgcggcggcaccaacggcgagttttttgtgttgaatgaacaggagaagctcagcgttacgcaaacctgcgtggatgaagtggctggtcgtgcgccggtcgtggcacacattggcgagatctctacgcgcgaaacgattcgtctgggtcagcagattgaaaaacttggcgtagatgccgtgtcggtcattgccccttacttcgtaccgctgaaacaggaagagttgattgcgcattacagcgcaattgccgacgcactgagcattccgatgtttctctataacatcccggcccgcactggcaatacgatccagccagaaaccgcgcgtgctctggcgtcgcaccccaatatcattgggattaaagacagcgccggaagcgacgaaagcctgaagggttttctcgatgcggtgcgcgacattgacggctttaatgtgctcaacggcccggattcgctgatccataaagggtttgtcgagggatgttcaacctgtatctctgggctcgccaacatcgcgccgcgagaaatcaatgccatctggtctcgcttccatgccggtgatattgaagggtcttatgaagcacaggagagtgtaacgggcctgcgtaccgatctttataaagtagcattctccccggctgcggtgaaaaaagcgttgcagcttatggggcatgatgttggtgatagccgctacgcggttaatttcacgcctgaacagatcagcgagattcaacaaattattcgtcattataacattaattaa

SEQ ID NO: 72730 - protein, 295 aa, Escherichia coli O6
MPKTIEGVLTAIVTPFTATGSLNIPALKVQVNRQLEAGNAIFCGGTNGEFFVLNEQEKLSVTQTCVDEVAGRAPVVAHIGEISTRETIRLGQQIEKLGVDAVSVIAPYFVPLKQEELIAHYSAIADALSIPMFLYNIPARTGNTIQPETARALASHPNIIGIKDSAGSDESLKGFLDAVRDIDGFNVLNGPDSLIHKGFVEGCSTCISGLANIAPREINAIWSRFHAGDIEGSYEAQESVTGLRTDLYKVAFSPAAVKKALQLMGHDVGDSRYAVNFTPEQISEIQQIIRHYNIN

SEQ ID NO: 72731 - DNA, 918 bp, Brucella suis
  CDS (1)..(918)
atgtcgaaattttttggcgttgtccctcccgtcgtcactccgcttaacgatgaccattcggtcgattacgattcctatacccgcgttctcgaacatctgatcgaaggcggctgccatggcctttttgccctcggttccaccagcgaggtggtgttctatgacgaggcagaccggcgcaggattcttgaacatacggtgaaagtggcgaatggccgtgttccggtcattgccggtgtcatagacccggcgaccgaccgcgtgattgcccatgcaaaagccgcaaaggacgttggcgccgatgcggtcgtcgtcacggctcctttctatacaatcaccagccagcccgagatcatcgatcatttccgcatggtgcgcgatgcggtcgatattccgctgattgcctacgacatcccggtctgcgtccatgccaagcttacacgccagaccgtggtaacgcttgccaatgaaggcacgatcatcggcctgaaggattcctccggcgatgacggcaatttccgctatgcactgctcgatctggctaaaaacaaaaacatgttcctgatgaccggctcggaaatcgtggtggacaatgcgcttttgatgggcgcgcacggcgttgttcccggcctcgccaatgtcgatccggcaggctatgtgcggctttgggatgccgcgcagcgcggcgactgggtggccgcgcgcaaggaacaggagcgcctttgccgcctcttcgagatcgtctgggttggtgcggggcgcgtcagcggcggagccgcaggcgtcggcgctttcaagaccgcgatgcgcagtctcggcattatttccaccaacaagatggcgcgcccgcgccaggcgctgaatacggcggaagcaggccgcatagacgcgatcctgcgcagcgtcggcctcctggattga

SEQ ID NO: 72732 - protein, 305 aa, Brucella suis
MSKFFGVVPPVVTPLNDDHSVDYDSYTRVLEHLIEGGCHGLFALGSTSEVVFYDEADRRRILEHTVKVANGRVPVIAGVIDPATDRVIAHAKAAKDVGADAVVVTAPFYTITSQPEIIDHFRMVRDAVDIPLIAYDIPVCVHAKLTRQTVVTLANEGTIIGLKDSSGDDGNFRYALLDLAKNKNMFLMTGSEIVVDNALLMGAHGVVPGLANVDPAGYVRLWDAAQRGDWVAARKEQERLCRLFEIVWVGAGRVSGGAAGVGAFKTAMRSLGIISTNKMARPRQALNTAEAGRIDAILRSVGLLD

SEQ ID NO: 72733 - DNA, 953 bp, Phytophthora infestans
  CDS (1)..(879)
atgacccccaacttgcaaggagcttttaccgcactcgtgacgccctttacagaggacggcagcgctgtcgactacgccaagctgcgtgagcttgtggagtggcagatccaggagggtatcaacggtctcgtgccgatgggcacgacgggcgagtgccccacggtctcccacgaggagcacgaccgcgttgtctcggaggtggtggctacggtcaatggccgcgtgcctgtgattgccggtacgggctccaacaacactgcggaggctctgcgtctcactcgcgcggccaaggacgccggtgccgacgcctgcctggtggtttgcccgtactacaacaagcccacgcagaagggtctgtacgcccacttcaaggccgtggccgaggtgggtctgcctgtggtggtgtacaacatccccggccggaccaacgtcaacctgacgccacagacaattgctgagctagccaagcttcccaacatcgtggccatcaaggagtcgaccggctcgctggaccaggccatggagatcgctgcgctctgcgacatcactatcctgtcgggcgacgacaacctgaccctgccgcttatggccatgggcgccaagggcgtcatcagtgtactctccaacgcctctcccaagaaggtgctggctgtcactgaccccatgctcaagggtgactacgctgccgcccgcaaggctgctctggagaacatcttcctggtcaagtcactgttcagcgaggccaacccgcagcccatcaagaaggtgctgcagctcatgggcaagtgcacagctactgtgcgtgccccgctggtggagtgcgagccttcaactgtcgagaacctcactaaactggccaaggagcacaagtttatctaaggcaaattgtaaagcagaccgtggatctggttaatccaaacctgctatagccaaaaaaaaaaaaaaaaaaaaaa

SEQ ID NO: 72734 - protein, 292 aa, Phytophthora infestans
MTPNLQGAFTALVTPFTEDGSAVDYAKLRELVEWQIQEGINGLVPMGTTGECPTVSHEEHDRVVSEVVATVNGRVPVIAGTGSNNTAEALRLTRAAKDAGADACLVVCPYYNKPTQKGLYAHFKAVAEVGLPVVVYNIPGRTNVNLTPQTIAELAKLPNIVAIKESTGSLDQAMEIAALCDITILSGDDNLTLPLMAMGAKGVISVLSNASPKKVLAVTDPMLKGDYAAARKAALENIFLVKSLFSEANPQPIKKVLQLMGKCTATVRAPLVECEPSTVENLTKLAKEHKFI

SEQ ID NO: 72735 - DNA, 1059 bp, Corynebacterium glutamicum
  CDS (101)..(1039)
attacctcagccttccaagctgatgatgcattacttaaaaactgcagacacttgaaaaacttctcacccgcactcgttccctcaacccacaaggagcaccatggcttccgcaactttcaccggcgtgatcccacccgtaatgaccccactccacgccgacggcagtgtggatgtagaaagcctccgcaagctcgttgaccacctcatcaatggtggcgtcgacggacttttcgcactgggctcctcaggcgaagcggcattcctcacccgcgcccagcgcaaactcgcactgaccaccatcatcgagcacaccgcaggccgcgttcccgtaactgctggtgtcattgaaaccaccactgctcgcgtgattgagctcgtggaagatgccctggaggctggtgccgaaggcctcgttgccactgcacctttctacacccgcacccacgatgtggaaattgaagaacacttccgcaagatccacgccgccgctccagagcttccactgtttgcctacaacatcccagtgtcggtgcactccaacctcaacccagtcatgcttttgacgctggccaaggatggcgttcttgcaggcaccaaggattccagtggcaatgatggcgcaatccgctcactgatcgaagctcgtgatgatgctggactcactgagcagttcaagatcctcaccggcagcgaaaccaccgttgatttcgcctaccttgcgggtgccgatggagttgtcccaggcctgggcaatgttgatcctgcagcatacgcagctttagcaaaactctgcctcgatggaaagtgggcagaagctgctgctttgcagaagcgcatcaaccacctcttccacatcgtcttcgtgggagacacctcccatatgtccggatccagcgctggtttgggcggtttcaagacagcactcgcacaccttggcattattgaatccaatgcgatggcagttcctcaccagagcctcagcgacgaagaaactgctcgcattcacgccattgttgatgaattcctgtacaccgcttaaggcccacacctcatgactga

SEQ ID NO: 72736 - protein, 312 aa, Corynebacterium glutamicum
MASATFTGVIPPVMTPLHADGSVDVESLRKLVDHLINGGVDGLFALGSSGEAAFLTRAQRKLALTTIIEHTAGRVPVTAGVIETTTARVIELVEDALEAGAEGLVATAPFYTRTHDVEIEEHFRKIHAAAPELPLFAYNIPVSVHSNLNPVMLLTLAKDGVLAGTKDSSGNDGAIRSLIEARDDAGLTEQFKILTGSETTVDFAYLAGADGVVPGLGNVDPAAYAALAKLCLDGKWAEAAALQKRINHLFHIVFVGDTSHMSGSSAGLGGFKTALAHLGIIESNAMAVPHQSLSDEETARIHAIVDEFLYTA

SEQ ID NO: 72737 - DNA, 909 bp, Xanthomonas campestris
  CDS (1)..(909)
atgagcattgctgcgttctggcacggcgtgttgccggccatcactaccccgttcaccgccaacggcgacatcgaccacgacttcctggccaagcatgccaatcagctggtggacgccggctgcaccgcgatcgtgccgctgggttcgttgggcgaagccgccaccttgagcgtggacgacaagctcgccatcctcaagacgttggtaacggccttgcagggccgcgtgccggtggtgccgggcatcgccagcctggccacgggcgaggcggtggcattggcaaaggcggcaaaggaactgggctgcggcgggctgatggtgttgccgccgtacgtgtattccaccgactggcgcgagatgggcgcgcatgtgcgtgcggtgatcgcggccaccgatctgccggtgatcctctacaacaacccggtggcctacaagaccgatttcggcccggcacagatcgccgagctggcggccgaattccccaatctgcaggcagtaaaggaatcttccggcgatgtgcgccgcttcgccgcgctgcaggaattgctgggcgatcgtctggcgctgctggtcggcatggacgacgccatcgtcgaaggcctgagcatgggcgccaaggggtggatcgccgggctggtcaatgcatatccgaaggagtcggtacgcctgttcgaactggcacgcgacggcggttaccccgccgccaaggaactgtacgactggttcctgccgctgctgcgcctggataccgtgcccaagttcgtgcagctgatcaaactggtgcaggaaaaggtgggcctgggcagcgagcgtgtccgtgcgccacgcctggtggtggacggtgccgagcgcgaggcagcgctgaaggtgatcgaccacgccatcgccaccgcgcccagcctgcactga

SEQ ID NO: 72738 - protein, 302 aa, Xanthomonas campestris
MSIAAFWHGVLPAITTPFTANGDIDHDFLAKHANQLVDAGCTAIVPLGSLGEAATLSVDDKLAILKTLVTALQGRVPVVPGIASLATGEAVALAKAAKELGCGGLMVLPPYVYSTDWREMGAHVRAVIAATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAAKELYDWFLPLLRLDTVPKFVQLIKLVQEKVGLGSERVRAPRLVVDGAEREAALKVIDHAIATAPSLH

SEQ ID NO: 72739 - DNA, 909 bp, Xanthomonas axonopodis
  CDS (1)..(909)
atgagcaatgctgcgttctggcacggcgtgctgccggccatcaccactccgttcaccgctaacggcgacatcgaccacgacttcctcggcaagcacgccaatcaactggtggatgccggttgcaccgcgatcgtgccgctgggctcgttgggcgaagctgcgaccttgagcgtggaagacaagctggcgatcctgcgcacgctggtcaccgccttgaacggtcgcgtgccggtggtgccgggcatcgcgagcctggccaccggcgaagcggtcgcgctggccaaggcggccaaggacatcggctgcggcggcttgatggtgctgccgccgtacgtgtactccaccgattggcgcgaaatgggcgcgcatgtgcgcgcggtgatcggcgcaaccgatctgccggtgatcctgtacaacaacccggtcgcctacaagaccgatttcggcccggcgcagatcgccgagctggccgccgaattcccgaacctgcaggcagtgaaggaatcgtccggcgacgtgcgccgcttcgccgcactgcaggaattgctgggcgatcgcctggcgctgctggtgggcatggacgatgccatcgtcgaaggcctgagcatgggcgccaagggttggatcgccggcctggtcaatgcgtatccgaaggaatcggtgcgcctgttcgaactcgcccgcgatggcggttacccggcggccagggagctttaccactggttcctgccgctgctgcgcctggatacggtgcccaccttcgtgcagctgatcaaactggtgcaggccaaggtcggcatgggcagcgagcaggtgcgtgcgccgcgcctggtggtggccggtgccgagcgcgatgccgcgttgaaggtcatcgaccatgccatcgccaccgcgcccaagttgtcttga

SEQ ID NO: 72740 - protein, 302 aa, Xanthomonas axonopodis
MSNAAFWHGVLPAITTPFTANGDIDHDFLGKHANQLVDAGCTAIVPLGSLGEAATLSVEDKLAILRTLVTALNGRVPVVPGIASLATGEAVALAKAAKDIGCGGLMVLPPYVYSTDWREMGAHVRAVIGATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAARELYHWFLPLLRLDTVPTFVQLIKLVQAKVGMGSEQVRAPRLVVAGAERDAALKVIDHAIATAPKLS

SEQ ID NO: 72741 - DNA, 933 bp, Desulfobacula toluolica
  CDS (1)..(933)
atgaagccagggtgctatacagcattaattaccccttttaatcaagcaggagaacttgatcaaaagggacttgaacagcttatcaactttcagattgaaaatggtatcacaggaatacttgcaacaggaaccactggtgaaagcccgacattcaaatggacggaacacgatgacgtaattgcccaggttgccaaacatgcaaaagacaaatgtctcacaattgccggaacaggaagcaataacaccgcagaagctctggaagctgtgggcaatgctgcaaaaaaagggattgatgcagtccttttggtggacccttattacaatggacccagctcccttgaaatcagaagggaatactatgaggtcattgccaagcaattcccggatgtaaatattattccttatattattccgggcagaaccggtgcgcagatgctgccccaggaccttgccatcctggcaaaaaatttttcaaatgtatcctgcgtaaaagaagcaacaggaaatattgaaaacatgcaacttacccgtaaattttgcggcaatgactttaaaatattctcaggggatgacgccctggtttatgacgtgatgactgatccgaaaatcaaggcatgcggagggatttcagtcatgtccaacattgccccgaaatttatgactcagatgatcttgcagctcaaccaggcagatacaaacggagccatgaaaatccagcaggccttaaaaccactgcttgaccttgtggtagttaccacacaagaagattccgagttcggacccgtcacttgcagggcagaaaatcctcttccattaaaaactttgatgcagttattgggcatgcgtcagtccctgccgcaaacccttgggaaaaatgaccctcaaaggctttcaaatccttttggatgccgcaaaaagcgtccaggcccataa

SEQ ID NO: 72742 - protein, 310 aa, Desulfobacula toluolica
MKPGCYTALITPFNQAGELDQKGLEQLINFQIENGITGILATGTTGESPTFKWTEHDDVIAQVAKHAKDKCLTIAGTGSNNTAEALEAVGNAAKKGIDAVLLVDPYYNGPSSLEIRREYYEVIAKQFPDVNIIPYIIPGRTGAQMLPQDLAILAKNFSNVSCVKEATGNIENMQLTRKFCGNDFKIFSGDDALVYDVMTDPKIKACGGISVMSNIAPKFMTQMILQLNQADTNGAMKIQQALKPLLDLVVVTTQEDSEFGPVTCRAENPLPLKTLMQLLGMRQSLPQTLGKNDPQRLSNPFGCRKKRPGP

SEQ ID NO: 72743 - DNA, 897 bp, Pyrococcus furiosus
  CDS (1)..(897)
atggaaggagtgatagttcctttggtgactccttttaaggaggattactcgatagactttgaggccttagagtggcatatagagtttttagaagataaaggagttcatggaatattcactaattcaaccacaggagagtttacaagcttgagttttgaagaaaagaaattattagcagaaaaaggaagggagctcacatcaaaagcttactatttggttggaacaggttcaactaatacctttgaagttattgagttgacaaaacacgcaaaggacataggggcagatgccactgtaatagtctctccatattattgtaaacttaaggatgaggcaatcttcagacacttctctattgttgcagaaagggcggatattccaataattctctatgccattccttcctgtgcaaacccaataaatgtagaaatagtgagaaaattagctcttgaacactcgaacataatcggaataaaggctagcgttgacagcttaacatacctcggcgagctccttgaagtaaaggaagaaagaaaagattttaaggtttttactggcttagatcaatatttctttaccctcctcaccctgggaggagacggagggatcatggcctgtgcaaactttgctccagagatccatctggaaatctggaacgcatttaaggaaaagaactttagaagagcaatagaattggcgagagaactcgtcaggataacaaaaatttacaaaatagcttcatctttcgcttcagcggtaaagcttgcaatggtagcaaaggggttcccaataaggccagttttgagacctccatatgttattgatggagaagaagttttcaacgaaattagagaaattgtagagtggaggcagatgttaagaaaggaaagcttatag

SEQ ID NO: 72744 - protein, 298 aa, Pyrococcus furiosus
MEGVIVPLVTPFKEDYSIDFEALEWHIEFLEDKGVHGIFTNSTTGEFTSLSFEEKKLLAEKGRELTSKAYYLVGTGSTNTFEVIELTKHAKDIGADATVIVSPYYCKLKDEAIFRHFSIVAERADIPIILYAIPSCANPINVEIVRKLALEHSNIIGIKASVDSLTYLGELLEVKEERKDFKVFTGLDQYFFTLLTLGGDGGIMACANFAPEIHLEIWNAFKEKNFRRAIELARELVRITKIYKIASSFASAVKLAMVAKGFPIRPVLRPPYVIDGEEVFNEIREIVEWRQMLRKESL

SEQ ID NO: 72745 - DNA, 906 bp, Salmonella typhimurium
  CDS (1)..(906)
atgactcagattacgaaatttcacggcgtatttccgccagttccgaccattgttaatgcgcagggagagttagataaagtcggcatggcaaccttgctggatcatcttattgcaagcaaggtcaatggcgtattactgctgggcagtggaggggaattttgccatatgaccaatgcgctgcgtctggaaaccgcagagttttgcgtccgtcatattaaccgccgtattccagtactattaggtattagcagcaccagcacgcaggaagtgattgagtatggtcagcatgccgaccgactcgaagtcgatgccgtgctggtactcaatccctactatgccagattgaccgatgagtatatttatcatcatttcaaaaccgtggctaataacataaaaagcccggtgattctctacaactttccagcattgacgggacaggaccttagcgttgatttaattacccggctggcgcaagatcaccccaatattatcggcattaaggataccgttgataatatcagccatattcgtgaaatcatcaataatgtcaggccagtgcgtccggacttcgttattttctccggctatgatgaatatatgatggatacgcttatcttaggcggcaacggcgggatcccagcgacagcgaactttgcgccacagctaacctgcgggatctaccgcgcgtggtgtgaaaaagagtatgagaccatgttcggattacagcgcaggctgtccgcgctttccactatttacagcctggattcacctttcttcgggataatcaaaaaggcaattcagcttagcggagtcgatatttcaactcatgtaatgccccccgttttgccggcaaatgaagaacatatttcgaatttgaagcagatcttacagcgtgcgggactttaa

SEQ ID NO: 72746 - protein, 301 aa, Salmonella typhimurium
MTQITKFHGVFPPVPTIVNAQGELDKVGMATLLDHLIASKVNGVLLLGSGGEFCHMTNALRLETAEFCVRHINRRIPVLLGISSTSTQEVIEYGQHADRLEVDAVLVLNPYYARLTDEYIYHHFKTVANNIKSPVILYNFPALTGQDLSVDLITRLAQDHPNIIGIKDTVDNISHIREIINNVRPVRPDFVIFSGYDEYMMDTLILGGNGGIPATANFAPQLTCGIYRAWCEKEYETMFGLQRRLSALSTIYSLDSPFFGIIKKAIQLSGVDISTHVMPPVLPANEEHISNLKQILQRAGL

SEQ ID NO: 72747 - DNA, 906 bp, Pyrobaculum aerophilum
  CDS (1)..(906)
atgaaactagaaggggttattgtggccacagtaatgccgtttgcaaaagacggcgttaattacgagggcttgagattgctcttgtcgaaaattgtggaggccggttatcacggcgtgtttcccacgtcttcaacgggagaggtgactaaactatcggcggaagagagggtgagggttatgcaactggctaaggaggttgcgggcggcaaggcgttggtcgtcgccggtactggcactggggatcacgtatctacaattgacattgcgaggaaatataaagacgttggcgtcgacgccatactcatcactccgccttattatatccagtacgactgggccgccctgtacgccttttataaaaaggtattggataaagtggacattccagtgattctgtacacaatccccctggccactggctataacgtgcccgtggaggtttttgaaatggtggcaggcgagtacagccaggtggttggagttaaagacagtagcggcgattttagataccacctagatctcatccatctactcggcaagagactgtctgtcctccaggggctggatatgttgtttgtcccgtctttagtaatgggggcacacggcgggattctggcggggcccaatttcctaggcaggatcacccttgagcaatacctcctcgtcaaagaggggaaaatcgcagaggcagtagccctccacaacaagctaatgcccctctggagatttatgggcggatgcgggctggtgggaaagctgggcgggaagtggcccacgctatacaaactagccacgcagctcgtccacggcatagacatggggcctccgagagagcccctgccgccagttgacgacaaggacaggcgcgagttggagaagattttaaaagagctcgggttaatataa

SEQ ID NO: 72748 - protein, 301 aa, Pyrobaculum aerophilum
MKLEGVIVATVMPFAKDGVNYEGLRLLLSKIVEAGYHGVFPTSSTGEVTKLSAEERVRVMQLAKEVAGGKALVVAGTGTGDHVSTIDIARKYKDVGVDAILITPPYYIQYDWAALYAFYKKVLDKVDIPVILYTIPLATGYNVPVEVFEMVAGEYSQVVGVKDSSGDFRYHLDLIHLLGKRLSVLQGLDMLFVPSLVMGAHGGILAGPNFLGRITLEQYLLVKEGKIAEAVALHNKLMPLWRFMGGCGLVGKLGGKWPTLYKLATQLVHGIDMGPPREPLPPVDDKDRRELEKILKELGLI

SEQ ID NO: 72749 - DNA, 1201 bp, Yersinia enterocolitica
  CDS (278)..(1159)
tcttcaatattacaaccgcagctactgacatggcgggtgatagtattcacgattccagggcggtcagcaccgagtgcggtaatgaccagataatgttcatcaagctgcggcaaaatcgctcttcctgtcatgctctttggggttaccatggtaaacataaaaaaaacctgctgccaagcgcttacaacacagttgtttgcttgcttttggatagaggtcaaaagtaccatgagtaacttgtttatggagggggtgggcaatgtttacgggaagtccgatgtttacaggaagcatagttgcgctgatcacgccgatggacgacaaaggtaatgtcgatcgtgcgagtcttaagaaacttatcgattatcatgtagccagtggaactgcggcgattgtctccgtaggcacgacgggtgaatctgcgacgttgaaccatgacgagcatgttgatgttgtcttgcagacgctcgaactggccgatggccggattcctgtgattgccggaaccggtgctaatgccacctccgaagctatttcgctcacgcagcgctttaatgataccggtgtggttggttgcctgacggtgacgccatattataaccgcccaatgcaggaagggttatatcagcacttcaaagcgattgctgaaagtaccgatttaccacaaatcctctataatgtgccctcgcgtaccggttgcgatatgttaccgccgaccattgcccgtttagccaagattaaaaatattgttgctgttaaagaagcaacagggaacttaagtcgggtaagtcagatccaagtgctggttgatgatgaagatttcatcctgctcagtggtgacgatgcgagcggtttagactttatgcagttaggtggccaaggtgttatttcggtgacagccaacattgctgcgcgcgaaatggttgaactttgcgcgctggctgcacagggtaactttgcagaggcacgccgtttgaatcagcgcttgatgccgttgcatcagcatttatttgtagaagcaaacccaattccggtgaaatgggctgcgaagaagctgggattaatggcgaatgacactctgcgtctgccaatgaccccactgactgacccagctaaacgggttgtggaagacgcgctgaaaagcgcaggtttgctgtaactcttagggaaatttgatggcaataacattgcaaaagtcgac

SEQ ID NO: 72750 - protein, 293 aa, Yersinia enterocolitica
MFTGSIVALITPMDDKGNVDRASLKKLIDYHVASGTAAIVSVGTTGESATLNHDEHVDVVLQTLELADGRIPVIAGTGANATSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGQGVISVTANIAAREMVELCALAAQGNFAEARRLNQRLMPLHQHLFVEANPIPVKWAAKKLGLMANDTLRLPMTPLTDPAKRVVEDALKSAGLL

SEQ ID NO: 72751 - DNA, 1726 bp, Methylobacillus glycogenes
  CDS (472)..(1344)
gaattctcgaacggcagctcgatctcgagcgcgtaaccgtcggcaaacgcatattcaatttccggcgcccactgggatatcgccattacgtagcgagtgttccgccaaattgttcacctccagctcacccttgggaaaacccagcggccgcaccagatcaaacagcatgggctcgggaatggcaggctgctcgctgctcaacgctgcgtcattggcatgcgacaacatggaaaacaggccggccaccgcagccatggccggcttgttcattacatcaggcttcatcgatccgtcatttctggaaacattggcgggtattataagaaaataatgctcccttaacatttccgcctcgccccggatcactttcctcacaatgatttacagccatgaaagggcataaaatcatattattatcctcccagtttcagttaaaatgggcaggtttaatcattatcaggtcgtataaccatgctgcaaggcagtctcgttgccatcgtcacccccatgctcgacgatggcagcctggatatccaggcgttacgctcactcatcgattaccatatcgagcagaaatccgatggcatcgtggtggtgggcacaacaggcgaatcccccactgtcgactttgatgaacacgccctgctgatcaagaccacggtcgagcatagtgctggccgtatcccggtcattgccggtacgggcgccaactccaccagcgaggctatcgccctcacccgcaaggcgaaagagctaggcgcagatgcatgcctgctggtcaccccctattacaacaagccgacacaggaaggcctgtatcagcacttccaggcgattgccgcggcagtggacattccgcagattttgtataacgtccccggccgcacaggctgcgacctgcaaaacgataccgtgcttcgccttgccgcgatcaagaacattgtcggcattaaggacgccacgggcaatatcgagcgcggcaccgacctgatcctgcgcgcaccggcaggatttgcaatctacagcggcgatgacgccagcagcctggcgctgttgttactcggcgggcacggcgtcatctcggtgacggcgaatgcggcccccaggctgatgcacgacatgtgtacggcggccctggcaggcgacaccaaggccgcccgcagcgccaacgccaagctgttcgcattgcatcagaaactgttcgtcgaggccaacccgatcccggtgaaatgggtgttgcagcagatgggcctgatccagggtggcattcgcctgccgctcgtgccactatcatcccaattccatgacacattgcgcagcgccatgaagcaagctgccatttgatgccaccgttattcagtcaagagaaaccatgaatcgattcacaatcaaacctgttttactggctacattgcttaccgtcagcggttgctccattccgttcattgataccagctcggactataaggcggcaggccgctcacgccccctggaagttccgcccgacctcaccaatatctcggccagcgacgcttacgccattcccggcgccgcgaccaattattccgattacagccagtcgttgaatgaaagcggccaggtagaaaacgagcaggataaagtgttgccgaatgcggacggcgtccgcatggagcgtgcgggagcgcagcgttggctggtggtgaacgccgcgccggaaaaagtctggcccgtcatccgtgaattc

SEQ ID NO: 72752 - protein, 290 aa, Methylobacillus glycogenes
MLQGSLVAIVTPMLDDGSLDIQALRSLIDYHIEQKSDGIVVVGTTGESPTVDFDEHALLIKTTVEHSAGRIPVIAGTGANSTSEAIALTRKAKELGADACLLVTPYYNKPTQEGLYQHFQAIAAAVDIPQILYNVPGRTGCDLQNDTVLRLAAIKNIVGIKDATGNIERGTDLILRAPAGFAIYSGDDASSLALLLLGGHGVISVTANAAPRLMHDMCTAALAGDTKAARSANAKLFALHQKLFVEANPIPVKWVLQQMGLIQGGIRLPLVPLSSQFHDTLRSAMKQAAI

SEQ ID NO: 72753 - DNA, 882 bp, Thermococcus litoralis
  CDS (1)..(882)
atgcctatgtttgaaggagtttttgtcccccatataaccccatttgatgatgaagaagaaataaatgaagaaatgctgcgtgatctcgtccactactttgcagatgctggtttaaacggcttagtaactttggggagcaatggagagttcccttatttgagctttgaggagaagcttagggttcttaagattgtgcgagacgagtctccagttccagttatagccggcgttgccgagaactctaccaaggaaactataaggcttgcgaaagaagcttgggatataggggtggatgctctcttaatagccccaccgtactacttcaagcctgacaagagggaacttttcgctcattattccagaattgcctacgaggtagaggctccaattttgctttacaacgttccaaagtttaccacaatcaacatagatctggatgtcttcgagaagcttgtggaggagcactccaacatcgttggtataaaggattcaagcgggtcaatagggagaatagcagagcttgtaagaagggtaggagataagataaatatcctagccggaaccgcggatgttatgtatccttcgtggatgctgggggcacatggggctgtcgtggcagttgcaaacgttgctccgagactttgtgttgaactttacaatgcatttcttgagaaaaggtatgaaagggcaagaaagctccagctcatgataaactacctcaatgaagttgtcgtcaagaaatacaaccagataagtgcaataaaagaggctatgaggatgctcggctttgaagtgggttacccgaggatgctggctttgccccttgatgaaaaggctctagaagacatagaacgggctttgattgagataggccttttatga

SEQ ID NO: 72754 - protein, 293 aa, Thermococcus litoralis
MPMFEGVFVPHITPFDDEEEINEEMLRDLVHYFADAGLNGLVTLGSNGEFPYLSFEEKLRVLKIVRDESPVPVIAGVAENSTKETIRLAKEAWDIGVDALLIAPPYYFKPDKRELFAHYSRIAYEVEAPILLYNVPKFTTINIDLDVFEKLVEEHSNIVGIKDSSGSIGRIAELVRRVGDKINILAGTADVMYPSWMLGAHGAVVAVANVAPRLCVELYNAFLEKRYERARKLQLMINYLNEVVVKKYNQISAIKEAMRMLGFEVGYPRMLALPLDEKALEDIERALIEIGLL

SEQ ID NO: 72755 - DNA, 891 bp, Rhizobium loti
  CDS (1)..(891)
atgatgactttgtttcgcggcctgtcggcgttcccccttacgccaaccgatgcggaagggcatgtcgacaccgagggtctggctcgttttctcgagcgtattcaacgcgccggagcggactccatcggccttctggggagcacgggcggttatgcttacctcaccagggaagaacgcaagcgtgccgttcaggctgccgtggaatgcatcggcggcaaaacgcctcttgtcgtgggtgtgggtgcattgcgtaccaatgaagctcaggctctggcgcgcgatgccaaatccgctggcgctgacggcctgctcctggcaccgatgtcctacgttcccctgaacgaggacgaagtcttccagcacttcgtcgcggtggccgaggcgggggaattgcctttgtgcatatataacaatccaagcaccacgcgcttcacattcagcgacgcattgatcgcccggctgtcagaggtgtccaacatcgtcgcggtgaaaatgcctctggcggcgaatgacgattacgcgggggaactggcacgtttgcggtcgatgacgcctgacacgttcacaatcggatacagcggcgattggggcgcggcggatgccctgcttgccggatgtgacacctggtacagcgttgcggcaggtctgctgccggtcccggcgcttgcgctgacgcgtgcagcgcagtccggcgacgcggtggagtccactcggttgaaccgcgctttcgggccgctctggaccttgttcaaacactacggcagcttccgcgttatgttcgtcatcgccgactacctcggtctggcgcacgtccagccaccgcgccctattttgccgttgccggaggacgccggagatgacattaggcaggcattggagaagctcgaatag

SEQ ID NO: 72756 - protein, 296 aa, Rhizobium loti
MMTLFRGLSAFPLTPTDAEGHVDTEGLARFLERIQRAGADSIGLLGSTGGYAYLTREERKRAVQAAVECIGGKTPLVVGVGALRTNEAQALARDAKSAGADGLLLAPMSYVPLNEDEVFQHFVAVAEAGELPLCIYNNPSTTRFTFSDALIARLSEVSNIVAVKMPLAANDDYAGELARLRSMTPDTFTIGYSGDWGAADALLAGCDTWYSVAAGLLPVPALALTRAAQSGDAVESTRLNRAFGPLWTLFKHYGSFRVMFVIADYLGLAHVQPPRPILPLPEDAGDDIRQALEKLE

SEQ ID NO: 72757 - DNA, 1044 bp, Oryza sativa
  CDS (1)..(1044)
atgcaacactctgacacagacaaatattcatacaggattagcagaggaaagttttcagtgacggccatctccctggatgattatcttccaatgcgaagtagtgaagtgaaaaatcggacatcaacaggtgatatcactagcctcagagtaataacagcggttaaaaccccttatctgccggatggaagatttgatcttgaagcatatgattcgctgataaacatgcagattgaaggtggtgctgaaggtgtaatagtgggaggaacaacaggagagggccacctgatgagctgggatgaacacatcatgcttattgggcatacagttaactgctttggcactaaaattaaagtggtcggcaacacaggaagtaactcaacaagggaggctattcacgcaactgagcagggattcgctgtaggtatgcacgcggctctccacatcaatccttactacgggaagacctccgtcgaagggttgatctcccattttgaggctgttctcccaatgggtccaaccatcatttacaatgtgccatccagagactggcaagacataccacctcctgtgattgaggcggtttcctcttatacgaacatggcaggtgtcaaagaatgtgttggacatgagagggttaagtgctatgctgacagaggaataagcatatggagtggtaatgatgatgaatgccatgagtctaggtggaaatatggtgccactggagtcatttctgtagccagcaaccttattcccggtctcatgcatagcctcatgtacgaaggggagaatgcagcgctcaatgataagctacttcctctgatgaaatggttgttttgccagcctaatccgattgcgctcaacaccgccctggctcagcttggagtggcaagacccgttttcagattaccttatgtacctctcccccttgaaaagagggttgagttcgtccgaattgtcgaatccattggacgggaaaattttgtgggtcagaaagaagcaagggttcttgatgatgatgattttgtgttgatcagtaggtattaa

SEQ ID NO: 72758 - protein, 347 aa, Oryza sativa
MQHSDTDKYSYRISRGKFSVTAISLDDYLPMRSSEVKNRTSTGDITSLRVITAVKTPYLPDGRFDLEAYDSLINMQIEGGAEGVIVGGTTGEGHLMSWDEHIMLIGHTVNCFGTKIKVVGNTGSNSTREAIHATEQGFAVGMHAALHINPYYGKTSVEGLISHFEAVLPMGPTIIYNVPSRDWQDIPPPVIEAVSSYTNMAGVKECVGHERVKCYADRGISIWSGNDDECHESRWKYGATGVISVASNLIPGLMHSLMYEGENAALNDKLLPLMKWLFCQPNPIALNTALAQLGVARPVFRLPYVPLPLEKRVEFVRIVESIGRENFVGQKEARVLDDDDFVLISRY

SEQ ID NO: 72759 - DNA, 891 bp, Bradyrhizobium japonicum
  CDS (1)..(891)
atggcagccaagacgaaattccgggggtcgttcaccgccttggtcacgccgttcaagaacggctcgctcgacgaggcagcgttccgctccctggtcaactggcagatttccgagggcaccaacggactggtcccggtcggcacgacaggcgagagcccgacgctcagccatgacgagcacaagaaggtcgtcgagtggtgcatcgaggaggccaagggccgcgtgcccgtggttgccggtgccggctccaactcgaccaaggaggcgatcgagctggcccagcacgccgagaaggcgggcgcggacgccgtgctggtggtgacgccttactacaacaagccgacccaggaagggatgtaccagcacttcaaggcgatcaacgatgcgatcgggattccaatcatcatttacaacatcccgccgcgctcggtgatcgacatgtcggtcgacaccatgaagcggctgtgggagctgaagaacatcgccggcgtcaaggacgccaccgccagcatggtccgcgtgtcgcagcagcgtgccgcgatgggcgaggacttcaaccagctctcgggcgaggatgcgaccatcctcggctacatggcccatggcggccacggctgcatctcggtgacctcgaacgtcgcaccgcgcctgtgctcggagttccacaccgcctggcagaagggcgatcacgccaccgcgctgaagctgcacgacaagctgatgccgctgcacaacaacctcttcatcgagagcaatccggcgccgatcaagtacgcgatgtcgctgctcggcaagcttgacgagacgctgcggctgccgatggtgccggtgaccgagccgacgcgcgttgccgtgcgcagcgccatggttcacgctggcctgatcaactga

SEQ ID NO: 72760 - protein, 296 aa, Bradyrhizobium japonicum
MAAKTKFRGSFTALVTPFKNGSLDEAAFRSLVNWQISEGTNGLVPVGTTGESPTLSHDEHKKVVEWCIEEAKGRVPVVAGAGSNSTKEAIELAQHAEKAGADAVLVVTPYYNKPTQEGMYQHFKAINDAIGIPIIIYNIPPRSVIDMSVDTMKRLWELKNIAGVKDATASMVRVSQQRAAMGEDFNQLSGEDATILGYMAHGGHGCISVTSNVAPRLCSEFHTAWQKGDHATALKLHDKLMPLHNNLFIESNPAPIKYAMSLLGKLDETLRLPMVPVTEPTRVAVRSAMVHAGLIN

SEQ ID NO: 72761 - DNA, 885 bp, Buchnera aphidicola
  CDS (1)..(885)
atgttcaaaggaagtattgttgcattaattacaccaatgaatgaagaaggtgaaatttgtcattcaagcttaaaaaagctaattgattatcatgtattaaataaaacaaaagctattgtttctattggaacgactggagaatcggctactcttagtcaagaagaacatattgaagtagttatgctaactttaaaacttgcaaataaacgcattcctatcattgcaggtacaggtgcgaatgcgacaacagaagcaatatccttaacaaaaagatttgaaaaatcaggaattgaagcatgtcttactgttacaccatactataacaaaccaactcaagaaggattataccagcattttaaagcaatttcagaaaacacaaaattaccacaaattttatataatgttccaagtcgaactggatgtgatttacttccatcaactgtggcaagattatctgaatttaaaaatattattggaattaaagaagcgacaggtgatctatcaagaatacataaaattaaaaaattggttaaagacgattttttattaattagtggtgatgaccctacggctttagattttattcaattaggtggtcaaggagtgatatcagttacagcaaatattgctgcaaaagaaatgacacagatgtgttcatatgcacttgaaggtaactttaaaagtgcaagatctataaatgaacgtttgatgttattacatgaatctttatttatagaacctaatcctattccaataaaatggttagctaaaaaaataggtttaataaaaagtgatacacttcgactaccgatgacaccaattttaaattctacacgtacacaaattgaaaaagcacttcaatatgctaatcttcaaaagatataa

SEQ ID NO: 72762 - protein, 294 aa, Buchnera aphidicola
MFKGSIVALITPMNEEGEICHSSLKKLIDYHVLNKTKAIVSIGTTGESATLSQEEHIEVVMLTLKLANKRIPIIAGTGANATTEAISLTKRFEKSGIEACLTVTPYYNKPTQEGLYQHFKAISENTKLPQILYNVPSRTGCDLLPSTVARLSEFKNIIGIKEATGDLSRIHKIKKLVKDDFLLISGDDPTALDFIQLGGQGVISVTANIAAKEMTQMCSYALEGNFKSARSINERLMLLHESLFIEPNPIPIKWLAKKIGLIKSDTLRLPMTPILNSTRTQIEKALQYANLQKI

SEQ ID NO: 72763 - DNA, 885 bp, Buchnera aphidicola
  CDS (1)..(885)
atgttaagaggaagtattgtagcacttataacaccaatgaatgaatatggtcatgtttgtgaaacaagtttagaaaaattaattaattatcatatcaataatggaaccaaagctattgtttctgttggaacaactggggaatcatctactcttagccaagaagaacacatcaacgtcgtaatgttaacattagaaataactaataaacgtcttccaatcattgcaggaacaggtgctaacgcaacatcagaagctattttattaactaaaaaatttgagaacacaggaatttctgcatgtttaacagtaactccatattacaatcgtcctacgcaaaaaggactatatcaacattttaaagcaatctcagaaaatacaaaaatacctcaaatcctatataacgttcccattcggacggggtgcgatttaatacctgaaacaatcattaaattatcgaaatttaaaaatattatcggtataaaagaagcaaccggtgatttatcacgtgttcaaaaaatcaaaaattcagtgcacaaaaatttttttattattagtggcgatgatacgacttttttagattttatacaattaggaggacatggtgtaatctcagttactgctaatatcgctgcaaaaataatgagtaatatttgtcatctagcacttaataaaaactttaaattagctagattcatgaataataaactaattccgttacatcaaggactctttcatgagcctaatcctattcccataaaatggctagctaaaaaaataggtttaatcgcatcagatacattacgtttacccatgactcctgtttctaataaaacacgtttaattttagaaaaagcactttatttttctaaaattactgcaaaataa

SEQ ID NO: 72764 - protein, 294 aa, Buchnera aphidicola
MLRGSIVALITPMNEYGHVCETSLEKLINYHINNGTKAIVSVGTTGESSTLSQEEHINVVMLTLEITNKRLPIIAGTGANATSEAILLTKKFENTGISACLTVTPYYNRPTQKGLYQHFKAISENTKIPQILYNVPIRTGCDLIPETIIKLSKFKNIIGIKEATGDLSRVQKIKNSVHKNFFIISGDDTTFLDFIQLGGHGVISVTANIAAKIMSNICHLALNKNFKLARFMNNKLIPLHQGLFHEPNPIPIKWLAKKIGLIASDTLRLPMTPVSNKTRLILEKALYFSKITAK

SEQ ID NO: 72765 - DNA, 891 bp, Chlorobium tepidum
  CDS (1)..(891)
atgtccaatcgccttatttcaggttcagccgtagcccttgttactccgtttcatcaggacggatcgatcgatttcgaagccatgcggcggctggtgcggttccatcgcgaggccggaaccgacatcgttcttccctgcggcaccaccggcgagtcgccgactctcacgaatgaggaggaggcggagatcatccgcgtcgtctgcgaggaggctggcgagtcgatgatggtcgccgccggcgcaggcaacaatgacacccggcacgcgatcgagctggcgcgcaacgccgaaaaggccggggcacaggccatcctttcggtcgcaccatactacaacaaaccttcgcaggaggggtactaccagcacttccgccacgtggccgaagcggtttcgattccggtgatcatctacaacgtgccggggcgcacgggcagcaacgtgaacgcccagacgattctgcggctggcgcgggacatcgagaacgtggtcgccgtcaaggaggcgtcggataacttcgagcagatcatgacgctcatcgacgagcgcccggagaacttctcggtgatgactggcgaggatgggctgatgctgcccttcatggcgctcggcggcgacggcgtgatttcagtggcggccaaccaggtgccaaaggtggtcaaggggctgatcgacgcaatgaaggcgggcaacctcgaagaggcccgcgccatcaaccgcaagtaccgcaagctgttcagactgaacttcatcgagagcaaccccgtgccggtcaagtacgcgctctcgctgatgggcatgatcgaagaggtctatcgcctgccgctcgtgccaatggccgacgccaacaaagcgattctgcgagcggagctggagaagctcagcctggtatga

SEQ ID NO: 72766 - protein, 296 aa, Chlorobium tepidum
MSNRLISGSAVALVTPFHQDGSIDFEAMRRLVRFHREAGTDIVLPCGTTGESPTLTNEEEAEIIRVVCEEAGESMMVAAGAGNNDTRHAIELARNAEKAGAQAILSVAPYYNKPSQEGYYQHFRHVAEAVSIPVIIYNVPGRTGSNVNAQTILRLARDIENVVAVKEASDNFEQIMTLIDERPENFSVMTGEDGLMLPFMALGGDGVISVAANQVPKVVKGLIDAMKAGNLEEARAINRKYRKLFRLNFIESNPVPVKYALSLMGMIEEVYRLPLVPMADANKAILRAELEKLSLV

SEQ ID NO: 72767 - DNA, 876 bp, Clostridium perfringens
  CDS (1)..(876)
atgtttaaagggtcttgtgtagctttaataacaccatttactgaagatggcgttaattatgaagagctaagaaaattattagaatggcatattaaaaatcatactgacgctattttagtttgtggaactacaggagaaggttctactatgactttagaagaaaagaaagaagttataaaattctctgtggaagttgtaaataaaagagttcctgtaatagctggaactggaacaaataatactaaggcttcaatagaattaagtaaatatgctgaagaagttggcgctgatatggtattaataataactccatattataataaaacttctcaaaaaggattatatgctcattttagtgctataaatgatgcaataaatattcctattatgctttataatgttccatcaagaactggaatgaatataactccattaatgcttgataaacttgcagatttaaataatgtagttgctataaaagaagctagcggagatctttcacaagtagctaaaatggctgaattatgtggtgatagaattgctatctattcaggtaatgatgatcaaatagttccaattttatctttaggcggagctggtgttgtttcagttttagcaaatattcttcctgaagaaactcacaatatatgtgaaaaatatttcttaggagaagttattgaatcacgtaaccttcaacttaaatatctttcattagcaaattctttatttatagaaacaaatccaatcccagttaaaacagctatgaatttaatgaattttaactgtggaccattaagattaccattatgcgaaatggaagattctaatttaataatattagaagaaaacttaaaagctaatggtttaataaaataa

SEQ ID NO: 72768 - protein, 291 aa, Clostridium perfringens
MFKGSCVALITPFTEDGVNYEELRKLLEWHIKNHTDAILVCGTTGEGSTMTLEEKKEVIKFSVEVVNKRVPVIAGTGTNNTKASIELSKYAEEVGADMVLIITPYYNKTSQKGLYAHFSAINDAINIPIMLYNVPSRTGMNITPLMLDKLADLNNVVAIKEASGDLSQVAKMAELCGDRIAIYSGNDDQIVPILSLGGAGVVSVLANILPEETHNICEKYFLGEVIESRNLQLKYLSLANSLFIETNPIPVKTAMNLMNFNCGPLRLPLCEMEDSNLIILEENLKANGLIK

SEQ ID NO: 72769 - DNA, 1134 bp, Coix lachryma
  CDS (1)..(1134)
atgatttccccccggatgacgacgaatctcctcccggctcggacgatctcccttgtctcaaatggcggcgcagcgacggcgagcccctcttctccctcggtggccgcacggccacggcgaccctcttcagggactggcagagggaaggtttctgccatcactctagatgattatcttccaatgcgaagtactgaagtgaagaaccgaacatcaacagatgacatcacaagtctgagattaatcacagctgtcaaaaccccctatttgcctgatggaagattcgatctggaagcatatgattctctcataaacatgcagatagagggtggtgctgaaggtgtaatagttggaggaacaacaggagagggtcacctcatgagctgggatgaacatatcatgctcattgggcatactgtgaactgctttggctctagaattaaagtgataggcaacacaggaagtaactcaaccagagaagctgttcacgcaacagagcagggatttgctgttggcatgcatgcagctctccacatcaatccttactatgggaagacctcaactgaaggaatgatttctcattttgagtctgtcctcccaatgggtccgaccatcatctacaacgtgccatccaggagtgcccaggatatccctcctgaagttattgtagcaatttcaggctatataaacatggcaggtgtcaaggaatgcattgggcacgagaggatcaagcactatgctgacaaaggtataacaatttggagcggtaatgacgacgaatgccatgattctaggtggaaatatggtgctactggagtaatttctgttactagcaaccttgttcctgggctcatgcacagcctcatgtacaaaggcgagaacgcggtgctgaaagagaagctgctgcccctgatgaaatggttgttctgccaaccaaatccgattgctctcaacactgctctggctcagctcggcgtggcaaggcctgtcttcagactgccatatgttccacttcctcttgaaaagagggccgagttcgtccggattgttgaggctattggacgggagaattttgtgggacagaaagagacccgagttctcgatgatgacgatttcgtgttgatcagtaggtactag

SEQ ID NO: 72770 - protein, 377 aa, Coix lachryma
MISPRMTTNLLPARTISLVSNGGAATASPSSPSVAARPRRPSSGTGRGKVSAITLDDYLPMRSTEVKNRTSTDDITSLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSTEGMISHFESVLPMGPTIIYNVPSRSAQDIPPEVIVAISGYINMAGVKECIGHERIKHYADKGITIWSGNDDECHDSRWKYGATGVISVTSNLVPGLMHSLMYKGENAVLKEKLLPLMKWLFCQPNPIALNTALAQLGVARPVFRLPYVPLPLEKRAEFVRIVEAIGRENFVGQKETRVLDDDDFVLISRY

SEQ ID NO: 72771 - DNA, 906 bp, Corynebacterium efficiens
  CDS (1)..(906)
atgagcacaggtttaacagcgaagaccggagttgagcatttcggtacggtcggagtggccatggtcaccccgttcactgaatccggcgaccttgatgtcgccgcgggccgcgagatcgcggcacacctggtggacaacggggtggatgccctgatcctggccggaaccaccggcgaatccccgaccgtcaccaccgctgagaaacttaccctgctcaaggccgtccgcgaggaagttggtgaccgtgccaagctcatcgcgggtgccggcactaacaacacacgttcatctgttgagctcgctgaggccttcgccgaggttggcgcagacggccttctggtggtcacaccctactactccaagccgagtcaggagggactggtccgccatttcacggagatcgcacaggccaccgacctgccgatctgtctctacgatattccgggacgttcaggtattcccattgagtctgataccatcagacgtctcagcgaattacccacgatcctcgcgatgaaagatgcgaagggtgatgtcgttgcagctgcaccgctgattgaggagaccggtctcgcctggtactcgggtgacgacccgctcaatctcgtgtggcttgccctgggagggtcaggcttcatctccgtcatcggacatgccgcccccaatgctctgcgtgagctgtacacaagcttcgaggaaggcgacctcgcccgtgcgcgggaaatcaacgccacactatccccgctggtcgcggcccagggtcgcctgggtggtgtcagcatggcaaaagccgccctgcgtctgcagggcatcaacgtaggagatccccgccttccgattgtcgctcccaatgagcaggaacttgaggatctccgtgcagatatgaaaaaagctggagttctataa

SEQ ID NO: 72772 - protein, 301 aa, Corynebacterium efficiens
MSTGLTAKTGVEHFGTVGVAMVTPFTESGDLDVAAGREIAAHLVDNGVDALILAGTTGESPTVTTAEKLTLLKAVREEVGDRAKLIAGAGTNNTRSSVELAEAFAEVGADGLLVVTPYYSKPSQEGLVRHFTEIAQATDLPICLYDIPGRSGIPIESDTIRRLSELPTILAMKDAKGDVVAAAPLIEETGLAWYSGDDPLNLVWLALGGSGFISVIGHAAPNALRELYTSFEEGDLARAREINATLSPLVAAQGRLGGVSMAKAALRLQGINVGDPRLPIVAPNEQELEDLRADMKKAGVL

SEQ ID NO: 72773 - DNA, 924 bp, Leptospira interrogans
  CDS (1)..(924)
atgattgccaaatccggctcaaatcaagaatctaaccctatgttccagggcgtttatacggcgatcatcacaccattcaaaaacgataaaatcgattacgacagttatttcaaactactggaaaaacaaatcaaagccggagtcagtggagttgttccttgtggaacgactggagaatctccgactctttctcatagtgaacacgcggaactgattcgagaaactgtcaaagcagtacaaggaaaaattcaagtagtggctggaactgggtccaattctacaaaagaagcgatcgaattgacagaggcggcttgtaaagatggagtggatggaattctttccgtaaatccttattataataaaccaacacaagaaggactctttcaacattttaaatcaattgcagaacattccaccgtaccagtgatgctctacaatattcctggaagaacttccgtaaatttattaccggaaaccgtactcaggcttagtgaggtcaaacagattcgatctatgaaagaggccacgggagatctgggacaaatggggaaattaatttccttagtgggaaataaaatgactgtactttccggggacgataacttgacccttcccttacttgcaatcggaggagtaggggttgtgtccgtgatttccaatttatttccaaaagctttagtacaacttgtagaatcgtttcaacagggaaaaatctccgaggccaaaaaaatacattatgattttattgaagtctttgcacttgcttttatggaaaccaacccgataccaatcaaggcggcgatgtgctggtttggtcattgtggtccggaaatacgacttccgttgactccactttctcaaaacgagacaagttctaaatttaaaaaggtactcgaaggtctgaaagaaaaaggatacgaatag

SEQ ID NO: 72774 - protein, 307 aa, Leptospira interrogans
MIAKSGSNQESNPMFQGVYTAIITPFKNDKIDYDSYFKLLEKQIKAGVSGVVPCGTTGESPTLSHSEHAELIRETVKAVQGKIQVVAGTGSNSTKEAIELTEAACKDGVDGILSVNPYYNKPTQEGLFQHFKSIAEHSTVPVMLYNIPGRTSVNLLPETVLRLSEVKQIRSMKEATGDLGQMGKLISLVGNKMTVLSGDDNLTLPLLAIGGVGVVSVISNLFPKALVQLVESFQQGKISEAKKIHYDFIEVFALAFMETNPIPIKAAMCWFGHCGPEIRLPLTPLSQNETSSKFKKVLEGLKEKGYE

SEQ ID NO: 72775 - DNA, 903 bp, Methanopyrus kandleri
  CDS (1)..(903)
atgggatttcagattgagggcgtcatcccagccctgatcactccctttacggacgacctgaaagggatcaatgaagagggactccgcgagaacgtctcacgattgctcgaggccggcgtgcacggcgtggtgcccgcagggaccaccggggaatcgtccacgctgagtcacgcagaacatcgacgcgtcatcgagatcgtcgttgacgaggtgaacgggaaggtgcccgtaatcgccggagcgggttcgaactcgacgcgcgaggccctcgagctctccacgtacgctgaagacgtaggggcagacgcgatcctttccgtggttccctactacaacaagccacctcaagagggtcttttcatccacttctctaagatcgcggaagccgtcgagtgccctattatcctctacaacgtgccgtcacgaacgggctgtgcgttggaaccggagacggccgccaagctcgcggaggaatattctcacatcgtcggcgtcaaagaggctagtggcgacctggacgtggtccaacgcttcatcgaagagactcctgacgacttcatcctactctccggagtcgatgagttgacgcttccgatcctcgccgtcggaggcgtcggcgtgatatccgtaacggccaacgtagctcccgagttgatggtagaaatgtacgaggcgtggaagagtggcgacgtagagcgtgcccgagagctccattacgagctcttaccactacaccgggcgctgttcaccgagacgaacccgatacccgtgaaagccgccgtcgagctcgtgggaatggcctcgagtccccctagaccaccacttaaggaagctcgcgaagacaccaaggagttgcttcggagggaactcaaaaagctaggattattgcccgagggggggtga

SEQ ID NO: 72776 - protein, 300 aa, Methanopyrus kandleri
MGFQIEGVIPALITPFTDDLKGINEEGLRENVSRLLEAGVHGVVPAGTTGESSTLSHAEHRRVIEIVVDEVNGKVPVIAGAGSNSTREALELSTYAEDVGADAILSVVPYYNKPPQEGLFIHFSKIAEAVECPIILYNVPSRTGCALEPETAAKLAEEYSHIVGVKEASGDLDVVQRFIEETPDDFILLSGVDELTLPILAVGGVGVISVTANVAPELMVEMYEAWKSGDVERARELHYELLPLHRALFTETNPIPVKAAVELVGMASSPPRPPLKEAREDTKELLRRELKKLGLLPEGG

SEQ ID NO: 72777 - DNA, 876 bp, Methanosarcina mazei
  CDS (1)..(876)
atgtttgaaggagcaatgcctgccctgatcactccttttacgaaagatgacaggattgacagggaaggcttacagaggaacatagcgtttgttgaagagggaggggtttcaggaatagtgccctgtggcacaaccggagaatcggcaaccctttctgcagcagagcatgaagaagtaatagacattgcagttgagtgctcaaaagttcctgtaattgcaggaacaggttcaaacaatacgggtgaagcactccagttcacaaaacacgccgcagatgcgggtgttgacggtgtacttcttatttctccttattataataagccaaatcctgcaggtcttcttgcccattttaagaagattgcagaggcagtagatatccccatgatcctctacaatgtcccttccaggacagggcaggatatgcctgtagacgtgattgtcgagcttgcaaaggtagaaaacatcgtgggtatcaaggaagccagcgggaacgcagcaaaagtttctcagatccttgagaacactatggatgacgactttgtagttctctcaggcgaggacgggctaactcttccgatcatttcaatgggaggcagaggagtcatttcagttgctgcaaacattgtgcctgataaaatgtcaggaatggtaaatgcagccctcaaaggagattacgaaactgcaagaaagctgcatttcgagatagccccgctgatccgtgcccttttccttgagacaaacccgattcctgtgaagaaagctgcagaacttgtcgggcttgcaagcggacacctgaggcttccactggctcccatcagcgatgccaaccaggcaaagcttgccaacgaactcagaaaactgggggtaatggaatga

SEQ ID NO: 72778 - protein, 291 aa, Methanosarcina mazei
MFEGAMPALITPFTKDDRIDREGLQRNIAFVEEGGVSGIVPCGTTGESATLSAAEHEEVIDIAVECSKVPVIAGTGSNNTGEALQFTKHAADAGVDGVLLISPYYNKPNPAGLLAHFKKIAEAVDIPMILYNVPSRTGQDMPVDVIVELAKVENIVGIKEASGNAAKVSQILENTMDDDFVVLSGEDGLTLPIISMGGRGVISVAANIVPDKMSGMVNAALKGDYETARKLHFEIAPLIRALFLETNPIPVKKAAELVGLASGHLRLPLAPISDANQAKLANELRKLGVME

SEQ ID NO: 72779 - DNA, 888 bp, Oceanobacillus iheyensis
  CDS (1)..(888)
atgaattttggaaaagtattaacagcgatggtgacgcctttcgataaacatgaagaaatcgattttcaagcattggatcatttaattgaccatctaattaataatgggtcagatggtttggtagtagctggtaccacaggtgaatctccaacgttaacacatgaagagagaataaaattattcgaatatgtcgtgaaaaaagtaaatggagcagtacccgtaattgccggaacgggctctaattatacgaaagcatcgattgaattgacaaaagaagtagcaaaaacaggtgttgatggagtaatgcttgttgcaccatattataataaaccgtcacaggatagcatgtatgaacattttaaggtaattgcagaaagcacagaattaccagtaatgctttataatgttccaggacgcacaggtgttgatatggatgtatctactgttgtacgtttatctcaaatagataatattgtgtccatcaaagatgcaagcgggaatttagaaaaaatgacaaatattattcgccttacagatgataatttttctgtgtatagtggggaagacagcttaactttaccagcactagctatcggtgctgatggcatcgtttctgtatcctctcatattattgggaatgatatgcaagaaatgattcaacgttttgaacaaggtcaagtagcagaagcagctaatatacatcagcgagtactacctgtcatgcaagaaatgtttgcaaatccaagtcctgttccagttaaaacagcactgaatcttcaatctgtgcctgtgggaaaggttcgattaccattaatcgagctaaccgatgaacagttgcaaaatttacagtccgtattatcggatttcgaacattctaaaatgatataa

SEQ ID NO: 72780 - protein, 295 aa, Oceanobacillus iheyensis
MNFGKVLTAMVTPFDKHEEIDFQALDHLIDHLINNGSDGLVVAGTTGESPTLTHEERIKLFEYVVKKVNGAVPVIAGTGSNYTKASIELTKEVAKTGVDGVMLVAPYYNKPSQDSMYEHFKVIAESTELPVMLYNVPGRTGVDMDVSTVVRLSQIDNIVSIKDASGNLEKMTNIIRLTDDNFSVYSGEDSLTLPALAIGADGIVSVSSHIIGNDMQEMIQRFEQGQVAEAANIHQRVLPVMQEMFANPSPVPVKTALNLQSVPVGKVRLPLIELTDEQLQNLQSVLSDFEHSKMI

SEQ ID NO: 72781 - DNA, 897 bp, Pasteurella multocida
  CDS (1)..(897)
atgtcagcaaacaattatctcttctcgggcagtatcgttgctatcgtgaccccaatggacagttctggcgaaattgattttgtcagattgaaaagtttagttgaacatcatatcgcagcgggcacggatgcgattgtctcagtaggtacaaccggtgaagctgcaacattaagcattgatgagaatgttaaaaccattttaaaaacggtcgagtttgctgatggacgtattcctgtgattgcgggagccggtgctaatgccactagcgaagccattgtaatgactaaactcttaaatgacagtggtgtagcaggctgtctttctgtggtgccttattataataagccaacccaagaaggtatgtatcagcattttaaagccattgcagaatgtacagatttgccacaaattttatataacgtaccaagtcgtactggaagcgatttgttgccagaaacagtagcccgtttggcgaaaatcaacaatattgttgctattaaagaagcaaccggtgatcttagtcgtgtcgccaaaattaaagaattggcgggagaggatttcattttcttaagtggtgatgatgcaacagggttagagtccattaaattaggggggcaaggtgtaatttctgtgaccaataacgtggcggccgcggacatggcaaaaatgtgtcatcttgcactaaatggacaatttgaggaagctgaacaaattaatcagcgcttgatggcattacataaaaatttatttgtcgaatccaatccaattcctgtgaaatgggcagcttaccgtttaggtttgattgatacaccgactttacgcttaccgttgacaacgctgagtgaacatttacaacctaaagtcgaagacgcattaaaaatcgcgggtttgttgtaa

SEQ ID NO: 72782 - protein, 298 aa, Pasteurella multocida
MSANNYLFSGSIVAIVTPMDSSGEIDFVRLKSLVEHHIAAGTDAIVSVGTTGEAATLSIDENVKTILKTVEFADGRIPVIAGAGANATSEAIVMTKLLNDSGVAGCLSVVPYYNKPTQEGMYQHFKAIAECTDLPQILYNVPSRTGSDLLPETVARLAKINNIVAIKEATGDLSRVAKIKELAGEDFIFLSGDDATGLESIKLGGQGVISVTNNVAAADMAKMCHLALNGQFEEAEQINQRLMALHKNLFVESNPIPVKWAAYRLGLIDTPTLRLPLTTLSEHLQPKVEDALKIAGLL

SEQ ID NO: 72783 - DNA, 909 bp, Prochlorococcus marinus
  CDS (1)..(909)
atgagtactgtccctgaaatatcatcagctccttttggacgtttattaaccgcaatggttactccatttgatacagcaggggctgttgattttgccttagctgctcgacttgcacgttatttagttgatcaaggttctgatggtcttattgtttgtgggactacaggagagtcacctactttaagctgggaagaacaatatcaattacttgaaacagtaagaaatgctgttaatggttcggcaaaggtattagctgggactgggagtaatagtacatctgaggcgattcatgcaactgctaaggcagctgaggctggagctgatggtgctttggtagttgtgccttactacaacaagcctccccaagcaggcttggaatcacattttcgtgcagttgctcaagcagctccagatttaccattaatgctttacaatattcctggaagaacaggttgttctatatctccaatcactgttcaaagactaatgaattgttcgaatattgtaagtttcaaagctgcaagtggcacaactaatgaagtgactgatctaagaattagatgcggttctagactcgcaatttatagtggagatgatgggcttcttcttccgatgttatctgttggtgctgttggtgtagtaagcgtagctagtcatattgttggcatgcgcttaaaagcaatgattgaggcatatttcgctggggaaaatagtcttgcacttagtcatcatgaacaattacaacctctatttaaagctttatttgcaacaactaatcccattccagttaaggcagctcttgaactaattggatggccagtaggtgctccccgcagtccattactccctttggaaaatcaaatgaaaaacgaacttatgaaaaccatttcagccttgcttcaaacctaa

SEQ ID NO: 72784 - protein, 302 aa, Prochlorococcus marinus
MSTVPEISSAPFGRLLTAMVTPFDTAGAVDFALAARLARYLVDQGSDGLIVCGTTGESPTLSWEEQYQLLETVRNAVNGSAKVLAGTGSNSTSEAIHATAKAAEAGADGALVVVPYYNKPPQAGLESHFRAVAQAAPDLPLMLYNIPGRTGCSISPITVQRLMNCSNIVSFKAASGTTNEVTDLRIRCGSRLAIYSGDDGLLLPMLSVGAVGVVSVASHIVGMRLKAMIEAYFAGENSLALSHHEQLQPLFKALFATTNPIPVKAALELIGWPVGAPRSPLLPLENQMKNELMKTISALLQT

SEQ ID NO: 72785 - DNA, 885 bp, Ralstonia solanacearum
  CDS (1)..(885)
atgacccagatttccggcagtctcgtcgccatcgtcacgcccatgcacgaggacggcagcctagatttcccgtcgttgcgcagcctgatcgactggcatatcgccgaaggcacggacggcatcgtcatcgtcgggaccagcggtgaatcgccgacggtgtcggtggacgagcaccgggagctgatccgcgtgacggtcgagcaggtcaacaagcgcattccggtcattgccggcaccggcggcaattccaccaccgaagccgtggagctgacggcctacgccaagtcggtgggcgccgatgcctcgctgcaggtcgtgccgtactacaacaagccgacgcaggagggcatgtacctgcacttccgcaaggtggcggagtcggtggacctgccggtgatcctgtacaacgtgcctggccgcaccgtcgccgatatgtcggtcgacacgatgctgcgcctcgcgcaggtgcccggcgtgatgggcgtcaaggaggcgaccggcaatatcgaccgtgccgcccagttgatcaaggccgcgccggcgtccttcaagatttacagcggggacgacccgaccgccgtcgcgctgatgctgctgggcggtcacggcaacatctccgtgacggccaacgtggcgccgcgcgccatgcatgacttgtgcgccgccgccatgcgcggcgatgtggagacggcccgccgcattcacatgcagctgctgtcggtgcacaagaacctgttcgtggaatcgaacccgattcccgtcaagtgggccctgcaagccatgggcaagatggccggcggcatccgcctgccgttgacgccgctggcggcccagtatcaagaggtggtgcgcgcatccttgcaggatgccggactgctctcctga

SEQ ID NO: 72786 - protein, 294 aa, Ralstonia solanacearum
MTQISGSLVAIVTPMHEDGSLDFPSLRSLIDWHIAEGTDGIVIVGTSGESPTVSVDEHRELIRVTVEQVNKRIPVIAGTGGNSTTEAVELTAYAKSVGADASLQVVPYYNKPTQEGMYLHFRKVAESVDLPVILYNVPGRTVADMSVDTMLRLAQVPGVMGVKEATGNIDRAAQLIKAAPASFKIYSGDDPTAVALMLLGGHGNISVTANVAPRAMHDLCAAAMRGDVETARRIHMQLLSVHKNLFVESNPIPVKWALQAMGKMAGGIRLPLTPLAAQYQEVVRASLQDAGLLS

SEQ ID NO: 72787 - DNA, 882 bp, Rhizobium loti
  CDS (1)..(882)
atgctgagaggctcgcttactgcgctcgtgacaccgttcgaaaagagcgggcgtttcgacgagaaagcctttcgcgcctttgtcgaatggcagctcggggaaggcacgacgggtctggtcccggtgggcacgaccggcgagtcgccgacgctgtcgcatgacgagcaccgccatgtcgtcaaggtctgcatcgaggtggccaatgggcgcgctccggtcgtcgccggcgccggctccaacaacaccgcggaagcggtcgggcttgtgcaatatgccgaaaaggccggcgccgatgccgccctggtcgtcacgccctattacaacaagccgacacagcgcggcctctacgagcatttcgccgccgtcgccagggcgaccaagctgccgatcatcatctacaacatcccgccgcgctcggtgatcgacatgatgccggagacgatgggccggctggcgcacgacttcaagaacatcgtcggcgtcaaggatgcgaccggcaaggtcgagcgtgtgtccgagcagcgcatgacctgcggcaaggatttcatccagctttccggcgaggatgcctcggcgctcggcttcaacgcccatggcggtgtcggctgcatctcggtgacctcgaacgtcgccccgcggctgtgcgccgaattccaggaagccacgctgtccggcgacagtgtgaaggcgctggaattgcaggaccgtctcttgccgctgcataaggcgatcttcctggagcccggcgtgtccggcgccaaatacgcgctgtcgaagctgggcaaggtcgagaacgtgctacggtcgccgttggtcacggtcgaggagtcgaccgcggcgaagatcgatgcggccatgaagcacgccggcttgatcaattag

SEQ ID NO: 72788 - protein, 293 aa, Rhizobium loti
MLRGSLTALVTPFEKSGRFDEKAFRAFVEWQLGEGTTGLVPVGTTGESPTLSHDEHRHVVKVCIEVANGRAPVVAGAGSNNTAEAVGLVQYAEKAGADAALVVTPYYNKPTQRGLYEHFAAVARATKLPIIIYNIPPRSVIDMMPETMGRLAHDFKNIVGVKDATGKVERVSEQRMTCGKDFIQLSGEDASALGFNAHGGVGCISVTSNVAPRLCAEFQEATLSGDSVKALELQDRLLPLHKAIFLEPGVSGAKYALSKLGKVENVLRSPLVTVEESTAAKIDAAMKHAGLIN

SEQ ID NO: 72789 - DNA, 885 bp, Rickettsia montana
  CDS (1)..(885)
atgcataacatatttaaaggtttaattaccgcacttataacaccttttaaagataataagttagacttatatgctttagagagaattataaaacatcaaataaagcatgaagtcgatgcagtattaattgcaggctcaacgggagaaagtagtagtttaagctttgaagaatataaattattactgcaaactagcgtagaaatcgttaataagtgtattcctataataagcgggtgttcatcaaataatactacttatgcaagagcacttgcagcggaatctacaaaaatcggcgtagatggttttatggctagcccaccatcttatgtcaaacctacccaacacgggatttataagcattttgaagcattgcatgaagtgtgtaatctacctattatgttatattcagctccaactagaagcggagtagatttttctgatgagacaatattgagacttagcaagctaccgcgtattttagcattaaaagattgtggtgtagatttagaacgtccattgcggatcagagcaacagttaaaaaggatttcaatattttaaccggtaatgatgaagtagtcttagcttttaatgctcaaggtggggtagggtggacttctgtagcctctaatattgttcctaatatatgtaaagagctattagaaaaatggaataagaacgatactaaaggagcattagaaatccatcagaaattactacctttatatacagcattatttgtagaatctaatccgattccgataaaatatgctgcacattatttaggtttatgtgaaaatgaaattagacccccattaactgaagcaagcgatagtgccaaaaaacaaattgaaaacatcataacatcactatctataaaaatatga

SEQ ID NO: 72790 - protein, 294 aa, Rickettsia montana
MHNIFKGLITALITPFKDNKLDLYALERIIKHQIKHEVDAVLIAGSTGESSSLSFEEYKLLLQTSVEIVNKCIPIISGCSSNNTTYARALAAESTKIGVDGFMASPPSYVKPTQHGIYKHFEALHEVCNLPIMLYSAPTRSGVDFSDETILRLSKLPRILALKDCGVDLERPLRIRATVKKDFNILTGNDEVVLAFNAQGGVGWTSVASNIVPNICKELLEKWNKNDTKGALEIHQKLLPLYTALFVESNPIPIKYAAHYLGLCENEIRPPLTEASDSAKKQIENIITSLSIKI

SEQ ID NO: 72791 - DNA, 885 bp, Rickettsia typhi
  CDS (1)..(885)
atgtataacatatttaaaggtttaattactgcactgataacaccttttaaaaataataaactagacttatatgctttcgagagtattctaaaccagcaaataaagcatgaagtcgatgcagtattaattgcaggctcaacaggagaagctaatagtttaagttttgaagaatataaattattactgaaaactagtgtagaaattgttaataatcgtatgcctataataagtggatgttcttcaaataatactgcttatgcaatagagcttgcaatagcatctaaaaaaattggtgttgatggttttatggctagccctccatcttatgtaaaaccgactcaacacggaatttataagcattttgaagcattacatgaagcgtgtaatttacctataatgttatattccgctccaactagaagcggagtagatttttctgatgagacaatattaagacttagcaagttaccgcgtattttagcattaaaagattgtggggtagatttagagcgtcctatgcgaattagagcaatagttaaagaggattttaatattttaaccggtaatgatgaagtagttttagcatttcatgcacaaggtgtaatagggtggatttccgtaacctctaatattgcacctaagatatgtaaagagttattagacaagtggtataataatgatattcaaggtgcattagagatgcatcagaaattactacctttatataaagcattatttttagaatctaatccaattccagtaaaatatgctgcacattatttaggtttatgtgaaaatgaaattagattacccttaactgaagcaagtgatagtgcgaaaaaacaaattaaaaaaattataacatcactatctataaaaatatga

SEQ ID NO: 72792 - protein, 294 aa, Rickettsia typhi
MYNIFKGLITALITPFKNNKLDLYAFESILNQQIKHEVDAVLIAGSTGEANSLSFEEYKLLLKTSVEIVNNRMPIISGCSSNNTAYAIELAIASKKIGVDGFMASPPSYVKPTQHGIYKHFEALHEACNLPIMLYSAPTRSGVDFSDETILRLSKLPRILALKDCGVDLERPMRIRAIVKEDFNILTGNDEVVLAFHAQGVIGWISVTSNIAPKICKELLDKWYNNDIQGALEMHQKLLPLYKALFLESNPIPVKYAAHYLGLCENEIRLPLTEASDSAKKQIKKIITSLSIKI

SEQ ID NO: 72793 - DNA, 885 bp, Shewanella oneidensis
  CDS (1)..(885)
atgataaacggaagcatcgtagccttaatcacgccaatgaacagtgatggctcagtagattttgcaagtcttgaaaggttagtcgaattccatattgaccaaggcacagacgccattgttgccgtgggaaccaccggcgagtcagcgactctgccaatgaatgagcacgttaccgtggtggcgcaaaccgttaagtttgcggcaggccgtattcctgtgattggtggcaacggtgctaatgcgacagcagaagctatcgaactgaccaagtccttatctaaagtgggggttgcggccatgttaggcgtaacaccttactacaataaacccactccaaagggcttagttgcacactataaagctgtcgcggcaagcactgatattccacaaattctgtataacgttcctggacgcaccgccgttgatatgaagcccgaaactgtggctgaattagtgagcgtgagcaatattattggcgtaaaagaagcaacgggcgacgtatctcgcgttaaacgcctacgtgagctttgtggtaatgactttatgttgtatagcggtgatgacgcgacagcaagcgagtttttactcttgggtggtaatggggtgatttctgttgccaacaacatagtgccaaaagcctttaaagccatgtgcgacgctgcgcttgcgggcaatgccgaattagccgcaagcatcgacgaaccactacgtggtctgtatagcacactgttttgcgaagcaaacccgatccctgttaaatgggcggcccatcgtatggggctgattgaatgtggtcatattcgtttacctttgactgaactttctgagcaatgtcatggtctgttgttagaggcaatgactcgtgcccagatagaggttaaataa

SEQ ID NO: 72794 - protein, 294 aa, Shewanella oneidensis
MINGSIVALITPMNSDGSVDFASLERLVEFHIDQGTDAIVAVGTTGESATLPMNEHVTVVAQTVKFAAGRIPVIGGNGANATAEAIELTKSLSKVGVAAMLGVTPYYNKPTPKGLVAHYKAVAASTDIPQILYNVPGRTAVDMKPETVAELVSVSNIIGVKEATGDVSRVKRLRELCGNDFMLYSGDDATASEFLLLGGNGVISVANNIVPKAFKAMCDAALAGNAELAASIDEPLRGLYSTLFCEANPIPVKWAAHRMGLIECGHIRLPLTELSEQCHGLLLEAMTRAQIEVK

SEQ ID NO: 72795 - DNA, 888 bp, Staphylococcus aureus
  CDS (1)..(888)
atgacacatttatttgagggtgttggcgttgcacttacaaccccttttacaaataacaaagttaatattgaagctttgaaaacacacgttaattttttactagaaaataatgcccaagcaatcatcgttaatggaactactgctgagagccctactttaacaacagatgaaaaagaacgcattctaaaaacagttattgatcttgtagataaacgtgttcctgtcatagcaggaactggcactaatgatactgaaaagtcaatccaagcttcaatccaagctaaagccttaggggctgatgcaattatgttaattacgccctactacaacaaaacgaaccaacgtggtttagtcaaacactttgaagcgattgcagatgctgtgaaattaccagtcgtgctgtacaatgttccttcaagaacgaacatgacaattgaaccagaaactgtagaaatattaagtcaacatccttatatagttgctttaaaagatgctacgaatgattttgagtatttagaagaagtgaaaaagcgcattgatacaaattcatttgcattatatagtggcaatgatgacaacgtcgtcgaatactatcaacgtggcggtcaaggggttatctctgttattgccaatgtcattcctaaagaatttcaagcgttatacgatgctcaacaaagtggattagatattcaagatcaatttaaaccaatcggcacactgttatcagctttatcagttgatattaacccaattcctattaaagctctaacaagttatttaggatttggaaattatgaattacgtctaccattggttagcctagaagatacagatactaaagtgcttcgtgaaacatatgacacatttaaagcgggtgaaaatgagtag

SEQ ID NO: 72796 - protein, 295 aa, Staphylococcus aureus
MTHLFEGVGVALTTPFTNNKVNIEALKTHVNFLLENNAQAIIVNGTTAESPTLTTDEKERILKTVIDLVDKRVPVIAGTGTNDTEKSIQASIQAKALGADAIMLITPYYNKTNQRGLVKHFEAIADAVKLPVVLYNVPSRTNMTIEPETVEILSQHPYIVALKDATNDFEYLEEVKKRIDTNSFALYSGNDDNVVEYYQRGGQGVISVIANVIPKEFQALYDAQQSGLDIQDQFKPIGTLLSALSVDINPIPIKALTSYLGFGNYELRLPLVSLEDTDTKVLRETYDTFKAGENE

SEQ ID NO: 72797 - DNA, 882 bp, Streptococcus mutans
  CDS (1)..(882)
atgtcaattcaagattttaaagacgtcaacattattacagctttcatcaccccatttaaagaagacggatcaatcaattttgctgctcttccaaagcttattgagcatttactggctcatcatactcaaggtttgctcttagcgggaacaactgctgagagtcctactcttactcatgatgaagaattggagttgtttgctgccgttcaaaaaattgttaatggacgtgttcctttaattgctggtgtggggacaaatgatacacgtgattctgtcaactttgttaaagaagttgctgactttggtggtttttctgctggtttagctattgttccttattacaacaaaccgacacaagaagggctctatcagcattttatgactcttgctgatgctagtgatctgcctattattatttataatattccgggacgcgttgtgacaacattagaaactgataccatgcttcgtttggctcagcatcctaatattattggtgttaaagagtgtacaaatcttgataatattgcttatttagttgacaataagccagatgatttcttaatctttacgggtgaagatggcgaggcttttcatgctcttagtttaggggctgatggcgttattagtgtagcttcacatactaatggcgatgagttatttgctatggtggaggctattgaaaagagtgatattaaaaaggctgctgggattcagcgtcaatttcttcctaaagttcacgcgctcttctctgttgccagtccagctcctgtcaaagcagttcttaatcatcaaggttttgatgcagggcctttgcgcttgccattagttgcttgtactgatgaagaagctagacgcattattgaaattgttgagaaatga

SEQ ID NO: 72798 - protein, 293 aa, Streptococcus mutans
MSIQDFKDVNIITAFITPFKEDGSINFAALPKLIEHLLAHHTQGLLLAGTTAESPTLTHDEELELFAAVQKIVNGRVPLIAGVGTNDTRDSVNFVKEVADFGGFSAGLAIVPYYNKPTQEGLYQHFMTLADASDLPIIIYNIPGRVVTTLETDTMLRLAQHPNIIGVKECTNLDNIAYLVDNKPDDFLIFTGEDGEAFHALSLGADGVISVASHTNGDELFAMVEAIEKSDIKKAAGIQRQFLPKVHALFSVASPAPVKAVLNHQGFDAGPLRLPLVACTDEEARRIIEIVEK

SEQ ID NO: 72799 - DNA, 891 bp, Synechococcus elongatus
  CDS (1)..(891)
atgactgacttcggacgtgtcattaccgccatgattacgccatttacagcggatggcgcgatcgcctacgatgtggcggcaaaactggcacagcaccttgtggccaatggctccgatggcattgttgtttgcggcaccaccggcgaatctcccaccctcacttgggaagaggaatttcaactctttcaaacggtgcagcaggcggtggcgggcaaagctaaaattattgccggtacgggttccaactccacccgggaagccattgatgccacggcaaaggccgcagaactgggcctcgatggtgcgctcttggttgtcccctactacaataaaccgccccaagaaggactctacgcccattttcaagcgatcgccaaggcggtgccggactttcccctcatgctctacaacatccccggccgcacagggcaaaacctgctaccagaaacagtgatccgccttgctgagtacccgaacattgttgccatcaaagaagccagcggcagccttgatcaagccagtaccctgcgtgctgctctaccgccgacctttcgcatttacgccggcgatgattccctgacgttgccattactggctgttggtggttatggtgtagtcagcgttgccagtcaccttgtgggcttacgcattcaagagatgatccaagcctttgtccagggagacacggccaaagccactgctattcactgtcaactcttgccactgtttaaggctttatttgtgacgacaaacccgattccgatcaaagctgcccttagcctccaaggttggtcagtgggtgaaccccgactacccctcacgtctgcaagtgacgccgtgattagccaattgaaggctgttttagatgaccttggcctactgaagtcttaa

SEQ ID NO: 72800 - protein, 296 aa, Synechococcus elongatus
MTDFGRVITAMITPFTADGAIAYDVAAKLAQHLVANGSDGIVVCGTTGESPTLTWEEEFQLFQTVQQAVAGKAKIIAGTGSNSTREAIDATAKAAELGLDGALLVVPYYNKPPQEGLYAHFQAIAKAVPDFPLMLYNIPGRTGQNLLPETVIRLAEYPNIVAIKEASGSLDQASTLRAALPPTFRIYAGDDSLTLPLLAVGGYGVVSVASHLVGLRIQEMIQAFVQGDTAKATAIHCQLLPLFKALFVTTNPIPIKAALSLQGWSVGEPRLPLTSASDAVISQLKAVLDDLGLLKS

SEQ ID NO: 72801 - DNA, 894 bp, Thermoanaerobacter tengcongensis
  CDS (1)..(894)
atgcctgtatttaaaggttcatgtgtggccatagtgaccccttttactgaaaatggagtgaattttgacaaacttggcgaattgattgaatggcatataaaagaaggaacagatgcaatcctcatatgcggaactacgggtgaagcttccacaatgactgatgaagagcaaaaggaagccataaaatttacagtagaaaaagtggcaaagagaataccagttattgcaggaaccggttcgaacaacactgctcatgcgattgaactcagcgaatacgcacaatcagtcggagcagatgctcttttggtcatcaccccttattacaacaaaacaacacaaaaaggattggtagctcatttcactgaaatagcacgtcacgtagatatacctattataatctacaacgtgcccagcagaacatctttaaacatgttgcctgagacgtacttagaagtcaagaaaaaagcagaaaatgtggtgggagtgaaagaagcaagtggagacatatctcagatcgctgaaatcgcccgcataatgggcaagtcttttgaaatatactcaggaaatgatgaccaggtaataccaatcatgtctttaggaggtcttggagtgatctccgtaacagcaaacataattcctgcaaaaatccatgagatgacgacagcatacctcaatggagacattgaaaaagcaagagatatgcaactagaactaaatcctttaaataaagcccttttcatagagacaaatccaatacctgtaaaaacagccatgaacctcatgggctttggagtgggtcctcttcgcctgccgcttgttgaaatgagcgagaaaaaccttgaatacctaaagtcagttttaaggcagtatggccttttaaaggaggaaaattga

SEQ ID NO: 72802 - protein, 297 aa, Thermoanaerobacter tengcongensis
MPVFKGSCVAIVTPFTENGVNFDKLGELIEWHIKEGTDAILICGTTGEASTMTDEEQKEAIKFTVEKVAKRIPVIAGTGSNNTAHAIELSEYAQSVGADALLVITPYYNKTTQKGLVAHFTEIARHVDIPIIIYNVPSRTSLNMLPETYLEVKKKAENVVGVKEASGDISQIAEIARIMGKSFEIYSGNDDQVIPIMSLGGLGVISVTANIIPAKIHEMTTAYLNGDIEKARDMQLELNPLNKALFIETNPIPVKTAMNLMGFGVGPLRLPLVEMSEKNLEYLKSVLRQYGLLKEEN

SEQ ID NO: 72803 - DNA, 897 bp, Wigglesworthia glossinidia brevipalpis
  CDS (1)..(897)
atgtttacaggaagtatagtagcgttaataactccaatgaaaaaatctggtaaaatagattttgatagcataaagggattaatcgaatatcacattgtcaataatacttctgctatattagcaataggaacaactggagaaaatttttctttaacttttgaagagcaatgcaatattgtcaaatatatttttgaaacatgcgacaaaaaaatacctgttatagcaggtataatatcatctaatattgaaaatattaagaaacaaattaatttttataataaaataaatatatcgggaattttgatatctactccttattatagttgtccgacacaaaatggtatatttaattactttaaagaaatttctaaaaatacagacataccgcagattatctataataatcctaaaaggactggatgcgatattttacctgaaactgtttcaaaattatcatatataaaaaatataattggaataaaagattccagcaaagacttaagtagagtaaaaaaaataaagtttttttctaaaaaaaatttttgtttattatgtggagatgatattaacatattagattttatgcaattaggaggatgtggtgtaatttctaccgctgcaaatattatcgcatatgaatcttcaagtttatgcagattaattaataatagacattattataaagcagaaaaattatattataatattttagacttatataaaattttattaatagctcctaatccaacacccataaagtgggcttgtaattttttaggtttgataaaaacaaaatatataagattgccaatgattggtttaaataaaaaagaaatttttatgtttaaaaaaatattaaataaaattaaattaaaaagcaaaattaattgtatttaa

SEQ ID NO: 72804 - protein, 298 aa, Wigglesworthia glossinidia brevipalpis
MFTGSIVALITPMKKSGKIDFDSIKGLIEYHIVNNTSAILAIGTTGENFSLTFEEQCNIVKYIFETCDKKIPVIAGIISSNIENIKKQINFYNKINISGILISTPYYSCPTQNGIFNYFKEISKNTDIPQIIYNNPKRTGCDILPETVSKLSYIKNIIGIKDSSKDLSRVKKIKFFSKKNFCLLCGDDINILDFMQLGGCGVISTAANIIAYESSSLCRLINNRHYYKAEKLYYNILDLYKILLIAPNPTPIKWACNFLGLIKTKYIRLPMIGLNKKEIFMFKKILNKIKLKSKINCI

SEQ ID NO: 72805 - DNA, 909 bp, Xanthomonas campestris
  CDS (1)..(909)
atgtccctttccggcatcatcaccgcgctggcgacccctttcgggccggacggcacactcgacctggatgcctggcgacggctgctggagcagcagctgcacggcggtgtccagggaatcgtggttgccggctcgaccggcgaagcggcggcactgagcgacgacgagtacgacacgctggtgcgtgcggccgtggcacaggtggccggtcgtgtgcaggtactggctggcaccgggctctccggtaccgcaaaaaccatcgcgcagacccgccgtgccgccacgctgggcgcgcagtacgcgctggtggtgacgccgccttacgtgcggcccacccaggccggcctgctggcgcacttccaggcggttgccgacaacggcggcctgccggtggtgctgtacaacgtgccgggccgtaccggctgcgacctgctgccggaaacggtcgccgcgctggtgagccacccgaacatcgtcggcatcaaggaagcgcgcagcgaaccggagcgggttgccgcgctggtggccatgcgcagcgacagattcgtggtgctcagcggtgacgacggcagcgccgcccagtcaatgctggccggcgccgacggcctggtgtcggtggcgtccaacgcgctgccgtcggcctaccgccggctctgcgatctggcccgcactggtcagcacgaggccgccaacgcctgggacacgcgtctgagcgagtaccacagcttctgcggcatcgaatccaatcccatccccgtcaaggcgctgctgcagcgcgccgggatcggccacggcctgcgcttgccgttgctgccactttctgcggcccatcagccggccgccgaccgccttgccgccaacgcagttgcgttggaagcgctttccagccgcgaaatgctcgcggcctga

SEQ ID NO: 72806 - protein, 302 aa, Xanthomonas campestris
MSLSGIITALATPFGPDGTLDLDAWRRLLEQQLHGGVQGIVVAGSTGEAAALSDDEYDTLVRAAVAQVAGRVQVLAGTGLSGTAKTIAQTRRAATLGAQYALVVTPPYVRPTQAGLLAHFQAVADNGGLPVVLYNVPGRTGCDLLPETVAALVSHPNIVGIKEARSEPERVAALVAMRSDRFVVLSGDDGSAAQSMLAGADGLVSVASNALPSAYRRLCDLARTGQHEAANAWDTRLSEYHSFCGIESNPIPVKALLQRAGIGHGLRLPLLPLSAAHQPAADRLAANAVALEALSSREMLAA

SEQ ID NO: 72807 - DNA, 909 bp, Xylella fastidiosa
  CDS (1)..(909)
atgtcactttccgggattattactgcgctggtcactccgtttgatcgagatggcgcgtttgaccgtgatgcgtggattcgtctgctggatctgcaattagcgggtggcgtgcagggcgtggttattgctggttccaccggcgaagcagcgacgttgaccgatgctgagtatgacgagatgctgtgctcggctgtggtccgagttggtgggcgtgtgccggtgttggcgggtactggtttgtctgggactgcgaaaacgatttctcaaactaaacgcgcggccgacaatggtgcaggctatgctttggtggtgacccctccgtacatacgtcccaaccaaggtggtctgaaggcgcattatttggctgtggctgaccaggggggattgccagtcgtgctgtacaatgtgcctagccgcaccggctgtgatctgttgccggagactgtcgctgatttggcggggcaccctaatattgtcggcattaaggaggcgtgcgctagtcgtgagcgtgtccaggcgctgcttgctttgcgtcgtccaggctttactgtattcagtggtgatgacagcagtgctgcgcgctcgatgttggacggtgccgatggtttggtttcggttgcttccaacgtattgccgtccgcttatcgtcatctatgtgatcttgctcgggcgggtgagcgtggtgctatcgatctgtggaatgcgcgtctgtctgattttcacgcattttgtggtctcgactccaatccgattccaattaaggcattgttacagcgtatcggcattggttatggattgcgtctgccactgctacccttgtcggtatgccatcatgacattgccgatcacttggctgaccaagtggcggcattggaagcactttctagccgtaaaatagttgcggcctga

SEQ ID NO: 72808 - protein, 302 aa, Xylella fastidiosa
MSLSGIITALVTPFDRDGAFDRDAWIRLLDLQLAGGVQGVVIAGSTGEAATLTDAEYDEMLCSAVVRVGGRVPVLAGTGLSGTAKTISQTKRAADNGAGYALVVTPPYIRPNQGGLKAHYLAVADQGGLPVVLYNVPSRTGCDLLPETVADLAGHPNIVGIKEACASRERVQALLALRRPGFTVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIADHLADQVAALEALSSRKIVAA

SEQ ID NO: 72809 - DNA, 21 bp, Primer
atgttcacgggaagtattgtc

SEQ ID NO: 72810 - DNA, 24 bp, Primer
ttacagcaaaccggcatgcttaag

SEQ ID NO: 72811 - protein, 300 aa, consensus
  MISC_FEATURE (1)..(300): consensus for the disclosure of xaa see table XV
TPXXXXXXXXXXXXXXXXXXXXXXXXXXXXXXXXXGXTGEXXXXXXXEXXXXXXXXXXXXXXXXXXXXXXXXXXXGXXXXXTXXXXXXXXXXXXXGXXXXXXXXXPXYXXXXXXXXXXXXHXXXXXXXXXXXPXXXYNXPXXXXXXXXXXXXXXLXXXXXXXXXXKXXXXXXXXXXXXXXXXXXXXXXXXXXXXXGXDXXXXXXXXXXXXGXXGXXXXXXXXXXXXXXXXXXXXXXXXXXXXAXXXXXXXXXXXXXXXXXXXXXXXXXXXXXXXXXXXXXKXXXXXXGXXXXXXXXXRXP

SEQ ID NO: 72812 - protein, 48 aa, consensus
  MISC_FEATURE (1)..(48): consensus for the disclosure of xaa see table XV
XXXXXXXXXXXXXXXXXXXXXXXXXXXXXXXXXXXXXXXEXXXXXXXX

SEQ ID NO: 72813 - protein, 71 aa, consensus
  MISC_FEATURE (1)..(71): consensus for the disclosure of xaa see table XV
XXXXXXXXXXXXXXXXXXXXXXXXXXXXXXXXXXXXPXXXYXXPXXXXXXXXXXXXXXXXXXXXXXXXXKX

SEQ ID NO: 72814 - DNA, 3369 bp, Escherichia coli; identical to SEQ ID NO: 45459
  CDS (1)..(3369)

SEQ ID NO: 72815 - protein, 1122 aa, Escherichia coli; identical to SEQ ID NO: 45460

SEQ ID NO: 72816 - DNA, 3375 bp, Pasteurella multocida subsp. multocida str. Pm70; identical to SEQ ID NO: 45461
  CDS (1)..(3375): transl_table=11

SEQ ID NO: 72817 - protein, 1124 aa, Pasteurella multocida subsp. multocida str. Pm70; identical to SEQ ID NO: 45462

SEQ ID NO: 72818 - DNA, 3366 bp, Xylella fastidiosa 9a5c; identical to SEQ ID NO: 45463
  CDS (1)..(3366): transl_table=11

SEQ ID NO: 72819 - protein, 1121 aa, Xylella fastidiosa 9a5c; identical to SEQ ID NO: 45464

SEQ ID NO: 72820 - DNA, 3372 bp, Yersinia pestis CO92; identical to SEQ ID NO: 45465
  CDS (1)..(3372)

SEQ ID NO: 72821 - protein, 1123 aa, Yersinia pestis CO92; identical to SEQ ID NO: 45466

SEQ ID NO: 72822 - DNA, 3405 bp, Xanthomonas campestris pv. campestris str. ATCC 33913; identical to SEQ ID NO: 45467
  CDS (1)..(3405): transl_table=11

SEQ ID NO: 72823 - protein, 1134 aa, Xanthomonas campestris pv. campestris str. ATCC 33913; identical to SEQ ID NO: 45468

SEQ ID NO: 72824 - DNA, 3198 bp, Chlorobium tepidum TLS; identical to SEQ ID NO: 45469
  CDS (1)..(3198): transl_table=11

SEQ ID NO: 72825 - protein, 1065 aa, Chlorobium tepidum TLS; identical to SEQ ID NO: 45470

SEQ ID NO: 72826 - DNA, 3501 bp, Oceanobacillus iheyensis HTE831; identical to SEQ ID NO: 45471
  CDS (1)..(3501): transl_table=11

SEQ ID NO: 72827 - protein, 1166 aa, Oceanobacillus iheyensis HTE831; identical to SEQ ID NO: 45472

SEQ ID NO: 72828 - DNA, 3813 bp, Shewanella oneidensis MR-1; identical to SEQ ID NO: 45473
  CDS (1)..(3813): transl_table=11

SEQ ID NO: 72829 - protein, 1270 aa, Shewanella oneidensis MR-1; identical to SEQ ID NO: 45474

SEQ ID NO: 72830 - DNA, 3483 bp, Pseudomonas putida KT2440; identical to SEQ ID NO: 45475
  CDS (1)..(3483): transl_table=11

SEQ ID NO: 72831 - protein, 1160 aa, Pseudomonas putida KT2440; identical to SEQ ID NO: 45476

SEQ ID NO: 72832 - DNA, 3489 bp, Vibrio vulnificus CMCP6; identical to SEQ ID NO: 45477
  CDS (1)..(3489): transl_table=11

SEQ ID NO: 72833 - protein, 1162 aa, Vibrio vulnificus CMCP6; identical to SEQ ID NO: 45478

SEQ ID NO: 72834 - DNA, 3477 bp, Pseudomonas syringae pv. tomato str. DC3000; identical to SEQ ID NO: 45479
  CDS (1)..(3477): transl_table=11

SEQ ID NO: 72835 - protein, 1158 aa, Pseudomonas syringae pv. tomato str. DC3000; identical to SEQ ID NO: 45480

SEQ ID NO: 72836 - DNA, 3492 bp, Vibrio parahaemolyticus RIMD 2210633; identical to SEQ ID NO: 45481
  CDS (1)..(3492): transl_table=11

SEQ ID NO: 72837 - protein, 1163 aa, Vibrio parahaemolyticus RIMD 2210633; identical to SEQ ID NO: 45482

SEQ ID NO: 72838 - DNA, 3372 bp, Salmonella enterica subsp. enterica serovar Typhi Ty2; identical to SEQ ID NO: 45483
  CDS (1)..(3372): transl_table=11

SEQ ID NO: 72839 - protein, 1123 aa, Salmonella enterica subsp. enterica serovar Typhi Ty2; identical to SEQ ID NO: 45484

SEQ ID NO: 72840 - DNA, 3294 bp, Mycobacterium bovis AF2122/97; identical to SEQ ID NO: 45485
  CDS (1)..(3294): transl_table=11

SEQ ID NO: 72841 - protein, 1097 aa, Mycobacterium bovis AF2122/97; identical to SEQ ID NO: 45486

SEQ ID NO: 72842 - DNA, 3342 bp, Haemophilus ducreyi 35000HP; identical to SEQ ID NO: 45487
  CDS (1)..(3342): transl_table=11

SEQ ID NO: 72843 - protein, 1113 aa, Haemophilus ducreyi 35000HP; identical to SEQ ID NO: 45488

SEQ ID NO: 72844 - DNA, 3312 bp, Prochlorococcus marinus subsp. marinus str. CCMP1375; identical to SEQ ID NO: 45489
  CDS (1)..(3312): transl_table=11

SEQ ID NO: 72845 - protein, 1103 aa, Prochlorococcus marinus subsp. marinus str. CCMP1375; identical to SEQ ID NO: 45490

SEQ ID NO: 72846 - DNA, 3420 bp, Candidatus Blochmannia floridanus; identical to SEQ ID NO: 45491
  CDS (1)..(3420): transl_table=11

SEQ ID NO: 72847 - protein, 1139 aa, Candidatus Blochmannia floridanus; identical to SEQ ID NO: 45492

SEQ ID NO: 72848 - DNA, 3174 bp, Prochlorococcus marinus subsp. pastoris str. CCMP1986; identical to SEQ ID NO: 45493
  CDS (1)..(3174): transl_table=11

SEQ ID NO: 72849 - protein, 1057 aa, Prochlorococcus marinus subsp. pastoris str. CCMP1986; identical to SEQ ID NO: 45494

SEQ ID NO: 72850 - DNA, 3198 bp, Chromobacterium violaceum ATCC 12472; identical to SEQ ID NO: 45495
  CDS (1)..(3198): transl_table=11

SEQ ID NO: 72851 - protein, 1065 aa, Chromobacterium violaceum ATCC 12472; identical to SEQ ID NO: 45496

SEQ ID NO: 72852 - DNA, 3390 bp, Photorhabdus luminescens subsp. laumondii TTO1; identical to SEQ ID NO: 45497
  CDS (1)..(3390): transl_table=11

SEQ ID NO: 72853 - protein, 1129 aa, Photorhabdus luminescens subsp. laumondii TTO1; identical to SEQ ID NO: 45498

SEQ ID NO: 72854 - DNA, 3291 bp, Mycobacterium avium subsp. paratuberculosis str. k10; identical to SEQ ID NO: 45499
  CDS (1)..(3291): transl_table=11

SEQ ID NO: 72855 - protein, 1096 aa, Mycobacterium avium subsp. paratuberculosis str. k10; identical to SEQ ID NO: 45500

SEQ ID NO: 72856 - DNA, 3399 bp, Leptospira interrogans serovar Copenhageni str. Fiocruz L1-130; identical to SEQ ID NO: 45501
  CDS (1)..(3399): transl_table=11

SEQ ID NO: 72857 - protein, 1132 aa, Leptospira interrogans serovar Copenhageni str. Fiocruz L1-130; identical to SEQ ID NO: 45502

SEQ ID NO: 72858 - DNA, 3588 bp, Parachlamydia sp. UWE25; identical to SEQ ID NO: 45503
  CDS (1)..(3588): transl_table=11

SEQ ID NO: 72859 - protein, 1195 aa, Parachlamydia sp. UWE25; identical to SEQ ID NO: 45504

SEQ ID NO: 72860 - DNA, 3666 bp, Acinetobacter sp. ADP1; identical to SEQ ID NO: 45505
  CDS (1)..(3666): transl_table=11

SEQ ID NO: 72861 - protein, 1221 aa, Acinetobacter sp. ADP1; identical to SEQ ID NO: 45506

SEQ ID NO: 72862 - DNA, 3399 bp, Erwinia carotovora subsp. atroseptica SCRI1043; identical to SEQ ID NO: 45507
  CDS (1)..(3399)

SEQ ID NO: 72863 - protein, 1132 aa, Erwinia carotovora subsp. atroseptica SCRI1043; identical to SEQ ID NO: 45508

SEQ ID NO: 72864 - DNA, 3150 bp, Propionibacterium acnes KPA171202; identical to SEQ ID NO: 45509
  CDS (1)..(3150): transl_table=11

SEQ ID NO: 72865 - protein, 1049 aa, Propionibacterium acnes KPA171202; identical to SEQ ID NO: 45510

SEQ ID NO: 72866 - DNA, 3171 bp, Desulfotalea psychrophila LSv54; identical to SEQ ID NO: 45511
  CDS (1)..(3171): transl_table=11

SEQ ID NO: 72867 - protein, 1056 aa, Desulfotalea psychrophila LSv54; identical to SEQ ID NO: 45512

SEQ ID NO: 72868 - DNA, 3504 bp, Mannheimia succiniciproducens MBEL55E; identical to SEQ ID NO: 45513
  CDS (1)..(3504): transl_table=11

SEQ ID NO: 72869 - protein, 1167 aa, Mannheimia succiniciproducens MBEL55E; identical to SEQ ID NO: 45514

SEQ ID NO: 72870 - DNA, 3345 bp, Burkholderia pseudomallei K96243; identical to SEQ ID NO: 45515
  CDS (1)..(3345): transl_table=11

SEQ ID NO: 72871 - protein, 1114 aa, Burkholderia pseudomallei K96243; identical to SEQ ID NO: 45516

SEQ ID NO: 72872 - DNA, 3417 bp, Methylococcus capsulatus str. Bath; identical to SEQ ID NO: 45517
  CDS (1)..(3417): transl_table=11

SEQ ID NO: 72873 - protein, 1138 aa, Methylococcus capsulatus str. Bath; identical to SEQ ID NO: 45518

SEQ ID NO: 72874 - DNA, 3339 bp, Nocardia farcinica IFM 10152; identical to SEQ ID NO: 45519
  CDS (1)..(3339): transl_table=11

SEQ ID NO: 72875 - protein, 1112 aa, Nocardia farcinica IFM 10152; identical to SEQ ID NO: 45520

SEQ ID NO: 72876 - DNA, 3480 bp, Photobacterium profundum SS9; identical to SEQ ID NO: 45521
  CDS (1)..(3480): transl_table=11

SEQ ID NO: 72877 - protein, 1159 aa, Photobacterium profundum SS9; identical to SEQ ID NO: 45522

SEQ ID NO: 72878 - DNA, 3468 bp, Idiomarina loihiensis L2TR; identical to SEQ ID NO: 45523
  CDS (1)..(3468): transl_table=11

SEQ ID NO: 72879 - protein, 1155 aa, Idiomarina loihiensis L2TR; identical to SEQ ID NO: 45524

SEQ ID NO: 72880 - DNA, 3369 bp, Azoarcus sp. EbN1; identical to SEQ ID NO: 45525
  CDS (1)..(3369): transl_table=11

SEQ ID NO: 72881 - protein, 1122 aa, Azoarcus sp. EbN1; identical to SEQ ID NO: 45526

SEQ ID NO: 72882 - DNA, 3240 bp, Francisella tularensis subsp. tularensis Schu 4; identical to SEQ ID NO: 45527
  CDS (1)..(3240): transl_table=11

SEQ ID NO: 72883 - protein, 1079 aa, Francisella tularensis subsp. tularensis Schu 4; identical to SEQ ID NO: 45528

SEQ ID NO: 72884 - DNA, 3507 bp, Azotobacter vinelandii; identical to SEQ ID NO: 45529
  CDS (1)..(3507)

SEQ ID NO: 72885 - protein, 1168 aa, Azotobacter vinelandii; identical to SEQ ID NO: 45530

SEQ ID NO: 72886 - DNA, 3435 bp, Haemophilus somnus 2336; identical to SEQ ID NO: 45531
  CDS (1)..(3435)

SEQ ID NO: 72887 - protein, 1144 aa, Haemophilus somnus 2336; identical to SEQ ID NO: 45532

SEQ ID NO: 72888 - DNA, 3345 bp, Actinobacillus pleuropneumoniae serovar 1 str. 4074; identical to SEQ ID NO: 45533
  CDS (1)..(3345)

SEQ ID NO: 72889 - protein, 1114 aa, Actinobacillus pleuropneumoniae serovar 1 str. 4074; identical to SEQ ID NO: 45534

SEQ ID NO: 72890 - DNA, 4539 bp, Psychrobacter sp. 273-4; identical to SEQ ID NO: 45535
  CDS (1)..(4539)

SEQ ID NO: 72891 - protein, 1512 aa, Psychrobacter sp. 273-4; identical to SEQ ID NO: 45536

SEQ ID NO: 72892 - DNA, 3381 bp, Haemophilus influenzae R2866; identical to SEQ ID NO: 45537
  CDS (1)..(3381)

SEQ ID NO: 72893 - protein, 1126 aa, Haemophilus influenzae R2866; identical to SEQ ID NO: 45538

SEQ ID NO: 72894 - DNA, 3339 bp, Burkholderia cepacia R18194; identical to SEQ ID NO: 45539
  CDS (1)..(3339)

SEQ ID NO: 72895 - protein, 1112 aa, Burkholderia cepacia R18194; identical to SEQ ID NO: 45540

SEQ ID NO: 72896 - DNA, 3603 bp, Burkholderia cepacia R1808; identical to SEQ ID NO: 45541
  CDS (1)..(3603)

SEQ ID NO: 72897 - protein, 1200 aa, Burkholderia cepacia R1808; identical to SEQ ID NO: 45542

SEQ ID NO: 72898 - DNA, 3453 bp, Pseudomonas fluorescens PfO-1; identical to SEQ ID NO: 45543
  CDS (1)..(3453)

SEQ ID NO: 72899 - protein, 1150 aa, Pseudomonas fluorescens PfO-1; identical to SEQ ID NO: 45544

SEQ ID NO: 72900 - DNA, 3384 bp, Burkholderia fungorum LB400; identical to SEQ ID NO: 45545
  CDS (1)..(3384)

SEQ ID NO: 72901 - protein, 1127 aa, Burkholderia fungorum LB400; identical to SEQ ID NO: 45546

SEQ ID NO: 72902 - DNA, 3183 bp, Geobacter metallireducens GS-15; identical to SEQ ID NO: 45547
  CDS (1)..(3183)

SEQ ID NO: 72903 - protein, 1060 aa, Geobacter metallireducens GS-15; identical to SEQ ID NO: 45548

SEQ ID NO: 72904 - DNA, 3195 bp, Geobacter sulfurreducens; identical to SEQ ID NO: 45549
  CDS (1)..(3195): transl_table=11

SEQ ID NO: 72905 - protein, 1064 aa, Geobacter sulfurreducens; identical to SEQ ID NO: 45550

SEQ ID NO: 72906 - DNA, 3450 bp, Pseudomonas syringae; identical to SEQ ID NO: 45551
  CDS (1)..(3450): transl_table=11

SEQ ID NO: 72907 - protein, 1149 aa, Pseudomonas syringae; identical to SEQ ID NO: 45552

SEQ ID NO: 72908 - DNA, 3258 bp, Mycobacterium smegmatis; identical to SEQ ID NO: 45553
  CDS (1)..(3258): transl_table=11

SEQ ID NO: 72909 - protein, 1085 aa, Mycobacterium smegmatis; identical to SEQ ID NO: 45554

SEQ ID NO: 72910 - DNA, 3213 bp, Buchnera aphidicola; identical to SEQ ID NO: 45555
  CDS (1)..(3213)

SEQ ID NO: 72911 - protein, 1070 aa, Buchnera aphidicola; identical to SEQ ID NO: 45556

SEQ ID NO: 72912 - DNA, 3186 bp, Buchnera aphidicola; identical to SEQ ID NO: 45557
  CDS (1)..(3186): transl_table=11

SEQ ID NO: 72913 - protein, 1061 aa, Buchnera aphidicola; identical to SEQ ID NO: 45558

SEQ ID NO: 72914 - DNA, 3336 bp, Buchnera aphidicola; identical to SEQ ID NO: 45559
  CDS (1)..(3336): transl_table=11

SEQ ID NO: 72915 - protein, 1111 aa, Buchnera aphidicola; identical to SEQ ID NO: 45560

SEQ ID NO: 72916 - DNA, 25 bp, Primer
atgttaagggtctaccattccaatc

SEQ ID NO: 72917 - DNA, 26 bp, Primer
ttatgactgattaaagcgaaacagcg

SEQ ID NO: 72918 - protein, 1491 aa, consensus; identical to SEQ ID NO: 45563
  MISC_FEATURE (1)..(1491): consensus for the disclosure of xaa see table XV

SEQ ID NO: 72919 - protein, 64 aa, consensus; identical to SEQ ID NO: 45564
  MISC_FEATURE (1)..(64): consensus for the disclosure of xaa see table XV

SEQ ID NO: 72920 - protein, 105 aa, consensus; identical to SEQ ID NO: 45565
  MISC_FEATURE (1)..(105): consensus for the disclosure of xaa see table XV

SEQ ID NO: 72921 - DNA, 1518 bp, Escherichia coli; identical to SEQ ID NO: 32416
  CDS (1)..(1518)

SEQ ID NO: 72922 - protein, 505 aa, Escherichia coli; identical to SEQ ID NO: 32417

SEQ ID NO: 72923 - DNA, 1536 bp, Streptococcus thermophilus CNRZ1066; identical to SEQ ID NO: 32418
  CDS (1)..(1536)

SEQ ID NO: 72924 - protein, 511 aa, Streptococcus thermophilus CNRZ1066; identical to SEQ ID NO: 32419

SEQ ID NO: 72925 - DNA, 1512 bp, Idiomarina loihiensis L2TR; identical to SEQ ID NO: 32420
  CDS (1)..(1512)

SEQ ID NO: 72926 - protein, 503 aa, Idiomarina loihiensis L2TR; identical to SEQ ID NO: 32421

SEQ ID NO: 72927 - DNA, 1731 bp, Francisella tularensis subsp. tularensis; identical to SEQ ID NO: 32422
  CDS (1)..(1731)

SEQ ID NO: 72928 - protein, 576 aa, Francisella tularensis subsp. tularensis; identical to SEQ ID NO: 32423

SEQ ID NO: 72929 - DNA, 1737 bp, Xenopus tropicalis; identical to SEQ ID NO: 32424
  CDS (1)..(1737)

SEQ ID NO: 72930 - protein, 578 aa, Xenopus tropicalis; identical to SEQ ID NO: 32425

SEQ ID NO: 72931 - DNA, 1809 bp, Danio rerio; identical to SEQ ID NO: 32426
  CDS (1)..(1809)

SEQ ID NO: 72932 - protein, 602 aa, Danio rerio; identical to SEQ ID NO: 32427

SEQ ID NO: 72933 - DNA, 1809 bp, Arabidopsis thaliana; identical to SEQ ID NO: 32428
  CDS (1)..(1809)

SEQ ID NO: 72934 - protein, 602 aa, Arabidopsis thaliana; identical to SEQ ID NO: 32429

SEQ ID NO: 72935 - DNA, 1539 bp, Vibrio cholerae O1 biovar eltor str. N16961; identical to SEQ ID NO: 32430
  CDS (1)..(1539): transl_table=11

SEQ ID NO: 72936 - protein, 512 aa, Vibrio cholerae O1 biovar eltor str. N16961; identical to SEQ ID NO: 32431

SEQ ID NO: 72937 - DNA, 1584 bp, Chlamydophila pneumoniae J138; identical to SEQ ID NO: 32432
  CDS (1)..(1584): transl_table=11

SEQ ID NO: 72938 - protein, 527 aa, Chlamydophila pneumoniae J138; identical to SEQ ID NO: 32433

SEQ ID NO: 72939 - DNA, 1335 bp, Sulfolobus tokodaii str. 7; identical to SEQ ID NO: 32434
  CDS (1)..(1335): transl_table=11

SEQ ID NO: 72940 - protein, 444 aa, Sulfolobus tokodaii str. 7; identical to SEQ ID NO: 32435

SEQ ID NO: 72941 - DNA, 1518 bp, Escherichia coli K12; identical to SEQ ID NO: 32436
  CDS (1)..(1518): transl_table=11

SEQ ID NO: 72942 - protein, 505 aa, Escherichia coli K12; identical to SEQ ID NO: 32437

SEQ ID NO: 72943 - DNA, 1518 bp, Salmonella typhimurium LT2; identical to SEQ ID NO: 32438
  CDS (1)..(1518): transl_table=11

SEQ ID NO: 72944 - protein, 505 aa, Salmonella typhimurium LT2; identical to SEQ ID NO: 32439

SEQ ID NO: 72945 - DNA, 1449 bp, Pyrobaculum aerophilum str. IM2; identical to SEQ ID NO: 32440
  CDS (1)..(1449): transl_table=11

SEQ ID NO: 72946 - protein, 482 aa, Pyrobaculum aerophilum str. IM2; identical to SEQ ID NO: 32441

SEQ ID NO: 72947 - DNA, 1725 bp, Drosophila melanogaster; identical to SEQ ID NO: 32442
  CDS (1)..(1725)

SEQ ID NO: 72948 - protein, 574 aa, Drosophila melanogaster; identical to SEQ ID NO: 32443

SEQ ID NO: 72949 - DNA, 1323 bp, Encephalitozoon cuniculi; identical to SEQ ID NO: 32444
  CDS (1)..(1323): transl_table=11

SEQ ID NO: 72950 - protein, 440 aa, Encephalitozoon cuniculi; identical to SEQ ID NO: 32445

SEQ ID NO: 72951 - DNA, 1596 bp, Schizosaccharomyces pombe; identical to SEQ ID NO: 32446
  CDS (1)..(1596)

SEQ ID NO: 72952 - protein, 531 aa, Schizosaccharomyces pombe; identical to SEQ ID NO: 32447

SEQ ID NO: 72953 - DNA, 1776 bp, Schizosaccharomyces pombe; identical to SEQ ID NO: 32448
  CDS (1)..(1776)

SEQ ID NO: 72954 - protein, 591 aa, Schizosaccharomyces pombe; identical to SEQ ID NO: 32449

SEQ ID NO: 72955 - DNA, 1581 bp, Corynebacterium glutamicum ATCC 13032; identical to SEQ ID NO: 32450
  CDS (1)..(1581): transl_table=11

SEQ ID NO: 72956 - protein, 526 aa, Corynebacterium glutamicum ATCC 13032; identical to SEQ ID NO: 32451

SEQ ID NO: 72957 - DNA, 1683 bp, Bifidobacterium longum NCC2705; identical to SEQ ID NO: 32452
  CDS (1)..(1683): transl_table=11

SEQ ID NO: 72958 - protein, 560 aa, Bifidobacterium longum NCC2705; identical to SEQ ID NO: 32453

SEQ ID NO: 72959 - DNA, 1752 bp, Plasmodium falciparum 3D7; identical to SEQ ID NO: 32454
  CDS (1)..(1752)

SEQ ID NO: 72960 - protein, 583 aa, Plasmodium falciparum 3D7; identical to SEQ ID NO: 32455

SEQ ID NO: 72961 - DNA, 1641 bp, Rhodopirellula baltica SH 1; identical to SEQ ID NO: 32456
  CDS (1)..(1641): transl_table=11

SEQ ID NO: 72962 - protein, 546 aa, Rhodopirellula baltica SH 1; identical to SEQ ID NO: 32457

SEQ ID NO: 72963 - DNA, 1563 bp, Corynebacterium diphtheriae NCTC 13129; identical to SEQ ID NO: 32458
  CDS (1)..(1563): transl_table=11

SEQ ID NO: 72964 - protein, 520 aa, Corynebacterium diphtheriae NCTC 13129; identical to SEQ ID NO: 32459

SEQ ID NO: 72965 - DNA, 1536 bp, Onion yellows phytoplasma OY-M; identical to SEQ ID NO: 32460
  CDS (1)..(1536): transl_table=11

SEQ ID NO: 72966 - protein, 511 aa, Onion yellows phytoplasma OY-M; identical to SEQ ID NO: 32461

SEQ ID NO: 72967 - DNA, 1542 bp, Lactobacillus johnsonii NCC 533; identical to SEQ ID NO: 32462
  CDS (1)..(1542): transl_table=11

SEQ ID NO: 72968 - protein, 513 aa, Lactobacillus johnsonii NCC 533; identical to SEQ ID NO: 32463

SEQ ID NO: 72969 - DNA, 1515 bp, Bdellovibrio bacteriovorus HD100; identical to SEQ ID NO: 32464
  CDS (1)..(1515): transl_table=11

SEQ ID NO: 72970 - protein, 504 aa, Bdellovibrio bacteriovorus HD100; identical to SEQ ID NO: 32465

SEQ ID NO: 72971 - DNA, 1503 bp, Mycoplasma mycoides subsp. mycoides SC str. PG1; identical to SEQ ID NO: 32466
  CDS (1)..(1503): transl_table=4

SEQ ID NO: 72972 - protein, 500 aa, Mycoplasma mycoides subsp. mycoides SC str. PG1; identical to SEQ ID NO: 32467

SEQ ID NO: 72973 - DNA, 1500 bp, Bacillus cereus ATCC 10987; identical to SEQ ID NO: 32468
  CDS (1)..(1500): transl_table=11

SEQ ID NO: 72974 - protein, 499 aa, Bacillus cereus ATCC 10987; identical to SEQ ID NO: 32469

SEQ ID NO: 72975 - DNA, 1578 bp, Eremothecium gossypii; identical to SEQ ID NO: 32470
  CDS (1)..(1578)

SEQ ID NO: 72976 - protein, 525 aa, Eremothecium gossypii; identical to SEQ ID NO: 32471

SEQ ID NO: 72977 - DNA, 1770 bp, Eremothecium gossypii; identical to SEQ ID NO: 32472
  CDS (1)..(1770)

SEQ ID NO: 72978 - protein, 589 aa, Eremothecium gossypii; identical to SEQ ID NO: 32473

SEQ ID NO: 72979 - DNA, 1917 bp, Magnaporthe grisea 70-15; identical to SEQ ID NO: 32474
  CDS (1)..(1917)

SEQ ID NO: 72980 - protein, 638 aa, Magnaporthe grisea 70-15; identical to SEQ ID NO: 32475

SEQ ID NO: 72981 - DNA, 1833 bp, Gibberella zeae PH-1; identical to SEQ ID NO: 32476
  CDS (1)..(1833)

SEQ ID NO: 72982 - protein, 610 aa, Gibberella zeae PH-1; identical to SEQ ID NO: 32477

SEQ ID NO: 72983 - DNA, 1821 bp, Aspergillus nidulans FGSC A4; identical to SEQ ID NO: 32478
  CDS (1)..(1821)

SEQ ID NO: 72984 - protein, 606 aa, Aspergillus nidulans FGSC A4; identical to SEQ ID NO: 32479

SEQ ID NO: 72985 - DNA, 1776 bp, Candida glabrata CBS138; identical to SEQ ID NO: 32480
  CDS (1)..(1776)

SEQ ID NO: 72986 - protein, 591 aa, Candida glabrata CBS138; identical to SEQ ID NO: 32481

SEQ ID NO: 72987 - DNA, 1782 bp, Debaryomyces hansenii CBS767; identical to SEQ ID NO: 32482
  CDS (1)..(1782)

SEQ ID NO: 72988 - protein, 593 aa, Debaryomyces hansenii CBS767; identical to SEQ ID NO: 32483

SEQ ID NO: 72989 - DNA, 1761 bp, Oryza sativa (japonica cultivar-group); identical to SEQ ID NO: 32484
  CDS (1)..(1761)

SEQ ID NO: 72990 - protein, 586 aa, Oryza sativa (japonica cultivar-group); identical to SEQ ID NO: 32485

SEQ ID NO: 72991 - DNA, 1749 bp, Yarrowia lipolytica CLIB99; identical to SEQ ID NO: 32486
  CDS (1)..(1749)

SEQ ID NO: 72992 - protein, 582 aa, Yarrowia lipolytica CLIB99; identical to SEQ ID NO: 32487

SEQ ID NO: 72993 - DNA, 1488 bp, Leptospira interrogans serovar Copenhageni str. Fiocruz L1-130; identical to SEQ ID NO: 32488
  CDS (1)..(1488): transl_table=11

SEQ ID NO: 72994 - protein, 495 aa, Leptospira interrogans serovar Copenhageni str. Fiocruz L1-130; identical to SEQ ID NO: 32489

SEQ ID NO: 72995 - DNA, 1590 bp, Parachlamydia sp. UWE25; identical to SEQ ID NO: 32490
  CDS (1)..(1590): transl_table=11

SEQ ID NO: 72996 - protein, 529 aa, Parachlamydia sp. UWE25; identical to SEQ ID NO: 32491

SEQ ID NO: 72997 - DNA, 1506 bp, Desulfovibrio vulgaris subsp. vulgaris str. Hildenborough; identical to SEQ ID NO: 32492
  CDS (1)..(1506): transl_table=11

SEQ ID NO: 72998 - protein, 501 aa, Desulfovibrio vulgaris subsp. vulgaris str. Hildenborough; identical to SEQ ID NO: 32493

SEQ ID NO: 72999 - DNA, 1518 bp, Erwinia carotovora subsp. atroseptica SCRI1043; identical to SEQ ID NO: 32494
  CDS (1)..(1518)

SEQ ID NO: 73000 - protein, 505 aa, Erwinia carotovora subsp. atroseptica SCRI1043; identical to SEQ ID NO: 32495

SEQ ID NO: 73001 - DNA, 1500 bp, Mesoplasma florum L1; identical to SEQ ID NO: 32496
  CDS (1)..(1500): transl_table=4

SEQ ID NO: 73002 - protein, 499 aa, Mesoplasma florum L1; identical to SEQ ID NO: 32497

SEQ ID NO: 73003 - DNA, 1533 bp, Propionibacterium acnes KPA171202; identical to SEQ ID NO: 32498
  CDS (1)..(1533): transl_table=11

SEQ ID NO: 73004 - protein, 510 aa, Propionibacterium acnes KPA171202; identical to SEQ ID NO: 32499

SEQ ID NO: 73005 - DNA, 1515 bp, Leifsonia xyli subsp. xyli str. CTCB07; identical to SEQ ID NO: 32500
  CDS (1)..(1515): transl_table=11

SEQ ID NO: 73006 - protein, 504 aa, Leifsonia xyli subsp. xyli str. CTCB07; identical to SEQ ID NO: 32501

SEQ ID NO: 73007 - DNA, 1512 bp, Desulfotalea psychrophila LSv54; identical to SEQ ID NO: 32502
  CDS (1)..(1512): transl_table=11

SEQ ID NO: 73008 - protein, 503 aa, Desulfotalea psychrophila LSv54; identical to SEQ ID NO: 32503

SEQ ID NO: 73009 - DNA, 1488 bp, Symbiobacterium thermophilum IAM 14863; identical to SEQ ID NO: 32504
  CDS (1)..(1488): transl_table=11

SEQ ID NO: 73010 - protein, 495 aa, Symbiobacterium thermophilum IAM 14863; identical to SEQ ID NO: 32505

SEQ ID NO: 73011 - DNA, 1512 bp, Mannheimia succiniciproducens MBEL55E; identical to SEQ ID NO: 32506
  CDS (1)..(1512): transl_table=11

SEQ ID NO: 73012 - protein, 503 aa, Mannheimia succiniciproducens MBEL55E; identical to SEQ ID NO: 32507

SEQ ID NO: 73013 - DNA, 1728 bp, Bacteroides fragilis YCH46; identical to SEQ ID NO: 32508
  CDS (1)..(1728): transl_table=11

SEQ ID NO: 73014 - protein, 575 aa, Bacteroides fragilis YCH46; identical to SEQ ID NO: 32509

SEQ ID NO: 73015 - DNA, 1491 bp, Methylococcus capsulatus str. Bath; identical to SEQ ID NO: 32510
  CDS (1)..(1491): transl_table=11

SEQ ID NO: 73016 - protein, 496 aa, Methylococcus capsulatus str. Bath; identical to SEQ ID NO: 32511

SEQ ID NO: 73017 - DNA, 1467 bp, Nocardia farcinica IFM 10152; identical to SEQ ID NO: 32512
  CDS (1)..(1467): transl_table=11

SEQ ID NO: 73018 - protein, 488 aa, Nocardia farcinica IFM 10152; identical to SEQ ID NO: 32513

SEQ ID NO: 73019 - DNA, 1491 bp, Legionella pneumophila str. Paris; identical to SEQ ID NO: 32514
  CDS (1)..(1491): transl_table=11

SEQ ID NO: 73020 - protein, 496 aa, Legionella pneumophila str. Paris; identical to SEQ ID NO: 32515

SEQ ID NO: 73021 - DNA, 1509 bp, Photobacterium profundum SS9; identical to SEQ ID NO: 32516
  CDS (1)..(1509): transl_table=11

SEQ ID NO: 73022 - protein, 502 aa, Photobacterium profundum SS9; identical to SEQ ID NO: 32517

SEQ ID NO: 73023 - DNA, 1488 bp, Leuconostoc mesenteroides subsp. mesenteroides ATCC 8293; identical to SEQ ID NO: 32518
  CDS (1)..(1488)

SEQ ID NO: 73024 - protein, 495 aa, Leuconostoc mesenteroides subsp. mesenteroides ATCC 8293; identical to SEQ ID NO: 32519

SEQ ID NO: 73025 - DNA, 1503 bp, Azotobacter vinelandii; identical to SEQ ID NO: 32520
  CDS (1)..(1503)

SEQ ID NO: 73026 - protein, 500 aa, Azotobacter vinelandii; identical to SEQ ID NO: 32521

SEQ ID NO: 73027 - DNA, 1686 bp, Nostoc punctiforme PCC 73102; identical to SEQ ID NO: 32522
  CDS (1)..(1686)

SEQ ID NO: 73028 - protein, 561 aa, Nostoc punctiforme PCC 73102; identical to SEQ ID NO: 32523

SEQ ID NO: 73029 - DNA, 1503 bp, Actinobacillus pleuropneumoniae serovar 1 str. 4074; identical to SEQ ID NO: 32524
  CDS (1)..(1503)

SEQ ID NO: 73030 - protein, 500 aa, Actinobacillus pleuropneumoniae serovar 1 str. 4074; identical to SEQ ID NO: 32525

SEQ ID NO: 73031 - DNA, 1482 bp, Fusobacterium nucleatum subsp. vincentii ATCC 49256; identical to SEQ ID NO: 32526
  CDS (1)..(1482): transl_table=11

SEQ ID NO: 73032 - protein, 493 aa, Fusobacterium nucleatum subsp. vincentii ATCC 49256; identical to SEQ ID NO: 32527

SEQ ID NO: 73033 - DNA, 1545 bp, Psychrobacter sp. 273-4; identical to SEQ ID NO: 32528
  CDS (1)..(1545)

SEQ ID NO: 73034 - protein, 514 aa, Psychrobacter sp. 273-4; identical to SEQ ID NO: 32529

SEQ ID NO: 73035 - DNA, 1506 bp, Dechloromonas aromatica RCB; identical to SEQ ID NO: 32530
  CDS (1)..(1506)

SEQ ID NO: 73036 - protein, 501 aa, Dechloromonas aromatica RCB; identical to SEQ ID NO: 32531

SEQ ID NO: 73037 - DNA, 1509 bp, Haemophilus influenzae R2866; identical to SEQ ID NO: 32532
  CDS (1)..(1509)

SEQ ID NO: 73038 - protein, 502 aa, Haemophilus influenzae R2866; identical to SEQ ID NO: 32533

SEQ ID NO: 73039 - DNA, 1686 bp, Anabaena variabilis ATCC 29413; identical to SEQ ID NO: 32534
  CDS (1)..(1686)

SEQ ID NO: 73040 - protein, 561 aa, Anabaena variabilis ATCC 29413; identical to SEQ ID NO: 32535

SEQ ID NO: 73041 - DNA, 1515 bp, Synechococcus elongatus PCC 7942; identical to SEQ ID NO: 32536
  CDS (1)..(1515)

SEQ ID NO: 73042 - protein, 504 aa, Synechococcus elongatus PCC 7942; identical to SEQ ID NO: 32537

SEQ ID NO: 73043 - DNA, 1551 bp, Ralstonia eutropha JMP134; identical to SEQ ID NO: 32538
  CDS (1)..(1551)

SEQ ID NO: 73044 - protein, 516 aa, Ralstonia eutropha JMP134; identical to SEQ ID NO: 32539

SEQ ID NO: 73045 - DNA, 1530 bp, Methylobacillus flagellatus KT; identical to SEQ ID NO: 32540
  CDS (1)..(1530)

SEQ ID NO: 73046 - protein, 509 aa, Methylobacillus flagellatus KT; identical to SEQ ID NO: 32541

SEQ ID NO: 73047 - DNA, 1722 bp, Crocosphaera watsonii WH 8501; identical to SEQ ID NO: 32542
  CDS (1)..(1722)

SEQ ID NO: 73048 - protein, 573 aa, Crocosphaera watsonii WH 8501; identical to SEQ ID NO: 32543

SEQ ID NO: 73049 - DNA, 1482 bp, Exiguobacterium sp. 255-15; identical to SEQ ID NO: 32544
  CDS (1)..(1482)

SEQ ID NO: 73050 - protein, 493 aa, Exiguobacterium sp. 255-15; identical to SEQ ID NO: 32545

SEQ ID NO: 73051 - DNA, 1527 bp, Burkholderia cepacia R1808; identical to SEQ ID NO: 32546
  CDS (1)..(1527)

SEQ ID NO: 73052 - protein, 508 aa, Burkholderia cepacia R1808; identical to SEQ ID NO: 32547

SEQ ID NO: 73053 - DNA, 1527 bp, Rubrivivax gelatinosus PM1; identical to SEQ ID NO: 32548
  CDS (1)..(1527)

SEQ ID NO: 73054 - protein, 508 aa, Rubrivivax gelatinosus PM1; identical to SEQ ID NO: 32549

SEQ ID NO: 73055 - DNA, 1506 bp, Magnetococcus sp. MC-1; identical to SEQ ID NO: 32550
  CDS (1)..(1506)

SEQ ID NO: 73056 - protein, 501 aa, Magnetococcus sp. MC-1; identical to SEQ ID NO: 32551

SEQ ID NO: 73057 - DNA, 1491 bp, Thermobifida fusca; identical to SEQ ID NO: 32552
  CDS (1)..(1491)

SEQ ID NO: 73058 - protein, 496 aa, Thermobifida fusca; identical to SEQ ID NO: 32553

SEQ ID NO: 73059 - DNA, 1548 bp, Methanosarcina barkeri str. fusaro; identical to SEQ ID NO: 32554
  CDS (1)..(1548)

SEQ ID NO: 73060 - protein, 515 aa, Methanosarcina barkeri str. fusaro; identical to SEQ ID NO: 32555

SEQ ID NO: 73061 - DNA, 1476 bp, Geobacter metallireducens GS-15; identical to SEQ ID NO: 32556
  CDS (1)..(1476)

SEQ ID NO: 73062 - protein, 491 aa, Geobacter metallireducens GS-15; identical to SEQ ID NO: 32557

SEQ ID NO: 73063 - DNA, 1755 bp, Cytophaga hutchinsonii; identical to SEQ ID NO: 32558
  CDS (1)..(1755)

SEQ ID NO: 73064 - protein, 584 aa, Cytophaga hutchinsonii; identical to SEQ ID NO: 32559

SEQ ID NO: 73065 - DNA, 1509 bp, Microbulbifer degradans 2-40; identical to SEQ ID NO: 32560
  CDS (1)..(1509)

SEQ ID NO: 73066 - protein, 502 aa, Microbulbifer degradans 2-40; identical to SEQ ID NO: 32561

SEQ ID NO: 73067 - DNA, 1497 bp, Pediococcus pentosaceus ATCC 25745; identical to SEQ ID NO: 32562
  CDS (1)..(1497)

SEQ ID NO: 73068 - protein, 498 aa, Pediococcus pentosaceus ATCC 25745; identical to SEQ ID NO: 32563

SEQ ID NO: 73069 - DNA, 1569 bp, Trichodesmium erythraeum IMS101; identical to SEQ ID NO: 32564
  CDS (1)..(1569)

SEQ ID NO: 73070 - protein, 522 aa, Trichodesmium erythraeum IMS101; identical to SEQ ID NO: 32565

SEQ ID NO: 73071 - DNA, 1491 bp, Streptococcus suis 89/1591; identical to SEQ ID NO: 32566
  CDS (1)..(1491)

SEQ ID NO: 73072 - protein, 496 aa, Streptococcus suis 89/1591; identical to SEQ ID NO: 32567

SEQ ID NO: 73073 - DNA, 1506 bp, Thiobacillus denitrificans ATCC 25259; identical to SEQ ID NO: 32568
  CDS (1)..(1506)

SEQ ID NO: 73074 - protein, 501 aa, Thiobacillus denitrificans ATCC 25259; identical to SEQ ID NO: 32569

SEQ ID NO: 73075 - DNA, 1551 bp, Polaromonas sp. JS666; identical to SEQ ID NO: 32570
  CDS (1)..(1551)

SEQ ID NO: 73076 - protein, 516 aa, Polaromonas sp. JS666; identical to SEQ ID NO: 32571

SEQ ID NO: 73077 - DNA, 1734 bp, Brachydanio rerio; identical to SEQ ID NO: 32572
  CDS (1)..(1734)

SEQ ID NO: 73078 - protein, 577 aa, Brachydanio rerio; identical to SEQ ID NO: 32573

SEQ ID NO: 73079 - DNA, 1506 bp, uncultured bacterium 577; identical to SEQ ID NO: 32574
  CDS (1)..(1506): transl_table=11

SEQ ID NO: 73080 - protein, 501 aa, uncultured bacterium 577; identical to SEQ ID NO: 32575

SEQ ID NO: 73081 - DNA, 1491 bp, Candidatus Portiera aleyrodidarum; identical to SEQ ID NO: 32576
  CDS (1)..(1491): transl_table=11

SEQ ID NO: 73082 - protein, 496 aa, Candidatus Portiera aleyrodidarum; identical to SEQ ID NO: 32577

SEQ ID NO: 73083 - DNA, 1518 bp, Citrobacter freundii; identical to SEQ ID NO: 32578
  CDS (1)..(1518): transl_table=11

SEQ ID NO: 73084 - protein, 505 aa, Citrobacter freundii; identical to SEQ ID NO: 32579

SEQ ID NO: 73085 - DNA, 1497 bp, Escherichia coli; identical to SEQ ID NO: 32580
  CDS (1)..(1497): transl_table=11

SEQ ID NO: 73086 - protein, 498 aa, Escherichia coli; identical to SEQ ID NO: 32581

SEQ ID NO: 73087 - DNA, 1788 bp, Mus musculus; identical to SEQ ID NO: 32582
  CDS (1)..(1788)

SEQ ID NO: 73088 - protein, 595 aa, Mus musculus; identical to SEQ ID NO: 32583

SEQ ID NO: 73089 - DNA, 1551 bp, Methanosarcina barkeri; identical to SEQ ID NO: 32584
  CDS (1)..(1551): transl_table=11

SEQ ID NO: 73090 - protein, 516 aa, Methanosarcina barkeri; identical to SEQ ID NO: 32585

SEQ ID NO: 73091 - DNA, 1878 bp, Homo sapiens; identical to SEQ ID NO: 32586
  CDS (1)..(1878)

SEQ ID NO: 73092 - protein, 625 aa, Homo sapiens [sequence omitted]

SEQ ID NO: 73093 - DNA, 1536 bp, Methanosarcina acetivorans; identical to SEQ ID NO: 32588
  CDS (1)..(1536): transl_table=11

SEQ ID NO: 73094 - protein, 511 aa, Methanosarcina acetivorans; identical to SEQ ID NO: 32589

SEQ ID NO: 73095 - DNA, 1536 bp, Methanosarcina mazei; identical to SEQ ID NO: 32590
  CDS (1)..(1536): transl_table=11

SEQ ID NO: 73096 - protein, 511 aa, Methanosarcina mazei; identical to SEQ ID NO: 32591

SEQ ID NO: 73097 - DNA, 1779 bp, Saccharomyces cerevisiae; identical to SEQ ID NO: 32592
  CDS (1)..(1779)

SEQ ID NO: 73098 - protein, 592 aa, Saccharomyces cerevisiae; identical to SEQ ID NO: 32593

SEQ ID NO: 73099 - DNA, 1731 bp, Saccharomyces cerevisiae; identical to SEQ ID NO: 32594
  CDS (1)..(1731)

SEQ ID NO: 73100 - protein, 576 aa, Saccharomyces cerevisiae; identical to SEQ ID NO: 32595

SEQ ID NO: 73101 - DNA, 1530 bp, Acinetobacter sp; identical to SEQ ID NO: 32596
  CDS (1)..(1530): transl_table=11

SEQ ID NO: 73102 - protein, 509 aa, Acinetobacter sp; identical to SEQ ID NO: 32597

SEQ ID NO: 73103 - DNA, 1500 bp, Agrobacterium tumefaciens; identical to SEQ ID NO: 32598
  CDS (1)..(1500): transl_table=11

SEQ ID NO: 73104 - protein, 499 aa, Agrobacterium tumefaciens; identical to SEQ ID NO: 32599

SEQ ID NO: 73105 - DNA, 1686 bp, Anabaena sp; identical to SEQ ID NO: 32600
  CDS (1)..(1686): transl_table=11

SEQ ID NO: 73106 - protein, 561 aa, Anabaena sp; identical to SEQ ID NO: 32601

SEQ ID NO: 73107 - DNA, 1794 bp, Aquifex aeolicus; identical to SEQ ID NO: 32602
  CDS (1)..(1794): transl_table=11

SEQ ID NO: 73108 - protein, 597 aa, Aquifex aeolicus; identical to SEQ ID NO: 32603

SEQ ID NO: 73109 - DNA, 1881 bp, Arabidopsis thaliana; identical to SEQ ID NO: 32604
  CDS (1)..(1881)

SEQ ID NO: 73110 - protein, 626 aa, Arabidopsis thaliana; identical to SEQ ID NO: 32605

SEQ ID NO: 73111 - DNA, 1485 bp, Bacillus stearothermophilus; identical to SEQ ID NO: 32606
  CDS (1)..(1485): transl_table=11

SEQ ID NO: 73112 - protein, 494 aa, Bacillus stearothermophilus; identical to SEQ ID NO: 32607

SEQ ID NO: 73113 - DNA, 1500 bp, Bacillus subtilis; identical to SEQ ID NO: 32608
  CDS (1)..(1500): transl_table=11

SEQ ID NO: 73114 - protein, 499 aa, Bacillus subtilis; identical to SEQ ID NO: 32609

SEQ ID NO: 73115 - DNA, 1731 bp, Bacteroides thetaiotaomicron; identical to SEQ ID NO: 32610
  CDS (1)..(1731): transl_table=11

SEQ ID NO: 73116 - protein, 576 aa, Bacteroides thetaiotaomicron; identical to SEQ ID NO: 32611

SEQ ID NO: 73117 - DNA, 1521 bp, Buchnera aphidicola; identical to SEQ ID NO: 32612
  CDS (1)..(1521): transl_table=11

SEQ ID NO: 73118 - protein, 506 aa, Buchnera aphidicola; identical to SEQ ID NO: 32613

SEQ ID NO: 73119 - DNA, 1512 bp, Buchnera aphidicola; identical to SEQ ID NO: 32614
  CDS (1)..(1512): transl_table=11

SEQ ID NO: 73120 - protein, 503 aa, Buchnera aphidicola; identical to SEQ ID NO: 32615

SEQ ID NO: 73121 - DNA, 1719 bp, Caenorhabditis elegans; identical to SEQ ID NO: 32616
  CDS (1)..(1719)

SEQ ID NO: 73122 - protein, 572 aa, Caenorhabditis elegans; identical to SEQ ID NO: 32617

SEQ ID NO: 73123 - DNA, 1506 bp, Campylobacter jejuni; identical to SEQ ID NO: 32618
  CDS (1)..(1506): transl_table=11

SEQ ID NO: 73124 - protein, 501 aa, Campylobacter jejuni; identical to SEQ ID NO: 32619

SEQ ID NO: 73125 - DNA, 1458 bp, Candidatus Blochmannia floridanus; identical to SEQ ID NO: 32620
  CDS (1)..(1458): transl_table=11

SEQ ID NO: 73126 - protein, 485 aa, Candidatus Blochmannia floridanus; identical to SEQ ID NO: 32621

SEQ ID NO: 73127 - DNA, 1578 bp, Chlamydophila caviae; identical to SEQ ID NO: 32622
  CDS (1)..(1578): transl_table=11

SEQ ID NO: 73128 - protein, 525 aa, Chlamydophila caviae; identical to SEQ ID NO: 32623

SEQ ID NO: 73129 - DNA, 1536 bp, Chlorobium tepidum; identical to SEQ ID NO: 32624
  CDS (1)..(1536): transl_table=11

SEQ ID NO: 73130 - protein, 511 aa, Chlorobium tepidum; identical to SEQ ID NO: 32625

SEQ ID NO: 73131 - DNA, 1581 bp, Chlamydia trachomatis; identical to SEQ ID NO: 32626
  CDS (1)..(1581): transl_table=11

SEQ ID NO: 73132 - protein, 526 aa, Chlamydia trachomatis; identical to SEQ ID NO: 32627

SEQ ID NO: 73133 - DNA, 1509 bp, Chromobacterium violaceum; identical to SEQ ID NO: 32628
  CDS (1)..(1509): transl_table=11

SEQ ID NO: 73134 - protein, 502 aa, Chromobacterium violaceum; identical to SEQ ID NO: 32629

SEQ ID NO: 73135 - DNA, 1506 bp, Clostridium perfringens; identical to SEQ ID NO: 32630
  CDS (1)..(1506): transl_table=11

SEQ ID NO: 73136 - protein, 501 aa, Clostridium perfringens; identical to SEQ ID NO: 32631

SEQ ID NO: 73137 - DNA, 1509 bp, Clostridium tetani; identical to SEQ ID NO: 32632
  CDS (1)..(1509): transl_table=11

SEQ ID NO: 73138 - protein, 502 aa, Clostridium tetani; identical to SEQ ID NO: 32633

SEQ ID NO: 73139 - DNA, 1497 bp, Coxiella burnetii; identical to SEQ ID NO: 32634
  CDS (1)..(1497): transl_table=11

SEQ ID NO: 73140 - protein, 498 aa, Coxiella burnetii; identical to SEQ ID NO: 32635

SEQ ID NO: 73141 - DNA, 1794 bp, Cricetulus longicaudatus; identical to SEQ ID NO: 32636
  CDS (1)..(1794)

SEQ ID NO: 73142 - protein, 597 aa, Cricetulus longicaudatus; identical to SEQ ID NO: 32637

SEQ ID NO: 73143 - DNA, 1578 bp, Deinococcus radiodurans; identical to SEQ ID NO: 32638
  CDS (1)..(1578): transl_table=11

SEQ ID NO: 73144 - protein, 525 aa, Deinococcus radiodurans; identical to SEQ ID NO: 32639

SEQ ID NO: 73145 - DNA, 1497 bp, Enterococcus faecalis; identical to SEQ ID NO: 32640
  CDS (1)..(1497): transl_table=11

SEQ ID NO: 73146 - protein, 498 aa, Enterococcus faecalis; identical to SEQ ID NO: 32641

SEQ ID NO: 73147 - DNA, 1482 bp, Fusobacterium nucleatum; identical to SEQ ID NO: 32642
  CDS (1)..(1482): transl_table=11

SEQ ID NO: 73148 - protein, 493 aa, Fusobacterium nucleatum; identical to SEQ ID NO: 32643

SEQ ID NO: 73149 - DNA, 1494 bp, Gloeobacter violaceus; identical to SEQ ID NO: 32644
  CDS (1)..(1494): transl_table=11

SEQ ID NO: 73150 - protein, 497 aa, Gloeobacter violaceus; identical to SEQ ID NO: 32645

SEQ ID NO: 73151 - DNA, 1497 bp, Haemophilus ducreyi; identical to SEQ ID NO: 32646
  CDS (1)..(1497): transl_table=11

SEQ ID NO: 73152 - protein, 498 aa, Haemophilus ducreyi; identical to SEQ ID NO: 32647

SEQ ID NO: 73153 - DNA, 1557 bp, Helicobacter hepaticus; identical to SEQ ID NO: 32648
  CDS (1)..(1557): transl_table=11

SEQ ID NO: 73154 - protein, 518 aa, Helicobacter hepaticus; identical to SEQ ID NO: 32649

SEQ ID NO: 73155 - DNA, 1485 bp, Lactococcus lactis; identical to SEQ ID NO: 32650
  CDS (1)..(1485): transl_table=11

SEQ ID NO: 73156 - protein, 494 aa, Lactococcus lactis; identical to SEQ ID NO: 32651

SEQ ID NO: 73157 - DNA, 1500 bp, Lactobacillus plantarum; identical to SEQ ID NO: 32652
  CDS (1)..(1500): transl_table=11

SEQ ID NO: 73158 - protein, 499 aa, Lactobacillus plantarum; identical to SEQ ID NO: 32653

SEQ ID NO: 73159 - DNA, 1497 bp, Listeria monocytogenes; identical to SEQ ID NO: 32654
  CDS (1)..(1497): transl_table=11

SEQ ID NO: 73160 - protein, 498 aa, Listeria monocytogenes; identical to SEQ ID NO: 32655

SEQ ID NO: 73161 - DNA, 1767 bp, Lycopersicon esculentum; identical to SEQ ID NO: 32656
  CDS (1)..(1767)

SEQ ID NO: 73162 - protein, 588 aa, Lycopersicon esculentum; identical to SEQ ID NO: 32657

SEQ ID NO: 73163 - DNA, 1512 bp, Neisseria meningitidis; identical to SEQ ID NO: 32658
  CDS (1)..(1512): transl_table=11

SEQ ID NO: 73164 - protein, 503 aa, Neisseria meningitidis; identical to SEQ ID NO: 32659

SEQ ID NO: 73165 - DNA, 1509 bp, Nitrosomonas europaea; identical to SEQ ID NO: 32660
  CDS (1)..(1509): transl_table=11

SEQ ID NO: 73166 - protein, 502 aa, Nitrosomonas europaea; identical to SEQ ID NO: 32661

SEQ ID NO: 73167 - DNA, 1482 bp, Oceanobacillus iheyensis; identical to SEQ ID NO: 32662
  CDS (1)..(1482): transl_table=11

SEQ ID NO: 73168 - protein, 493 aa, Oceanobacillus iheyensis; identical to SEQ ID NO: 32663

SEQ ID NO: 73169 - DNA, 1809 bp, Oryza sativa; identical to SEQ ID NO: 32664
  CDS (1)..(1809)

SEQ ID NO: 73170 - protein, 602 aa, Oryza sativa; identical to SEQ ID NO: 32665

SEQ ID NO: 73171 - DNA, 1506 bp, Pasteurella multocida; identical to SEQ ID NO: 32666
  CDS (1)..(1506): transl_table=11

SEQ ID NO: 73172 - protein, 501 aa, Pasteurella multocida; identical to SEQ ID NO: 32667

SEQ ID NO: 73173 - DNA, 1737 bp, Porphyromonas gingivalis; identical to SEQ ID NO: 32668
  CDS (1)..(1737): transl_table=11

SEQ ID NO: 73174 - protein, 578 aa, Porphyromonas gingivalis; identical to SEQ ID NO: 32669

SEQ ID NO: 73175 - DNA, 1506 bp, Pseudomonas aeruginosa; identical to SEQ ID NO: 32670
  CDS (1)..(1506): transl_table=11

SEQ ID NO: 73176 - protein, 501 aa, Pseudomonas aeruginosa; identical to SEQ ID NO: 32671

SEQ ID NO: 73177 - DNA, 1503 bp, Pseudomonas syringae; identical to SEQ ID NO: 32672
  CDS (1)..(1503): transl_table=11

SEQ ID NO: 73178 - protein, 500 aa, Pseudomonas syringae; identical to SEQ ID NO: 32673

SEQ ID NO: 73179 - DNA, 1533 bp, Ralstonia solanacearum; identical to SEQ ID NO: 32674
  CDS (1)..(1533): transl_table=11

SEQ ID NO: 73180 - protein, 510 aa, Ralstonia solanacearum; identical to SEQ ID NO: 32675

SEQ ID NO: 73181 - DNA, 1497 bp, Rhizobium meliloti; identical to SEQ ID NO: 32676
  CDS (1)..(1497): transl_table=11

SEQ ID NO: 73182 - protein, 498 aa, Rhizobium meliloti; identical to SEQ ID NO: 32677

SEQ ID NO: 73183 - DNA, 1503 bp, Shewanella oneidensis; identical to SEQ ID NO: 32678
  CDS (1)..(1503): transl_table=11

SEQ ID NO: 73184 - protein, 500 aa, Shewanella oneidensis; identical to SEQ ID NO: 32679

SEQ ID NO: 73185 - DNA, 1488 bp, Staphylococcus aureus; identical to SEQ ID NO: 32680
  CDS (1)..(1488): transl_table=11

SEQ ID NO: 73186 - protein, 495 aa, Staphylococcus aureus; identical to SEQ ID NO: 32681

SEQ ID NO: 73187 - DNA, 1485 bp, Sulfolobus solfataricus; identical to SEQ ID NO: 32682
  CDS (1)..(1485): transl_table=11

SEQ ID NO: 73188 - protein, 494 aa, Sulfolobus solfataricus; identical to SEQ ID NO: 32683

SEQ ID NO: 73189 - DNA, 1521 bp, Synechococcus elongatus; identical to SEQ ID NO: 32684
  CDS (1)..(1521): transl_table=11

SEQ ID NO: 73190 - protein, 506 aa, Synechococcus elongatus; identical to SEQ ID NO: 32685

SEQ ID NO: 73191 - DNA, 1509 bp, Synechococcus sp; identical to SEQ ID NO: 32686
  CDS (1)..(1509): transl_table=11

SEQ ID NO: 73192 - protein, 502 aa, Synechococcus sp; identical to SEQ ID NO: 32687

SEQ ID NO: 73193 - DNA, 1509 bp, Thermotoga maritima; identical to SEQ ID NO: 32688
  CDS (1)..(1509): transl_table=11

SEQ ID NO: 73194 - protein, 502 aa, Thermotoga maritima; identical to SEQ ID NO: 32689

SEQ ID NO: 73195 - DNA, 1479 bp, Thermus thermophilus; identical to SEQ ID NO: 32690
  CDS (1)..(1479): transl_table=11

SEQ ID NO: 73196 - protein, 492 aa, Thermus thermophilus; identical to SEQ ID NO: 32691

SEQ ID NO: 73197 - DNA, 1500 bp, Thermoanaerobacter tengcongensis; identical to SEQ ID NO: 32692
  CDS (1)..(1500): transl_table=11

SEQ ID NO: 73198 - protein, 499 aa, Thermoanaerobacter tengcongensis; identical to SEQ ID NO: 32693

SEQ ID NO: 73199 - DNA, 1482 bp, Ureaplasma parvum; identical to SEQ ID NO: 32694
  CDS (1)..(1482): transl_table=4

SEQ ID NO: 73200 - protein, 493 aa, Ureaplasma parvum; identical to SEQ ID NO: 32695

SEQ ID NO: 73201 - DNA, 1518 bp, Vibrio parahaemolyticus; identical to SEQ ID NO: 32696
  CDS (1)..(1518): transl_table=11

SEQ ID NO: 73202 - protein, 505 aa, Vibrio parahaemolyticus; identical to SEQ ID NO: 32697

SEQ ID NO: 73203 - DNA, 1533 bp, Vibrio vulnificus; identical to SEQ ID NO: 32698
  CDS (1)..(1533): transl_table=11

SEQ ID NO: 73204 - protein, 510 aa, Vibrio vulnificus; identical to SEQ ID NO: 32699

SEQ ID NO: 73205 - DNA, 1482 bp, Wigglesworthia glossinidia brevipalpis; identical to SEQ ID NO: 32700
  CDS (1)..(1482): transl_table=11

SEQ ID NO: 73206 - protein, 493 aa, Wigglesworthia glossinidia brevipalpis; identical to SEQ ID NO: 32701

SEQ ID NO: 73207 - DNA, 1524 bp, Wolinella succinogenes; identical to SEQ ID NO: 32702
  CDS (1)..(1524): transl_table=11

SEQ ID NO: 73208 - protein, 507 aa, Wolinella succinogenes; identical to SEQ ID NO: 32703

SEQ ID NO: 73209 - DNA, 1518 bp, Xanthomonas campestris; identical to SEQ ID NO: 32704
  CDS (1)..(1518): transl_table=11

SEQ ID NO: 73210 - protein, 505 aa, Xanthomonas campestris; identical to SEQ ID NO: 32705

SEQ ID NO: 73211 - DNA, 1521 bp, Xylella fastidiosa; identical to SEQ ID NO: 32706
  CDS (1)..(1521): transl_table=11

SEQ ID NO: 73212 - protein, 506 aa, Xylella fastidiosa; identical to SEQ ID NO: 32707

SEQ ID NO: 73213 - DNA, 1518 bp, Yersinia pestis; identical to SEQ ID NO: 32708
  CDS (1)..(1518): transl_table=11

SEQ ID NO: 73214 - protein, 505 aa, Yersinia pestis; identical to SEQ ID NO: 32709

SEQ ID NO: 73215 - DNA, 23 bp, Primer
atgtctgaacaagaaacacgggg

SEQ ID NO: 73216 - DNA, 22 bp, Primer
ttatttctgtgggcgcatcgcc

SEQ ID NO: 73217 - protein, 561 aa, consensus; identical to SEQ ID NO: 32712
  MISC_FEATURE (1)..(561): consensus for the disclosure of xaa see table XV

SEQ ID NO: 73218 - protein, 34 aa, consensus; identical to SEQ ID NO: 32713
  MISC_FEATURE (1)..(34): consensus for the disclosure of xaa see table XV

SEQ ID NO: 73219 - protein, 46 aa, consensus; identical to SEQ ID NO: 32714
  MISC_FEATURE (1)..(46): consensus for the disclosure of xaa see table XV

SEQ ID NO: 73220 - protein, 135 aa, consensus; identical to SEQ ID NO: 32715
  MISC_FEATURE (1)..(135): consensus for the disclosure of xaa see table XV

SEQ ID NO: 73221 - protein, 62 aa, consensus; identical to SEQ ID NO: 32716
  MISC_FEATURE (1)..(62): consensus for the disclosure of xaa see table XV

SEQ ID NO: 73222 - protein, 45 aa, consensus; identical to SEQ ID NO: 32717
  MISC_FEATURE (1)..(45): consensus for the disclosure of xaa see table XV

SEQ ID NO: 73223 - DNA, 159 bp, Escherichia coli; identical to SEQ ID NO: 57058
  CDS (1)..(159)

SEQ ID NO: 73224 - protein, 52 aa, Escherichia coli; identical to SEQ ID NO: 57059

SEQ ID NO: 73225 - DNA, 25 bp, Primer
atgaacggtgctacctccttatatg

SEQ ID NO: 73226 - DNA, 26 bp, Primer
ttattctggctcattcaataattgcg

SEQ ID NO: 73227 - DNA, 1425 bp, Escherichia coli K12; identical to SEQ ID NO: 28717
  CDS (1)..(1425)

SEQ ID NO: 73228 - protein, 474 aa, Escherichia coli K12; identical to SEQ ID NO: 28718

SEQ ID NO: 73229 - DNA, 1401 bp, Haemophilus influenzae; identical to SEQ ID NO: 28719
  CDS (1)..(1401)

SEQ ID NO: 73230 - protein, 466 aa, Haemophilus influenzae; identical to SEQ ID NO: 28720

SEQ ID NO: 73231 - DNA, 1350 bp, Bacillus subtilis; identical to SEQ ID NO: 28721
  CDS (1)..(1350)

SEQ ID NO: 73232 - protein, 449 aa, Bacillus subtilis; identical to SEQ ID NO: 28722

SEQ ID NO: 73233 - DNA, 1545 bp, Xylella fastidiosa; identical to SEQ ID NO: 28723
  CDS (1)..(1545)

SEQ ID NO: 73234 - protein, 514 aa, Xylella fastidiosa; identical to SEQ ID NO: 28724

SEQ ID NO: 73235 - DNA, 1251 bp, Nostoc sp. PCC 7120; identical to SEQ ID NO: 28725
  CDS (1)..(1251)

SEQ ID NO: 73236 - protein, 416 aa, Nostoc sp. PCC 7120; identical to SEQ ID NO: 28726

SEQ ID NO: 73237 - DNA, 1428 bp, Salmonella enterica subsp. enterica serovar Typhi; identical to SEQ ID NO: 28727
  CDS (1)..(1428)

SEQ ID NO: 73238 - protein, 475 aa, Salmonella enterica subsp. enterica serovar Typhi; identical to SEQ ID NO: 28728

SEQ ID NO: 73239 - DNA, 1290 bp, Nostoc sp. PCC 7120; identical to SEQ ID NO: 28729
  CDS (1)..(1290)

SEQ ID NO: 73240 - protein, 429 aa, Nostoc sp. PCC 7120; identical to SEQ ID NO: 28730

SEQ ID NO: 73241 - DNA, 1206 bp, Nostoc sp. PCC 7120; identical to SEQ ID NO: 28731
  CDS (1)..(1206)

SEQ ID NO: 73242 - protein, 401 aa, Nostoc sp. PCC 7120; identical to SEQ ID NO: 28732

SEQ ID NO: 73243 - DNA, 1545 bp, Agrobacterium tumefaciens; identical to SEQ ID NO: 28733
  CDS (1)..(1545)

SEQ ID NO: 73244 - protein, 514 aa, Agrobacterium tumefaciens; identical to SEQ ID NO: 28734

SEQ ID NO: 73245 - DNA, 1446 bp, Yersinia pestis; identical to SEQ ID NO: 28735
  CDS (1)..(1446)

SEQ ID NO: 73246 - protein, 481 aa, Yersinia pestis; identical to SEQ ID NO: 28736

SEQ ID NO: 73247 - DNA, 1572 bp, Agrobacterium tumefaciens; identical to SEQ ID NO: 28737
  CDS (1)..(1572)

SEQ ID NO: 73248 - protein, 523 aa, Agrobacterium tumefaciens; identical to SEQ ID NO: 28738

SEQ ID NO: 73249 - DNA, 1407 bp, Agrobacterium tumefaciens; identical to SEQ ID NO: 28739
  CDS (1)..(1407)

SEQ ID NO: 73250 - protein, 468 aa, Agrobacterium tumefaciens; identical to SEQ ID NO: 28740

SEQ ID NO: 73251 - DNA, 1425 bp, Brucella melitensis; identical to SEQ ID NO: 28741
  CDS (1)..(1425)

SEQ ID NO: 73252 - protein, 474 aa, Brucella melitensis; identical to SEQ ID NO: 28742

SEQ ID NO: 73253 - DNA, 1362 bp, Aquifex aeolicus; identical to SEQ ID NO: 28743
  CDS (1)..(1362)

SEQ ID NO: 73254 - protein, 453 aa, Aquifex aeolicus; identical to SEQ ID NO: 28744

SEQ ID NO: 73255 - DNA, 1500 bp, Neisseria meningitidis; identical to SEQ ID NO: 28745
  CDS (1)..(1500)

SEQ ID NO: 73256 - protein, 499 aa, Neisseria meningitidis; identical to SEQ ID NO: 28746

SEQ ID NO: 73257 - DNA, 1170 bp, Pseudomonas aeruginosa; identical to SEQ ID NO: 28747
  CDS (1)..(1170)

SEQ ID NO: 73258 - protein, 389 aa, Pseudomonas aeruginosa; identical to SEQ ID NO: 28748

SEQ ID NO: 73259 - DNA, 1407 bp, Sinorhizobium meliloti; identical to SEQ ID NO: 28749
  CDS (1)..(1407)

SEQ ID NO: 73260 - protein, 468 aa, Sinorhizobium meliloti; identical to SEQ ID NO: 28750

SEQ ID NO: 73261 - DNA, 1332 bp, Helicobacter pylori; identical to SEQ ID NO: 28751
  CDS (1)..(1332)

SEQ ID NO: 73262 - protein, 443 aa, Helicobacter pylori; identical to SEQ ID NO: 28752

SEQ ID NO: 73263 - DNA, 1419 bp, Caulobacter crescentus; identical to SEQ ID NO: 28753
  CDS (1)..(1419)

SEQ ID NO: 73264 - protein, 472 aa, Caulobacter crescentus; identical to SEQ ID NO: 28754

SEQ ID NO: 73265 - DNA, 1446 bp, Xylella fastidiosa; identical to SEQ ID NO: 28755
  CDS (1)..(1446)

SEQ ID NO: 73266 - protein, 481 aa, Xylella fastidiosa; identical to SEQ ID NO: 28756

SEQ ID NO: 73267 - DNA, 1458 bp, Treponema pallidum subsp. pallidum (syphilis spirochete); identical to SEQ ID NO: 28757
  CDS (1)..(1458)

SEQ ID NO: 73268 - protein, 485 aa, Treponema pallidum subsp. pallidum (syphilis spirochete); identical to SEQ ID NO: 28758

SEQ ID NO: 73269 - DNA, 1380 bp, Thermotoga maritima; identical to SEQ ID NO: 28759
  CDS (1)..(1380)

SEQ ID NO: 73270 - protein, 459 aa, Thermotoga maritima; identical to SEQ ID NO: 28760

SEQ ID NO: 73271 - DNA, 1371 bp, Vibrio cholerae; identical to SEQ ID NO: 28761
  CDS (1)..(1371)

SEQ ID NO: 73272 - protein, 456 aa, Vibrio cholerae; identical to SEQ ID NO: 28762

SEQ ID NO: 73273 - DNA, 1961 bp, Pseudomonas aeruginosa; identical to SEQ ID NO: 28763
  CDS (496)..(1920)

SEQ ID NO: 73274 - protein, 474 aa, Pseudomonas aeruginosa; identical to SEQ ID NO: 28764

SEQ ID NO: 73275 - DNA, 1593 bp, Caulobacter crescentus; identical to SEQ ID NO: 28765
  CDS (1)..(1593)

SEQ ID NO: 73276 - protein, 530 aa, Caulobacter crescentus; identical to SEQ ID NO: 28766

SEQ ID NO: 73277 - DNA, 1536 bp, Rickettsia conorii; identical to SEQ ID NO: 28767
  CDS (1)..(1536)

SEQ ID NO: 73278 - protein, 511 aa, Rickettsia conorii; identical to SEQ ID NO: 28768

SEQ ID NO: 73279 - DNA, 1452 bp, Borrelia burgdorferi (Lyme disease spirochete); identical to SEQ ID NO: 28769
  CDS (1)..(1452)

SEQ ID NO: 73280 - protein, 483 aa, Borrelia burgdorferi (Lyme disease spirochete); identical to SEQ ID NO: 28770

SEQ ID NO: 73281 - DNA, 1494 bp, Chlamydia trachomatis; identical to SEQ ID NO: 28771
  CDS (1)..(1494)

SEQ ID NO: 73282 - protein, 497 aa, Chlamydia trachomatis; identical to SEQ ID NO: 28772

SEQ ID NO: 73283 - DNA, 1431 bp, Helicobacter pylori; identical to SEQ ID NO: 28773
  CDS (1)..(1431)

SEQ ID NO: 73284 - protein, 476 aa, Helicobacter pylori; identical to SEQ ID NO: 28774

SEQ ID NO: 73285 - DNA, 1302 bp, Clostridium acetobutylicum; identical to SEQ ID NO: 28775
  CDS (1)..(1302)

SEQ ID NO: 73286 - protein, 433 aa, Clostridium acetobutylicum; identical to SEQ ID NO: 28776

SEQ ID NO: 73287 - DNA, 2009 bp, Brucella abortus; identical to SEQ ID NO: 28777
  CDS (275)..(1816)

SEQ ID NO: 73288 - protein, 513 aa, Brucella abortus; identical to SEQ ID NO: 28778

SEQ ID NO: 73289 - DNA, 1185 bp, Synechocystis sp; identical to SEQ ID NO: 28779
  CDS (1)..(1185)

SEQ ID NO: 73290 - protein, 394 aa, Synechocystis sp; identical to SEQ ID NO: 28780

SEQ ID NO: 73291 - DNA, 1251 bp, Synechocystis sp; identical to SEQ ID NO: 28781
  CDS (1)..(1251)

SEQ ID NO: 73292 - protein, 416 aa, Synechocystis sp; identical to SEQ ID NO: 28782

SEQ ID NO: 73293 - DNA, 1359 bp, Synechocystis sp; identical to SEQ ID NO: 28783
  CDS (1)..(1359)

SEQ ID NO: 73294 - protein, 452 aa, Synechocystis sp; identical to SEQ ID NO: 28784

SEQ ID NO: 73295 - DNA, 1740 bp, Lactococcus lactis; identical to SEQ ID NO: 28785
  CDS (230)..(1456)

SEQ ID NO: 73296 - protein, 408 aa, Lactococcus lactis; identical to SEQ ID NO: 28786

SEQ ID NO: 73297 - DNA, 1383 bp, Rhodobacter capsulatus; identical to SEQ ID NO: 28787
  CDS (1)..(1383)

SEQ ID NO: 73298 - protein, 460 aa, Rhodobacter capsulatus; identical to SEQ ID NO: 28788

SEQ ID NO: 73299 - DNA, 1392 bp, Haemophilus influenzae; identical to SEQ ID NO: 28789
  CDS (1)..(1392)

SEQ ID NO: 73300 - protein, 463 aa, Haemophilus influenzae; identical to SEQ ID NO: 28790

SEQ ID NO: 73301 - DNA, 1800 bp, Yersinia enterocolitica; identical to SEQ ID NO: 28791
  CDS (244)..(1680)

SEQ ID NO: 73302 - protein, 478 aa, Yersinia enterocolitica; identical to SEQ ID NO: 28792

SEQ ID NO: 73303 - DNA, 2027 bp, Azotobacter vinelandii; identical to SEQ ID NO: 28793
  CDS (483)..(1904)

SEQ ID NO: 73304 - protein, 473 aa, Azotobacter vinelandii; identical to SEQ ID NO: 28794

SEQ ID NO: 73305 - DNA, 1905 bp, Brucella abortus; identical to SEQ ID NO: 28795
  CDS (333)..(1835)

SEQ ID NO: 73306 - protein, 500 aa, Brucella abortus; identical to SEQ ID NO: 28796

SEQ ID NO: 73307 - DNA, 1466 bp, Campylobacter jejuni; identical to SEQ ID NO: 28797
  CDS (48)..(1466)

SEQ ID NO: 73308 - protein, 472 aa, Campylobacter jejuni; identical to SEQ ID NO: 28798

SEQ ID NO: 73309 - DNA, 1191 bp, Pseudomonas aeruginosa; identical to SEQ ID NO: 28799
  CDS (14)..(1183)

SEQ ID NO: 73310 - protein, 389 aa, Pseudomonas aeruginosa; identical to SEQ ID NO: 28800

SEQ ID NO: 73311 - DNA, 1488 bp, Burkholderia mallei ATCC 23344; identical to SEQ ID NO: 28801
  CDS (1)..(1488)

SEQ ID NO: 73312 - protein, 495 aa, Burkholderia mallei ATCC 23344; identical to SEQ ID NO: 28802

SEQ ID NO: 73313 - DNA, 1209 bp, Burkholderia pseudomallei K96243; identical to SEQ ID NO: 28803
  CDS (1)..(1209)

SEQ ID NO: 73314 - protein, 402 aa, Burkholderia pseudomallei K96243; identical to SEQ ID NO: 28804

SEQ ID NO: 73315 - DNA, 1458 bp, Burkholderia pseudomallei K96243; identical to SEQ ID NO: 28805
  CDS (1)..(1458)

SEQ ID NO: 73316 - protein, 485 aa, Burkholderia pseudomallei K96243; identical to SEQ ID NO: 28806

SEQ ID NO: 73317 - DNA, 1557 bp, Burkholderia pseudomallei K96243; identical to SEQ ID NO: 28807
  CDS (1)..(1557)

SEQ ID NO: 73318 - protein, 518 aa, Burkholderia pseudomallei K96243; identical to SEQ ID NO: 28808

SEQ ID NO: 73319 - DNA, 1419 bp, Burkholderia pseudomallei K96243; identical to SEQ ID NO: 28809
  CDS (1)..(1419)

SEQ ID NO: 73320 - protein, 472 aa, Burkholderia pseudomallei K96243; identical to SEQ ID NO: 28810

SEQ ID NO: 73321 - DNA, 1566 bp, Bacteroides fragilis; identical to SEQ ID NO: 28811
  CDS (19)..(1566)

SEQ ID NO: 73322 - protein, 515 aa, Bacteroides fragilis; identical to SEQ ID NO: 28812

SEQ ID NO: 73323 - DNA, 2358 bp, Bacillus licheniformis DSM 13; identical to SEQ ID NO: 28813
  CDS (501)..(1871)

SEQ ID NO: 73324 - protein, 456 aa, Bacillus licheniformis DSM 13; identical to SEQ ID NO: 28814

SEQ ID NO: 73325 - DNA, 1470 bp, Mannheimia succiniciproducens MBEL55E; identical to SEQ ID NO: 28815
  CDS (1)..(1470)

SEQ ID NO: 73326 - protein, 489 aa, Mannheimia succiniciproducens MBEL55E; identical to SEQ ID NO: 28816

SEQ ID NO: 73327 - DNA, 1425 bp, Borrelia garinii PBi; identical to SEQ ID NO: 28817
  CDS (1)..(1425)

SEQ ID NO: 73328 - protein, 474 aa, Borrelia garinii PBi; identical to SEQ ID NO: 28818

SEQ ID NO: 73329 - DNA, 1224 bp, Lactococcus lactis; identical to SEQ ID NO: 28819
  CDS (1)..(1224)

SEQ ID NO: 73330 - protein, 407 aa, Lactococcus lactis; identical to SEQ ID NO: 28820

SEQ ID NO: 73331 - DNA, 1557 bp, Rickettsia typhi; identical to SEQ ID NO: 28821
  CDS (1)..(1557)

SEQ ID NO: 73332 - protein, 518 aa, Rickettsia typhi; identical to SEQ ID NO: 28822

SEQ ID NO: 73333 - DNA, 1485 bp, Onchocerca volvulus endobacterium; identical to SEQ ID NO: 28823
  CDS (1)..(1485)

SEQ ID NO: 73334 - protein, 494 aa, Onchocerca volvulus endobacterium; identical to SEQ ID NO: 28824

SEQ ID NO: 73335 - DNA, 1455 bp, Desulfotalea psychrophila; identical to SEQ ID NO: 28825
  CDS (1)..(1455)

SEQ ID NO: 73336 - protein, 484 aa, Desulfotalea psychrophila; identical to SEQ ID NO: 28826

SEQ ID NO: 73337 - DNA, 1467 bp, Erwinia carotovora; identical to SEQ ID NO: 28827
  CDS (1)..(1467)

SEQ ID NO: 73338 - protein, 488 aa, Erwinia carotovora; identical to SEQ ID NO: 28828

SEQ ID NO: 73339 - DNA, 1371 bp, Erwinia carotovora; identical to SEQ ID NO: 28829
  CDS (1)..(1371)

SEQ ID NO: 73340 - protein, 456 aa, Erwinia carotovora; identical to SEQ ID NO: 28830

SEQ ID NO: 73341 - DNA, 1404 bp, Acinetobacter sp; identical to SEQ ID NO: 28831
  CDS (1)..(1404)

SEQ ID NO: 73342 - protein, 467 aa, Acinetobacter sp; identical to SEQ ID NO: 28832

SEQ ID NO: 73343 - DNA, 1518 bp, Bartonella quintana; identical to SEQ ID NO: 28833
  CDS (1)..(1518)

SEQ ID NO: 73344 - protein, 505 aa, Bartonella quintana; identical to SEQ ID NO: 28834

SEQ ID NO: 73345 - DNA, 1395 bp, Bartonella quintana; identical to SEQ ID NO: 28835
  CDS (1)..(1395)

SEQ ID NO: 73346 - protein, 464 aa, Bartonella quintana; identical to SEQ ID NO: 28836

SEQ ID NO: 73347 - DNA, 1512 bp, Bartonella quintana; identical to SEQ ID NO: 28837
  CDS (1)..(1512)

SEQ ID NO: 73348 - protein, 503 aa, Bartonella quintana; identical to SEQ ID NO: 28838

SEQ ID NO: 73349 - DNA, 1518 bp, Bartonella henselae; identical to SEQ ID NO: 28839
  CDS (1)..(1518)

SEQ ID NO: 73350 - protein, 505 aa, Bartonella henselae; identical to SEQ ID NO: 28840

SEQ ID NO: 73351 - DNA, 1392 bp, Bartonella henselae; identical to SEQ ID NO: 28841
  CDS (1)..(1392)

SEQ ID NO: 73352 - protein, 463 aa, Bartonella henselae; identical to SEQ ID NO: 28842

SEQ ID NO: 73353 - DNA, 1368 bp, Photobacterium profundum; identical to SEQ ID NO: 28843
  CDS (1)..(1368)

SEQ ID NO: 73354 - protein, 455 aa, Photobacterium profundum; identical to SEQ ID NO: 28844

SEQ ID NO: 73355 - DNA, 1455 bp, Parachlamydia sp; identical to SEQ ID NO: 28845
  CDS (1)..(1455)

SEQ ID NO: 73356 - protein, 484 aa, Parachlamydia sp; identical to SEQ ID NO: 28846

SEQ ID NO: 73357 - DNA, 1563 bp, Rhodopseudomonas palustris; identical to SEQ ID NO: 28847
  CDS (1)..(1563)

SEQ ID NO: 73358 - protein, 520 aa, Rhodopseudomonas palustris; identical to SEQ ID NO: 28848

SEQ ID NO: 73359 - DNA, 1506 bp, Rhodopseudomonas palustris; identical to SEQ ID NO: 28849
  CDS (1)..(1506)

SEQ ID NO: 73360 - protein, 501 aa, Rhodopseudomonas palustris; identical to SEQ ID NO: 28850

SEQ ID NO: 73361 - DNA, 1200 bp, Rhodopseudomonas palustris; identical to SEQ ID NO: 28851
  CDS (1)..(1200)

SEQ ID NO: 73362 - protein, 399 aa, Rhodopseudomonas palustris; identical to SEQ ID NO: 28852

SEQ ID NO: 73363 - DNA, 1392 bp, Rhodopseudomonas palustris; identical to SEQ ID NO: 28853
  CDS (1)..(1392)

SEQ ID NO: 73364 - protein, 463 aa, Rhodopseudomonas palustris; identical to SEQ ID NO: 28854

SEQ ID NO: 73365 - DNA, 1572 bp, Rhodopseudomonas palustris; identical to SEQ ID NO: 28855
  CDS (1)..(1572)

SEQ ID NO: 73366 - protein, 523 aa, Rhodopseudomonas palustris; identical to SEQ ID NO: 28856

SEQ ID NO: 73367 - DNA, 1401 bp, uncultured bacterium 580; identical to SEQ ID NO: 28857
  CDS (1)..(1401)

SEQ ID NO: 73368 - protein, 466 aa, uncultured bacterium 580; identical to SEQ ID NO: 28858

SEQ ID NO: 73369 - DNA, 1476 bp, uncultured bacterium 106; identical to SEQ ID NO: 28859
  CDS (1)..(1476)

SEQ ID NO: 73370 - protein, 491 aa, uncultured bacterium 106; identical to SEQ ID NO: 28860

SEQ ID NO: 73371 - DNA, 1143 bp, uncultured bacterium 105; identical to SEQ ID NO: 28861
  CDS (1)..(1143)

SEQ ID NO: 73372 - protein, 380 aa, uncultured bacterium 105; identical to SEQ ID NO: 28862

SEQ ID NO: 73373 - DNA, 1395 bp, Rhizobium sp; identical to SEQ ID NO: 28863
  CDS (1)..(1395)

SEQ ID NO: 73374 - protein, 464 aa, Rhizobium sp; identical to SEQ ID NO: 28864

SEQ ID NO: 73375 - DNA, 1449 bp, Desulfovibrio vulgaris; identical to SEQ ID NO: 28865
  CDS (1)..(1449)

SEQ ID NO: 73376 - protein, 482 aa, Desulfovibrio vulgaris; identical to SEQ ID NO: 28866

SEQ ID NO: 73377 - DNA, 1167 bp, Leptospira interrogans; identical to SEQ ID NO: 28867
  CDS (1)..(1167)

SEQ ID NO: 73378 - protein, 388 aa, Leptospira interrogans; identical to SEQ ID NO: 28868

SEQ ID NO: 73379 - DNA, 1494 bp, Wolbachia pipientis wMel; identical to SEQ ID NO: 28869
  CDS (1)..(1494)

SEQ ID NO: 73380 - protein, 497 aa, Wolbachia pipientis wMel; identical to SEQ ID NO: 28870

SEQ ID NO: 73381 - DNA, 1482 bp, Treponema denticola; identical to SEQ ID NO: 28871
  CDS (1)..(1482)

SEQ ID NO: 73382 - protein, 493 aa, Treponema denticola; identical to SEQ ID NO: 28872

SEQ ID NO: 73383 - DNA, 1395 bp, Geobacter sulfurreducens; identical to SEQ ID NO: 28873
  CDS (1)..(1395)

SEQ ID NO: 73384 - protein, 464 aa, Geobacter sulfurreducens; identical to SEQ ID NO: 28874

SEQ ID NO: 73385 - DNA, 1416 bp, Geobacter sulfurreducens; identical to SEQ ID NO: 28875
  CDS (1)..(1416)

SEQ ID NO: 73386 - protein, 471 aa, Geobacter sulfurreducens; identical to SEQ ID NO: 28876

SEQ ID NO: 73387 - DNA, 1221 bp, Lactobacillus johnsonii; identical to SEQ ID NO: 28877
  CDS (1)..(1221)

SEQ ID NO: 73388 - protein, 406 aa, Lactobacillus johnsonii; identical to SEQ ID NO: 28878

SEQ ID NO: 73389 - DNA, 1425 bp, Wolinella succinogenes; identical to SEQ ID NO: 28879
  CDS (1)..(1425)

SEQ ID NO: 73390 - protein, 474 aa, Wolinella succinogenes; identical to SEQ ID NO: 28880

SEQ ID NO: 73391 - DNA, 1368 bp, Vibrio vulnificus; identical to SEQ ID NO: 28881
  CDS (1)..(1368)

SEQ ID NO: 73392 - protein, 455 aa, Vibrio vulnificus; identical to SEQ ID NO: 28882

SEQ ID NO: 73393 - DNA, 1497 bp, Porphyromonas gingivalis; identical to SEQ ID NO: 28883
  CDS (1)..(1497)

SEQ ID NO: 73394 - protein, 498 aa, Porphyromonas gingivalis; identical to SEQ ID NO: 28884

SEQ ID NO: 73395 - DNA, 1320 bp, Gloeobacter violaceus; identical to SEQ ID NO: 28885
  CDS (1)..(1320)

SEQ ID NO: 73396 - protein, 439 aa, Gloeobacter violaceus; identical to SEQ ID NO: 28886

SEQ ID NO: 73397 - DNA, 1467 bp, Chromobacterium violaceum; identical to SEQ ID NO: 28887
  CDS (1)..(1467)

SEQ ID NO: 73398 - protein, 488 aa, Chromobacterium violaceum; identical to SEQ ID NO: 28888

SEQ ID NO: 73399 - DNA, 1413 bp, Chromobacterium violaceum; identical to SEQ ID NO: 28889
  CDS (1)..(1413)

SEQ ID NO: 73400 - protein, 470 aa, Chromobacterium violaceum; identical to SEQ ID NO: 28890

SEQ ID NO: 73401 - DNA, 1158 bp, Prochlorococcus marinus; identical to SEQ ID NO: 28891
  CDS (1)..(1158)

SEQ ID NO: 73402 - protein, 385 aa, Prochlorococcus marinus; identical to SEQ ID NO: 28892

SEQ ID NO: 73403 - DNA, 1125 bp, Synechococcus sp; identical to SEQ ID NO: 28893
  CDS (1)..(1125)

SEQ ID NO: 73404 - protein, 374 aa, Synechococcus sp; identical to SEQ ID NO: 28894

SEQ ID NO: 73405 - DNA, 1299 bp, Synechococcus sp; identical to SEQ ID NO: 28895
  CDS (1)..(1299)

SEQ ID NO: 73406 - protein, 432 aa, Synechococcus sp; identical to SEQ ID NO: 28896

SEQ ID NO: 73407 - DNA, 1527 bp, Rhodopirellula baltica; identical to SEQ ID NO: 28897
  CDS (1)..(1527)

SEQ ID NO: 73408 - protein, 508 aa, Rhodopirellula baltica; identical to SEQ ID NO: 28898

SEQ ID NO: 73409 - DNA, 1530 bp, Rhodopirellula baltica; identical to SEQ ID NO: 28899
  CDS (1)..(1530)

SEQ ID NO: 73410 - protein, 509 aa, Rhodopirellula baltica; identical to SEQ ID NO: 28900

SEQ ID NO: 73411 - DNA, 1890 bp, Rhodopirellula baltica; identical to SEQ ID NO: 28901
  CDS (1)..(1890)

SEQ ID NO: 73412 - protein, 629 aa, Rhodopirellula baltica; identical to SEQ ID NO: 28902

SEQ ID NO: 73413 - DNA, 1188 bp, Prochlorococcus marinus; identical to SEQ ID NO: 28903
  CDS (1)..(1188)

SEQ ID NO: 73414 - protein, 395 aa, Prochlorococcus marinus; identical to SEQ ID NO: 28904

SEQ ID NO: 73415 - DNA, 1176 bp, Prochlorococcus marinus; identical to SEQ ID NO: 28905
  CDS (1)..(1176)

SEQ ID NO: 73416 - protein, 391 aa, Prochlorococcus marinus; identical to SEQ ID NO: 28906

SEQ ID NO: 73417 - DNA, 1434 bp, Helicobacter hepaticus; identical to SEQ ID NO: 28907
  CDS (1)..(1434)

SEQ ID NO: 73418 - protein, 477 aa, Helicobacter hepaticus; identical to SEQ ID NO: 28908

SEQ ID NO: 73419 - DNA, 1419 bp, Haemophilus ducreyi; identical to SEQ ID NO: 28909
  CDS (1)..(1419)

SEQ ID NO: 73420 - protein, 472 aa, Haemophilus ducreyi; identical to SEQ ID NO: 28910

SEQ ID NO: 73421 - DNA, 1386 bp, Candidatus Blochmannia floridanus; identical to SEQ ID NO: 28911
  CDS (1)..(1386)

SEQ ID NO: 73422 - protein, 461 aa, Candidatus Blochmannia floridanus; identical to SEQ ID NO: 28912

SEQ ID NO: 73423 - DNA, 1137 bp, Bordetella pertussis; identical to SEQ ID NO: 28913
  CDS (1)..(1137)

SEQ ID NO: 73424 - protein, 378 aa, Bordetella pertussis; identical to SEQ ID NO: 28914

SEQ ID NO: 73425 - DNA, 1116 bp, Bordetella parapertussis; identical to SEQ ID NO: 28915
  CDS (1)..(1116)

SEQ ID NO: 73426 - protein, 371 aa, Bordetella parapertussis; identical to SEQ ID NO: 28916

SEQ ID NO: 73427 - DNA, 1488 bp, Bordetella parapertussis; identical to SEQ ID NO: 28917
  CDS (1)..(1488)

SEQ ID NO: 73428 - protein, 495 aa, Bordetella parapertussis; identical to SEQ ID NO: 28918

SEQ ID NO: 73429 - DNA, 1467 bp, Chlamydophila caviae; identical to SEQ ID NO: 28919
  CDS (1)..(1467)

SEQ ID NO: 73430 - protein, 488 aa, Chlamydophila caviae; identical to SEQ ID NO: 28920

SEQ ID NO: 73431 - DNA, 1419 bp, Streptomyces avermitilis; identical to SEQ ID NO: 28921
  CDS (1)..(1419)

SEQ ID NO: 73432 - protein, 472 aa, Streptomyces avermitilis; identical to SEQ ID NO: 28922

SEQ ID NO: 73433 - DNA, 1491 bp, Nitrosomonas europaea; identical to SEQ ID NO: 28923
  CDS (1)..(1491)

SEQ ID NO: 73434 - protein, 496 aa, Nitrosomonas europaea; identical to SEQ ID NO: 28924

SEQ ID NO: 73435 - DNA, 1323 bp, Enterococcus faecalis; identical to SEQ ID NO: 28925
  CDS (25)..(1323)

SEQ ID NO: 73436 - protein, 432 aa, Enterococcus faecalis; identical to SEQ ID NO: 28926

SEQ ID NO: 73437 - DNA, 1356 bp, Coxiella burnetii; identical to SEQ ID NO: 28927
  CDS (1)..(1356)

SEQ ID NO: 73438 - protein, 451 aa, Coxiella burnetii; identical to SEQ ID NO: 28928

SEQ ID NO: 73439 - DNA, 1368 bp, Enterobacter cloacae; identical to SEQ ID NO: 28929
  CDS (1)..(1368)

SEQ ID NO: 73440 - protein, 455 aa, Enterobacter cloacae; identical to SEQ ID NO: 28930

SEQ ID NO: 73441 - DNA, 1545 bp, Xylella fastidiosa; identical to SEQ ID NO: 28931
  CDS (1)..(1545)

SEQ ID NO: 73442 - protein, 514 aa, Xylella fastidiosa; identical to SEQ ID NO: 28932

SEQ ID NO: 73443 - DNA, 1377 bp, Xylella fastidiosa; identical to SEQ ID NO: 28933
  CDS (1)..(1377)

SEQ ID NO: 73444 - protein, 458 aa, Xylella fastidiosa; identical to SEQ ID NO: 28934

SEQ ID NO: 73445 - DNA, 1368 bp, Vibrio parahaemolyticus; identical to SEQ ID NO: 28935
  CDS (1)..(1368)

SEQ ID NO: 73446 - protein, 455 aa, Vibrio parahaemolyticus; identical to SEQ ID NO: 28936

SEQ ID NO: 73447 - DNA, 1161 bp, Pseudomonas syringae; identical to SEQ ID NO: 28937
  CDS (1)..(1161)

SEQ ID NO: 73448 - protein, 386 aa, Pseudomonas syringae; identical to SEQ ID NO: 28938

SEQ ID NO: 73449 - DNA, 1440 bp, Pseudomonas syringae; identical to SEQ ID NO: 28939
  CDS (1)..(1440)

SEQ ID NO: 73450 - protein, 479 aa, Pseudomonas syringae; identical to SEQ ID NO: 28940

SEQ ID NO: 73451 - DNA, 1479 bp, Pseudomonas putida; identical to SEQ ID NO: 28941
  CDS (1)..(1479)

SEQ ID NO: 73452 - protein, 492 aa, Pseudomonas putida; identical to SEQ ID NO: 28942

SEQ ID NO: 73453 - DNA, 1524 bp, Bradyrhizobium japonicum; identical to SEQ ID NO: 28943
  CDS (1)..(1524)

SEQ ID NO: 73454 - protein, 507 aa, Bradyrhizobium japonicum; identical to SEQ ID NO: 28944

SEQ ID NO: 73455 - DNA, 1272 bp, Bradyrhizobium japonicum; identical to SEQ ID NO: 28945
  CDS (1)..(1272)

SEQ ID NO: 73456 - protein, 423 aa, Bradyrhizobium japonicum; identical to SEQ ID NO: 28946

SEQ ID NO: 73457 - DNA, 1578 bp, Bradyrhizobium japonicum; identical to SEQ ID NO: 28947
  CDS (1)..(1578)

SEQ ID NO: 73458 - protein, 525 aa, Bradyrhizobium japonicum; identical to SEQ ID NO: 28948

SEQ ID NO: 73459 - DNA, 1587 bp, Bradyrhizobium japonicum; identical to SEQ ID NO: 28949
  CDS (1)..(1587)

SEQ ID NO: 73460 - protein, 528 aa, Bradyrhizobium japonicum; identical to SEQ ID NO: 28950

SEQ ID NO: 73461 - DNA, 1536 bp, Bacteroides thetaiotaomicron; identical to SEQ ID NO: 28951
  CDS (1)..(1536)

SEQ ID NO: 73462 - protein, 511 aa, Bacteroides thetaiotaomicron; identical to SEQ ID NO: 28952

SEQ ID NO: 73463 - DNA, 1410 bp, Escherichia coli O6; identical to SEQ ID NO: 28953
  CDS (1)..(1410)

SEQ ID NO: 73464 - protein, 469 aa, Escherichia coli O6; identical to SEQ ID NO: 28954

SEQ ID NO: 73465 - DNA, 1392 bp, Yersinia pestis; identical to SEQ ID NO: 28955
  CDS (1)..(1392)

SEQ ID NO: 73466 - protein, 463 aa, Yersinia pestis; identical to SEQ ID NO: 28956

SEQ ID NO: 73467 - DNA, 1374 bp, Wigglesworthia glossinidia brevipalpis; identical to SEQ ID NO: 28957
  CDS (1)..(1374)

SEQ ID NO: 73468 - protein, 457 aa, Wigglesworthia glossinidia brevipalpis; identical to SEQ ID NO: 28958

SEQ ID NO: 73469 - DNA, 1128 bp, Synechococcus elongatus; identical to SEQ ID NO: 28959
  CDS (1)..(1128)

SEQ ID NO: 73470 - protein, 375 aa, Synechococcus elongatus; identical to SEQ ID NO: 28960

SEQ ID NO: 73471 - DNA, 1170 bp, Synechococcus elongatus; identical to SEQ ID NO: 28961
  CDS (1)..(1170)

SEQ ID NO: 73472 - protein, 389 aa, Synechococcus elongatus; identical to SEQ ID NO: 28962

SEQ ID NO: 73473 - DNA, 1353 bp, Shewanella oneidensis; identical to SEQ ID NO: 28963
  CDS (1)..(1353)

SEQ ID NO: 73474 - protein, 450 aa, Shewanella oneidensis; identical to SEQ ID NO: 28964

SEQ ID NO: 73475 - DNA, 1518 bp, Chlorobium tepidum; identical to SEQ ID NO: 28965
  CDS (1)..(1518)

SEQ ID NO: 73476 - protein, 505 aa, Chlorobium tepidum; identical to SEQ ID NO: 28966

SEQ ID NO: 73477 - DNA, 1461 bp, Rhizobium etli; identical to SEQ ID NO: 28967
  CDS (1)..(1461)

SEQ ID NO: 73478 - protein, 486 aa, Rhizobium etli; identical to SEQ ID NO: 28968

SEQ ID NO: 73479 - DNA, 1368 bp, Pasteurella piscicida; identical to SEQ ID NO: 28969
  CDS (1)..(1368)

SEQ ID NO: 73480 - protein, 455 aa, Pasteurella piscicida; identical to SEQ ID NO: 28970

SEQ ID NO: 73481 - DNA, 1437 bp, Xanthomonas campestris; identical to SEQ ID NO: 28971
  CDS (1)..(1437)

SEQ ID NO: 73482 - protein, 478 aa, Xanthomonas campestris; identical to SEQ ID NO: 28972

SEQ ID NO: 73483 - DNA, 1437 bp, Xanthomonas axonopodis; identical to SEQ ID NO: 28973
  CDS (1)..(1437)

SEQ ID NO: 73484 - protein, 478 aa, Xanthomonas axonopodis; identical to SEQ ID NO: 28974

SEQ ID NO: 73485 - DNA, 1578 bp, Xanthomonas axonopodis; identical to SEQ ID NO: 28975
  CDS (1)..(1578)

SEQ ID NO: 73486 - protein, 525 aa, Xanthomonas axonopodis; identical to SEQ ID NO: 28976

SEQ ID NO: 73487 - DNA, 2077 bp, Klebsiella pneumoniae; identical to SEQ ID NO: 28977
  CDS (374)..(1807)

SEQ ID NO: 73488 - protein, 477 aa, Klebsiella pneumoniae; identical to SEQ ID NO: 28978

SEQ ID NO: 73489 - DNA, 1536 bp, Xanthomonas campestris; identical to SEQ ID NO: 28979
  CDS (1)..(1536)

SEQ ID NO: 73490 - protein, 511 aa, Xanthomonas campestris; identical to SEQ ID NO: 28980

SEQ ID NO: 73491 - DNA, 1473 bp, Ralstonia solanacearum; identical to SEQ ID NO: 28981
  CDS (1)..(1473)

SEQ ID NO: 73492 - protein, 490 aa, Ralstonia solanacearum; identical to SEQ ID NO: 28982

SEQ ID NO: 73493 - DNA, 1518 bp, Ralstonia solanacearum; identical to SEQ ID NO: 28983
  CDS (1)..(1518)

SEQ ID NO: 73494 - protein, 505 aa, Ralstonia solanacearum; identical to SEQ ID NO: 28984

SEQ ID NO: 73495 - DNA, 1368 bp, Salmonella typhimurium; identical to SEQ ID NO: 28985
  CDS (1)..(1368)

SEQ ID NO: 73496 - protein, 455 aa, Salmonella typhimurium; identical to SEQ ID NO: 28986

SEQ ID NO: 73497 - DNA, 1512 bp, Rhizobium meliloti; identical to SEQ ID NO: 28987
  CDS (1)..(1512)

SEQ ID NO: 73498 - protein, 503 aa, Rhizobium meliloti; identical to SEQ ID NO: 28988

SEQ ID NO: 73499 - DNA, 1398 bp, Rhizobium meliloti; identical to SEQ ID NO: 28989
  CDS (1)..(1398)

SEQ ID NO: 73500 - protein, 465 aa, Rhizobium meliloti; identical to SEQ ID NO: 28990

SEQ ID NO: 73501 - DNA, 1551 bp, Rhizobium loti; identical to SEQ ID NO: 28991
  CDS (1)..(1551)

SEQ ID NO: 73502 - protein, 516 aa, Rhizobium loti; identical to SEQ ID NO: 28992

SEQ ID NO: 73503 - DNA, 1542 bp, Rhizobium loti; identical to SEQ ID NO: 28993
  CDS (1)..(1542)

SEQ ID NO: 73504 - protein, 513 aa, Rhizobium loti; identical to SEQ ID NO: 28994

SEQ ID NO: 73505 - DNA, 1515 bp, Rhizobium loti; identical to SEQ ID NO: 28995
  CDS (1)..(1515)

SEQ ID NO: 73506 - protein, 504 aa, Rhizobium loti; identical to SEQ ID NO: 28996

SEQ ID NO: 73507 - DNA, 1287 bp, Rhizobium loti; identical to SEQ ID NO: 28997
  CDS (1)..(1287)

SEQ ID NO: 73508 - protein, 428 aa, Rhizobium loti; identical to SEQ ID NO: 28998

SEQ ID NO: 73509 - DNA, 1446 bp, Pseudomonas syringae; identical to SEQ ID NO: 28999
  CDS (1)..(1446)

SEQ ID NO: 73510 - protein, 481 aa, Pseudomonas syringae; identical to SEQ ID NO: 29000

SEQ ID NO: 73511 - DNA, 1380 bp, Pasteurella multocida; identical to SEQ ID NO: 29001
  CDS (1)..(1380)

SEQ ID NO: 73512 - protein, 459 aa, Pasteurella multocida; identical to SEQ ID NO: 29002

SEQ ID NO: 73513 - DNA, 1362 bp, Aeromonas hydrophila; identical to SEQ ID NO: 29003
  CDS (1)..(1362)

SEQ ID NO: 73514 - protein, 453 aa, Aeromonas hydrophila; identical to SEQ ID NO: 29004

SEQ ID NO: 73515 - DNA, 1503 bp, Myxococcus xanthus; identical to SEQ ID NO: 29005
  CDS (1)..(1503)

SEQ ID NO: 73516 - protein, 500 aa, Myxococcus xanthus; identical to SEQ ID NO: 29006

SEQ ID NO: 73517 - DNA, 1476 bp, Shigella sonnei; identical to SEQ ID NO: 29007
  CDS (1)..(1476)

SEQ ID NO: 73518 - protein, 491 aa, Shigella sonnei; identical to SEQ ID NO: 29008

SEQ ID NO: 73519 - DNA, 1512 bp, Bartonella henselae; identical to SEQ ID NO: 29009
  CDS (1)..(1512)

SEQ ID NO: 73520 - protein, 503 aa, Bartonella henselae; identical to SEQ ID NO: 29010

SEQ ID NO: 73521 - DNA, 1437 bp, Buchnera aphidicola; identical to SEQ ID NO: 29011
  CDS (1)..(1437)

SEQ ID NO: 73522 - protein, 478 aa, Buchnera aphidicola; identical to SEQ ID NO: 29012

SEQ ID NO: 73523 - DNA, 1515 bp, Rhizobium meliloti; identical to SEQ ID NO: 29013
  CDS (1)..(1515)

SEQ ID NO: 73524 - protein, 504 aa, Rhizobium meliloti; identical to SEQ ID NO: 29014

SEQ ID NO: 73525 - DNA, 1377 bp, Bacillus subtilis; identical to SEQ ID NO: 29015
  CDS (1)..(1377)

SEQ ID NO: 73526 - protein, 458 aa, Bacillus subtilis; identical to SEQ ID NO: 29016

SEQ ID NO: 73527 - DNA, 24 bp, Primer
atgaaaaaaaccacattagcactg

SEQ ID NO: 73528 - DNA, 25 bp, Primer
ttactgcattaacaggtagatggtg

SEQ ID NO: 73529 - protein, 406 aa, consensus; identical to SEQ ID NO: 29019
  MISC_FEATURE (1)..(406): consensus for the disclosure of xaa see table XV

SEQ ID NO: 73530 - protein, 66 aa, consensus; identical to SEQ ID NO: 29020
  MISC_FEATURE (1)..(66): consensus for the disclosure of xaa see table XV

SEQ ID NO: 73531 - protein, 37 aa, consensus; identical to SEQ ID NO: 29021
  MISC_FEATURE (1)..(37): consensus for the disclosure of xaa see table XV

SEQ ID NO: 73532 - protein, 30 aa, consensus; identical to SEQ ID NO: 29022
  MISC_FEATURE (1)..(30): consensus for the disclosure of xaa see table XV

SEQ ID NO: 73533 - protein, 34 aa, consensus; identical to SEQ ID NO: 29023
  MISC_FEATURE (1)..(34): consensus for the disclosure of xaa see table XV

SEQ ID NO: 73534 - protein, 68 aa, consensus; identical to SEQ ID NO: 29024
  MISC_FEATURE (1)..(68): consensus for the disclosure of xaa see table XV

SEQ ID NO: 73535 - DNA, 501 bp, Escherichia coli
  CDS (1)..(501)
atgctggaaacagaaacgggccgctactctgacacactgcgttcggcgctggtttctctcgatggcgataacgcatgggcattaagcgaaagctggtgtggcactattcagtggatttgtccgagtccgtatcggcctcatcatgggcgcaaaaactggtttctgggcattgggcgttttaccgctgatgagcaggaacaatcggatgcaatccgttatgagacgctgcgttcgtcggggccgggcggtcaacatgtcaataaaaccgactcggcggtacgcgccacgcatttggcatccggtattagcgtgaaggttcagtcagagcgtagtcagcatgctaacaagcggctggcacgattgctgattgcctggaagctggagcaacagcaacaggaaaatagcgcggcgctgaaatcgcagcggcgaatgttccatcaccagattgaacgtggcaacccgcgacggacatttacagggatggcttttatcgaaggataa

SEQ ID NO: 73536 - protein, 166 aa, Escherichia coli
MLETETGRYSDTLRSALVSLDGDNAWALSESWCGTIQWICPSPYRPHHGRKNWFLGIGRFTADEQEQSDAIRYETLRSSGPGGQHVNKTDSAVRATHLASGISVKVQSERSQHANKRLARLLIAWKLEQQQQENSAALKSQRRMFHHQIERGNPRRTFTGMAFIEG

SEQ ID NO: 73537 - DNA, 1116 bp, Staphylococcus epidermidis RP62A
  CDS (1)..(1116)
atggaactatctgagattaaaagaaatttagaagaatatcaaaatcacttaaatcaaattagggggtctcttgacttagaaaataaagagacgaacatacaagagtatgaagaaatgatgactgatcctgatttttggaatgatcaaactaaagcacaagatatcattgataagaacaatgcactaaaatctatagtaaatgggtattatcaactgacaaatgctgtcgatgatatgagtgcgacgagagagttattacaagaagaatatgatgaggatatgaagatagaattagaagaggaagttcagcaatttgaagaacaaattgatcaatatgagttacaattactcctcgacggaccacatgatgcaaataatgctatattagagcttcatcccggtgctggcggtacagaatcacaagattgggtaagtatgcttcttaggatgtatcaacgttactgtgaacaaaatggctttaaagttgaaacggttgattatcttccaggagatgaagcaggcgttaaaagtgtcacattacttattaaaggacataatgcttatggttatttaaaggcagaaaaaggtgttcatcgtttagttagaatttcacctttcgattcatctggtagacgccatacttcttttgcatcatgtgatgttattcctgattttaataatgatgaaattgaaatcgagattaacccagatgatatcacagtggatacttttagagcttcaggcgctggtggacaacatattaacaaaactgagtctgcaattagaattacacatcaccctacaggtattgtagtcaacaaccaaaatgaacgatctcaaataaaaaatagagaagctgcaatgaaaatgttgaagtccaaactttatcaattaaagttagaagagcaagagcaagaaatggctgaaattcgaggcgaacaaaaagacattggatggggaagtcagattcgttcttacgtctttcatccatattcaatgattaaagatcatcgtacgaatgaagaaactggtaaagtagacgctgttatggatggagaaataggcccattcatagaagcttatttaagaaaagaaatggatagtcgagacgtataa

SEQ ID NO: 73538 - protein, 371 aa, Staphylococcus epidermidis RP62A
MELSEIKRNLEEYQNHLNQIRGSLDLENKETNIQEYEEMMTDPDFWNDQTKAQDIIDKNNALKSIVNGYYQLTNAVDDMSATRELLQEEYDEDMKIELEEEVQQFEEQIDQYELQLLLDGPHDANNAILELHPGAGGTESQDWVSMLLRMYQRYCEQNGFKVETVDYLPGDEAGVKSVTLLIKGHNAYGYLKAEKGVHRLVRISPFDSSGRRHTSFASCDVIPDFNNDEIEIEINPDDITVDTFRASGAGGQHINKTESAIRITHHPTGIVVNNQNERSQIKNREAAMKMLKSKLYQLKLEEQEQEMAEIRGEQKDIGWGSQIRSYVFHPYSMIKDHRTNEETGKVDAVMDGEIGPFIEAYLRKEMDSRDV

SEQ ID NO: 73539 - DNA, 969 bp, Gluconobacter oxydans 621H
  CDS (1)..(969)
atgcgcgagcggacaacgctggcgaaccagatcgaaggtgtccagcggatcgaatccgaggtcgaaggtacgctcgaactggtcgaactggcggaaatggaaggagacgaaagtctcgtccaggacgccgtgcagaccctgcgcgccattgccgaggacgttcgcaagcgcgaaatcgaaagtctgctctcgggcgaagcggacagcaatgactgctacgtcgaggtaaatgcgggcgccggtggcacggaagcccaggactgggccgagatgctcctgcgcatgtatacgcgctgggccgagcagcatggctataaggtcaccttcatcgaaggcagcgaaggcgagcaggccggcatcaagtccgccaccatccaggtgagcggccccaatgcctatggctggctcaagaccgaggcgggcgtgcaccgtctggtccggatctcacccttcgatgcggcagcccgtcgccagacgtcgtttgcgtccgtctgggtctatccggtcgtcgatgactcgatcgagatcgacatcaacgattcggacctgcgtgtcgatacgttccgagcgtccggtgcgggtggacagcacgtcaacaagacggattcggcgatccggatcacccatatccccacagggatcgtggtggcctgtcagacggaccggtcgcagcaccgcaaccgtgccaaagccatggaaatgctgcgggcccgcatgtacgaggcggagctccagaagcgtgaggcggcggctgcccagacggaagcctcaaagaccgatatcggctggggccaccagatccgttcctacgttctggcgccttaccagctggtcaaggatctacggacgggggtggagaaggggaacccgggcgccgtgctcgatggtgccctggacgacttcatgtcggcctctctggcccagagtgtgggagcgacccgctccgaagccagcgcctccgcccagtag

SEQ ID NO: 73540 - protein, 322 aa, Gluconobacter oxydans 621H
MRERTTLANQIEGVQRIESEVEGTLELVELAEMEGDESLVQDAVQTLRAIAEDVRKREIESLLSGEADSNDCYVEVNAGAGGTEAQDWAEMLLRMYTRWAEQHGYKVTFIEGSEGEQAGIKSATIQVSGPNAYGWLKTEAGVHRLVRISPFDAAARRQTSFASVWVYPVVDDSIEIDINDSDLRVDTFRASGAGGQHVNKTDSAIRITHIPTGIVVACQTDRSQHRNRAKAMEMLRARMYEAELQKREAAAAQTEASKTDIGWGHQIRSYVLAPYQLVKDLRTGVEKGNPGAVLDGALDDFMSASLAQSVGATRSEASASAQ

SEQ ID NO: 73541 - DNA, 999 bp, Lactobacillus acidophilus NCFM
  CDS (1)..(999)
atggctcagccagatttttgggataatcaagaaaaagctcaaaaactaattagtgaaaacaatgttttaaaggaaaaaagagactcattcttaaaattaagcgaagattatgaaaatgagttaactgcactcgatttgctgcgtgaagagccagattcagatttacaaacagaagttgaaacagatttaatagctttacaggaagcttttcataattatgaattagatttacttttgtctggcaaatatgatagtcataacgcattatttgaaatacatcctggtgcaggtggtactgaagcaatggactggggacaaatgctccttagaatgtatcagcgctattgtgatacagcaggttttaaatttgaaataaatgattatgaaccaggagaagaagcaggagtaaaaagtgttactgctagagtagtcggccataatgcttatggaatgctaaagtcggaaaatggtgttcatcgcttggttagaatttcaccatttgactctgccaagagacggcatacttcttttgcatcagttgaagtaattccggagattgatgatagtatcaaaattgatatcgatcctaaggatttaagaatcgatgtatatcggtcaagtggtgcaggtggacaacacattaataaaacatcaagtgctgtaagaattacgcacttaccgactggaatagtcactacatcacaggctcaacgctcacagattcaaaaccgtgagactgcaatgaatgagttgcgggctaagctatttcatttagaagaagaaaaaaagcgcaagcaaaagcaggctttgaaaggtgatcaaaaagaaattggttggggttcacaaattagatcatatgtatttcatccgtacaatttagttaaagaccttagaactggatacgaaacagctgatacaactggtgtaatggatgggaaacttcaaccatttatttattcgtatttgcaatggttgcttagtcaggaaaatccagaatag

SEQ ID NO: 73542 - protein, 332 aa, Lactobacillus acidophilus NCFM
MAQPDFWDNQEKAQKLISENNVLKEKRDSFLKLSEDYENELTALDLLREEPDSDLQTEVETDLIALQEAFHNYELDLLLSGKYDSHNALFEIHPGAGGTEAMDWGQMLLRMYQRYCDTAGFKFEINDYEPGEEAGVKSVTARVVGHNAYGMLKSENGVHRLVRISPFDSAKRRHTSFASVEVIPEIDDSIKIDIDPKDLRIDVYRSSGAGGQHINKTSSAVRITHLPTGIVTTSQAQRSQIQNRETAMNELRAKLFHLEEEKKRKQKQALKGDQKEIGWGSQIRSYVFHPYNLVKDLRTGYETADTTGVMDGKLQPFIYSYLQWLLSQENPE

SEQ ID NO: 73543 - DNA, 756 bp, Ehrlichia ruminantium str. Welgevonden
  CDS (1)..(756)
atgttttctgatgaagcagatcaaaacgattgttttatagaaattcaatctggtgctggtggtacagaaagtaatgattggtctaatatgctcttacgaatgtacataaggtgggcagaaatatatcataattttaaaacacaagttgtgtataagttagacggtgaagaaactggtgtaaaatctgccattattaaagttataggatacaatgcatatggatggtcaaaaaccgaaagtggtattcacagattagtacgtatatcaccatttaattcaaatgcaaagcgtcatactacatttgcaagtgtattagtatctccagttacaaatgagaattttgatattcaaattcacgataaagatctacgtatagatacatatagagcatctggagcaggtggacaacacgtcaacaaaacagaaagtgctgttcgtattacacacattccatcaggaatcgtagttcaatgtcaaaataatagatctcaacatcaaaatttgggtgaagcatacaacttgttaagaagcagattgtatcaattaaaattacaagagaaagaaaaaaaaatggcacaagaacatagccaaagatgtgatataggatggggaaaccaaattaggtcatatgtcatgcacccatatcaaatggtaaaagatatacgtacaggatatgaaactggtaatgtcaactcagtactagatggagacttagatgcgtttattatagcaacattaacaaaaaaaattacataa

SEQ ID NO: 73544 - protein, 251 aa, Ehrlichia ruminantium str. Welgevonden
MFSDEADQNDCFIEIQSGAGGTESNDWSNMLLRMYIRWAEIYHNFKTQVVYKLDGEETGVKSAIIKVIGYNAYGWSKTESGIHRLVRISPFNSNAKRHTTFASVLVSPVTNENFDIQIHDKDLRIDTYRASGAGGQHVNKTESAVRITHIPSGIVVQCQNNRSQHQNLGEAYNLLRSRLYQLKLQEKEKKMAQEHSQRCDIGWGNQIRSYVMHPYQMVKDIRTGYETGNVNSVLDGDLDAFIIATLTKKIT

SEQ ID NO: 73545 - DNA, 1011 bp, Wolbachia endosymbiont strain TRS of Brugia malayi
  CDS (1)..(1011)
atgcgcctcgaaaagttggagtctcagactgcggatggtaacctatggcaagacaaccaaaaggcacaagaagttttaaaagaatattctaaaattaagaatgatgtagagtcgttttcaaagctagaaagtgattataatgatgctatcagtttaatgaaatccgctattgatgaaaacgatgaagagtttttctctgaagttgaaaatgaattagtaaaactggagaaattaatcaagcgtaaagaaacagatttcttatttactgatgaagcggataataatgattgcttcttagaaatacactcaggagctggtggaacagagagcaatgattgggctgaaatgttaatgcgcatgtatataaggtgggcagagatttatcacaattttaaagttgaagttgtagaaaagttagaaggagactcaattggtataaaatctgcaataataaaaatcattggagagaaggcatatggatgggcaaaaagcgaaagtggcattcacagacttgttagaatatcaccatttgacgcaaacagtaaacgtcataccagttttgtaagcataggagtgactccagtgatagaggattcaattgatattgctgtggatgagggaactctaaagattgacacttaccgcgcttcaggggcaggcggccagcacgtgaacaaaactgaaagtgcggtgcgtgttacacacattccaacaggtgttatagttcagtgccaaaataaccgttcccagcatcagaataaaaatgaggcattgaaattacttaaagggcgtttataccaaattaaactggagaaaaaagagcagaaaatggctgaagagtacggcaaaaaatgcggcataggttggggcaatcaaatcaggtcatacgttatgcatccgtatcaaatggtaaaggatttaaggaccggatatgaggtgggtaacataaattccatcttcgatggcaatatagactgtttcatagttaatgtgctcactaataaaaattag

SEQ ID NO: 73546 - protein, 336 aa, Wolbachia endosymbiont strain TRS of Brugia malayi
MRLEKLESQTADGNLWQDNQKAQEVLKEYSKIKNDVESFSKLESDYNDAISLMKSAIDENDEEFFSEVENELVKLEKLIKRKETDFLFTDEADNNDCFLEIHSGAGGTESNDWAEMLMRMYIRWAEIYHNFKVEVVEKLEGDSIGIKSAIIKIIGEKAYGWAKSESGIHRLVRISPFDANSKRHTSFVSIGVTPVIEDSIDIAVDEGTLKIDTYRASGAGGQHVNKTESAVRVTHIPTGVIVQCQNNRSQHQNKNEALKLLKGRLYQIKLEKKEQKMAEEYGKKCGIGWGNQIRSYVMHPYQMVKDLRTGYEVGNINSIFDGNIDCFIVNVLTNKN

SEQ ID NO: 73547 - DNA, 990 bp, Xanthomonas oryzae pv. oryzae KACC10331
  CDS (1)..(990)
atgtggaacgacgccgagcgcgcgcaggccttgggccgcgagcgttcgatgctggaaaagaccgtgatcggcattgccgatgtgctgtcgggcctggtcgatgcgggtgacctgctggagctggccgagagcgaacaggacgaagacactgcattggcggtgatcgccgatctggacaagtaccagacccatgtcgagaagctggaattcgagcgcatgttctccggccagatggacggcgccaatgcgttcgtcgacatccaggccggcgccgggggcaccgaggcgcaggactgggccgaaatcctgttgcgcatgtacctgcgctgggccgagtcgcgcggctggaagaccgagctgatggaagtgtccggcggcgaagtcgcgggcatcaagtcggccaccgtccgcatcgaaggcgagtacgcctatggctggttgaagaccgagatcggcgtgcaccggctggtgcgcaagtcgccgttcgactccgataaccgccggcacaccagctttacctcggtgttcgtgtcgccggaagtggacgacaacatcgagatcgacatcaatccggccgacctgcgtaccgacgtgtatcgctcgtccggcgccggtggtcagcacgtcaacaagaccgaatcggcggtacgtatcacgcacatcccgaccaataccgtggttgcctgccagaccggccgcagccagcaccagaaccgcgacaacgcgatgaagatgctggcggccaagctgtacgagctggaagtgcagaagcgcaatgtcgagcgcgatgcgctggaagcgaccaagtccgacatcggctggggcagccagatccgcaactacgtgctcgatcagagccgcatcaaggatctgcgaaccggcatcgaacgcagcgacacgcagaaagtgctggacggcgacctggacgaattcgtcgaggccagcctgaaggccggtctcgcagcgggctccaaacgcctggatgcctga

SEQ ID NO: 73548 - protein, 329 aa, Xanthomonas oryzae pv. oryzae KACC10331
MWNDAERAQALGRERSMLEKTVIGIADVLSGLVDAGDLLELAESEQDEDTALAVIADLDKYQTHVEKLEFERMFSGQMDGANAFVDIQAGAGGTEAQDWAEILLRMYLRWAESRGWKTELMEVSGGEVAGIKSATVRIEGEYAYGWLKTEIGVHRLVRKSPFDSDNRRHTSFTSVFVSPEVDDNIEIDINPADLRTDVYRSSGAGGQHVNKTESAVRITHIPTNTVVACQTGRSQHQNRDNAMKMLAAKLYELEVQKRNVERDALEATKSDIGWGSQIRNYVLDQSRIKDLRTGIERSDTQKVLDGDLDEFVEASLKAGLAAGSKRLDA

SEQ ID NO: 73549 - DNA, 1023 bp, Mesorhizobium loti MAFF303099
  CDS (1)..(1023): transl_table=11
gtgcgggccgaggacgccagcctctggaacgaaccgctggaagcgcagaagctgatgcgcgagcgtcagggcctcgaggaaggcatcgcggcggtcaagggcctgacccaggcgctggaagacaatatcggcctgatcgagctcggcgaggaagagggcgacgagggcgtcatcaccgaggccgaagcggcgatccgctcgatgcagggcgaggccaaggcccgccaggtcgaaacgctgctgtcgggtgaagccgacgccaacgacacctatctcgaaatccatgccggcgccggcggcaccgaaagccaggactgggcctcgatgcttttgcgcatgtacacgcgctgggccgaacgccgccgcttcaaagtcgaagtgctggaagtgcatgacggcgaagaggccggcatcaagtccgcgacgctgatgatcaagggccacaatgcctatggctggctgaagactgaatccggcgtccatcgcctggtccgcatttcgccctatgacagcaatgcgcgccggcacacttccttcgccagcgtctgggtctatccggtcatcgacgacacgatcgagatcgatgtttcagaatcggacgtgcgcatcgacacctatcgctcgtcgggctctggcggccagcacgtcaacaccaccgattcggctgtgcgcatcacccatatcgccaccggcatcgcggtcgcctgccaggccgagcgttcgcagcacaagaaccgggcgaaggcctgggagatgctgcgctcgcgcctttacgaggaagagctgaagaagcgtgaggccatcgccaacgccaccgaagcctcgaagagcgacatcggctggggccaccagatccgctcctacgtgctgcagccgtaccagttggtgaaggatctgcgcaccggcgtcgaaagcaccagcccgtcgagcgtgctcgatggcgacctcgacgacttcatggaagcctcgctgtcgcaacgcatcgaaggcggcgcaggcgaggccgtggcggatctggactag

SEQ ID NO: 73550 - protein, 340 aa, Mesorhizobium loti MAFF303099
MRAEDASLWNEPLEAQKLMRERQGLEEGIAAVKGLTQALEDNIGLIELGEEEGDEGVITEAEAAIRSMQGEAKARQVETLLSGEADANDTYLEIHAGAGGTESQDWASMLLRMYTRWAERRRFKVEVLEVHDGEEAGIKSATLMIKGHNAYGWLKTESGVHRLVRISPYDSNARRHTSFASVWVYPVIDDTIEIDVSESDVRIDTYRSSGSGGQHVNTTDSAVRITHIATGIAVACQAERSQHKNRAKAWEMLRSRLYEEELKKREAIANATEASKSDIGWGHQIRSYVLQPYQLVKDLRTGVESTSPSSVLDGDLDDFMEASLSQRIEGGAGEAVADLD

SEQ ID NO: 73551 - DNA, 1449 bp, Arabidopsis thaliana
  CDS (1)..(1449)
atgttatcgttaatcatcagaaggtctcgaagcagattcatcatccatggaatcaaaatttcttgtaactctctgtcggctgtagattcaagttcttcagttttggtttctagaagaaccttcagttcaacacctgcgttaagctattttggattcaattatggaaaaatctctaatttgaatcagagatttggtaattacgcttattctgggagtagtttcgcttccagtactcgatcattgagctcagaagctgtagctgtggcagcgacttgtgatggacttactgtggaacgaattatagctaatcagtggccgattttagatgagaatgaaggtgattggaagagtcacgctgcagcaattgcacagtctattcaagtcatcaagagacgattacagtggaagaaactcttggtgaggctgaaagttttatctgcagagttgaacaagtctgatctttgggatgatccaactcatgctggtaagataagccgggagcacggctcgcttacgggaaaaatgaaaggagttatgacatttgagagagagcttcttgaacacattgacatgttgaaactcgctaaagaggagaacgattcagagttagaatcggaaactttaaaggcattgatagatatgagaagggtgtcaaaagagaaagaactcgaggctttattatctgcggataatgatccttgttcttgttatatcgaggttcaagctggagctggaggaacagagagcaatgattgggcagctatggtaatggaaatgtacaaaacatgggctcaacgacgcaaattttcagtcactgtggttgatgaagctcctggggagatagcaggaatcaagcgtgctacaatcaaagtgaacggtgaatacgcatacggatacgccaaagcagaagttggagtacataggctggtgcgtatatccccgtttgacagtggaaaacggagacacacttcgtttgcggcagttgcggtgattccaattctaggtgatgggtccacccgtgtggagatcaatgactccgatctccggattgagcggttccgttctggaggagccggtgggcagcacgctaacacgacagacagtgctgttagaatcgttcacataccaactggcataacagcaacttgtcagaatgaaaggtcacaacatagtaacaaggcttcagcaatggcagtactacaatcacggttagaccaactggaaatggctcgtcagacagcaatgaacgctcaacatacacaatcactaacagagatcagctggggaaaccagatacgaacttatgttctccatccatacagaatggtgaaggatctgcgaaccaactacgaggtctctgatcctgactcggttcttgaaggagacttagatggtttcatcttgagcttcttatcttcttctttagacaaagatgatcctgaacattag

SEQ ID NO: 73552 - protein, 482 aa, Arabidopsis thaliana
MLSLIIRRSRSRFIIHGIKISCNSLSAVDSSSSVLVSRRTFSSTPALSYFGFNYGKISNLNQRFGNYAYSGSSFASSTRSLSSEAVAVAATCDGLTVERIIANQWPILDENEGDWKSHAAAIAQSIQVIKRRLQWKKLLVRLKVLSAELNKSDLWDDPTHAGKISREHGSLTGKMKGVMTFERELLEHIDMLKLAKEENDSELESETLKALIDMRRVSKEKELEALLSADNDPCSCYIEVQAGAGGTESNDWAAMVMEMYKTWAQRRKFSVTVVDEAPGEIAGIKRATIKVNGEYAYGYAKAEVGVHRLVRISPFDSGKRRHTSFAAVAVIPILGDGSTRVEINDSDLRIERFRSGGAGGQHANTTDSAVRIVHIPTGITATCQNERSQHSNKASAMAVLQSRLDQLEMARQTAMNAQHTQSLTEISWGNQIRTYVLHPYRMVKDLRTNYEVSDPDSVLEGDLDGFILSFLSSSLDKDDPEH

SEQ ID NO: 73553 - DNA, 1047 bp, Borrelia burgdorferi B31
  CDS (1)..(1047): transl_table=11
atgccgaagacatttggaggaagctttgacaaaaatgaaattcaagctaaaatcgaaaaatatgaaaaagaaataaaccagaaaaatttttggaatgatcctaaaagagctcaaaaagtaattaaggctcaaagtattttaaaaaataaaattgatccgtgggaagagctaataaataaaataaaagacttaagcgatttgtgcgaaattgccgaaaatgaaaaagatactaacggcttggaaattgaatttaatacgcttgaaaaacaatacaaagatttactcacaatttcttactttaaagaagagcttgacgcaaacaatgcttttttaactattcattctggggctgggggcactgaagcatgtgactgggtcgcaatgctttacagaatgtattcaagatacgctgagagaaaaaaatacaaaacagaacttattgatttactcgaagcagaaggtggaataaaatctgttacaatagaaatcaaaggtgagtatgcttatgggctattgaaaagtgaagttggaatacatcgtcttataagaatttctccttttgatgctgctaaaaaaaggcatacctcttttgcatcagtatttgttgaccctgttattgatgacaaaatagaaataacaatcaaaccagaagacataagaattgatacatacagagcatcgggagccggaggacaacacgtcaataaaacatcctctgctgtaagaataactcacattgaaacaggaatagtaactcagtctcaaagcgacagaagccagcacaaaaacaaagacttggcaatgaaagttttaaaatcaagactttatgaatactataagagcaaagaagatgaaaaaaacaaatccaagcaagacacaaaaaaagaaatttcttggggcaaccaaataagatcttacgtatttcaaccttacaatttggtaaaagatcacagaacaaaatttgaaaattcaaacaccacttcggttatggacggaaacatagacaatttcatagaagagtatctaaaatggaaaagcttaaactaa

SEQ ID NO: 73554 - protein, 348 aa, Borrelia burgdorferi B31
MPKTFGGSFDKNEIQAKIEKYEKEINQKNFWNDPKRAQKVIKAQSILKNKIDPWEELINKIKDLSDLCEIAENEKDTNGLEIEFNTLEKQYKDLLTISYFKEELDANNAFLTIHSGAGGTEACDWVAMLYRMYSRYAERKKYKTELIDLLEAEGGIKSVTIEIKGEYAYGLLKSEVGIHRLIRISPFDAAKKRHTSFASVFVDPVIDDKIEITIKPEDIRIDTYRASGAGGQHVNKTSSAVRITHIETGIVTQSQSDRSQHKNKDLAMKVLKSRLYEYYKSKEDEKNKSKQDTKKEISWGNQIRSYVFQPYNLVKDHRTKFENSNTTSVMDGNIDNFIEEYLKWKSLN

SEQ ID NO: 73555 - DNA, 1098 bp, Vibrio cholerae O1 biovar eltor str. N16961
  CDS (1)..(1098): transl_table=11
atgtttgaaatcaatcctattaaaaaccgcctgcaggatgtgtctgaacgcacaaatatcctgagggggtatcttgactatgacgccaagaaagagcgtcttgaagaagtcaatgccgaattagaacaacctgatgtctggacccaacctgagcgtgcgcaagccctcggtaaagagcgttcagcacttgaagcggttgtggataccatcgatcaactggatcgtggtgtcgacgatgtcgaaggtctactagaactggccatcgaagcggaagatcaagaaacgtttgatgaaattggtcctgaattggatgagctagaagcgaaacttgaacagctcgaattccgccgcatgttctctggcgatcacgattcttccgattgctaccttgacctacaagccggctctggcggtacagaagcgcaagattggacgtcgatgctgctgcgcatgtacttgcgctgggcagatgctaaaggctttaaaaccgaagtgattgaagtgtcggaaggcgacgtagcaggattgaaatctgcgacagtgcgtatcattggtgattacgcgtatggttggctacgtacggaaaccggtgtacaccgtttagtgcgtaaatcaccgttcgattcaggtggccgccgtcatacgtcgtttgcttcggcgtttatctaccctgaagtagatgaaaacatagatatcgaaattaaccctgccgatctgcgtatagacgtgtatcgtgcttctggtgccggtggtcagcacgttaacaccaccgaatcggcggtacgtatcactcacgtaccgaccaatacggtcgtgcagtgtcaaaacgatcgctcacagcacaaaaacaaagaccaagcgatgaagcaacttcgcgccaaactgtttgaattggagctgcaaaagcagaacgccgagaaacaggctaacgaagatgctaaatccgacattggttggggtagccaaatccgttcttacgtgttggatgattcacgaatcaaggatttacgtacaggtattgaaaaccgcaacacgcaagcggtactcgatggtgacttagacaaatttatcgaagctagcctgaaatcaggcctgtaa

SEQ ID NO: 73556 - protein, 365 aa, Vibrio cholerae O1 biovar eltor str. N16961
MFEINPIKNRLQDVSERTNILRGYLDYDAKKERLEEVNAELEQPDVWTQPERAQALGKERSALEAVVDTIDQLDRGVDDVEGLLELAIEAEDQETFDEIGPELDELEAKLEQLEFRRMFSGDHDSSDCYLDLQAGSGGTEAQDWTSMLLRMYLRWADAKGFKTEVIEVSEGDVAGLKSATVRIIGDYAYGWLRTETGVHRLVRKSPFDSGGRRHTSFASAFIYPEVDENIDIEINPADLRIDVYRASGAGGQHVNTTESAVRITHVPTNTVVQCQNDRSQHKNKDQAMKQLRAKLFELELQKQNAEKQANEDAKSDIGWGSQIRSYVLDDSRIKDLRTGIENRNTQAVLDGDLDKFIEASLKSGL

SEQ ID NO: 73557 - DNA, 1050 bp, Buchnera aphidicola str. APS (Acyrthosiphon pisum)
  CDS (1)..(1050): transl_table=11
gtgtacaagatcttaagaggtatctttgactataacaaaaaaaaatcccgtgttttagaaattgatttagaattatcatcacctaaaacatggacagaacagatatctataaaaaaacttaataaagaaaaatatttattgaattctataattcaaaatatcaatgaaatcgaagaaaacattaaagaagtagttatttttttagaattggcaatagaaacacaagataacctagtatttaaagaatctttattagaaattcaaaaaatagaacaagaaataaaaaaacttgaattttaccgtatgttttcaaaaaaaaatgaccactacgactgctatattgatatacaatctggatccggaggtacagacgcacaagattggtctaaaatgttactaagaatgtacttaagatgggctgataaaaaaggatttcacactgaaattattgatgaatctatcggtgaaatagttgggattaaatcatctactattaaagtaagtggagaatatgcctttggttggtttagaacagaaacaggcatacatcgtttaattagaaaaagtccttttgattctggaaagagacgtcatacttcctttagttcaatttttatatatccagatataaatgaaaaaattgatataaatattaattattctgatctcagaattgacgtgtatagagcatctggagcaggaggacaacatgtaaatagaacggaatcagctgtacgtattactcatttgcctacgaacattgttacccaatgtcaaaataatcgttctcaacacaaaaataaagaacaagcaatgaaacaaatgcaatcaaaactatacgaaatacaaatgagaaaaaaacaagaagaaaaacaaaaaatagaacaaaataaatcagatataacatggggaaatcaaatacgatcatatatattagataactctaaaataaaagaccttcgcactggagttgaaaaaaatcatgttcaatctgttttagatggcgatctagatgatttcattgaacaaagtttaattatggggttatga

SEQ ID NO: 73558 - protein, 349 aa, Buchnera aphidicola str. APS (Acyrthosiphon pisum)
MYKILRGIFDYNKKKSRVLEIDLELSSPKTWTEQISIKKLNKEKYLLNSIIQNINEIEENIKEVVIFLELAIETQDNLVFKESLLEIQKIEQEIKKLEFYRMFSKKNDHYDCYIDIQSGSGGTDAQDWSKMLLRMYLRWADKKGFHTEIIDESIGEIVGIKSSTIKVSGEYAFGWFRTETGIHRLIRKSPFDSGKRRHTSFSSIFIYPDINEKIDININYSDLRIDVYRASGAGGQHVNRTESAVRITHLPTNIVTQCQNNRSQHKNKEQAMKQMQSKLYEIQMRKKQEEKQKIEQNKSDITWGNQIRSYILDNSKIKDLRTGVEKNHVQSVLDGDLDDFIEQSLIMGL

SEQ ID NO: 73559 - DNA, 867 bp, Bacillus halodurans C-125
  CDS (1)..(867): transl_table=11
ttggaagtctcctatgagctttgtaaggaagaaacggatgcagacttacaacaggaattagagcaaggtctaaaaggtttagtgaaagaattaaatgagtttgaattgcagttgctgttaaatgagccttacgataaaaacaatgccattttagagcttcacccaggtgcgggaggaacagaatctcaagactgggcttccatgctgttaagaatgtacacccgttgggcagaaaacaaaggctataaagtggagacattggattatttaccgggggatgaagctggggtcaaaagtgttacgttattaattaaaggacataacgcttatggctatttgaaagcggagaaaggtgtacatcgtcttgtgcggatctctccttttgattcgtccggacggcgacatacgtcgtttgtttcatgtgaagtaatgccggagcttgacgatagtgtcgagattgaaatctcaacggaagatttaaaaattgatacgtatcgttctagcggtgccggtgggcagcatgtcaatacgactgattcagctgtgagaattacccaccttccgacaaatacggttgtcacatgccaaagtgaacgttcacagattaaaaaccgcgaacgagcgatgaaaatgttacaggccaaattgttgcagttaaagctggaggagcagcaaaaagagttggctgaaatccgcggggaacaaaaagaaatcggttggggaagtcaaattcgttcatacgtattccatccatatagtatggtaaaagatcaccgtacgaatgtggaagttgggaatacgaatgcggtgatggatggagagattgattccttcatcgacgcttaccttcggtggaatgtctcataa

SEQ ID NO: 73560 - protein, 288 aa, Bacillus halodurans C-125
MEVSYELCKEETDADLQQELEQGLKGLVKELNEFELQLLLNEPYDKNNAILELHPGAGGTESQDWASMLLRMYTRWAENKGYKVETLDYLPGDEAGVKSVTLLIKGHNAYGYLKAEKGVHRLVRISPFDSSGRRHTSFVSCEVMPELDDSVEIEISTEDLKIDTYRSSGAGGQHVNTTDSAVRITHLPTNTVVTCQSERSQIKNRERAMKMLQAKLLQLKLEEQQKELAEIRGEQKEIGWGSQIRSYVFHPYSMVKDHRTNVEVGNTNAVMDGEIDSFIDAYLRWNVS

SEQ ID NO: 73561 - DNA, 963 bp, Pasteurella multocida subsp. multocida str. Pm70
  CDS (1)..(963): transl_table=11
gtgtggaacgaaccagaaaaagcacaagcattaggtaaagaacgggttgccttagaaggggtcgtcaatacaatccatacacttgatcaaggcttagaagatgtcgaagggctactcgaactagcaattgaagccgaagatgaagcgactttccatgaagccgtcgcagagctcgaagaattagaacaacagttggcaaaattagaatttcgccgtatgtttagtggtcaacatgatgcagcagactgctatgttgacttacaagcgggctctggtggtaccgaagcacaagattggactgaaatgttactgcgtatgtatttacgctgggctgaaagtaaaggctttaaaaccgaattaatggaagtgtccgatggggatgttgccggaattaaatccgccacgattaaagtttctggtgaatatgcttttggttggctacgcacagaaaccggcattcaccgtttagtacgtaaaagtccatttgactccaacaaccgtcgtcatacctcgtttagtgcggcattcgtttatcctgaaattgatgacgatattgatatcgacattaatcctgcagatctgcgtattgatgtttatcgtgcttcaggtgccggtggtcagcacgtcaataaaaccgaaagtgcggtgcgtattacccatattccaagtggcattgtggtgcaatgccaaaatgatcgctctcaacataaaaacaaagatcaatgtatgaaacagttgaaagcgaaactgtatgaaatggaattgcaaaagaagaatgccgataaacaagccatggaagacaacaaatccgatattggttggggcagtcaaatccgttcctatgtgttagacgattcacgcattaaagatttacgcacgggtgtggaaaatcgcaatacccaagcagtgctcgatggcgacttagatcgctttattgaggccagtttaaaagccggattataa

SEQ ID NO: 73562 - protein, 320 aa, Pasteurella multocida subsp. multocida str. Pm70
MWNEPEKAQALGKERVALEGVVNTIHTLDQGLEDVEGLLELAIEAEDEATFHEAVAELEELEQQLAKLEFRRMFSGQHDAADCYVDLQAGSGGTEAQDWTEMLLRMYLRWAESKGFKTELMEVSDGDVAGIKSATIKVSGEYAFGWLRTETGIHRLVRKSPFDSNNRRHTSFSAAFVYPEIDDDIDIDINPADLRIDVYRASGAGGQHVNKTESAVRITHIPSGIVVQCQNDRSQHKNKDQCMKQLKAKLYEMELQKKNADKQAMEDNKSDIGWGSQIRSYVLDDSRIKDLRTGVENRNTQAVLDGDLDRFIEASLKAGL

SEQ ID NO: 73563 - DNA, 615 bp, Pseudomonas aeruginosa PAO1
  CDS (1)..(615): transl_table=11
atgatcctgctgcaactctccgcggcccaggggccggcggaatgctgcctggcggtggcgaaggcgttcgagcggctgtgcctcgaggcggcgcaagccggcgtcgaggtcgaggtaatcgaggaggtggccggcgagcgtccgcgcacctggcgttcgctgctcctggggctgcgcggcactgccgccgaagcgctcgccgagcgctggtgcggcggtatccagtggatctgccccagcccctaccgggcaaggcatgcgcgcaagaactggttcatcggcgcggagcgcttcgccgcgccgccggccagtctggagggcgagatccgtttcgagaccctgcgctcttccggccccggcggccagcatgtcaacaccaccgactcggcggtgcgcgccacccacctggccagcggcatcagcgtcagggtgcagagccagcgtagccagcacgccaacaaacgcctggcgatcctgctgatcgcccggcgcctcgcggaccaggcgagcagcgcggccgacgcgctgcgcgcggagcgccgccgggcccacggtcggatcagtcgcggcgcggctcgccgggtattccgcggcgagcgtttcgagccggcctga

SEQ ID NO: 73564 - protein, 204 aa, Pseudomonas aeruginosa PAO1
MILLQLSAAQGPAECCLAVAKAFERLCLEAAQAGVEVEVIEEVAGERPRTWRSLLLGLRGTAAEALAERWCGGIQWICPSPYRARHARKNWFIGAERFAAPPASLEGEIRFETLRSSGPGGQHVNTTDSAVRATHLASGISVRVQSQRSQHANKRLAILLIARRLADQASSAADALRAERRRAHGRISRGAARRVFRGERFEPA

SEQ ID NO: 73565 - DNA, 1266 bp, Deinococcus radiodurans R1
  CDS (1)..(1266): transl_table=11
gtggtgcgggagcaagggcgcggacccgggccgccccgctccccacaaagcccacagaaagcaccgttcgggacgcgctttgccgctatactgccggcttggcacagtccgcaccccgcccaacgggttacgcctacgaacacaggccgcgcggaaaggagacacgcaccatgcaagaactgctggaaaaactggcgtcgctccgggagtacctttgacattcccggcaaaacgcgccgcctgaacgaactcgaccgcgaactcagcgaccccgacctctggaacgaccagagccgcgcccggcaggtgacgcaggaagccggcagcgtgcgtaaaatcgtggaggaatatgccgggctgacctccgacgcgcagggcctgagcgaaatgctcgacctcgccgacgaagaggagcgcgaactgctcgaagacgagcaggccgggctgcaaaagcgggtggacgacctctaccgcgaaacgctctttaccatgaagcacgccgacaccgccgccatcgtgcgcgtcaagggcggggcaggcggcaccgaggcgcaggactgggcggggatgctcgcccgcatgtacatgcgctgggccgagcgccggggctacaaggtggacattctggacgaggtggcgggcgaccaggccggttaccagagcatcgaattcatcatccggggcgaaaaggccttcgggatgatggcccccgagcacggggtgcaccggctggtgcgcgtctcgccgttcgattccaacaaccgccgccagacgagcttcgcctccgtggacgtggtgccggaagtgccggaagaggaaatcaacatccacattcccgactcggacctgcgccgcgacgtgttccgttcgcagggcgcgggcggacagggcgtgaacaccaccgactcggcggtgcgcttgacccacctgcccacggggattgcggtggcgtgccagatcacgcgttcgcagatcaagaaccacgaactcgccctgcaaatcctcaagcagcgcctgtacgacatcgagatgaaaaagcgcgaggcggaagaactcgccgcccgtgggcagcaggccaaggtggagtggggcagccagatgcgctcctacgtgctcgacaagcagtacatcaaggaccaccgcaccggcctgatgatgcacaaccccgacgacgtgctcgacggcgacctcgacgagctgatgtgggccggtctggagtggatggccggcaagcgcgtggcggaggaaacgggggacgaggagtaa

SEQ ID NO: 73566 - protein, 421 aa, Deinococcus radiodurans R1
MVREQGRGPGPPRSPQSPQKAPFGTRFAAILPAWHSPHPAQRVTPTNTGRAERRHAPCKNCWKNWRRSGSTFDIPGKTRRLNELDRELSDPDLWNDQSRARQVTQEAGSVRKIVEEYAGLTSDAQGLSEMLDLADEEERELLEDEQAGLQKRVDDLYRETLFTMKHADTAAIVRVKGGAGGTEAQDWAGMLARMYMRWAERRGYKVDILDEVAGDQAGYQSIEFIIRGEKAFGMMAPEHGVHRLVRVSPFDSNNRRQTSFASVDVVPEVPEEEINIHIPDSDLRRDVFRSQGAGGQGVNTTDSAVRLTHLPTGIAVACQITRSQIKNHELALQILKQRLYDIEMKKREAEELAARGQQAKVEWGSQMRSYVLDKQYIKDHRTGLMMHNPDDVLDGDLDELMWAGLEWMAGKRVAEETGDEE

SEQ ID NO: 73567 - DNA, 501 bp, Escherichia coli O157:H7
  CDS (1)..(501): transl_table=11
gtgctggaaacagaaacgggccgctactctgacacgctgcgttcggcgctgatttctctggatggcgacaacgcatgggcgttaagcgaaagttggtgcggcactattcagtggatttgtctgagtccgtatcggcctcatcatgggcgcaaaaactggtttctgggcattgggcgttttaccgctgatgagcaggaacaatcggatgcaatccgttatgagacgctgcgtccgtcggggccgggcggtcaacatgtcaataaaaccgactcggcggtacgcgccacgcatctggcaaccgggattagcgtgaaggttcagtcagaacgcagccagcatgctaacaaacggctggcgcgattgctgattgcctggaagctggagcagcagcaacaggaaaatagcgcagtgctgaaatcgcagcggcgaatgttccatcaccagattgaacgtggcaacccgcgacgaacgttcacagggatggcttttatcgaaggataa

SEQ ID NO: 73568 - protein, 166 aa, Escherichia coli O157:H7
MLETETGRYSDTLRSALISLDGDNAWALSESWCGTIQWICLSPYRPHHGRKNWFLGIGRFTADEQEQSDAIRYETLRPSGPGGQHVNKTDSAVRATHLATGISVKVQSERSQHANKRLARLLIAWKLEQQQQENSAVLKSQRRMFHHQIERGNPRRTFTGMAFIEG

SEQ ID NO: 73569 - DNA, 990 bp, Clostridium acetobutylicum ATCC 824
  CDS (1)..(990): transl_table=11
atgcaggagcctgatttttggaatgatgtaaaaagagcacaagaaataagcatggagataaaatttcttaaaggaagaattgatagatttaattctattgaaagcagaattgaagatgataatgtacttatagaaatgtgcagagaagatgaaaatgaagaagaagcggatgagatactaaaggaagttcgtgacttacatgaagaggtagataattttaagatagaaataattctttcaggagaatatgatagaaataatgctattttgaatcttcatacaggcgttggaggtaccgatgcacaggattggacacaaatgcttttgaggatgtatacaagatgggcggaagctaaagggttcaaggtagacataattgatatgctcccaggagatgaagcaggtataaaaagtgtaagtataaatattgatggagaatttgcttatggatatttaaaggctgaaaaagggatacatagattggtcagaatttcaccctttaatgcaaatggtaaaagacaaacttcttttgcatctgttgaagtacttccacaattaactcaaagccaagatatagttatacgacctgaagatttaaaagtggatacttatagggccagtggagcaggtggtcagcatgtaaataaaacagaatcagcagtaagaataacccatcttccaacgggaatagttgtacaatgtcagtctgaaagaagtcagcattctaataaggaaactgctatgaacatgttaaaatcaaagcttgttgagttaaaagaaagaatgcataaggaaaaggtagaagacttagcaggagaacttaaggatatgggatggggaaatcaaataaggtcatatgtatttcaaccatacacaatggttaaggatcataggactggtgtagagacttcaaatgtagatgctgttatggatggagaaattgataaatttataatagagtacttaaataaggaaaacagccagaaataa

SEQ ID NO: 73570 - protein, 329 aa, Clostridium acetobutylicum ATCC 824
MQEPDFWNDVKRAQEISMEIKFLKGRIDRFNSIESRIEDDNVLIEMCREDENEEEADEILKEVRDLHEEVDNFKIEIILSGEYDRNNAILNLHTGVGGTDAQDWTQMLLRMYTRWAEAKGFKVDIIDMLPGDEAGIKSVSINIDGEFAYGYLKAEKGIHRLVRISPFNANGKRQTSFASVEVLPQLTQSQDIVIRPEDLKVDTYRASGAGGQHVNKTESAVRITHLPTGIVVQCQSERSQHSNKETAMNMLKSKLVELKERMHKEKVEDLAGELKDMGWGNQIRSYVFQPYTMVKDHRTGVETSNVDAVMDGEIDKFIIEYLNKENSQK

SEQ ID NO: 73571 - DNA, 615 bp, Clostridium acetobutylicum ATCC 824
  CDS (1)..(615): transl_table=11
atgtggctacaaattagtgcaggcacagggcctgttgaaagctgtagattcgtatacttatttttaaacttagtaaaaaaagaatgcaaatatagaaatataaaaattgaagttttagactttgtacctggtgaaaaaatcggcactcttaaatctgtatttttaaagcttagtggagaaggtgctaagacgtatgctagctcaattacgggaactcatcttcttatttgggaaagcgaatacagaaaaaatcacaggagaaaaaattggtttatagctgttaattcttttagttatgaaactaacgaggacctaaacgataaggatattattattgaaaaaatgcgaagcagtggtaaaggtggacaacacgttaacaaaactgaaaccgctgtaagaataactcataaaaagaccggtatagttgtgaactcaagcgaagaaagaagtcagtttgcaaatataaaacttgcaaaggctagattaatcattgaacttaagaaattatcagatgagaggcgcaaaagaaatcgcagtgaaagatggactgctggaataaatatagttcgtggcaatccagttaacgtatatacttacaaggaactaaattcttag

SEQ ID NO: 73572 - protein, 204 aa, Clostridium acetobutylicum ATCC 824
MWLQISAGTGPVESCRFVYLFLNLVKKECKYRNIKIEVLDFVPGEKIGTLKSVFLKLSGEGAKTYASSITGTHLLIWESEYRKNHRRKNWFIAVNSFSYETNEDLNDKDIIIEKMRSSGKGGQHVNKTETAVRITHKKTGIVVNSSEERSQFANIKLAKARLIIELKKLSDERRKRNRSERWTAGINIVRGNPVNVYTYKELNS

SEQ ID NO: 73573 - DNA, 1029 bp, Sinorhizobium meliloti 1021
  CDS (1)..(1029): transl_table=11
ttgaacaacaaggcggaagacccgtcgctctggaacgacgcggccgaggcgcagaagctgatgcgggagcgccagcagctcgatgacggcatcaatggcctgcgccgcttcgagcagcagctcaacgacaacatcgagctcatcgaactcggtgaagaggagggcgattcggcgatcgtcgcggaggccgaggaagcgcttcgccaactgcgcggcgaggcggcgaaaaagcaggtcgaggccatgctttcgggcgaggccgaccagaacgacacatatctcgaagtccattcgggcgccggcggcacggaaagccaggactgggcgaacatgctgcttcgcatgtatacccgatgggccgaacgccagggctacaaggtcgagctcatggaaatccaggacggggaagaagcgggcatcaaatcggccacgctcctcgtcaaggggcacaatgcctatggctggctgaagacggaatcgggcgtgcatcgcctcgtccgcatttctccgtatgacagcaacgctcgccgtcatacgtccttttcgtccatctgggtctatcccgtcgtggacgaatcgatccagatcgacatcaacgaaagcgattgccggatcgatacctaccgctcctcgggcgccggcggtcagcacgtcaatacgaccgattcggccgtgcgcatcacgcatatgccgagcggcatcgtggtgcagtgccagcaggaacgctcgcagcacaagaaccgcgccaaggcatgggacatgcttcgcgcgcggctctacgaggctgaactgaagaagcgcgaggaggcggccaacgccgaggcggcatcgaagaccgatatcggctggggtcaccagatccgctcctacgtcctgcagccctaccagctggtgaaggatttgaggacgggagtcgaaagcagcagcccgggcgacgtgctcgacggtgaactgaatgaattcatggaggcagcccttgcgcatcgcgtcagcggcggcgcggatgcggccgtcgacgacctgagctaa

SEQ ID NO: 73574 - protein, 342 aa, Sinorhizobium meliloti 1021
MNNKAEDPSLWNDAAEAQKLMRERQQLDDGINGLRRFEQQLNDNIELIELGEEEGDSAIVAEAEEALRQLRGEAAKKQVEAMLSGEADQNDTYLEVHSGAGGTESQDWANMLLRMYTRWAERQGYKVELMEIQDGEEAGIKSATLLVKGHNAYGWLKTESGVHRLVRISPYDSNARRHTSFSSIWVYPVVDESIQIDINESDCRIDTYRSSGAGGQHVNTTDSAVRITHMPSGIVVQCQQERSQHKNRAKAWDMLRARLYEAELKKREEAANAEAASKTDIGWGHQIRSYVLQPYQLVKDLRTGVESSSPGDVLDGELNEFMEAALAHRVSGGADAAVDDLS

SEQ ID NO: 73575 - DNA, 867 bp, Synechocystis sp. PCC 6803
  CDS (1)..(867): transl_table=11
gtggagcttttggagttagaggacgaccaagccctactgacggaagcggaaactaccctggaacaactgcaaaaagaattagaccgttgggaactgcagcagttactgtctggcccctatgacgcgaaaggggccactttaactatcaatgcgggggctggagggaccgatgcccaagactgggcggaaatgctgctgcggatgtacacccgttggagcgaaaaacagggctacaaagtccatttggcggaaatttccgagggagacgaagcgggcttaaaatccgtcacgttggagattgaagggcgttacgcctacggttacctcaaatcggaaaagggcacccatcgtttggtgcgtatttctccttttaatgccaacggtaaacgccagactagctttgctggggtggaagtgatgcctttgctgggggaagaagcaattagtttggatattccggataaggatttggacatttccacctccagggccggcggtaaaggcgggcaaaacgtgaacaaagtggaaaccgctgtacggattgttcatctacccacaggtttggctgtgcgttgcacccaggaacgttcccagttacaaaataaagaaaaggccctagccattctcaaagctaagttattaattgtcctagaagagcaacgggcccaggcgatcgccgaaattcgaggggacatggtggaagcggcctggggcacccaaattcgcaactatgtttttcatccttaccaattggtcaaagatttgcggactaatgtggaaaccaccgatgtggggggcgtgatggatggggaattatcagattttattgaagcttatctccgacatagcgcccgcttggatagctaa

SEQ ID NO: 73576 - protein, 288 aa, Synechocystis sp. PCC 6803
MELLELEDDQALLTEAETTLEQLQKELDRWELQQLLSGPYDAKGATLTINAGAGGTDAQDWAEMLLRMYTRWSEKQGYKVHLAEISEGDEAGLKSVTLEIEGRYAYGYLKSEKGTHRLVRISPFNANGKRQTSFAGVEVMPLLGEEAISLDIPDKDLDISTSRAGGKGGQNVNKVETAVRIVHLPTGLAVRCTQERSQLQNKEKALAILKAKLLIVLEEQRAQAIAEIRGDMVEAAWGTQIRNYVFHPYQLVKDLRTNVETTDVGGVMDGELSDFIEAYLRHSARLDS

SEQ ID NO: 73577 - DNA, 615 bp, Salmonella typhimurium LT2
  CDS (1)..(615): transl_table=11
atgatcttactgcaactttcttctgcgcagggaccggacgagtgttgtctggcggtaaaaaaagcgctggattgtctgacgaaagaagctgccagagaaaaggtatcgctgacgcgacttgaaacagagccgggacgattaccagacacgctgcgttccgcgctggtctcgctggacggcgaaaaagctatggctttcagtgaacgttggtgcggcacgttactgtggatttgtaccagcccgtatcgtccgcaccatgggcgaaaaaactggtacgtcggcattgggcgcttttccgccgacgagcacatacagtctgatgagattcgtttcgagactttgcgctcttccggcccgggtgggcagcacgttaataaaaccgactcggcagtgcgggccacgcacctggcgagcgggattagcgtgaaggttcagtcggagcgcagtcaacatgcgaataagcgtctggcccggctgctgattgcctggcggctggaacagcaacggcaaaatgagtgtgcggcattgaagtctgaaaggcgtctgttccatcatcagattgagcgcggcaatccgctgcggatatttaaaggaatggcgtttacgccacaataa

SEQ ID NO: 73578 - protein, 204 aa, Salmonella typhimurium LT2
MILLQLSSAQGPDECCLAVKKALDCLTKEAAREKVSLTRLETEPGRLPDTLRSALVSLDGEKAMAFSERWCGTLLWICTSPYRPHHGRKNWYVGIGRFSADEHIQSDEIRFETLRSSGPGGQHVNKTDSAVRATHLASGISVKVQSERSQHANKRLARLLIAWRLEQQRQNECAALKSERRLFHHQIERGNPLRIFKGMAFTPQ

SEQ ID NO: 73579 - DNA, 1077 bp, Salmonella typhimurium LT2
  CDS (1)..(1077): transl_table=11
ataaccgcattcaggacctcacggaacgcaccaacgttcttagggggtatctttgactacgatgctaagaaagagcgtctggaagaagtaaacgccgagctggaacagccggatgtctggaacgaacctgagcgcgcgcaggcgctgggaaaagagcgttcatcgctcgaagcgatcgtcgatacgcttgatcaaatgactcaggggctggacgacgtttccgggctgctggaactggcggtagaagctgacgacgaagagacgtttaacgaagccgtcgcggaactgaatacgctggaagagaagttggcgcagttggaattccgccggatgttctccggcgagtacgatagcgccgattgctatctcgatattcaggccggttccggtggtactgaagcgcaggactgggccagcatgttgctgcgtatgtatctgcgttgggcggaagcgcgcggcttcaagacagaagtcattgaagaatcggaaggggaagtcgccggtattaagtccgcgactatcaaaatctccggcgaatatgcctatggctggctgcgcactgaaaccggcgtacatcgtctggtgcgtaaaagcccgtttgactccggcggtcgccgtcatacctcgtttagctccgcgtttgtgtacccggaagtggacgacgatatcgatatcgacattaacccggcggatctgcgtatcgacgtctatcgcgcgtctggcgcaggcggtcagcacgttaaccgtacggaatccgccgtgcgtatcacccatattccaaccggaatcgtgacgcagtgccagaacgaccgttcgcagcacaaaaacaaagaccaggccatgaagcagatgaaagcgaagctttatgaactggagatgcagaaaaagaacgctgaaaaacaggcgatggaagacactaagtccgatatcggctggggaagccagattcgttcctatgtcctggacgattcccgcattaaagacctgcgtactggggtggaaacccgcaatacacaggcggtactggacggtagtctggatcaatttatcgaagcaagtttgaaagcagggctatga

SEQ ID NO: 73580 - protein, 358 aa, Salmonella typhimurium LT2
MTAFRTSRNAPTFLGGIFDYDAKKERLEEVNAELEQPDVWNEPERAQALGKERSSLEAIVDTLDQMTQGLDDVSGLLELAVEADDEETFNEAVAELNTLEEKLAQLEFRRMFSGEYDSADCYLDIQAGSGGTEAQDWASMLLRMYLRWAEARGFKTEVIEESEGEVAGIKSATIKISGEYAYGWLRTETGVHRLVRKSPFDSGGRRHTSFSSAFVYPEVDDDIDIDINPADLRIDVYRASGAGGQHVNRTESAVRITHIPTGIVTQCQNDRSQHKNKDQAMKQMKAKLYELEMQKKNAEKQAMEDTKSDIGWGSQIRSYVLDDSRIKDLRTGVETRNTQAVLDGSLDQFIEASLKAGL

SEQ ID NO: 73581 - DNA, 984 bp, Listeria innocua Clip11262
  CDS (1)..(984): transl_table=11
atgttggatccgaatttttggaacgaccaacaagcggctcaaaaagtaattaatgaatcaaatggatacaaagaaacgtatcaagcttttcatgcgcttgaagaagaacaagaaagcatggaaatcagtttagaactactaaaagaagaagcagatgaagatttacaagcagaattagaaaaagatattaaagcatatgtggcgacgataagtgaatttgaacttaagttaatgttaagtgatccatatgataaaaataatgctattttagaattgcatccaggtgctggtggaacagaatcacaagactggggctcaatgttattacgcatgtatcaacgttggtctgagaaaaaaggttttaaagtcgaaatgctcgattatcaagcgggtgatgaagcgggtattaaaagcgttacattactcatcaaagggcacaatgcatacggctatttgaaagcagaaaaaggtgtgcatcgtttagttcgtatctctccattcgattcatcaggtagacgtcatacatcttttgtttcagtggatgttatgccagaattagatgatgaaattgaaatcgaagtacgtacagaagatttgaaaattgatacgtatcgtgcaactggtgctggcggacagcatattaatacaaccgattcagcagttcggatgacacatattccatccgggattgtagtaacctgccaatcagaacgttcgcagcttaaaaaccgtgaacaagcaatgaaaatgttgaaaacaaaactatatcaaaaagaacaagaagaaaaagaacgcgagctagcagaaattcgtggtgagcaaaaagaaattggttggggaagccaaattcgttcgtatgttttccacccttactccatggtgaaagaccatcgtacaaattacgaaaccggtaatattcaagcggtaatggatggagatttagacgactttatcaatgcatatttgcgttctaggattggataa

SEQ ID NO: 73582 - protein, 327 aa, Listeria innocua Clip11262
MLDPNFWNDQQAAQKVINESNGYKETYQAFHALEEEQESMEISLELLKEEADEDLQAELEKDIKAYVATISEFELKLMLSDPYDKNNAILELHPGAGGTESQDWGSMLLRMYQRWSEKKGFKVEMLDYQAGDEAGIKSVTLLIKGHNAYGYLKAEKGVHRLVRISPFDSSGRRHTSFVSVDVMPELDDEIEIEVRTEDLKIDTYRATGAGGQHINTTDSAVRMTHIPSGIVVTCQSERSQLKNREQAMKMLKTKLYQKEQEEKERELAEIRGEQKEIGWGSQIRSYVFHPYSMVKDHRTNYETGNIQAVMDGDLDDFINAYLRSRIG

SEQ ID NO: 73583 - DNA, 903 bp, Ralstonia solanacearum GMI1000
  CDS (1)..(903): transl_table=11
gtggtctttgcgctgaccaagctcgacgaagacctcaccggcggcgccgagctgttcgaactggctcgcgaagagggcgatgacgacaccatcgaggccgtcgaggccgataccgcaggcatgcgcgccattgtcgaagacatggaattccgccgcatgttctccggcccgatggacgccgccaactgcttcatcgacatccaggccggcgccggcggcaccgaggcgtgcgactgggcctcgatgctgctgcgccaatacctgaagtactgcgaacgcaagggcttcaagaccgaggtgctggaagagtccgaaggcgatgtcgccggcatcaagagcgcctcgctcaaggtcgagggcgaatacgcctttggcttcctgcggaccgaaaccggcgtgcaccgcctggtgcgcaagtcgccgttcgactcggcgggcgggcgccatacgtcgttctcgtcgatcttcgtgtatccggaagtggacgactcgatcgagatcgaggtcaacccggcggatctgcgcgtcgacacgtaccgcgcgtccggcgcgggcggccagcacatcaacaagaccgactcggccgtgcggatcacgcacatcccgaccggcatcgtcgtgcagtgccagaacgaccgctcgcagcaccgcaaccgcgccgaagccatgacgatgctgaagtcgcgcctgtacgagcatgagctgcgcaagcgccaggccgaggccgacaagctggaggcctccaagaccgacgtgggctggggccaccagatccgttcctacgtgctggaccagagccgcatcaaggatctgcgcaccaacgtggaaatctccaacacccagaaagtgctggacggcgacctcgatgccttcatcgaagccagcctgaagcaaggcgtctga

SEQ ID NO: 73584 - protein, 300 aa, Ralstonia solanacearum GMI1000
MVFALTKLDEDLTGGAELFELAREEGDDDTIEAVEADTAGMRAIVEDMEFRRMFSGPMDAANCFIDIQAGAGGTEACDWASMLLRQYLKYCERKGFKTEVLEESEGDVAGIKSASLKVEGEYAFGFLRTETGVHRLVRKSPFDSAGGRHTSFSSIFVYPEVDDSIEIEVNPADLRVDTYRASGAGGQHINKTDSAVRITHIPTGIVVQCQNDRSQHRNRAEAMTMLKSRLYEHELRKRQAEADKLEASKTDVGWGHQIRSYVLDQSRIKDLRTNVEISNTQKVLDGDLDAFIEASLKQGV

SEQ ID NO: 73585 - DNA, 624 bp, Ralstonia solanacearum GMI1000
  CDS (1)..(624): transl_table=11
atgatcctgctgcaattctcttccgcgcaagggccggccgaatgcgaactggctgtgctcaaggggctggcttgcctgcaacgcgaatcggcgctggccggcgtgcgggtcgaagtgctcgaacaggaggacggcgaacaccccggcacgctgcgctccgcgctggtcagcctggagggcgatgccgaggcggccgtggcgcaacggtgggagggcacgatccagtggacctgccccagcccctatcgcccgcgccacgcacgcaagaactggttcttcggcgtggcacgctgcgccgcgcccgcggccaccctgccgagcgaaatccggttcgagacggcccgcgcatccggcccgggcgggcagcacgtcaacaagacagaatcggcagtgcgagccatccacctggccaccggcatcagcgtcaaggtgcagaccgagcgcagccagcacgccaacaagcgcctggctgtcctgctgctggcgcacaagctggcgagccatgacgcagcggccagcgccgcgcagcgcgcccaccggcgcacgctccaccatcaggtggcgcggggcaacccgcggcgcgtgttcaagggcgagcggttcgagccggccgggggcgattag

SEQ ID NO: 73586 - protein, 207 aa, Ralstonia solanacearum GMI1000
MILLQFSSAQGPAECELAVLKGLACLQRESALAGVRVEVLEQEDGEHPGTLRSALVSLEGDAEAAVAQRWEGTIQWTCPSPYRPRHARKNWFFGVARCAAPAATLPSEIRFETARASGPGGQHVNKTESAVRAIHLATGISVKVQTERSQHANKRLAVLLLAHKLASHDAAASAAQRAHRRTLHHQVARGNPRRVFKGERFEPAGGD

SEQ ID NO: 73587 - DNA, 1029 bp, Agrobacterium tumefaciens str. C58
  CDS (1)..(1029): transl_table=11
ttgaacaataaggcagaggacccgaccctctggaacgatgcctccgaagcccagaagctgatgcgcgaacgccagcagctggatgacagcatcaacggcgtcaaggcgctggagcagcagctcaaggacaatatcgagctgatcgaactcggcgagatggaaggcgacgatgagatcgtcaaggacgccgaagatgcgctgaaggcgctgagaagcgaagcgaaccgccgccaggtggaagccatgctttccggcgaggccgacagcaacgacacctatgtggaagtgcattccggcgccggcggcaccgaaagccaggattgggcgaacatgctgctgcgcatgtacacccgctgggcggagcgtcagggcttcaaggtcgaagttctcgaaatccacgatggcgatgaggcgggcatcaagtcggccaccattctggtcaagggccataacgcctttggctggatgaagacggaatcaggcgtgcaccgcctcgttcgcatctcgccctatgacagcaatgcccggcgtcacacctcgttttcttccatctgggtctatccggtggtcgatgattcgatccagatcgacatcaatgaaagcgattgccgtatcgatacctatcgctcgtccggtgcgggcggccagcacgtcaacaccactgactcggctgtgcgtatcacgcatattccgaccggcatcgccgttgcctgccagcaggagcgctcccagcacaagaaccgcgccaaggcgtgggacatgctgcgcgcccgcctctatgaggtggaactgcaaaagcgggaagaggcggccaatgcgcaggccgcatccaagaccgatatcggctggggccatcagatccgttcctacgttctccagccctaccagctggtcaaggacctgcgcaccggcgtggaaagcaccgcgcccggcaacgtgctggatggtgacctgaacgagttcatggaagccgcacttgcccatcgcatcagcggcggcgcggatgtggaggtctcggatatcgattaa

SEQ ID NO: 73588 - protein, 342 aa, Agrobacterium tumefaciens str. C58
MNNKAEDPTLWNDASEAQKLMRERQQLDDSINGVKALEQQLKDNIELIELGEMEGDDEIVKDAEDALKALRSEANRRQVEAMLSGEADSNDTYVEVHSGAGGTESQDWANMLLRMYTRWAERQGFKVEVLEIHDGDEAGIKSATILVKGHNAFGWMKTESGVHRLVRISPYDSNARRHTSFSSIWVYPVVDDSIQIDINESDCRIDTYRSSGAGGQHVNTTDSAVRITHIPTGIAVACQQERSQHKNRAKAWDMLRARLYEVELQKREEAANAQAASKTDIGWGHQIRSYVLQPYQLVKDLRTGVESTAPGNVLDGDLNEFMEAALAHRISGGADVEVSDID

SEQ ID NO: 73589 - DNA, 966 bp, Brucella melitensis 16M
  CDS (1)..(966): transl_table=11
atgcgtgagcgccagcaactggaagacagtatcaatggcatcaatcacctcaagcagacgctgaacgatagtgtcgaactcatcgccatgggcgaggaggaaggcgacaagtcgatcgtcgaggatgcggaaaaaaccatccgtgacctcaaggatgagatcgaccgccgccagatcgacatgctcctctccggcgaagccgatgcgaacgacacctatctggaagtccatgcgggcgcaggcggcacggaaagccaggactgggcgtccatgcttttgcgcatgtatacccgctgggccgagcgcaacgggcgcaaggtggaggtcatggaagtacatgaaggcgaagaagcgggcatcaagtccgcgaccattctcgtcaaggggcacaattcctatggcatgttgaaaaccgaatccggcgtgcatcgtctggtgcgcatttcgccttatgattctaacgcgcgccgtcatacctccttcgcgagcatctgggtctatcctgtcatcgatgacaatatcgaggttcaggtgacggaggcggatgtccgtatcgacacttatcgcgcttctggcgcgggcgggcagcacgtcaacacgaccgattcggcggtgcgtatcacgcatattgcaaccggcatcgtggtgcagtgtcaggcggaacgttcgcagcacaagaaccgtgaaaaggcctggtccatgcttcgcgcgcgcctctatgaagaggagctgaaaaagcgcgaagaggctacggatgcggcgaatgccaccaagaccgatatcggctgggggcaccagattcgctcctacgttctccagccttatcagcttgtgaaagatttgcgcacaggtgttgaaagcaccaacccgcaggaagtgctggacggcgccgtcacgcctttcatggaggccgctcttgcccatcgcattcagggtggcggcgaaatgatcgaggatatcgattga

SEQ ID NO: 73590 - protein, 321 aa, Brucella melitensis 16M
MRERQQLEDSINGINHLKQTLNDSVELIAMGEEEGDKSIVEDAEKTIRDLKDEIDRRQIDMLLSGEADANDTYLEVHAGAGGTESQDWASMLLRMYTRWAERNGRKVEVMEVHEGEEAGIKSATILVKGHNSYGMLKTESGVHRLVRISPYDSNARRHTSFASIWVYPVIDDNIEVQVTEADVRIDTYRASGAGGQHVNTTDSAVRITHIATGIVVQCQAERSQHKNREKAWSMLRARLYEEELKKREEATDAANATKTDIGWGHQIRSYVLQPYQLVKDLRTGVESTNPQEVLDGAVTPFMEAALAHRIQGGGEMIEDID

SEQ ID NO: 73591 - DNA, 927 bp, Fusobacterium nucleatum subsp. nucleatum ATCC 25586
  CDS (1)..(927): transl_table=11
atgaattttgaaaaaaatatagtttcaagatatgaaaagttagcgacagaaattgacgatgaagaagttttaattgattttgttgaaagtggagaaacttcatttgaaagtgaactttcagaaaaacataaaaatttaaaaaccgatatagaagaatttgaaatcaatttgttacttgatggagaatatgatatgaataatgccattgtaacaattcattctggtgcaggaggaacagaagcttgtgattgggctgatatgttatatagaatgtatttaagatggtgtaatttaaaaggctataaagtatcagaacttgattttatggaaggggacagtgttggagtaaagtcagttacatttttagttgaaggaataaatgcctatggttatttaaaatctgaaaaaggaatacatagacttgttagaatttcaccttttgatgctaacaagaaaagacatacatcatttgcttcagttgaagttgtaccagaagttgatgaaaatgtggaagttgaaataaatcctgttgatattagaattgatacatatagagcaagtggagcaggtggacaacatgttaatatgacagattctgctgtaagaataacacattttccaagtggaatagtggtaacttgtcaaaaagaaagatctcaacttagtaacagagaaactgctatgaaaatgttaaaatcaaaattacttgaattagagttaaagaaaaaagaagaagaaatgaaaaaaattcaaggagaacaatctgatattggttggggaaatcagataaggtcttatgtatttcaaccttatgcactagtaaaagaccatagaactaatactgagattggaaatgtaaaagctgttatggatggagatatagatggttttatcaattcatatttaagatggataaaaaacaattaa

SEQ ID NO: 73592 - protein, 308 aa, Fusobacterium nucleatum subsp. nucleatum ATCC 25586
MNFEKNIVSRYEKLATEIDDEEVLIDFVESGETSFESELSEKHKNLKTDIEEFEINLLLDGEYDMNNAIVTIHSGAGGTEACDWADMLYRMYLRWCNLKGYKVSELDFMEGDSVGVKSVTFLVEGINAYGYLKSEKGIHRLVRISPFDANKKRHTSFASVEVVPEVDENVEVEINPVDIRIDTYRASGAGGQHVNMTDSAVRITHFPSGIVVTCQKERSQLSNRETAMKMLKSKLLELELKKKEEEMKKIQGEQSDIGWGNQIRSYVFQPYALVKDHRTNTEIGNVKAVMDGDIDGFINSYLRWIKNN

SEQ ID NO: 73593 - DNA, 1044 bp, Thermoanaerobacter tengcongensis MB4
  CDS (1)..(1044): transl_table=11
gtgtttctctttgacgtggaagggataaaaaaagagatagaggatatagaaaagcagatgtcagatccttctttctggagcgatttgaaaaaatctcaggaactttctaaaaagcaaaaagcgttgaaagaacttctggaagaatatgaatcccttctttctcgctgtgaagacttgtacactctaattgagctaggtttggaagaaggggatgaatctatcgctgaagaggtggagagggaatacaaagagcttaaaaaagaggttgaaaatcttaaaatacgtactcttttgagtgggccatatgacaaaaacaatgctatactctctattcacgcagggtcaggtggcactgaagctcaggactgggctgaaatgcttcttaggatgtacaccagatgggctaatgataagggatttgaagtagaaatactggattatctggaaggggaagaagccggcataaagagtgctactcttctcataaagggaccctttgcctatggttatctgaagggagaggcaggagttcacagacttgtcaggatttctccttttgatgcagcaggcaggcgccatacctcttttgctctggtagaagttatacctgagcttgaagatgatatagaaattgaaataaggcctgaagatttaaaaattgatacgttcagggcatcaggcgcaggggggcagcatgttaacaagacagagtctgcagtgaggattactcaccttccgacagggatagttgtctcatgtcagaatgagaggtctcagatacagaatagagagactgctatgaaaatgctcaaagcaaagcttttggatttgatgatgaaagagagaaaagaaaagatagaggacctaaagggagagcacagagaggctgcatggggtaaccagataaggtcttatgtttttcagccctatactcttgtaaaagaccacaggacaaattatgaagaaggaaatgtaaatgccgttatggacggagagatagatgggtttataaatgcttatttaaagcaaaagagcgcatcctga

SEQ ID NO: 73594 - protein, 347 aa, Thermoanaerobacter tengcongensis MB4
MFLFDVEGIKKEIEDIEKQMSDPSFWSDLKKSQELSKKQKALKELLEEYESLLSRCEDLYTLIELGLEEGDESIAEEVEREYKELKKEVENLKIRTLLSGPYDKNNAILSIHAGSGGTEAQDWAEMLLRMYTRWANDKGFEVEILDYLEGEEAGIKSATLLIKGPFAYGYLKGEAGVHRLVRISPFDAAGRRHTSFALVEVIPELEDDIEIEIRPEDLKIDTFRASGAGGQHVNKTESAVRITHLPTGIVVSCQNERSQIQNRETAMKMLKAKLLDLMMKERKEKIEDLKGEHREAAWGNQIRSYVFQPYTLVKDHRTNYEEGNVNAVMDGEIDGFINAYLKQKSAS

SEQ ID NO: 73595 - DNA, 942 bp, Xanthomonas campestris pv. campestris str. ATCC 33913
  CDS (1)..(942): transl_table=11
atgctggaaaagaccgtcatcggcatcgccgatgtgctggccggcctcaccgatgccggcgagttgctggacctggccgagagcgagcaggacgaagacaccgccgtggcggtgatcgccgacctggacaagtaccaggcacacgtcgaaaagctggaattccagcgcatgttctccgggcagatggacggcgccaacgcgttcgtcgacatccaggccggcgccggcggtaccgaagcccaggactgggcggaaatcctgctgcgcatgtatctgcgctgggccgagtcgcgcggctggaagaccgagctgatggaagtgtccggcggcgaagtcgcgggcatcaagtcggccacgatccgcatcgaaggcgagtacgcctatggctggttgaagaccgagatcggcgtgcaccggctggtgcgcaagtcgccgttcgactccgacaaccgccggcataccagcttcacctcggtgttcgtgtcgccggaagtggacgacaacatcgagatcgacatcaatccggccgatctgcgtaccgacgtttaccgctcctcgggtgccggcggccagcacgtcaacaagaccgagtcggcggtgcgcatcacgcatattccgaccaataccgtggtcgcctgccagaccggccgcagccagcaccagaaccgcgacaacgcgatgaagatgctggccgccaagttgtacgagctggaagtgcagaagcgcaacgtcgagcgcgatgcgctggaagcgaccaagtccgacatcggctggggcagccagatccgcaactatgtgctcgaccagagccgtatcaaggatctgcgcaccggcatcgaacgcagcgacacccagaaggtgctcgatggcgatctggacgaattcgtcgaagccagcctcaaggccggcctggcggcgggctccaagcgcctggatgcctga

SEQ ID NO: 73596 - protein, 313 aa, Xanthomonas campestris pv. campestris str. ATCC 33913
MLEKTVIGIADVLAGLTDAGELLDLAESEQDEDTAVAVIADLDKYQAHVEKLEFQRMFSGQMDGANAFVDIQAGAGGTEAQDWAEILLRMYLRWAESRGWKTELMEVSGGEVAGIKSATIRIEGEYAYGWLKTEIGVHRLVRKSPFDSDNRRHTSFTSVFVSPEVDDNIEIDINPADLRTDVYRSSGAGGQHVNKTESAVRITHIPTNTVVACQTGRSQHQNRDNAMKMLAAKLYELEVQKRNVERDALEATKSDIGWGSQIRNYVLDQSRIKDLRTGIERSDTQKVLDGDLDEFVEASLKAGLAAGSKRLDA

SEQ ID NO: 73597 - DNA, 990 bp, Xanthomonas axonopodis pv. citri str. 306
  CDS (1)..(990): transl_table=11
gtgtggaacgacgccgaacgcgcgcaggccctgggccgcgagcgttcgatgctggaaaagaccgtgatcggcattgccgatgtgctgtcgggcctggccgatgcgggcgacctgctggagctggccgagagcgaacaggacgaagacactgcggtggcggtgatcgccgatctggacaactaccaggcgcatgtcgaaaagctggaattccagcgcatgttctccggccagatggacggcgccaacgcgttcgtcgacatccaggctggcgccggcggcaccgaggcgcaggactgggccgaaatcctgctgcgcatgtatctgcgctgggccgagtcgcgcggctggaaaaccgagttgatggaagtctccggtggcgaagtggcgggcatcaagtcggccaccgtgcgcatcgagggcgaatacgcctacggctggctgaagaccgagatcggcgtgcatcggctggtgcgcaaatcgccgttcgactcggacaaccgccggcataccagcttcacctcggtgttcgtgtcgccggaagtggacgacaacatcgagatcgacatcaatccggccgacctgcgtaccgacgtgtatcgctcgtccggtgccggtggtcagcacgtcaacaagaccgaatcggcggtgcgtatcacgcacatcccgaccaataccgtggtcgcctgccagaccggccgcagccagcaccagaaccgcgacaacgcgatgaaaatgctggccgccaagttgtacgagctggaagtgcaaaagcgcaacgccgagaaggatgccttggaagcgaccaagtccgacatcggctggggcagccagatccgcaattacgtgctcgaccagagccgcatcaaggatctgcgcaccggcatcgagcgcagcgatacgcagaaggtgctggacggcgacctggacgaattcgtcgaggccagcctgaaggccggtctggcagcgggctccaaacgcctggatgcctga

SEQ ID NO: 73598 - protein, 329 aa, Xanthomonas axonopodis pv. citri str. 306
MWNDAERAQALGRERSMLEKTVIGIADVLSGLADAGDLLELAESEQDEDTAVAVIADLDNYQAHVEKLEFQRMFSGQMDGANAFVDIQAGAGGTEAQDWAEILLRMYLRWAESRGWKTELMEVSGGEVAGIKSATVRIEGEYAYGWLKTEIGVHRLVRKSPFDSDNRRHTSFTSVFVSPEVDDNIEIDINPADLRTDVYRSSGAGGQHVNKTESAVRITHIPTNTVVACQTGRSQHQNRDNAMKMLAAKLYELEVQKRNAEKDALEATKSDIGWGSQIRNYVLDQSRIKDLRTGIERSDTQKVLDGDLDEFVEASLKAGLAAGSKRLDA

SEQ ID NO: 73599 - DNA, 876 bp, Staphylococcus aureus subsp. aureus MW2
  CDS (1)..(876): transl_table=11
atggatgctacttgggatttattacaagaagaatttgatgaagaaatgaaagaagacttagagcaagaggtcattaattttaaggctaaagtggatgaatacgaattgcaattattattagatgggcctcacgatgccaataacgcaattctagagttacatcctggtgcaggtggcacggagtctcaagattgggctaatatgctatttagaatgtatcaacgttattgtgagaagaaaggctttaaagttgaaactgttgattatctacctggggatgaagcagggattaaaagtgtaacattgctcatcaaagggcataatgcttatggttatttaaaagctgaaaaaggtgtacaccgactagtacgaatttctccatttgattcatcaggacgtcgtcatacatcatttgcatcatgcgacgttattccagattttaataatgatgaaatagagattgaaatcaatccggatgatattacagttgatacattcagagcttctggtgcaggtggtcagcatattaacaaaactgaatcggcaatacgaattacccaccacccctcaggtatagttgttaataaccaaaatgaacgttctcaaattaaaaaccgtgaagcagctatgaaaatgttaaagtctaaattatatcaattaaaattggaagagcaggcacgtgaaatggctgaaattcgtggcgaacaaaaagaaatcggctggggaagccaaattagatcatatgttttccatccatactcaatggtgaaagatcatcgtacgaacgaagaaacaggtaaggttgatgcagtgatggatggagacattggaccatttatcgaatcatatttaagacagacaatgtcgcacgattaa

SEQ ID NO: 73600 - protein, 291 aa, Staphylococcus aureus subsp. aureus MW2
MDATWDLLQEEFDEEMKEDLEQEVINFKAKVDEYELQLLLDGPHDANNAILELHPGAGGTESQDWANMLFRMYQRYCEKKGFKVETVDYLPGDEAGIKSVTLLIKGHNAYGYLKAEKGVHRLVRISPFDSSGRRHTSFASCDVIPDFNNDEIEIEINPDDITVDTFRASGAGGQHINKTESAIRITHHPSGIVVNNQNERSQIKNREAAMKMLKSKLYQLKLEEQAREMAEIRGEQKEIGWGSQIRSYVFHPYSMVKDHRTNEETGKVDAVMDGDIGPFIESYLRQTMSHD

SEQ ID NO: 73601 - DNA, 873 bp, Thermosynechococcus elongatus BP-1
  CDS (1)..(873): transl_table=11
gtggaaacagccctggaactgctggagttagaactggatgaagggttgctgacagaggcaactacgctgctaaaggagttagacacccagttgaatcgctgggaactggaacaactcctcagtggcccctacgacaaaaacaacgctattgtcacgatcaatgctggggcgggcgggactgatgcccaggattgggcagaaatgttgctgcggatgtacacccgctgggcagagcgccacggttaccaaacccatctggcagaactttcagaaggggaagaggcaggtattaagtcggcaaccttggaaattcgcggtcgctacgcctatggctatctgcgttctgaaaagggtacccatcggctagtgcgcatttctcccttcaatgccaatggcaaacggcaaacgagcttcgctggagtggatgtgatgcccgaactggatcaatccgttaccgttgagattcccgaaagcgatttagaaattaccacttcccgcagtggtggcaagggggggcaaaacgtcaacaaggtggaaacggcagtgcgcattgtccataaaccaacgggcttagctgtccgctgcacgcaggagcgatcgcaactgcaaaataaggaaaaggcccttgccattctcaaggcgaagctattggtgattgcccaagagcaaaaggccaaggaaattgccgatattcgtggcgaggccgttgaggcggcttggggcaaccaaattcgcaactatgtctttcacccctatcaactggtcaaggacctgcgcacagaggtggaaacgacagccattcaggatgtgatggatggtaaccttgatccctttatccaagcctacctgcggcagcaaacggcggccagctaa

SEQ ID NO: 73602 - protein, 290 aa, Thermosynechococcus elongatus BP-1
METALELLELELDEGLLTEATTLLKELDTQLNRWELEQLLSGPYDKNNAIVTINAGAGGTDAQDWAEMLLRMYTRWAERHGYQTHLAELSEGEEAGIKSATLEIRGRYAYGYLRSEKGTHRLVRISPFNANGKRQTSFAGVDVMPELDQSVTVEIPESDLEITTSRSGGKGGQNVNKVETAVRIVHKPTGLAVRCTQERSQLQNKEKALAILKAKLLVIAQEQKAKEIADIRGEAVEAAWGNQIRNYVFHPYQLVKDLRTEVETTAIQDVMDGNLDPFIQAYLRQQTAAS

SEQ ID NO: 73603 - DNA, 984 bp, Oceanobacillus iheyensis HTE831
  CDS (1)..(984): transl_table=11
atggcagatccttctttttgggatgaccaaaataaggctcaaagtgtaatacaagagacaaatggtatcaaagaatatgttaatggatttgaaacaatagaagagaatctagaaaacctagaagtttcttatgagttagttaaagaagaaaatgaccaagaactatttgctgatttagatgctgagcttcaacagtttataacagatgtaaaccaatttgagttacagttattactaagtgaaccgtatgatgcaaacaatgctattctagaactgcacccaggcgccggaggtacagaatctcaggattgggctagcatgttacttagaatgtatcagcgctgggcagaagaacgtaattttaaagtggaaacgttggattatttgccaggtgatgaagctggtctgaaaagcgtcacgttgatcattaaaggccataatgcctatggatatttaaaagcagaaaaaggagtacatcgtctagtacgaatctccccatttgattcttctggtagaagacacacttcatttgtttcatgtgatgttacaccggaaatgtcagatgatgtcgatattgatattagaacagaggatattaaagtagatacgtatcgtgcaagtggtgcgggtggacagcatgtaaatacaactgattctgctgttcgaattactcacctacctacaaacatcattgttacttgtcaaaatgaacgttctcaaataaaaaatagagaagcggcaatgaagatgttgaaatccaaactatatcaattagaagttgaaaagcaaaggcaagaattagatgatatacgcggagaacaaaaggaaattggctggggaagtcaaattagatcgtatgtattccacccatattctatggtgaaagaccatcgaacagacaaagagactggtaatacacaggcggttatggatggagatataaatcctttcattgatgcttatcttcgttcacaaatggattaa

SEQ ID NO: 73604 - protein, 327 aa, Oceanobacillus iheyensis HTE831
MADPSFWDDQNKAQSVIQETNGIKEYVNGFETIEENLENLEVSYELVKEENDQELFADLDAELQQFITDVNQFELQLLLSEPYDANNAILELHPGAGGTESQDWASMLLRMYQRWAEERNFKVETLDYLPGDEAGLKSVTLIIKGHNAYGYLKAEKGVHRLVRISPFDSSGRRHTSFVSCDVTPEMSDDVDIDIRTEDIKVDTYRASGAGGQHVNTTDSAVRITHLPTNIIVTCQNERSQIKNREAAMKMLKSKLYQLEVEKQRQELDDIRGEQKEIGWGSQIRSYVFHPYSMVKDHRTDKETGNTQAVMDGDINPFIDAYLRSQMD

SEQ ID NO: 73605 - DNA, 1125 bp, Bifidobacterium longum NCC2705
  CDS (1)..(1125): transl_table=11
atggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgaccaggactctctggacgaggcgcaaagcgaaatcggcgagatccagaaggatctcgaccagatggagatccagaccctgcttgacggcgaatacgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggccggcatcaagtccgccaccttccaggtggacgccccctacgcttacggccgactgtccgtggaaggcggcacccaccgtctggtgcgcatctccccgttcgacaaccagggccgccgccagaccagcttcgccgccgtggaagtggtgccgctggtcgaggccaccgatcacatcgacattccggatacggacatccgcgtggacacctactgctcctccggccccggcggccagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgacatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaa

SEQ ID NO: 73606 - protein, 374 aa, Bifidobacterium longum NCC2705
MAEFDFTQAIGEARAKYESIAKALDVDRLKADIKDLETQAAAPGLWDDPENAQKITSRLSAAESQLKRLNSASQRIDDVETLVELGHEEGDQDSLDEAQSEIGEIQKDLDQMEIQTLLDGEYDERSAVVTIRSGAGGVDAADFAQMLLRMYLRYCERNGFKAKVMDTSYAEEAGIKSATFQVDAPYAYGRLSVEGGTHRLVRISPFDNQGRRQTSFAAVEVVPLVEATDHIDIPDTDIRVDTYCSSGPGGQGVNTTYSAVRITHLPTGIVVTMQDERSQIQNRASAMAVLQSRLLVLRHEEEAKKKKELAGDIKASWGDQMRSYVLHPYQMVKDLRTGYETSQTQAVFDGDINAFIEAGIRWRHEQRRAAETEE

SEQ ID NO: 73607 - DNA, 1089 bp, Bifidobacterium longum NCC2705
  CDS (1)..(1089): transl_table=11
atggcagacgaacagttcccggcggcggcaaccgcgcttgaggagtaccagtccatcgaagagcagatggcaagccccgaagtcgtgtccaacccggacaagctgcgcaagctgggtcgtcgtcacgccgaactgggtgccatcgtgggtgcctacaaagcctggttgcaggtgaaggacgatctggcagccgctcaggagatggccggcgaggacgccgacttcgccgaggaagccaagcgtcttgaagacgaactgcccggtgtcgaggagaagctgcgcaccgcgctgatcccgcgtgacccggatgatgcgcgcgacaccatcatggagatcaaggccggcaccggcggcgaggaagccgcactgttcgccggcgacctgctgcgcatgtacacccgttacgccgagaagcgtggctggagcgtgaacgtgcagtccgagaacaccaccgagctcggcggcgtcaaggacgtgcagatcgccatccgcgccaagggcacgcccgctcccgaagacggcgtgtgggcttcgatgaagtacgagggcggcgtacaccgtgtgcagcgcatccccgtcaccgaatcgcagggccgtatccagacttccgctgccggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgccaaccggaatcacggtgaacatgcaggatgagaagtcgcagattcagaaccgtgccgccgcgttgcgcgtactgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaattacaaggcttacaaccttgacgccgtgctcgacggcgacctgcaggccgtcatcgattccgacatccaagccgacgaggccgaccgtctggccaatcagaaatga

SEQ ID NO: 73608 - protein, 362 aa, Bifidobacterium longum NCC2705
MADEQFPAAATALEEYQSIEEQMASPEVVSNPDKLRKLGRRHAELGAIVGAYKAWLQVKDDLAAAQEMAGEDADFAEEAKRLEDELPGVEEKLRTALIPRDPDDARDTIMEIKAGTGGEEAALFAGDLLRMYTRYAEKRGWSVNVQSENTTELGGVKDVQIAIRAKGTPAPEDGVWASMKYEGGVHRVQRIPVTESQGRIQTSAAGVIVFPEADEDDDEIEIDPKDLKIDIFMSSGPGGQSVNTTYSAVRMTHLPTGITVNMQDEKSQIQNRAAALRVLKSRLLAMKHEQEAAEAADMRHSQVRSLDRSERIRTYNFPENRIVDHRTNYKAYNLDAVLDGDLQAVIDSDIQADEADRLANQK

SEQ ID NO: 73609 - DNA, 456 bp, Shigella flexneri 2a str. 301
  CDS (1)..(456): transl_table=11
gtgaaaaaggcgctggacaggctaattaaagaagctgcccgacaagacgtcgcggtaacggtgctggaaacagaaacaggccgctactctgacacgctgcgttcggcgctgatttctctggatggcgacaacgcatgggcgttaagcgaaagctggtgtggcactattcagtggatttgcccgagcccgtatcgcccacatcacgggcgtaaaaactggtttctgggcattgggcgttttaccgctgatgagcaggagcaatccgatgcgatccggtatgagacgctgcgttcgtcggggccgggcggtcaacatgtcaataaaaccgactcggcggtacgcgccacgcatttggcatccggtattagcgtgaaggttcagtcagagcgcagccagcatgctaacaaacggctggcgcgattgctgattgcctggaagctggatcagcagcaatag

SEQ ID NO: 73610 - protein, 151 aa, Shigella flexneri 2a str. 301
MKKALDRLIKEAARQDVAVTVLETETGRYSDTLRSALISLDGDNAWALSESWCGTIQWICPSPYRPHHGRKNWFLGIGRFTADEQEQSDAIRYETLRSSGPGGQHVNKTDSAVRATHLASGISVKVQSERSQHANKRLARLLIAWKLDQQQ

SEQ ID NO: 73611 - DNA, 1104 bp, Leptospira interrogans serovar Lai str. 56601
  CDS (1)..(1104): transl_table=11
atggaagttaaatcggcaaaagaactcaaaagaatctctaaagaattacaagagaattttttaaaccgttggaaattgttgaatttggaacaagacaaggatcgtctcaagtcgctcacagaaaaagcggaagatccaaatctttggaacaatccagaagaagccagacttgtaagtcagaaaaaaaacgaactcgaaaaaaaactcaatccttggtttactattcagcaggatatattagattttcctgatttagtggatctcaccttggacgaaaaaggcgaaaacggggttggagaactttcttccgaatacaatagacttcaagaaaagttcgaggaattagaacttttaggcgctttaaaaaatccggaagatttaaaacccgcctttttaaacattcatccaggagccggcggaaccgaaagtcaagactgggcggaaatgctcctcagaatgtacacacgttatttcgaaaaaaaagggtatcagtattctctaatagacgttcaagcaggagacggcgccggtattaaaaatgccaccttacacgtgataggtgattttgcattcggatttcttaaaggcgaaaacggagttcacagactcgttcggatttctccctttgacgcgaataaaagaagacatacttctttcgtttcagttcacgtcagccccgaaatagacgacgatatagacatcaaaatcgaagagaaagatattcgtgtagacgtttatcgttcttcgggcgcgggcggtcagcacgtaaatactaccgactccgcggttcgaatcacccacatgccgagtggtatcgtagtcgcttgtcaaaatgaaaggtctcagattaaaaacagagatactgcattcaaaatgttgaaagctagactttacgagttggaacaagaaaaagcaaaggaagagttggaaaaaaaatccggagaaaaaaaagacatcgcttggggttctcagattcgtagttatgtatttcatccttacaatcttgtaaaagatcatagaaccgatcacgaaaccggtaacgttgcagccgtgatggacggtgacatagaaccattcattcttgcttatttgaaaacgctttaa

SEQ ID NO: 73612 - protein, 367 aa, Leptospira interrogans serovar Lai str. 56601
MEVKSAKELKRISKELQENFLNRWKLLNLEQDKDRLKSLTEKAEDPNLWNNPEEARLVSQKKNELEKKLNPWFTIQQDILDFPDLVDLTLDEKGENGVGELSSEYNRLQEKFEELELLGALKNPEDLKPAFLNIHPGAGGTESQDWAEMLLRMYTRYFEKKGYQYSLIDVQAGDGAGIKNATLHVIGDFAFGFLKGENGVHRLVRISPFDANKRRHTSFVSVHVSPEIDDDIDIKIEEKDIRVDVYRSSGAGGQHVNTTDSAVRITHMPSGIVVACQNERSQIKNRDTAFKMLKARLYELEQEKAKEELEKKSGEKKDIAWGSQIRSYVFHPYNLVKDHRTDHETGNVAAVMDGDIEPFILAYLKTL

SEQ ID NO: 73613 - DNA, 978 bp, Streptococcus mutans UA159
  CDS (1)..(978): transl_table=11
atgacagaaccagacttctgggatgacaatattgctgcccaaaagacatcacaagagttaaacgaacttaagctcaaatatgaaaccttcaacagcatgcaggaactgtcggatgagacagaattgttgcaagaaatgttagaagaagatgatagtttgcaaggcgaacttgaagaagaccttgtcaagcttgataagattatgaccagttatgagatgacgcttcttttatcagaaccctatgatgctaacaatgctattttggagatccatccgggttctggcggtacagaagcccaagactggggtgatatgctgctgagaatgtatacccgctttgggaatgccaaggggttcaaagtagacgttttggattatcaagctggtgatgaggctggtattaaatcagtcgctttatcttttgaaggccaaaatgcttatggtcttttaaaatcagaaatgggtgttcaccgtttggtcagaatctcaccatttgattcagccaaacgtcgccacacttcctttgcctctgttgaggtcatgccagagcttgatgataccatagaagtagatattagagatgaagatatcaagatggatactttccgttctggtggtgctggcggacaaaatgtgaataaagtgtcaactggagttcgcttaacccatattcctagcggcattgttgttgcttcgacggtagatcgtacccaatatggaaatcgcgatcgagccatgaaaatgcttcaggctaaactttatcaaatggagcaggaaaaaaaggctcaagaagtggatgctctcaaaggtgacaaaaaggaaatcacttggggcagtcaaattcgttcttatgttttcaccccttatactatggtgaaagatcatcggacaaactatgaagtttctcaggtagatagggtcatggatggtgaactagatggttttattgacgcctttctcaaatggcgtatggaataa

SEQ ID NO: 73614 - protein, 325 aa, Streptococcus mutans UA159
MTEPDFWDDNIAAQKTSQELNELKLKYETFNSMQELSDETELLQEMLEEDDSLQGELEEDLVKLDKIMTSYEMTLLLSEPYDANNAILEIHPGSGGTEAQDWGDMLLRMYTRFGNAKGFKVDVLDYQAGDEAGIKSVALSFEGQNAYGLLKSEMGVHRLVRISPFDSAKRRHTSFASVEVMPELDDTIEVDIRDEDIKMDTFRSGGAGGQNVNKVSTGVRLTHIPSGIVVASTVDRTQYGNRDRAMKMLQAKLYQMEQEKKAQEVDALKGDKKEITWGSQIRSYVFTPYTMVKDHRTNYEVSQVDRVMDGELDGFIDAFLKWRME

SEQ ID NO: 73615 - DNA, 1014 bp, Streptococcus agalactiae NEM316
  CDS (1)..(1014): transl_table=11
ttggaagaggagattgctcttcttgaaaatcaaatgactgagccagacttttggaatgacaatattgcagcgcaaaagacatctcaagaactgaatgagttaaaaggtaagtatgatactttccataatatgcaagaattatctgacgaaacagaactcttacttgagatgcttgacgaagatgattctttgaaagaagaattagaagaaaatctaatgcagctagataagataatgggtgcttatgaaatgacgcttctcttatctgagccttatgaccacaataatgctatcttagaaatccatcctggttcaggaggaactgaagcgcaagattggggagatttactcttacgaatgtatacccgttttggcaatgctaatggtttcaaagtagaagtattagattatcaagcaggggatgaagctggtattaaatcggttaccctctcttttgaaggccccaatgcttatggtttgttgaaatcagaaatgggagttcatcgcctcgttcgtatatcaccttttgattcggctaaacgtcgtcatacctcatttgcttcagttgaagtgatgccagagttagatgatacgattgaagtagaagtacgtgatgatgacattaaaatggatactttccgttccggaggagctggtggtcagaacgtcaataaagtatcaacaggtgttcgtttgacgcatattccaactggaattgtggtatcgtctaccgttgaccgtactcaatatgggaaccgcgatcgcgctatgaagatgttgcaggctaagctatatcagttagaacaagaaaagaaagcacaagaagtagatgctcttaagggtgataaaaaagaaatcacttggggaagtcagattcgttcttatgttttcaccccttatacgatggtgaaggatcatcgtactaactttgagcttgctcaggtagataaggttatggatggagaaatcaatggctttattgatgcctaccttaagtggcgcattgaagactaa

SEQ ID NO: 73616 - protein, 337 aa, Streptococcus agalactiae NEM316
MEEEIALLENQMTEPDFWNDNIAAQKTSQELNELKGKYDTFHNMQELSDETELLLEMLDEDDSLKEELEENLMQLDKIMGAYEMTLLLSEPYDHNNAILEIHPGSGGTEAQDWGDLLLRMYTRFGNANGFKVEVLDYQAGDEAGIKSVTLSFEGPNAYGLLKSEMGVHRLVRISPFDSAKRRHTSFASVEVMPELDDTIEVEVRDDDIKMDTFRSGGAGGQNVNKVSTGVRLTHIPTGIVVSSTVDRTQYGNRDRAMKMLQAKLYQLEQEKKAQEVDALKGDKKEITWGSQIRSYVFTPYTMVKDHRTNFELAQVDKVMDGEINGFIDAYLKWRIED

SEQ ID NO: 73617 - DNA, 1170 bp, Corynebacterium efficiens YS-314
  CDS (1)..(1170): transl_table=11
ttgtgcatggtggctgcacgggttgctgtctttgggtgggtgcagcaccaggtaacatggttgaccatgcgtcccgaaatctctgcagaactttccgagctcgacagcaccctcaccaccattgagaagatcctcaatcccgaggagctgtccgaccgtgttcgcgagctggaggcccaggccgccgatccggggctgtgggacaaccccgaccacgcccagcaggtcacctccgagctttcccacgtgcaggcggaactgcgcaaggtcaccgaactgcgccagcgtctggatgatctgccgatcatgtatgaactggccgaggaggagggcgatgacacctccctggtggatgaggaactggcggacctgcgcaccggcgtcgaggcccttgaggtcaagaccatgctgtccggtgaatacgatgcccgcgaggccgtgatcaacatccgctccggcgccggtggtgtggacgccgccgactgggccgagatgctcatgcgcatgtacatccgctgggcggagaagcacggccacaaggtggatgtctatgacatctcctacgcagaggaggccggcatcaagtcggcgaccttcgtggtccacggtgactatatgtatggccagctctccgtggagcagggggcccaccgcctggtgcgcatcagtcccttcgacaaccagggccgccgccagacctcgttcgccgaggtggaggtgctgcccgtggtggagcaggtcgactccatcgacatccccgattcggaggtccgcgtggatgtctaccgctcctccggtcccggtggccagtccgtcaacaccaccgactccgcggtccgcctgacccacatcccgaccggcatcgtcgtgacctgtcagaatgagaaatcccagatccagaacaaggcctctgccatgcgggtgctccaggcgaaactgctggagaagaagcgccaggaggaacgcgccgagatggacgccctgggtgccggcggcaacgcctcctggggtaaccagatgcgctcctatgtcctgcacccgtaccagatggtgaaggatctgcgcaccaactacgaggtcaatgatccctccaaggtgctcgacggtgacatcgacggtctgctggaggccggcatccgctggcggatggctcagcagcaggagagctag

SEQ ID NO: 73618 - protein, 389 aa, Corynebacterium efficiens YS-314
MCMVAARVAVFGWVQHQVTWLTMRPEISAELSELDSTLTTIEKILNPEELSDRVRELEAQAADPGLWDNPDHAQQVTSELSHVQAELRKVTELRQRLDDLPIMYELAEEEGDDTSLVDEELADLRTGVEALEVKTMLSGEYDAREAVINIRSGAGGVDAADWAEMLMRMYIRWAEKHGHKVDVYDISYAEEAGIKSATFVVHGDYMYGQLSVEQGAHRLVRISPFDNQGRRQTSFAEVEVLPVVEQVDSIDIPDSEVRVDVYRSSGPGGQSVNTTDSAVRLTHIPTGIVVTCQNEKSQIQNKASAMRVLQAKLLEKKRQEERAEMDALGAGGNASWGNQMRSYVLHPYQMVKDLRTNYEVNDPSKVLDGDIDGLLEAGIRWRMAQQQES

SEQ ID NO: 73619 - DNA, 999 bp, Staphylococcus epidermidis ATCC 12228
  CDS (1)..(999): transl_table=11
atgactgatcctgatttttggaatgatcaaactaaagcacaagatatcattgataagaacaatgcactaaaatctatagtaaatgggtattatcaactgacaaatgctgtcgatgatatgagtgcgacgagagagttattacaagaagaatatgatgaggatatgaagatagaattagaagaggaagttcagcaatttgaagaacaaattgatcaatatgagttacaattactcctcgacggaccacatgatgcaaataatgctatattagagcttcatcccggtgctggcggtacagaatcacaagattgggtaagtatgcttcttaggatgtatcaacgttactgtgaacaaaatggctttaaagttgaaacggttgattatcttccaggagatgaagcaggcgttaaaagtgtcacattacttattaaaggacataatgcttatggttatttaaaggcagaaaaaggtgttcatcgtttagttagaatttcacctttcgattcatctggtagacgccatacttcttttgcatcatgtgatgttattcctgattttaataatgatgaaattgaaatcgagattaacccagatgatatcacagtggatacttttagagcttcaggcgctggtggacaacatattaacaaaactgagtctgcaattagaattacacatcaccctacaggtattgtagtcaacaaccaaaatgaacgatctcaaataaaaaatagagaagctgcaatgaaaatgttgaagtccaaactttatcaattaaagttagaagagcaagagcaagaaatggctgaaattcgaggcgaacaaaaagacattggatggggaagtcagattcgttcttacgtctttcatccatattcaatgattaaagatcatcgtacgaatgaagaaactggtaaagtagacgctgttatggatggagaaataggcccattcatagaagcttatttaagaaaagaaatggatagtcgagacgtataa

SEQ ID NO: 73620 - protein, 332 aa, Staphylococcus epidermidis ATCC 12228
MTDPDFWNDQTKAQDIIDKNNALKSIVNGYYQLTNAVDDMSATRELLQEEYDEDMKIELEEEVQQFEEQIDQYELQLLLDGPHDANNAILELHPGAGGTESQDWVSMLLRMYQRYCEQNGFKVETVDYLPGDEAGVKSVTLLIKGHNAYGYLKAEKGVHRLVRISPFDSSGRRHTSFASCDVIPDFNNDEIEIEINPDDITVDTFRASGAGGQHINKTESAIRITHHPTGIVVNNQNERSQIKNREAAMKMLKSKLYQLKLEEQEQEMAEIRGEQKDIGWGSQIRSYVFHPYSMIKDHRTNEETGKVDAVMDGEIGPFIEAYLRKEMDSRDV

SEQ ID NO: 73621 - DNA, 969 bp, Bradyrhizobium japonicum USDA 110
  CDS (1)..(969)
atgcaggagcggacctcgctggaggattcgctgtcgggcatcggcaaggtcgagcaggagctcgaagacgacatcggcatgatcgagctcggcgaagccgagggcgatgacggcgtcgtggccgaagccgaagctgcgctgaaggccctgaagaaggaagtcgcgcggcgcgagctcgaggcgctgctgtcgggcgaagccgaccgcttcgattcctatctcgaggtccacgccggcgccggcggcaccgaaagccaggactgggcgcagatgctgctgcgcatgtacacgcgctgggcggagacgcacggcttcaaggtcgagtatctcgaagagtccgagggcgaagaagccggcatcaagtcggcgacgatccaggtctcaggccacaacgcctatggctggctgaagaccgaggcgggcgtgcatcggctggtgcgcatctcgccgttcgattccaacgcgcggcggcacacgtcgttctccagcgtgcaggtgttcccggtcatcgacgacagcatcaagatcgacatcaaggaatccgacgtccgcgtcgataccatgcggtcgggcggcgccggcggccagcacgtcaacaagaccgaatccgcggtgcgcctgacgcatatcccgaccggtgtcgcggtggtctgccaggccggccgctcgcagcacaagaaccgggcgcaggcctgggacatgctgcgcgcgcggttgtacgaaatggagttgaagaagcgcgaggagaaggccgccgccgaccaggccgccaagaccgatatcggctggggccaccagatccgctcctacgtgctgcagccctatcagatggtgaaggatctgcgcacgggcgtgcagacctccgacacctcgggcgtgctcaacggcgaactcgacgacttcatggccgcgacgctggcgcagcgcgccttcggaaccgccggcgctgacatcgaggatgtggactag

SEQ ID NO: 73622 - protein, 322 aa, Bradyrhizobium japonicum USDA 110
MQERTSLEDSLSGIGKVEQELEDDIGMIELGEAEGDDGVVAEAEAALKALKKEVARRELEALLSGEADRFDSYLEVHAGAGGTESQDWAQMLLRMYTRWAETHGFKVEYLEESEGEEAGIKSATIQVSGHNAYGWLKTEAGVHRLVRISPFDSNARRHTSFSSVQVFPVIDDSIKIDIKESDVRVDTMRSGGAGGQHVNKTESAVRLTHIPTGVAVVCQAGRSQHKNRAQAWDMLRARLYEMELKKREEKAAADQAAKTDIGWGHQIRSYVLQPYQMVKDLRTGVQTSDTSGVLNGELDDFMAATLAQRAFGTAGADIEDVD

SEQ ID NO: 73623 - DNA, 1014 bp, Buchnera aphidicola str. Bp (Baizongia pistaciae)
  CDS (1)..(1014): transl_table=11
ataaaaaaaaatagattgctagaaataaatatggaattaaaacttcctgaaacttggaaacatccaagtttaataaaaaaaataaacaaagaaaaaaatcaattaatatctgtagtaactcaaataacaaaaatagataatgatgttcaagaattaattgacattttaaatttagaaaattcaaataatataaatagtatattagataatgttttatatgaatttaaaaacattgaaaaatctattcatgaactagaaaaatgtagtatgtttttaggtaaatatgactatttgagttgttatgtagatatacaatctggatcaggcggggtggaggctcaagattgggcaagcatgttattgcgcatgtatgtaagatgggcagaatcaaaaaaatttaaaatagatattattgaacaaacatatggtgaagtagtaggtataaagtctgctactattgaggtattagggaagtatgcattcggttggtttcgtactgaaactggtatacatcgtttagttcgaaaaagtccatttaatgcgcaccatagaagacatacatctttttcttctgtatatgtgtatcctattttagacgatgctattaatgttgatattaacactcgtgatttaaaaattgatgtatatcgcgcttcaggtgcaggagggcaacatgttaataaaactgaatctgcagttagaattagacatttacctacaggtatagttgtgcaatgtcaaaatgatagatctcaacataaaaataaagatcaagctatgaaacaattaaaagcaaagctttatgaacaactaataaatgaaaaaaaatgtcaacaaaagatattagagaataataaattgaatataggatggggacatcaaatacgttcatatacgttagataactctcgtattaaagatttaaggacaggtgtagaaagtaaaaatattcagtctgttttagatggaggattagatctatttgttgaatgtagtttaagaaatggattataa

SEQ ID NO: 73624 - protein, 337 aa, Buchnera aphidicola str. Bp (Baizongia pistaciae)
MKKNRLLEINMELKLPETWKHPSLIKKINKEKNQLISVVTQITKIDNDVQELIDILNLENSNNINSILDNVLYEFKNIEKSIHELEKCSMFLGKYDYLSCYVDIQSGSGGVEAQDWASMLLRMYVRWAESKKFKIDIIEQTYGEVVGIKSATIEVLGKYAFGWFRTETGIHRLVRKSPFNAHHRRHTSFSSVYVYPILDDAINVDINTRDLKIDVYRASGAGGQHVNKTESAVRIRHLPTGIVVQCQNDRSQHKNKDQAMKQLKAKLYEQLINEKKCQQKILENNKLNIGWGHQIRSYTLDNSRIKDLRTGVESKNIQSVLDGGLDLFVECSLRNGL

SEQ ID NO: 73625 - DNA, 909 bp, Xylella fastidiosa Temecula1
  CDS (1)..(909): transl_table=11
gtgctgaacggggtcgctgaagccagcgaatttttggatctggctgaaatagagcaagatcaggagatgttgcaggctgtcctgaacgacgtggacatctatcaacttcaggtcgagaaactggagtttcagcgcatgttttccgggaagatggacggtgccaatgcgtttgttgacatccaggcgggtgctggagggaccgaggcccaagattgggcagagatgctgctgcgtatgtatttgcgttgggccgaggggcgtggttggaaggccgaattgcttgaagtttctggcggtgaagtggccggcatcaaatcagccacgtttcgcgtggagggcgattttgcctacggttggttgaagacggagactggggtgcatcgtttggtgcgtaagtcgccatttgattcggataaccgtcgccatacgagttttacctctgtctttgtttccccggaggtcgatgacaacatcgacattgagattaacccggccgacttgaagaccgatgtataccgctcctctggggctggtggtcagcacgtgaacaagactgagtctgcagtacgtatcacccacgtaccgagtgggattgtggtggcctgccagacggaacgtagtcagcatgctaaccgtgatcgtgcgatgaagatgctggcggccaagttgtacgagtcggagatccagaagcggaatgccgaaaaagacgtacttgaggcctctaagtctgatatcggctgggggagtcagattcgcaattacgtattggatcagagtcggattaaagatcttcgtactggcgttgagcgcagcgatactcagaaagtacttgacggcgatttagatgagtttattgaagcgagtttgaaggctggtttggaagcaggcgctaaacgcgccgatgcatga

SEQ ID NO: 73626 - protein, 302 aa, Xylella fastidiosa Temecula1
MLNGVAEASEFLDLAEIEQDQEMLQAVLNDVDIYQLQVEKLEFQRMFSGKMDGANAFVDIQAGAGGTEAQDWAEMLLRMYLRWAEGRGWKAELLEVSGGEVAGIKSATFRVEGDFAYGWLKTETGVHRLVRKSPFDSDNRRHTSFTSVFVSPEVDDNIDIEINPADLKTDVYRSSGAGGQHVNKTESAVRITHVPSGIVVACQTERSQHANRDRAMKMLAAKLYESEIQKRNAEKDVLEASKSDIGWGSQIRNYVLDQSRIKDLRTGVERSDTQKVLDGDLDEFIEASLKAGLEAGAKRADA

SEQ ID NO: 73627 - DNA, 978 bp, Clostridium tetani E88
  CDS (1)..(978): transl_table=11
atgcaagaacctgatttttgggaagatataaagagagcacaagaagtaacacaacaggaaaaattaattaaagatagattagaaaagtttgactctttagagaatagaatagaagattctttagttcttatagaacttatgaaagaagaagaggacatttcctcggcaggagaagtattaaaagagttagtgctacttaagaaggaaatagagagttttagaatagaagttttattatcaggtgaatatgatagaaacaatgctataatgacattacatgcaggagtagggggaacagatgcccaagattggactgaaatgttgcttagaatgtatacaagatgggcagagaagaaaggttataaggtagatactttagactttctaccaggtgatgaggcaggaataaaaagtgttaccttaaaaataactggagatttcgcttatggatatttaaaagcagaaaaaggagtacacagaattgtaaggatatcaccttataatgccaatggaaaaagacaaacttcttttgcatccttagaattgataccagaacttacagaagatcaagacatagaaataatagatgatgatttaaaagtagatacttatagagctagtggagctggtggacaacacgtaaataaaacagaatctgcagtaagaataactcatattccaacaggaatagttgtacaatgccaatcagaacgaagtcaacattctaatagggatactgcactaaaaatgcttaaagctaaacttgtagagttgaaagaagcagagcacaaagaaaagatagaagatctaactggtgaattaaaagatatgggatggggaagtcagataagatcttacgtatttcatccatataacttagtaaaagatcatagaacttcagcagaaacaggtaatttaacagcagtaatggatggagatattgatttgtttataaatgaatatttaaaagctaactaa

SEQ ID NO: 73628 - protein, 325 aa, Clostridium tetani E88
MQEPDFWEDIKRAQEVTQQEKLIKDRLEKFDSLENRIEDSLVLIELMKEEEDISSAGEVLKELVLLKKEIESFRIEVLLSGEYDRNNAIMTLHAGVGGTDAQDWTEMLLRMYTRWAEKKGYKVDTLDFLPGDEAGIKSVTLKITGDFAYGYLKAEKGVHRIVRISPYNANGKRQTSFASLELIPELTEDQDIEIIDDDLKVDTYRASGAGGQHVNKTESAVRITHIPTGIVVQCQSERSQHSNRDTALKMLKAKLVELKEAEHKEKIEDLTGELKDMGWGSQIRSYVFHPYNLVKDHRTSAETGNLTAVMDGDIDLFINEYLKAN

SEQ ID NO: 73629 - DNA, 1131 bp, Tropheryma whipplei str. Twist
  CDS (1)..(1131): transl_table=11
atgaatattaccgaactttttgattccctgaaggaaatcgagaagaccttcagtgaaataacaagtgttgtttcgccagttttgctctcaaagagaatagcagaactaaccgctcgcgtgtcggatccagatctttggaccacacccgacagggcacaacagatcgcgcgtgagctcagcattacaaaagcccaactcgatcgcctaacaaatcttgaagcccaacttgatgaaatgcgtgttctggttactctattagagaatgagcatgacgctggcctgcttgatgagggcagcagaaaggcgaaattactccttgaggaggccaaccacctgttgattcaaaacatgctaaataatgagtacgattgctatcctgcagtgcttacaatccgggcaggagcgggcggtattgatgccgccgatttcgcacagatgctcttgcgaatgtatatacggtgggcccaaaaacactcttccgaagcgattgtaatggacataagctatgccgaagaggccggcattcgttcagcaaccctgcgaattgatctaccatttgcttttggtaagttacatcaagagtcaggaactcataggctggttcggattagcccgtttaacgcagccggaaaaagacatacaagctttgctgcagttgaggtaatacctctcctagaggaggtatcttctatcgaaataactaatgatgaaatcagaatagatgtctttagatcatcaggacccggaggacagtctgttaacacaacagactcagcagtcagaataacccatctcccaacaggaattgtagtctcctgccaaaacgagaaaagccagatacaaaaccgagaatcagcaatgcggatcctgcgagcgaggctgctccttaacaagagacaggaagaggctgccattcgtaaggagcttgccggaaacatagttgcaagctggggtgagcaggtgcgcaattatgttctcgcgccttatcagcttgtaaaggatcttcgcagtctgcacgaaagttccatgccggacaaagtgtttgacggtgacattgatggcttcattgatgccggaataaaatggcacgcgcaaaaacacatactaaaccaaaatggcacgcgcgaatag

SEQ ID NO: 73630 - protein, 376 aa, Tropheryma whipplei str. Twist
MNITELFDSLKEIEKTFSEITSVVSPVLLSKRIAELTARVSDPDLWTTPDRAQQIARELSITKAQLDRLTNLEAQLDEMRVLVTLLENEHDAGLLDEGSRKAKLLLEEANHLLIQNMLNNEYDCYPAVLTIRAGAGGIDAADFAQMLLRMYIRWAQKHSSEAIVMDISYAEEAGIRSATLRIDLPFAFGKLHQESGTHRLVRISPFNAAGKRHTSFAAVEVIPLLEEVSSIEITNDEIRIDVFRSSGPGGQSVNTTDSAVRITHLPTGIVVSCQNEKSQIQNRESAMRILRARLLLNKRQEEAAIRKELAGNIVASWGEQVRNYVLAPYQLVKDLRSLHESSMPDKVFDGDIDGFIDAGIKWHAQKHILNQNGTRE

SEQ ID NO: 73631 - DNA, 783 bp, Vibrio parahaemolyticus RIMD 2210633
  CDS (1)..(783): transl_table=11
ttggaagagaagcttgcgcagctagaattccgccgcatgttctctggtgaccacgatagctctgattgctacattgacttgcaagcaggttcaggtggtacagaggcgcaagactggaccaacatgatgctacgcatgtacttacgctgggctgaagcgaaaggcttcaaggcggaagtgatcgaagtatctgaaggtgaggttgcgggtcttaaatctgcaacggttcgtatctctggtgattacgcttacggttggctacgtacagaaactggtgttcaccgtttagtacgcaaatcgccattcgattcaggcggccgtcgtcatacgtcttttgcgtctgcgttcatctacccagagattgatgaaaacattgctatcgacattaaccctgctgatctgcgtatcgacgtttaccgtgcgtcaggtgcgggtggtcagcacgtcaacaccactgaatctgcggtacgtattacgcacgtaccaacgaatactgtggtgcagtgtcaaaacgaccgttctcaacataagaacaaagatcaggcaatgaaacagcttcgagcgaagctatttgagcttgagttgcaaaagcaaaacgcggaaaaacaagctaatgaagacgctaagtctgacattggctggggtagccagatccgttcttacgtattggatgattcacgcattaaagacctccgtacgggcgttgaaaaccgtaatactcaagcggttcttgatggcgatctggacaaatttattgaagctagcctgaaatcaggcctataa

SEQ ID NO: 73632 - protein, 260 aa, Vibrio parahaemolyticus RIMD 2210633
MEEKLAQLEFRRMFSGDHDSSDCYIDLQAGSGGTEAQDWTNMMLRMYLRWAEAKGFKAEVIEVSEGEVAGLKSATVRISGDYAYGWLRTETGVHRLVRKSPFDSGGRRHTSFASAFIYPEIDENIAIDINPADLRIDVYRASGAGGQHVNTTESAVRITHVPTNTVVQCQNDRSQHKNKDQAMKQLRAKLFELELQKQNAEKQANEDAKSDIGWGSQIRSYVLDDSRIKDLRTGVENRNTQAVLDGDLDKFIEASLKSGL

SEQ ID NO: 73633 - DNA, 621 bp, Bacteroides thetaiotaomicron VPI-5482
  CDS (1)..(621): transl_table=11
atgaaggagaaagtctatttacagataacttccggcaggggacctgcggaatgttgccgggtggtggcattggtactcgaaagaatagtaagacaggcgcaggcaagcggactgaaaatggaaatgatagaacgtgaagtgggaccggtcaaccggacactgctttcggctaccattgctcttcaaggcgcagcgagcggagaactggcggatgaatgggagggaacggtgcaatggattgcccaaagcccgtatcgcatttatcacaagcggaaaaactggtttgtcggtgtgcattcgtttgtgttgtcggagagtcaggaggctacagaaagagatttccgctatgaaaccttacgggcttccggtccgggcgggcagcatgtcaacaagacagagtccgcggtccgtgccgttcacatcccgtccgggatgagtgtggtagcttccgaccaacgttcacaatggcagaacaagaagctggcaacggaacgcctgttggtgaaactttcgtcatggacgatggaacaggcgatgattcaggcgcaggaaaactggagtaatcataatcatcttcaacgggggaatcccgtgaaggtgattcgggaaccgctgatttag

SEQ ID NO: 73634 - protein, 206 aa, Bacteroides thetaiotaomicron VPI-5482
MKEKVYLQITSGRGPAECCRVVALVLERIVRQAQASGLKMEMIEREVGPVNRTLLSATIALQGAASGELADEWEGTVQWIAQSPYRIYHKRKNWFVGVHSFVLSESQEATERDFRYETLRASGPGGQHVNKTESAVRAVHIPSGMSVVASDQRSQWQNKKLATERLLVKLSSWTMEQAMIQAQENWSNHNHLQRGNPVKVIREPLI

SEQ ID NO: 73635 - DNA, 1107 bp, Streptomyces avermitilis MA-4680
  CDS (1)..(1107)
atggcagtcgtcgatgtatccgaagagctcaagtccctctcctcgaccatggagtcgatcgaggccgttttggacctcgacaagctgagggcagacatcgccgtgctcgaggagcaggcggccgcgccgtccctgtgggacgaccccgaggcggcgcagaagatcaccagcaagctctcccacctccaggcggaggtgcggaaggccgaggccctgcgcggccggatcgacgacctcagcgtcctcttcgagatggccgaggaggaggacgacccggacacccgcgccgaggccgagtccgagctcaccgccgtcaagaaggcactggacgagatggaggtccggacgctgctctccggggagtacgactcccgcgaggccctcgtgaacatccgggcggaggccggtggcgtcgacgccgccgacttcgccgagaagctgcagcgcatgtatctgcgctgggccgagcagcgcgggtacaagaccgagatctacgagacgtcgtacgccgaagaggccggcatcaagtccacgaccttcgccgtccaggtgccgtacgcgtacgggacgctgtcggtggagcagggcacgcaccggctcgtgcggatctcccccttcgacaaccaggggcgtcggcagacctccttcgcgggtgtcgagatccttcccgtggtggagaccaccgaccacatcgagatcgacgagtccgagctgcgggtggacgtctaccggtcctccggccccggcggccagggcgtgaacaccaccgactccgcggtgcgcctcacccacctgcccaccggcatcgtcgtctcctgccagaacgagcggtcgcagatccagaacaaggcgtccgcgatgaacgtcctccaggccaagctgctcgaccggcgccggcaggaggagcaggccaagatggacgccctcaagggcgacggcggcaattcctggggcaaccagatgcggtcgtacgtcctgcacccgtaccagatggtcaaggatctgcggaccgagtacgaggtcggcaatccggaggccgttttcaacggtgagatcgaagggttcctcgaggccgggattcgctggcgcaagcagcaggagaagtaa

SEQ ID NO: 73636 - protein, 368 aa, Streptomyces avermitilis MA-4680
MAVVDVSEELKSLSSTMESIEAVLDLDKLRADIAVLEEQAAAPSLWDDPEAAQKITSKLSHLQAEVRKAEALRGRIDDLSVLFEMAEEEDDPDTRAEAESELTAVKKALDEMEVRTLLSGEYDSREALVNIRAEAGGVDAADFAEKLQRMYLRWAEQRGYKTEIYETSYAEEAGIKSTTFAVQVPYAYGTLSVEQGTHRLVRISPFDNQGRRQTSFAGVEILPVVETTDHIEIDESELRVDVYRSSGPGGQGVNTTDSAVRLTHLPTGIVVSCQNERSQIQNKASAMNVLQAKLLDRRRQEEQAKMDALKGDGGNSWGNQMRSYVLHPYQMVKDLRTEYEVGNPEAVFNGEIEGFLEAGIRWRKQQEK

SEQ ID NO: 73637 - DNA, 1014 bp, Chlamydophila caviae GPIC
  CDS (1)..(1014): transl_table=11
ttgactgaattagaagatcagaccttgaaagaggacttctggcaagacgttgctcatgctggaaaagtttctgaacgcgtcgcatcattaaaacgacaaatttctgattatgaagaattcaaaagtaaggtagataacctgacttttttcttaaatgatagtgaagcttcttcagatcccgaacttcgtgaagatttagaaaaagaattttctgtttgtgaaactatccttgccgaatgggaaacgcaacgcttactttctggcgaggtggataaaaatccctgctttttaacgatcaatgctggtgcgggggggaccgagtcttgtgattgggtggaaatgcttttcaggatgtattctcgctgggcatcccaccatcaatggaaagccgaggttatagatcgtcaagaaggggatgtcgcagggattaagcatattaccgtaaagttttcaggagagtatgcttatggttatgctaaagcagagcgtggtgtgcatagacttgtgcgcatttcccctttcgatagtaatgcgaaacgtcatacaagctttgcttccgtggatgtctatcctgaaattgatgatgagatagaaattgatatccgcccaaatgatttgcgtattgatacgtaccgatcttcaggagctggaggacagcacgtcaatgttaccgattctgctgtgagaattacccatattcccacaggaattattgtttcttgccaaagtgagcgcagccaaatccagaatcgtgaaagctgcatgaaaatgttgcgcgcaagaatgtatcagcaggttcttcaggaacggttagaaaagcaacttcttgatagaaaaaataaaaaagaaattgcttggggttcacaaattcgtaattatgtttttcagccttatactttggtcaaagatatgcgtacggggcatgagactggcaatgtgcaggctatgatggacggagaattgctagatgatttcgtcaaagcgtatttagcagagtatggagaagcctcatga

SEQ ID NO: 73638 - protein, 337 aa, Chlamydophila caviae GPIC
MTELEDQTLKEDFWQDVAHAGKVSERVASLKRQISDYEEFKSKVDNLTFFLNDSEASSDPELREDLEKEFSVCETILAEWETQRLLSGEVDKNPCFLTINAGAGGTESCDWVEMLFRMYSRWASHHQWKAEVIDRQEGDVAGIKHITVKFSGEYAYGYAKAERGVHRLVRISPFDSNAKRHTSFASVDVYPEIDDEIEIDIRPNDLRIDTYRSSGAGGQHVNVTDSAVRITHIPTGIIVSCQSERSQIQNRESCMKMLRARMYQQVLQERLEKQLLDRKNKKEIAWGSQIRNYVFQPYTLVKDMRTGHETGNVQAMMDGELLDDFVKAYLAEYGEAS

SEQ ID NO: 73639 - DNA, 1044 bp, Nitrosomonas europaea ATCC 19718
  CDS (1)..(1044): transl_table=11
ttgatttgcggaggtatctttgacttcgatgccaagcaaatacggctgacggagctggaacgccagtctgaagatcccgccatctggaatgatccggatcgcgcccaggaaatggggcgtgagaaaaaatctctcgaaaacatcgtacatactctgcaatcggtcgatcgtcaattgcgggatacgcatgaactgctgcagatcgcccaggaagaaaacgacaaagaaaccctgcaaagcattgccgatgatgtcacggaactcgatcagacactggccgggatggagtttcgccggatgttttccgatccgatggatcctaataactgttttgtcgatatccagtccggttcgggtggaactgaagcacaggactgggcatcgatgctggaaagaatgtacctgcgctactgtgaacggcgcggactgggagtggaactgctggaagaatctcctggcgacgtagccggtatcaagagtgccacgctcaagataagcggtgaatatgcctatggctatctgcgcacagaaacgggtgtgcaccggctggtgcgtaaatcaccatttgattccggtaaccggcggcatacttcctttgccagcgtgtttgtctatccggaagtggatgacagtatcgaaatcgacatcaatccagccgatttgcgggtagatacctttcgtgcctcaggcgcgggcgggcagcatatcaataaaacagattcagctgtccggatcacgcatattccaaccggtatcgtcgttcaatgccagagtggccgctcccagcaccgcaaccgtgctgatgccatgacagtactgaaatcccgtttgtatgaagcagaactgagaaaacgcaacgagaccaaacaggccatcgaagattccaaaaccgatatcgcctggggtcaccagattcgctcttatgtgctggatcagtcccgtatcaaggatttgcgcaccaatatcgagatcggcaatacccaggctgtactcgatggtgatctggatacattcatcgaagcaagtctcaagcagggggtatga

SEQ ID NO: 73640 - protein, 347 aa, Nitrosomonas europaea ATCC 19718
MICGGIFDFDAKQIRLTELERQSEDPAIWNDPDRAQEMGREKKSLENIVHTLQSVDRQLRDTHELLQIAQEENDKETLQSIADDVTELDQTLAGMEFRRMFSDPMDPNNCFVDIQSGSGGTEAQDWASMLERMYLRYCERRGLGVELLEESPGDVAGIKSATLKISGEYAYGYLRTETGVHRLVRKSPFDSGNRRHTSFASVFVYPEVDDSIEIDINPADLRVDTFRASGAGGQHINKTDSAVRITHIPTGIVVQCQSGRSQHRNRADAMTVLKSRLYEAELRKRNETKQAIEDSKTDIAWGHQIRSYVLDQSRIKDLRTNIEIGNTQAVLDGDLDTFIEASLKQGV

SEQ ID NO: 73641 - DNA, 1368 bp, Arabidopsis thaliana
  CDS (1)..(1368)
atgtccatggagctcaccgttctcggacccctcgccggtcggagtttcgcaatcgccggaaaacctaaacttctgcttcttcgaccaacaaacctccctcttctccgtctctcactcccgctttctcttcccaatttctcttcgtcctctcgttttaattcgcccatattcgctgcacaggagagtaacttgagtgtatccaacgaaaacgaaaccagtgagtggctgatgcaagatttttatacattgagaaaagatgtagaaatagcatcagctcgtgttgaagagattagagcttctgctaatttacaacaactagaacaagagattacaaatctggaatcaaaagctactgatacatcgttttgggatgatcgtactaaagctcaagaaactttatcgtctttaaatgatcttaaagatcgtatgcggttactctctgagttcaaaacgatggttgaagatgccgaaacgattgttaaactaacagaagagatggactctactgatgttagtttacttgaagaagccatgggaatcattaaagagttgaataaatctttagataaatttgagcttactcagcttttatcaggaccttatgacaaagaaggtgctgttgtttacattacagctggagctggaggaacagatgcacaggattgggctgatatgttgcttaggatgtatatgagatggggagagaagcagcggtacaagacgaaagttgttgaaatgtctaatggagaagaggcagggattaagtcagcgactcttgaaattgaagggcgttatgcatatggttacatttcaggggagaaaggaactcataggattgtccgacaatcgcctttcaattcgaaaggtcttcgccagacaagcttttctggtgtggaagtgatgccgcttttgcctgaggaagcggtgggaatcgaaataccagaagaggaccttgacattagtttcacgagggcaggtgggaaaggaggacagaatgttaacaaggttgaaactgctgtacggattactcatatccctactggtgttgctgttcgttgcacagaggagagaagtcaactggcgaacaagacgagagctctgatcagactaaaagcgaaactgatggtgattgcggaggagcaacgtgctactgaaatcaaggaaataagaggagatgcagtgaaagctgaatggggacagcagatcaggaactacgtgtttcatccgtacaaactcgttaaggatgtccgaacaggtcatgaaacttctgatatcacatctgtaatggatggtgacttggaccctttcatcaaagcttaccttaagcataagtacaccttagccatggcttctgctgtaaccaattag

SEQ ID NO: 73642 - protein, 455 aa, Arabidopsis thaliana
MSMELTVLGPLAGRSFAIAGKPKLLLLRPTNLPLLRLSLPLSLPNFSSSSRFNSPIFAAQESNLSVSNENETSEWLMQDFYTLRKDVEIASARVEEIRASANLQQLEQEITNLESKATDTSFWDDRTKAQETLSSLNDLKDRMRLLSEFKTMVEDAETIVKLTEEMDSTDVSLLEEAMGIIKELNKSLDKFELTQLLSGPYDKEGAVVYITAGAGGTDAQDWADMLLRMYMRWGEKQRYKTKVVEMSNGEEAGIKSATLEIEGRYAYGYISGEKGTHRIVRQSPFNSKGLRQTSFSGVEVMPLLPEEAVGIEIPEEDLDISFTRAGGKGGQNVNKVETAVRITHIPTGVAVRCTEERSQLANKTRALIRLKAKLMVIAEEQRATEIKEIRGDAVKAEWGQQIRNYVFHPYKLVKDVRTGHETSDITSVMDGDLDPFIKAYLKHKYTLAMASAVTN

SEQ ID NO: 73643 - DNA, 1101 bp, Helicobacter hepaticus ATCC 51449
  CDS (1)..(1101): transl_table=11
atggattcttatgaatatggtgagttacttaaaactttgcacaataaatgtgagaatattgcaaagattcttaatccaacttcgcttcaaaagcagcttaaagatattgagaatcttgagcaagatgagcatttttggaatgatagcaaaagagcagcagaagtagcgaagcaaaagcgaaaatgtgagcgaatgctacaaacttatacgaacacaaaacaagaaattgatgatgcactagaactatatgaaatagctatgagcgaggaagattctcgcactttagagttgctttttgagcaagcaccttctttacttagtcatattcaaaaggttgagattgaagtaatgttaagtggtgagaatgatggttcaaatgctattattactattcagcccggtgctggtggcacagaatctcaagattgggcaagtatcctttatcgtatgtatttgcgttggagtgagcgtagggggtttaaagttgagctgcttgattaccaagatggcgaggaagcagggattaaaggtgtggcttttatcataaaaggcgaaaatgcttatggttatgctaaaagcgagaatggtgtgcatcgtttagtgagaatctctccttttgatgcaaatgctaagaggcatacgagttttgctagtgtgcaggtaagtccagagcttgatgatgatataaacattgagattgaggacaaagatatacgcattgatacttatcgtgcaagtggagcaggcggacaacacgtcaataaaacagaatctgctattagaatcactcattttcctacaggtatagtggtgcaatgtcaaaatgatagaagtcagcataaaaacaaggctacggcgatgaaaatgttaaaatccaaactctatgagttagagttgcaaaaaaatcaagaaggagcaagtcaagaaaaaagtgaaattggttggggacatcaaatccgctcctatgtgcttgctccttatcaacaggtaaaagatttgcgcactcaatttgctacaagtgatacaagcggtgtgcttgatggagatattgatgagattatagaatctgttcttgtgcatacaagtgcgaaagataattaa

SEQ ID NO: 73644 - protein, 366 aa, Helicobacter hepaticus ATCC 51449
MDSYEYGELLKTLHNKCENIAKILNPTSLQKQLKDIENLEQDEHFWNDSKRAAEVAKQKRKCERMLQTYTNTKQEIDDALELYEIAMSEEDSRTLELLFEQAPSLLSHIQKVEIEVMLSGENDGSNAIITIQPGAGGTESQDWASILYRMYLRWSERRGFKVELLDYQDGEEAGIKGVAFIIKGENAYGYAKSENGVHRLVRISPFDANAKRHTSFASVQVSPELDDDINIEIEDKDIRIDTYRASGAGGQHVNKTESAIRITHFPTGIVVQCQNDRSQHKNKATAMKMLKSKLYELELQKNQEGASQEKSEIGWGHQIRSYVLAPYQQVKDLRTQFATSDTSGVLDGDIDEIIESVLVHTSAKDN

SEQ ID NO: 73645 - DNA, 1014 bp, Rhodopirellula baltica SH 1
  CDS (1)..(1014): transl_table=11
atggcagctcccgacttctggaacgacagcgaatcagcccaaaaggtagtgatgcagctgaagggcctgaagggaatcgtctcgcccctgaatgagcttgagtcctcggcggaagacttggaagccctctttgagatggctgatgaagacgaatcgatcgttgatgaggttcggtccgagatcgatcgcctggaggtcgtcctggatgacctcgaactcaaagcgttgctgaacggtccgaatgattccgccggtgcgatcgtgacgatcaacgcccgcgacggtgggaccgatgccaatgactgggccgatatgctgctgcggatgtactccgcttgggcggttggtcaggaatataaaatcgaattgctggaccgccaagaaaacgaggaggcggggatcaaccacgcctcgatcgcggtacgaggaccaatggcgtatggctatttgaaaggcgaagaaggcatgcaccggttggttcggatcagtccgttcaacagcgagagcaagcgtcagacgagttttgcagccgtgagtgtttcgccggaaatcgacgattcgatcgaggtgaatgtcgagaagaaggacgttcgcgaagacacgtatcgggccagtggagcgggtggtcagcacgtcaataaaacggacagtgccattcgtttgacacacatcccgaccaacacggtcgtgcagtgtcaaaaccaacgaagccagcaccagaaccgagacaccgcttggaagatgttgcgggccaagttggcccggatcgaagaagaacgccgcgaagcggaggaagccaagaagtacgagactcaggcgagaaccggattcggtagccagattcgcaactacttcctgcatcccgaccagcgagtcaaagacgctcggaccggtcattacgtcggcaacttcaacagcgtgcttgatggcagcgaactgcagggctttttcgacgcgttcctgcgattgaaagctggaaagacggaagccgttcactccggcgacgacgattga

SEQ ID NO: 73646 - protein, 337 aa, Rhodopirellula baltica SH 1
MAAPDFWNDSESAQKVVMQLKGLKGIVSPLNELESSAEDLEALFEMADEDESIVDEVRSEIDRLEVVLDDLELKALLNGPNDSAGAIVTINARDGGTDANDWADMLLRMYSAWAVGQEYKIELLDRQENEEAGINHASIAVRGPMAYGYLKGEEGMHRLVRISPFNSESKRQTSFAAVSVSPEIDDSIEVNVEKKDVREDTYRASGAGGQHVNKTDSAIRLTHIPTNTVVQCQNQRSQHQNRDTAWKMLRAKLARIEEERREAEEAKKYETQARTGFGSQIRNYFLHPDQRVKDARTGHYVGNFNSVLDGSELQGFFDAFLRLKAGKTEAVHSGDDD

SEQ ID NO: 73647 - DNA, 837 bp, Wigglesworthia glossinidia endosymbiont of Glossina brevipalpis
  CDS (1)..(837): transl_table=11
ttgtctttagaagaaaatgattcaaaatctttgcttgaagttaataatgaaataattttattgaataaaagaatgaaaaaaatagaacttatgtgctatttttttgaaaaaaatgatcgttgtaattgttatatggatatacagccaggatctggaggaatagatgcccaagattgggcttcaatattattaaggatgtatttaaaatgggcagatcgtaataattttaaaaccgatattatttataagtcaagttctgaaatagctggtataaaatcagctacagttaaatttttaggatcttatgcatacggatggttaaaaaaagaaactggaatacatagattagtaagaaaaagtccatttgactctaacgggaaaagacatacttctttttgttcaatatttgtatatccagatataaatgataaaattgaaattaaaataaatttatcagatcttagaattgatgtatatagatcttctggagcaggaggtcaacatgtaaataggacagagtctgctgttagaataacacatttgcctactaaaataaccacacagtgtcaaagcgatagatctcaacacaaaaataaagaaaaggctattaatcagcttaaatcgaaactatatgaatttgagttaagaaaaaaaaataaagataaaaaaatcatagaaaaatccaaatcaaaaattgcttgggggaatcaaattagatcatatatatttgataattctatagtaaaagatttaagaactggaattgaatcgaaaaagattcagtctattttagacggggatttaaatatttttcttaacaagaattttaacatataa

SEQ ID NO: 73648 - protein, 278 aa, Wigglesworthia glossinidia endosymbiont of Glossina brevipalpis
MSLEENDSKSLLEVNNEIILLNKRMKKIELMCYFFEKNDRCNCYMDIQPGSGGIDAQDWASILLRMYLKWADRNNFKTDIIYKSSSEIAGIKSATVKFLGSYAYGWLKKETGIHRLVRKSPFDSNGKRHTSFCSIFVYPDINDKIEIKINLSDLRIDVYRSSGAGGQHVNRTESAVRITHLPTKITTQCQSDRSQHKNKEKAINQLKSKLYEFELRKKNKDKKIIEKSKSKIAWGNQIRSYIFDNSIVKDLRTGIESKKIQSILDGDLNIFLNKNFNI

SEQ ID NO: 73649 - DNA, 1056 bp, Haemophilus ducreyi 35000HP
  CDS (1)..(1056): transl_table=11
ctgagcgtacacagctcattcgggggtatctttgactttgataccaaagttgagcgcttagaagaagtcaatgccgaattagaacagcctgaaatttggaacacaccagaaaaagcgcaaactttaggcaaagaacgttctactttagaaatggtcgtaaatacgattaatgcgctgattcaaggtatagaagatgtagaagctttaattgaattagccgttgaagccgaagatgaacaaaccttatatgaagcccaaatagaagcggacgaattagccacaaaattagccaaattagaatttcaacgaatgtttagcggcccctatgatgcaactgattgctatctagatttacaagcaggctctggtggtacagaagcacaagattggacagaaatgttattacgtatgtatttacgctgggcagaaagtaaaggttttaaaacagaattaattgaagtttctgatggcgatgtagccggtttgaaatcagccactatccgtataaccggtgaatatgcatttggttggttacgtaccgaaacaggaattcatcgcttagtgcgtaaaagtccatttgattcaaataatcgtcgccatacttcttttgcggcagcttttgtctatccagaagtggatgatgatgtagatattgaaattaatccggcagatttacgcatcgatgtttatcgtgcttccggtgcgggggggcaacacgtgaataaaacagaatccgccgtgcgaattactcatatgccatcaggtattgtggtgcaatgccaaaatgggcgttctcaacatcaaaataaagatcaatgtatgaaacagctgagagctaaattatacgaaatggaaatgatgaaaaagaacgctgaaaaacaagcaatggaagaaaataaatctgatattggttggggtagccaaattcgatcatatgtattagatgactctcgtattaaagatttacgtaccggtgttgaaaaccgtaatacacaagccgtactagatggtgatttagataggtttattgaagccagtctaaaagctggtttataa

SEQ ID NO: 73650 - protein, 351 aa, Haemophilus ducreyi 35000HP
MSVHSSFGGIFDFDTKVERLEEVNAELEQPEIWNTPEKAQTLGKERSTLEMVVNTINALIQGIEDVEALIELAVEAEDEQTLYEAQIEADELATKLAKLEFQRMFSGPYDATDCYLDLQAGSGGTEAQDWTEMLLRMYLRWAESKGFKTELIEVSDGDVAGLKSATIRITGEYAFGWLRTETGIHRLVRKSPFDSNNRRHTSFAAAFVYPEVDDDVDIEINPADLRIDVYRASGAGGQHVNKTESAVRITHMPSGIVVQCQNGRSQHQNKDQCMKQLRAKLYEMEMMKKNAEKQAMEENKSDIGWGSQIRSYVLDDSRIKDLRTGVENRNTQAVLDGDLDRFIEASLKAGL

SEQ ID NO: 73651 - DNA, 1071 bp, Prochlorococcus marinus subsp. marinus str. CCMP1375
  CDS (1)..(1071): transl_table=11
atgctcaggactgtctttgacgtaccggttttaaatgcgcttcaagttgatcttgaacaaatagctgctcaacctgacttttggaatgaccagcaaaaggcaagaaaacaaatgcgtcaacttgatgaagtgaaagatcaattaacgaaattagctaattggaatgctgcaattgaagatgcgaaagtttctttagagctatatgaattggaacctgacaatgaaatgatagaagaagctcaaattggactttgtcagttaaaaacagagcttgatctgtgggaactcgaaagattgttaagtggaccttatgataaagaaggagcagttttagcaataaacgctggagctggcgggacagatgcgcaagattgggcccaaatgctactaagaatgtatatgcgatgggctgaatctcatggaatgaaagtcatactcagtgaactttcagaaggagaagaggcaggtatcaaaagtgcgacaattgaaattgaaggacgatatgcttatgggtatttgcaaaatgagaaaggtacacatcgtttagttagaatttctcctttcaatgccaatggtaaacgccagacaagttttgcaggcattgaggttatgcctcagcttgaagaggatgttcatcttgagataccagagaaagatttagaagtaactacaagtcggtctggaggagctggtggtcaaaatgttaacaaggtagaaactgcagttcgtattcttcatattccaacaggacttgctgtgcgttgtactcaagagcgctctcaacttcagaataaagagaaagcaatggcattacttaaagctaaattgatgattattgcccaagagcagcgagcagcagaaattgctgatattcgtggtgacatagtcgaagctgcctggggaaaccaaatccgcaattatgtatttcatccttatcagatggtcaaagaccttagatcaggtacagaatctaatgatgtcgaaagtgtaatgaatggagatttggatttatttattcaatctcttttgttgcaaggtctagaaaatcaagataatgaaagagatagttga

SEQ ID NO: 73652 - protein, 356 aa, Prochlorococcus marinus subsp. marinus str. CCMP1375
MLRTVFDVPVLNALQVDLEQIAAQPDFWNDQQKARKQMRQLDEVKDQLTKLANWNAAIEDAKVSLELYELEPDNEMIEEAQIGLCQLKTELDLWELERLLSGPYDKEGAVLAINAGAGGTDAQDWAQMLLRMYMRWAESHGMKVILSELSEGEEAGIKSATIEIEGRYAYGYLQNEKGTHRLVRISPFNANGKRQTSFAGIEVMPQLEEDVHLEIPEKDLEVTTSRSGGAGGQNVNKVETAVRILHIPTGLAVRCTQERSQLQNKEKAMALLKAKLMIIAQEQRAAEIADIRGDIVEAAWGNQIRNYVFHPYQMVKDLRSGTESNDVESVMNGDLDLFIQSLLLQGLENQDNERDS

SEQ ID NO: 73653 - DNA, 762 bp, Chlamydophila pneumoniae TW-183
  CDS (1)..(762): transl_table=11
ttgctttccggagaggcagacaagaactcttgtttccttacgatcaatgctggggcaggtgggacggagtcgtgtgattgggtagagatgctgtttcgtatgtattcccgatgggcgacgaaacatcaatgggccttagaggttgtcgatcgcttagatggtgaagttgttggaattaagcatgttactgtaaagttttcaggaatgtatgcttatgggtatgccaaggcagagcgaggagtacatcgtttggtgcgtatctcacctttcgatagtaatgggaaacgtcacactagctttgcttctgtagacgtcttccctgagattgatgatcagattaagattgagatacgacctaatgatttacgtatagatacgtttcgttcttcgggagcaggaggacaacacgtcaacgttacggaatccgcagtcaggatcacgcacctaccttctggagtcgttgtttcatgtcaaaatgaacgtagtcagatacagaatcgtgagagctgtatgaaaatgctacaagcaaagttgtatcagcaggttttacaagaacgtttagagaagcaatctcttgatcgcaaagataaaaaggaaattgcttggggatctcaaattcgcaactacgtatttcagccctatactcttgttaaagatgtacgtacgggacatgaaacaggaaatgtccaagcgatgctcgacggcgagctattggatgaatttattaaagcatatttggcagagtttggagaagtttcatga

SEQ ID NO: 73654 - protein, 253 aa, Chlamydophila pneumoniae TW-183
MLSGEADKNSCFLTINAGAGGTESCDWVEMLFRMYSRWATKHQWALEVVDRLDGEVVGIKHVTVKFSGMYAYGYAKAERGVHRLVRISPFDSNGKRHTSFASVDVFPEIDDQIKIEIRPNDLRIDTFRSSGAGGQHVNVTESAVRITHLPSGVVVSCQNERSQIQNRESCMKMLQAKLYQQVLQERLEKQSLDRKDKKEIAWGSQIRNYVFQPYTLVKDVRTGHETGNVQAMLDGELLDEFIKAYLAEFGEVS

SEQ ID NO: 73655 - DNA, 1104 bp, Bordetella parapertussis 12822
  CDS (1)..(1104): transl_table=11
atggaagccgaacgtcagaaccagctcgtcgcccgactcgaagactacgcggagcgcgaacaggctctacggaggtatcttgactacgatgccaaatcggaacgcctgcaagtcgtaaacgccgagctcgaagacccggccatctggaacgaccccaagcacgcccaggacctgggccgtgaaaagaaatccctcgaagacgtcgtcgagaccctgaccgaattgggcagcggcctggccgactcgtgcgagctcgtcgaactggcgctggccgatagcgacgacgccacgctggaagccatcgagcacgatgtcgaccgcttccaggaaaagctggaaacgctcgaattccgccgcatgttcgccaacccggccgatccgctgaactgcttcgtcgacatccaggcgggcgccggcggcaccgaagcgcaggactgggcctcgatgctgctgcgccagtacctcaagtacgccgagcgcaagggcttcaaagccgaaatcctcgaagaatccgagggcgacgtcgccggcctgaagtcggccaccatcaagatcgaaggcgagtacgcattcggctacctgcgcaccgaaaccggcgtgcaccgcctggtgcgcaagagcccgttcgactcctcgggcggccgccacacctcgtttgccagcgtattcgtctaccccgaggtcgacgagtccttcgaggtcgaggtcaacccggccgacctgcgcatcgacacctaccgcgccagcggcgcgggcggccagcacatcaacaagaccgactccgccgtgcgcatcacgcacgcgccatcgggtatcgtggtgcagtgccagaacgaccgctcgcagcatcgcaaccgggccgaggcgatgcagatgctcaaatccaagctgtacgagctggaaatgcgcaaccgcatgaccgagcagcagaagctggaagattccaagaccgacgtgggctggggccaccagatccgctcgtacgtgctggaccagagccgcatcaaggacctgcgcaccaacgtggaaatttccaatacccagaaagtgctcgacggcgacctggacccgttcatccaggccagcctcaagcaaggcgtgtaa

SEQ ID NO: 73656 - protein, 367 aa, Bordetella parapertussis 12822
MEAERQNQLVARLEDYAEREQALRRYLDYDAKSERLQVVNAELEDPAIWNDPKHAQDLGREKKSLEDVVETLTELGSGLADSCELVELALADSDDATLEAIEHDVDRFQEKLETLEFRRMFANPADPLNCFVDIQAGAGGTEAQDWASMLLRQYLKYAERKGFKAEILEESEGDVAGLKSATIKIEGEYAFGYLRTETGVHRLVRKSPFDSSGGRHTSFASVFVYPEVDESFEVEVNPADLRIDTYRASGAGGQHINKTDSAVRITHAPSGIVVQCQNDRSQHRNRAEAMQMLKSKLYELEMRNRMTEQQKLEDSKTDVGWGHQIRSYVLDQSRIKDLRTNVEISNTQKVLDGDLDPFIQASLKQGV

SEQ ID NO: 73657 - DNA, 1122 bp, Prochlorococcus marinus subsp. pastoris str. CCMP1986
  CDS (1)..(1122): transl_table=11
ttgatagatataacagaatttaaaaaagatctttcagagttaaccaagcgcctgggtaatgctcaggattgtcttgacgttcccaatttagtagctaagaaaaaagagttagagcaaattgctgctcaaccagaattctggggtaatcaggcagatgcaaaaaaacatatgctcaaccttgatgatgttagagatcaacttcaattgttagataaatggaaaatgttcatttctgatgctgaagcttctcttgagctttattccttagagcctgaagaagaaatgattgttgagtcacatcaagggttagtcactttaagagagaatttagataagtgggaattccaaagattattatgtggtgaatatgataaagaagctgctatcgtctctattaatgctggtgcaggtggcactgatgcacaagattgggtggaaattctattaagaatgtattcaagatgggtagataataatggaatgagcttagaaattactgatttatctgatggagaagaagcaggtattaaaagcgttacttttgaagttaatggtaaatatgcttatggttatcttcaaaatgaaaaaggtactcatagattagtaagaatctcaccgtttaatgcaaatggtaaaagacaaactagtttcgctggagttgaggtcatgcctaaattagatcaaagtatttcattagatattcctgataaagatttagaaattacaactagtagatcaggtggagctggtggacaaaacgttaataaagtagaaacagcagtaaggattgtacatttgccttcaggaatcgctgtaagatgtactcaagagagatctcagttacaaaataaggagaaagcaatgttattgcttaaagctaaattattagtaatagctaaagaacaaagagcttctgaaatatcggatattaaaggtgatattgttgaagctgcatggggtaatcaaatacgaaattatgtttttcatccctatcaaatggtcaaagatttaagaacaatgaaagagactaatgatttagatgcagttcttaatggtggattagatcaatttattcatgaattattacgtatgaatatttcttctaaagagtctattaaataa

SEQ ID NO: 73658 - protein, 373 aa, Prochlorococcus marinus subsp. pastoris str. CCMP1986
MIDITEFKKDLSELTKRLGNAQDCLDVPNLVAKKKELEQIAAQPEFWGNQADAKKHMLNLDDVRDQLQLLDKWKMFISDAEASLELYSLEPEEEMIVESHQGLVTLRENLDKWEFQRLLCGEYDKEAAIVSINAGAGGTDAQDWVEILLRMYSRWVDNNGMSLEITDLSDGEEAGIKSVTFEVNGKYAYGYLQNEKGTHRLVRISPFNANGKRQTSFAGVEVMPKLDQSISLDIPDKDLEITTSRSGGAGGQNVNKVETAVRIVHLPSGIAVRCTQERSQLQNKEKAMLLLKAKLLVIAKEQRASEISDIKGDIVEAAWGNQIRNYVFHPYQMVKDLRTMKETNDLDAVLNGGLDQFIHELLRMNISSKESIK

SEQ ID NO: 73659 - DNA, 1128 bp, Prochlorococcus marinus str. MIT 9313
  CDS (1)..(1128): transl_table=11
ttgctggacctcaccgacttcaaacgcgatctttctgagctcaccgaccgcctgggccaagcccaggactgtcttgacgttcctgctctaaacgctcgccaacaagatctcgagcaactcgctgctcaaccagatttctggaacgaccagcaaaacgcccagaagcagatgcgtcagctggacgaagttaaagcccagctaacgcaaatcacgctctggcgtagtgccgtcaatgatgcccaggcaaccttagagctctacgacctagagccagacgacgagatgctcagcgaagcccaatcggggctgaaacagctgcgccaagggcttgatcgctgggagctcgaacgactacttagcggcgagtacgacaaggaaggcgccgtgctctcaattaacgctggagctggtggcacagatgctcaagactgggctcagatgctgctcaggatgtacacccgctgggcagaggatcacgacatgaccgtgaccgtggacgagctttccgaaggggaagaggcaggaattaaaagcgccacggtagagattgaaggccgctatgcctacggctatctgcgtaatgaaaagggcacccaccgcttggtgagaatctctcctttcaacgccaatggcaagcgccaaacaagctttgcaggcgtggagatcatgccaaaaatcgatcaggaagtagagctcgatatccccgagaaagatctagaagtcaccaccagccgctccggtggcgccgggggccaaaacgtcaacaaggtggagacagccgtacgcattcttcatatcccaacaggattagcggtgcgctgtacgcaagagcgctcacaactacaaaacaaagaaaaggcattggctctactgaaagccaagctgatggtgatcgcccaggagcagcgtgctgccgagatcgctgacatccgcggcgatatcgttgaagctgcctggggcaatcagatccgcaactatgtcttccatccctaccaaatggtgaaagacctgcgcacagcagaagaaaccacagacgtgcaagcggtgatgaatggtgatttagaccgattcattcagaccctgctgcgtcagggtgtcgatcgtccaggcagtgatatggatcaataa

SEQ ID NO: 73660 - protein, 375 aa, Prochlorococcus marinus str. MIT 9313
MLDLTDFKRDLSELTDRLGQAQDCLDVPALNARQQDLEQLAAQPDFWNDQQNAQKQMRQLDEVKAQLTQITLWRSAVNDAQATLELYDLEPDDEMLSEAQSGLKQLRQGLDRWELERLLSGEYDKEGAVLSINAGAGGTDAQDWAQMLLRMYTRWAEDHDMTVTVDELSEGEEAGIKSATVEIEGRYAYGYLRNEKGTHRLVRISPFNANGKRQTSFAGVEIMPKIDQEVELDIPEKDLEVTTSRSGGAGGQNVNKVETAVRILHIPTGLAVRCTQERSQLQNKEKALALLKAKLMVIAQEQRAAEIADIRGDIVEAAWGNQIRNYVFHPYQMVKDLRTAEETTDVQAVMNGDLDRFIQTLLRQGVDRPGSDMDQ

SEQ ID NO: 73661 - DNA, 1125 bp, Synechococcus sp. WH 8102
  CDS (1)..(1125): transl_table=11
ctggatctcaccgacttcaagcgcgatctctccgagctcactgaccgcctgggccatgcccaggactgtcttgacgtccccgcactgaaggccagacaacaagatctagaacaactcgccgcccagcctgatttctgggatgaccagcaggcggcccagaagcagatgcgccgcctggatgaggtgaaggcgcagctgcagcagctggcggactggggcggtgctgtggacgatgccaaggcaacgctggagctctacgagctggaaccggacgaggagatgctcaccgaggcccaggagggcctcaatcaactgcgccagggcttggaccgctgggagctggaacgcctgctcagtggtgattacgacaaggaaggcgctgtgctcaccatcaatgctggcgccggtggcaccgatgctcaggactgggcacagatgctgctgcgcatgtacacacgctgggcggaagaccacggcatgaaggtgaccgtggacgaactctccgagggtgaggaagcaggcatcaagagctgcacgatcgaggtggaaggccgttacgcctacggctatctacggaatgagaagggcacccaccgactggtgcggatctcaccgttcaacgccaacgacaagcgtcagaccagctttgccggcatcgaggtgatgcccaagatcgatgaggaggtcgacatcgacattcccgaaaaggatctggaggtcaccaccagtcgttccggtggtgcgggcggacagaacgtcaacaaggtggaaacagcggtgcgcatcctccacatcccgacgggcctggcggtgcgttgcacccaggagcgatcgcagcttcagaacaaggaaaaggccatggcgctgctcaaggccaagctgctggtgatcgcccaggagcaacgggccgccgaaatcgccgacatccgtggcgacatcgttgaagcggcctggggcaaccagatccgcaactacgtgttccatccgtatcaaatggtcaaggacctgcgcaccagcgaggagaccaatgatgtgcaggcggtgatggacggggccctcgaccccttcatcgacgcctcgttgcgccagggtgtagacagccccggcgccgacgccgattcctga

SEQ ID NO: 73662 - protein, 374 aa, Synechococcus sp. WH 8102
MDLTDFKRDLSELTDRLGHAQDCLDVPALKARQQDLEQLAAQPDFWDDQQAAQKQMRRLDEVKAQLQQLADWGGAVDDAKATLELYELEPDEEMLTEAQEGLNQLRQGLDRWELERLLSGDYDKEGAVLTINAGAGGTDAQDWAQMLLRMYTRWAEDHGMKVTVDELSEGEEAGIKSCTIEVEGRYAYGYLRNEKGTHRLVRISPFNANDKRQTSFAGIEVMPKIDEEVDIDIPEKDLEVTTSRSGGAGGQNVNKVETAVRILHIPTGLAVRCTQERSQLQNKEKAMALLKAKLLVIAQEQRAAEIADIRGDIVEAAWGNQIRNYVFHPYQMVKDLRTSEETNDVQAVMDGALDPFIDASLRQGVDSPGADADS

SEQ ID NO: 73663 - DNA, 900 bp, Chromobacterium violaceum ATCC 12472
  CDS (1)..(900): transl_table=11
gtgctggtgctggacggcatcaacgccaccatcggcgacagccgcgaactgttcgacatgggcaagagcgaggaagacgacgacaccatcctcgcggtgcaggccgatctggaagaagtggaagccaaagtggcgcagctggaattccgccgcatgttccacgatccgatggaccccaccaactgcttcatcgacatccaggccggcgccggcggcaccgaagcccaggactgggccggcatgctgctgcgcatgtatacccgctacgccgagcgcaagggcttcaaggtggacgtgctggaactgtccgagggcgaagtggccggcgtcaccagcgccacgctgaagatcgagggcgagtacgcctacggcctgctgcgcaccgaagtgggcgtgcaccgcctggtgcgcgtgtcgccgttcgactccaacgcccgccgccacacctcgttctcgtcggtgttcgtgtatccggaagtggacgacagcttcgagatcgacatcaacccggcggacgtgcgcaccgacacctatcgcgcctccggcgccggcggccagcacatcaacaagaccgactccgccgtgcgtctgacccacatccccaccggcatcgtcgtgcagtgccagaacgaccgttcccagcaccgcaaccgcgacgaggcctggcagatgctgcgcgccaagctgtacgagctggagctgaagaagcgcaacgaagccaagcaggcgctggaagacaccaagaccgacgtgggctggggccaccagatccgctcctacgtgttcgaccaatcccgcatcaaggatttgcgcaccagctacgaagtgggcaacatcaagggcgtcatggacggcgacctggacggcttcatcgaagccagcctcaagcacggcgtctaa

SEQ ID NO: 73664 - protein, 299 aa, Chromobacterium violaceum ATCC 12472
MLVLDGINATIGDSRELFDMGKSEEDDDTILAVQADLEEVEAKVAQLEFRRMFHDPMDPTNCFIDIQAGAGGTEAQDWAGMLLRMYTRYAERKGFKVDVLELSEGEVAGVTSATLKIEGEYAYGLLRTEVGVHRLVRVSPFDSNARRHTSFSSVFVYPEVDDSFEIDINPADVRTDTYRASGAGGQHINKTDSAVRLTHIPTGIVVQCQNDRSQHRNRDEAWQMLRAKLYELELKKRNEAKQALEDTKTDVGWGHQIRSYVFDQSRIKDLRTSYEVGNIKGVMDGDLDGFIEASLKHGV

SEQ ID NO: 73665 - DNA, 1107 bp, Wolinella succinogenes DSM 1740
  CDS (1)..(1107): transl_table=11
ttggatagttatgaatatggggaacttctcaaagagctctcaaccaagcgcgacaacatcgctaaaatcatcaagcccgattccatagagaatcgacttggagagattgaagcgctggaacactctgagggcttttggaatgacgccaccaaagctggagaggttcaaaaagagaagcgcaaactagagcgcattttgaaaaaatatgaagaggctaatcaagcgatcaatgacgccaaagagctctttgagattgccacgcaagacaacgacgaagagacccttggactcctttttgaagaatcgggacacctagagaaagagatcaaaagtgtcgagattgaggtgatgttaagcggcgaacatgatggctcaaacgccattatcaccattcaccctggagcaggcggaaccgaatcgcaagattgggcgagcattctctatcgaatgtatctgcgctgggcagaacgaagaggcttcaaggtggaggtgctcgactaccaagagggtgaagaggcgggaatcaaagacgcctccttcatcatcaaaggggagaatgcctatggctatctcaaagtggaaaacggaatccatcgtcttgtgaggatctctccctttgatgccaacgctaagcgtcacacctccttcacctccgtcatggtgagccctgaagtggatgatgatatcgatatagagatcgaagagaaagatcttcgtcttgacacctatcgtgccagcggggcgggggggcagcatgtcaacaagactgagagcgcgatacgaatcactcacatccccacaggtatcgtggtgcagtgccaaaatgaccgaagccaacacaaaaacaaggccaccgccttcaagatgctcaaaagcaggctctatgagctagagctcgccaaaagaagtgctgaatacgattcgatggagaagagcgagattggctgggggcaccagatacgaagctatgttctcgccccctatcagcaggtcaaagacactcgtagcaacattgcctacagcaatattgaagcaattcttgatggcgatttggatgagctacttgaaggggtgctcatcagccaatttgatcaaccaggggagtga

SEQ ID NO: 73666 - protein, 368 aa, Wolinella succinogenes DSM 1740
MDSYEYGELLKELSTKRDNIAKIIKPDSIENRLGEIEALEHSEGFWNDATKAGEVQKEKRKLERILKKYEEANQAINDAKELFEIATQDNDEETLGLLFEESGHLEKEIKSVEIEVMLSGEHDGSNAIITIHPGAGGTESQDWASILYRMYLRWAERRGFKVEVLDYQEGEEAGIKDASFIIKGENAYGYLKVENGIHRLVRISPFDANAKRHTSFTSVMVSPEVDDDIDIEIEEKDLRLDTYRASGAGGQHVNKTESAIRITHIPTGIVVQCQNDRSQHKNKATAFKMLKSRLYELELAKRSAEYDSMEKSEIGWGHQIRSYVLAPYQQVKDTRSNIAYSNIEAILDGDLDELLEGVLISQFDQPGE

SEQ ID NO: 73667 - DNA, 1065 bp, Gloeobacter violaceus PCC 7421
  CDS (1)..(1065): transl_table=11
gtgcgcgcctgggtaaaacccaggactatctttgacgtcgcccaacgccaaatccgcattgccgccctggagcagcaggccagcgcccctgatttttgggacgatcaagccgcggcccaaaaggccctccagaacctcaacaacttgaagcaacccctggagcagttcggccgctggcgcaacctgctctccgacgccgaggtggtactcgaactggtccaggagaccggtgacgagtcgctgctgccggaggcggaaggcaatatcgaagcgctcgtgggcgaactcgatcgctgggaactggagcagttgctgagcggcccctacgacgagcggggggcgattctcagcatcaacgccggggcggggggcaccgacgcccaggattgggctgagatgcttttgcgcatgtacacccgctgggccgagcgccagggctaccaggcgcacctgttggagctgtcggaaggtgaagaagcgggggtcaaatcggcgacccttgagatcgacggtcgctacgcctacggctatttgtcggccgaaaaaggcacccaccgcctggtgcgcatctcgcccttcaacgccaacgacaagcgccagaccagcttcgcaggggttgaggtgatgccggtcctcgacgactcggtgcaggtggatatccgccccgacgacatcgaaatcgatacgttccgctccggcgggaagggcggccagaacgtcaacaaggtggaaacgggggtacgcgtcacccacaaacccaccggcatctcggtgcgctgcacccaggagcgcgcccagctgcaaaaccgcaataaggcgatggagatgcttaaagcccgcctgctggtgctcgaagaagaaaagcgccagcaacatttgagcgacattcgcggcgaagcggtggatgcggcctggggtaaccagatccgctcctatgtctttcatccgtaccagatggtcaaagatctgcgcactgaggaggaaacctccgatgttaccggtgtgatgaacggcaagatcgagccgtttatcgagcgctatttgcgccggcagcacaagctctga

SEQ ID NO: 73668 - protein, 354 aa, Gloeobacter violaceus PCC 7421
MRAWVKPRTIFDVAQRQIRIAALEQQASAPDFWDDQAAAQKALQNLNNLKQPLEQFGRWRNLLSDAEVVLELVQETGDESLLPEAEGNIEALVGELDRWELEQLLSGPYDERGAILSINAGAGGTDAQDWAEMLLRMYTRWAERQGYQAHLLELSEGEEAGVKSATLEIDGRYAYGYLSAEKGTHRLVRISPFNANDKRQTSFAGVEVMPVLDDSVQVDIRPDDIEIDTFRSGGKGGQNVNKVETGVRVTHKPTGISVRCTQERAQLQNRNKAMEMLKARLLVLEEEKRQQHLSDIRGEAVDAAWGNQIRSYVFHPYQMVKDLRTEEETSDVTGVMNGKIEPFIERYLRRQHKL

SEQ ID NO: 73669 - DNA, 933 bp, Photorhabdus luminescens subsp. laumondii TTO1
  CDS (1)..(933): transl_table=11
ttgggtaaagaacgctcctcattagaagagattgtcgaaacaattgatcagcttgagcagggactggaagatgtacaaggtttactggaactggcagtagaagctgacgatgaagagacttttaatgaagctgtggtagagctggagcagcttgaagaaaaattgggtcagttagaatttcgccgtatgttttctggtgagtacgacagtgctgactgttatcttgatttgcaggcaggctctggtggcaccgaggctcaagattgggcaagtatgctgatgcgtatgtatctgcgttgggctgaatccaaaggctttaaaacggaaatcattgaagaatcagatggtgaagttgctggcttgaaatcagcgaccattaagatcatgggcgattatgcttatggttggttgcgtactgaaaccggtgttcaccgcttggtacgtaaaagcccatttgattctggtggtcgtcgccatacttcattcagttctgctttcatctatcccgaagtggatgatgatattgatattgaaattaatccggcagacttacgtattgatgtttatcgcgcgtctggtgcgggtggtcagcacgttaacaaaacagaatctgcggtgcgtattacccatattccaaccaacattgtgactcagtgtcagaatgatcgttctcagcataaaaacaaagaccaggcgatgaaacagctaaaagcgaagctgtatgaactggaaatgcagaaaaagaacgccaataaacaggaaatggaagagaataaatccgatattggttggggtagtcaaattcgctcttatgttctggatgactcacgcatcaaagacttgcgcaccggcgttgaaactcgcaatacacaatcggtgctggatggtgatctcgataaattcattgaagcaagcctgaaagctggcttatga

SEQ ID NO: 73670 - protein, 310 aa, Photorhabdus luminescens subsp. laumondii TTO1
MGKERSSLEEIVETIDQLEQGLEDVQGLLELAVEADDEETFNEAVVELEQLEEKLGQLEFRRMFSGEYDSADCYLDLQAGSGGTEAQDWASMLMRMYLRWAESKGFKTEIIEESDGEVAGLKSATIKIMGDYAYGWLRTETGVHRLVRKSPFDSGGRRHTSFSSAFIYPEVDDDIDIEINPADLRIDVYRASGAGGQHVNKTESAVRITHIPTNIVTQCQNDRSQHKNKDQAMKQLKAKLYELEMQKKNANKQEMEENKSDIGWGSQIRSYVLDDSRIKDLRTGVETRNTQSVLDGDLDKFIEASLKAGL

SEQ ID NO: 73671 - DNA, 870 bp, Vibrio vulnificus YJ016
  CDS (1)..(870): transl_table=11
gtggatgacgttgaaggtttgcttgagctggccattgaagctgaagatcaagagacctttgatgaaatcggtccagaacttgaagccttagaagagaagctcgcgggcttagagttccgtcgcatgttctctggcgcacacgattcttcagattgctatattgatctgcaagcaggttctggcggtacagaagcgcaagactggacgagcatgatgcttcgcatgtatcttcgttgggctgaagcgaaaggcttcaaaaccgaagtgatcgaagtctccgaaggagatgttgctggccttaagtcggtcaccgtacgtattatcggtgattatgcttatggttggttgcgtaccgaaacgggtgttcaccgtttagtgcgtaaatctccgtttgactcaggcggtcgtcgtcacacttcttttgcttctgcgtttgtttacccagagattgatgaaaacatcgacatcgacattaaccctgccgatctccgtattgacgtgtatcgtgcgtctggtgcgggtggtcagcacgtaaacaccaccgaatctgcggtacgtattacccacgtaccaacgaataccgtggttcagtgtcagaacgaccgttctcaacacaaaaacaaagatcaagcgatgaagcagcttcgcgctaagctgtttgaacttgagttgcaaaagcaaaatgcggaaaaacaagctaatgaagacgctaagtctgacattggctggggtagccagatccgttcttacgtattggatgattcacgcattaaagacctccgtacgggcgtcgaaaaccgtaatactcaagcggttcttgacggtgatctggacaaatttattgaagctagcctgaaatcaggcctttaa

SEQ ID NO: 73672 - protein, 289 aa, Vibrio vulnificus YJ016
MDDVEGLLELAIEAEDQETFDEIGPELEALEEKLAGLEFRRMFSGAHDSSDCYIDLQAGSGGTEAQDWTSMMLRMYLRWAEAKGFKTEVIEVSEGDVAGLKSVTVRIIGDYAYGWLRTETGVHRLVRKSPFDSGGRRHTSFASAFVYPEIDENIDIDINPADLRIDVYRASGAGGQHVNTTESAVRITHVPTNTVVQCQNDRSQHKNKDQAMKQLRAKLFELELQKQNAEKQANEDAKSDIGWGSQIRSYVLDDSRIKDLRTGVENRNTQAVLDGDLDKFIEASLKSGL

SEQ ID NO: 73673 - DNA, 1110 bp, Corynebacterium diphtheriae NCTC 13129
  CDS (1)..(1110): transl_table=11
atgcgaccggaaactcaatctgctgtaactcaactcgactcgactttgacgaccatcgaaaaagtgatgaatcccgaggatttggagtcgcgtgttcgcgagttggaacagcaagcctccgatcctacgctgtgggacgatcctgacaccgcgcaaaaggtgactaccgagttgtcttcggtgcaagccaagctgaaaaagctcagcacattgcgccagcgtatcgacgacctccccgtgatgtatgagctcgccgatgaggaaggcgaggatgctttagcgcttgccgacgaagaactcgccgagctgaccgcagacgttgaagccttagaagtaaagactatgttgtctggcgagtacgattcccgtgaggcagtgatcaatatccgttctggcgccggtggcgtggatgccgctgactgggcggaaatgctcatgcgtatgtacatccgctgggctgagaaaaacgaccacaaagtagatatttacgacatttcttatgccgaagaagcaggcattaagtccgcaacgttcgtagttcatggtgagtacatgtacggacaattatcggtcgaacagggtgctcaccgcttggttcgtattagtccttttgataaccaggggcgtcgccagacctctttcgctgagatcgaggttctccccgttgttgaacaaacagaccacatcgatatccctgactccgaagtgcgtgtcgacgtctaccgttcctcggggccaggtgggcagtccgtgaacaccaccgactcggccgtgcgtctaacgcacatcccaacgggcatcgtcgtgacgtgtcagaatgagaagtcccagatccagaacaaggcatcagccatgcgcgttcttcaagcaaaacttttggagcgtaagcgccaagaagagcgtgccgaacttgatgcgctcggcgcaggcggtaacgcctcatggggcaaccaaatgcgctcctatgtgctgcacccatatcaaatggtaaaagatctgcgtacaaactatgaggtcaatgacccccagaaggttctcgacggcgacatcgatggcctcctagaagcaggtattcgctggcgcatggcggaacaacaggggcaaaactaa

SEQ ID NO: 73674 - protein, 369 aa, Corynebacterium diphtheriae NCTC 13129
MRPETQSAVTQLDSTLTTIEKVMNPEDLESRVRELEQQASDPTLWDDPDTAQKVTTELSSVQAKLKKLSTLRQRIDDLPVMYELADEEGEDALALADEELAELTADVEALEVKTMLSGEYDSREAVINIRSGAGGVDAADWAEMLMRMYIRWAEKNDHKVDIYDISYAEEAGIKSATFVVHGEYMYGQLSVEQGAHRLVRISPFDNQGRRQTSFAEIEVLPVVEQTDHIDIPDSEVRVDVYRSSGPGGQSVNTTDSAVRLTHIPTGIVVTCQNEKSQIQNKASAMRVLQAKLLERKRQEERAELDALGAGGNASWGNQMRSYVLHPYQMVKDLRTNYEVNDPQKVLDGDIDGLLEAGIRWRMAEQQGQN

SEQ ID NO: 73675 - DNA, 969 bp, Rhodopseudomonas palustris CGA009
  CDS (1)..(969): transl_table=11
atgcaggagcgcacctcgcttgaggattcgctcaccggcatcggcaaggtcgagcgtgagctgaccgacaatatcgagatgatcgaactcggcgaggccgagggcgacgaaggtatcgtcaaggaagccgaggatgcgctcaaggcgctgaagaaggaagtggcgcgccgcgagctggaagcgctgctgtccggcgaagccgatcgcttcgacacctatctcgaagtccacgccggcgccggcggcaccgaaagccaggactgggcctcgatgctgctgcggatgtacgtgcgctgggcggagaagcacggcttcaagatcgagtatctcgaagagtccgagggcgaagaggcggggatcaaatcggcgacgattcagatctccggccacaacgcctatggctggctgaagaccgaagccggcgtgcatcgcctggtgcggatctcgccgttcgactccaacgcccgtcggcacacctctttctcgtcggtgcagattttcccggtgatcgacaattcgatcaagatcgacatcgccgagtccgacgttcgcgtcgatacgatgcgctccggcggcgccggcggtcagcacgtcaacaagaccgaatccgcggtgcgcctgacccacatcccgaccggagtcgcggtggtctgtcaggccggccggtcgcagcacaagaaccgcgcccaggcgtgggacatgctgcgcgcacggctgtacgagatcgaactgaagaagcgcgaggagcaggccgccgccgatcaggccgccaagaccgagatcggctggggccaccagatccgctcttacgtgctgcagccgtatcagatggtcaaagacctgcgtaccggcgtacagacctccgacaccgccggcgtgctcgacggcgatctcgacgagttcatggccgccaccctggcccagcgcgccttcggcggcggaccgggcgcgatcgaggacgtcgactaa

SEQ ID NO: 73676 - protein, 322 aa, Rhodopseudomonas palustris CGA009
MQERTSLEDSLTGIGKVERELTDNIEMIELGEAEGDEGIVKEAEDALKALKKEVARRELEALLSGEADRFDTYLEVHAGAGGTESQDWASMLLRMYVRWAEKHGFKIEYLEESEGEEAGIKSATIQISGHNAYGWLKTEAGVHRLVRISPFDSNARRHTSFSSVQIFPVIDNSIKIDIAESDVRVDTMRSGGAGGQHVNKTESAVRLTHIPTGVAVVCQAGRSQHKNRAQAWDMLRARLYEIELKKREEQAAADQAAKTEIGWGHQIRSYVLQPYQMVKDLRTGVQTSDTAGVLDGDLDEFMAATLAQRAFGGGPGAIEDVD

SEQ ID NO: 73677 - DNA, 1110 bp, Onion yellows phytoplasma OY-M
  CDS (1)..(1110): transl_table=11
gtggaaaaatacgaaattaatcaaattttacaaaacttgcatcaaaaccttcaagatttaaaacaagcccttgatataaaaaaaaccaatcaaacaattgaaaaattaaattacgccatgcaaaaagaagatttttggaaatacccccaaaaagctgttacaataagccaacaattcaacgacttgcaagacaaaaaaactactttagaaactttaaaacaaaattatttggatctagaaactttatttaatttaaatgaaagcccaaataaaacttctgctttattagaagaagaattaaaaaaccttactaaagccgtttttgatttcaaaattaaaatttttttgaatcaatcttatgatattaacaatgctattttattattccatccaggagcaggaggtactgaatcgcaagattggtgcgaaatgcttttccgtatgtatcaaaaatatgctcaaaaaaagaattttaaaaccgaaattcttgattatcaaccaggtgaaggagcaggaatcaaatcagctaccttattaattaaaggaacttatgcttatggttatctaaaagcggaaaaaggagttcatcgtttggtaagaatttctccttttgatgctaattccaaaagacatacttcttttgtagcttgcgatgttttgccagaaattaatgaagaaatcaaaattaatttaaaaacagaagatcttaaaattgatgtttttagaagtagtggtgcaggcggacaacacgtaaatactactgattcagcagtaagaataactcatttgccaacaggattagtagtgggttgtcaaaatgaacgtagtcagatcaaaaacaaagaaaaagctttgcaaatgctaaaaaccaagttatttcaattagcatcaaaaaaacaaaaagaagaaaatgctaaaaaatttcaaagcgaccaaaaagaaaatggttggggttctcaaattagaagctatgtttttcatccttacaaaatggttaaagatcaccgcactaatcaagaaatttttcaattagaacaagtaatggatggaaacatcgacgaatttatcaatggatatttaaccaaaatacctattagttctcctcattaa

SEQ ID NO: 73678 - protein, 369 aa, Onion yellows phytoplasma OY-M
MEKYEINQILQNLHQNLQDLKQALDIKKTNQTIEKLNYAMQKEDFWKYPQKAVTISQQFNDLQDKKTTLETLKQNYLDLETLFNLNESPNKTSALLEEELKNLTKAVFDFKIKIFLNQSYDINNAILLFHPGAGGTESQDWCEMLFRMYQKYAQKKNFKTEILDYQPGEGAGIKSATLLIKGTYAYGYLKAEKGVHRLVRISPFDANSKRHTSFVACDVLPEINEEIKINLKTEDLKIDVFRSSGAGGQHVNTTDSAVRITHLPTGLVVGCQNERSQIKNKEKALQMLKTKLFQLASKKQKEENAKKFQSDQKENGWGSQIRSYVFHPYKMVKDHRTNQEIFQLEQVMDGNIDEFINGYLTKIPISSPH

SEQ ID NO: 73679 - DNA, 1119 bp, Geobacter sulfurreducens PCA
  CDS (1)..(1119): transl_table=11
atgttcagagaagaagttgcacgggtcgaaaatttcggggagcggattgccaagctccgggggtctcttgacatagacagcaagcgggaagacatccaggaactggaagcgcagatcgccgctcccggcttctgggacaataacgaggaagcccagaaggtcctgcgggagagaacccgcatcgaaaaactcatagacctgtgggatcgcctcaaccgccaggcggacgacatccgcgtcctcatcgaattgggagaggaagcccaggacgaggccacactcgacgaagtccgcgccctcaacgacagccttgagcgcgaagtggaaggggccgaattccagcgcatgttgtcgggcccccacgacaagaacagctgtttcgtttccatcaatgccggcgccggcggaaccgaggcccaggactgggccgagatgctgctcaggatgtacctgcgctactgcgagcgcaagggctggaagaccgaaatcaccgacttccaggcgggagacgaggccggggtgaagtcggcgacctttacggttgacggtgagtacgcatacggctatcttaaggccgaggccgggattcaccgcctcgtgcggatttcccccttcgacagcaacgcccgccggcatacctcctttgcctcggtgttcgtcttccccgaaatcgaggacgacatcgagatcaagattgccgagtcggatctgcgggtcgatacctaccgttccagtggcgccggcggtcaacacgtaaacaccaccgactccgccgtccggcttactcaccttcccacgggcatcgtggtcgcctgccagtgcgagcgaagccagcacctgaacaaagccacggcgctgcggatgctccgggcgaaactctacgaaaaggagctccaggagcgcgaagtccaggcctccgaactggccggcgagaaaaaggatatcggctggggaagccagatccgctcctatgtgctccacccctataagatggtcaaggatctgcggaccggcgtcgaatcgggcaaccccgacgcggtcctggacggtgcactggaggatttcgttgtagcgttcctcatgggggtgcggcgcgatgtgaaagactccgacgagtaa

SEQ ID NO: 73680 - protein, 372 aa, Geobacter sulfurreducens PCA
MFREEVARVENFGERIAKLRGSLDIDSKREDIQELEAQIAAPGFWDNNEEAQKVLRERTRIEKLIDLWDRLNRQADDIRVLIELGEEAQDEATLDEVRALNDSLEREVEGAEFQRMLSGPHDKNSCFVSINAGAGGTEAQDWAEMLLRMYLRYCERKGWKTEITDFQAGDEAGVKSATFTVDGEYAYGYLKAEAGIHRLVRISPFDSNARRHTSFASVFVFPEIEDDIEIKIAESDLRVDTYRSSGAGGQHVNTTDSAVRLTHLPTGIVVACQCERSQHLNKATALRMLRAKLYEKELQEREVQASELAGEKKDIGWGSQIRSYVLHPYKMVKDLRTGVESGNPDAVLDGALEDFVVAFLMGVRRDVKDSDE

SEQ ID NO: 73681 - DNA, 999 bp, Lactobacillus johnsonii NCC 533
  CDS (1)..(999): transl_table=11
atggcagaacctggtttttgggataatcaagaacaagcacaaagcttaattaatgatactaatcgaatgaaggaaaaaagtgaaaactttaagcaacttgaagcaaaattcgatgatgctcaaactgctttagaattacttaaagcagatccagatcctgaattgagtgaagaattatctgaagaaatggtgtcattatcacaaagttttcatgattatgaattatcattattattgtcagataaatatgatcaacataatgctctaatggaaattcatccaggtgctggtggtactgaagctatggattgggctgatatgcttttgaggatgtatcaacgctatgcagttagccatgatttaaaatttgaaattgaagattatgaacctggtgaagaagctggtgttaaaagtgtaagcatccggattcaaggaaaaaatgcttttggattacttaaatctgaaaatggtgttcatagattagtaagaatatctccttttgattctgctaaaagacgacatacatcttttgcttctgtagaggtaataccagagattgatcaaagcattgaggttgatattaatccagatgatttaagaattgacgtttatcgctcaagtggtgctgggggtcagcatattaataagacttctagtgcagttcgaattactcacttacctactggaattattacctcatcgcaggctcagaggtcgcaattacaaaatagagaaactgcgatgaatatgttacgggcaaagctattccagctagaagaagagaagaaaagaaagcagacagaagaacttaaaggtaatcaaaaagaaattggctttggttctcaaattcgctcttatgtttttcatccttacaatatggtaaaagatcatcgaactaattttgaaactagtgatgtaaatggtgtaatggatggaaaactagataattttatttatgcctacttacagtggctcttaagcaaaaaaaatccgaactaa

SEQ ID NO: 73682 - protein, 332 aa, Lactobacillus johnsonii NCC 533
MAEPGFWDNQEQAQSLINDTNRMKEKSENFKQLEAKFDDAQTALELLKADPDPELSEELSEEMVSLSQSFHDYELSLLLSDKYDQHNALMEIHPGAGGTEAMDWADMLLRMYQRYAVSHDLKFEIEDYEPGEEAGVKSVSIRIQGKNAFGLLKSENGVHRLVRISPFDSAKRRHTSFASVEVIPEIDQSIEVDINPDDLRIDVYRSSGAGGQHINKTSSAVRITHLPTGIITSSQAQRSQLQNRETAMNMLRAKLFQLEEEKKRKQTEELKGNQKEIGFGSQIRSYVFHPYNMVKDHRTNFETSDVNGVMDGKLDNFIYAYLQWLLSKKNPN

SEQ ID NO: 73683 - DNA, 966 bp, Bdellovibrio bacteriovorus HD100
  CDS (1)..(966): transl_table=11
atgcaaaagctgaacaaagaaaaagccctgcttgaaaaagccgtgggggaattcgacgcctttgcaagtcgcttgagcgactccaaggttctgctggaaatggccgaagaagcccaggatgaaggcagtttctctgaagccaaagccgaggtcgtggcactggaaaagttgggggaagagcttgagttgaaacgagttctgaacggcgaattggacagcaacagctcgtatctgtccatcaactccggggcaggtggtacggagtcctgtgactgggcctccatgcttttgcgtatgtacacgcgttatgctgacaagcatggctttaaagttcaaatcatcgagatgaccgagggcgagggtgccgggattaaatcctgcacgcttttgatcgaaggcccttatgcctatggatatctgaaggcggaatccggagtgcatcgtctggtgcgtatttctccgtttgattccaatgcccgtcgccatacatcttttgcgtccgtgtttgcctgggcggaagtggatgatgacatcaatatcgaagttcgtcctgatgatctgaaagtggacaccttccgcgccagcggggccggtggccagcacgtcaacagaacggattctgcggttcgtatgactcacattccatccggggttattgtgacctgtcaggtggaaagatctcagattcagaaccgtgaaaaagccctgaagatgttgaaagcgcgcctttatgaaatggaaatcgaaaagcgcaacgcggaaaaagacgcgatgaattcccagaaaaaagccaatgaatggggttcgcagattcgctcttacgtgatgcatccttatcagatggtgaaagatcaccgcactgattttgaaaccaatcaggtcgatgacgtgatggacggggatctggatggatttatcatgtcttacttgaaatcgactttgacggcagaaagtcagccttcgtga

SEQ ID NO: 73684 - protein, 321 aa, Bdellovibrio bacteriovorus HD100
MQKLNKEKALLEKAVGEFDAFASRLSDSKVLLEMAEEAQDEGSFSEAKAEVVALEKLGEELELKRVLNGELDSNSSYLSINSGAGGTESCDWASMLLRMYTRYADKHGFKVQIIEMTEGEGAGIKSCTLLIEGPYAYGYLKAESGVHRLVRISPFDSNARRHTSFASVFAWAEVDDDINIEVRPDDLKVDTFRASGAGGQHVNRTDSAVRMTHIPSGVIVTCQVERSQIQNREKALKMLKARLYEMEIEKRNAEKDAMNSQKKANEWGSQIRSYVMHPYQMVKDHRTDFETNQVDDVMDGDLDGFIMSYLKSTLTAESQPS

SEQ ID NO: 73685 - DNA, 594 bp, Anopheles gambiae str. PEST
  CDS (1)..(594)
atgatacaaataacctcaggaagaggacctttagaatgccagtgggtagttgctaagattctgaaggtttttctagaggaagtaaaacaagaaaaaatagattataaaatcattaatcgtgaaaacggggatgaaaacctgacactaaaatccgtaaccctgcttttaaaggataaagaaataacaacatttctaaaaagttggttagggagtatttgttgggtcggaaagagtacatacagaaagctgcataaaaggagtaattggtttgttggagtatttgaaattgaagatgcagaagaaattcattttgatgaaaaagatattcagtttcagacaactcgcagccaggggagtggaggacagaatgtaaacaaagtaaatacggcagttcgtgctacctatataccaaccggagaaagtgtttttgtacaggattcccgatcacagctggagaataagaaactatcggttacacgtttaaaagaaaaggtaatggcacagcatattttgaaaatacaacgcagaatgcaggatacctggagcaatcatatgcaggtacagcgtggaaatccgattcgtacttattcctag

SEQ ID NO: 73686 - protein, 197 aa, Anopheles gambiae str. PEST
MIQITSGRGPLECQWVVAKILKVFLEEVKQEKIDYKIINRENGDENLTLKSVTLLLKDKEITTFLKSWLGSICWVGKSTYRKLHKRSNWFVGVFEIEDAEEIHFDEKDIQFQTTRSQGSGGQNVNKVNTAVRATYIPTGESVFVQDSRSQLENKKLSVTRLKEKVMAQHILKIQRRMQDTWSNHMQVQRGNPIRTYS

SEQ ID NO: 73687 - DNA, 1383 bp, Oryza sativa (japonica cultivar-group)
  CDS (1)..(1383)
atgtcctgtagccgaagtgcggcaatgattgactgcccgcggctgctcctggcggccgcgcgcgcctctccgtaccccagctccgccgctcaccggagggtctgcaccgccggagtccctcccgtacccgtatattgccgtgtcagccaccgccgcaggtcctccgttcctgtgcaatctgcatcctctgggtcaggaagccaatcaagcgttgcagaaagttcggaggctaccgaatgggccatgcaggatttctacgctttgcggaaggatgtcgagctggctgtagcgcgcgtcagtgaagtcaggcagtctgctggtttggatcagcttgaggaggaaatcgcttcgctcgagaagaaatctgcagatagttccttgtgggatgatccttccaaggcacaggagatacttgttgctctgacagaggtcaaagacagagtcaagcttctcaacgatttgaagttgcaggttgaagaagctgagaccattgtaaagcttactgaggagttagattccatagatactggccttcttgaagaagcctcaaagatcataaaggcattaaacaaagcactagataactttgagatgacacagcttctttctggaccttatgacaaggaaggtgctgtgattaatattactgcaggtgctggtggcaccgatgcccaggattgggctgacatgttactgaggatgtatgttaggtggggagagaagcagcggtacaagacaagagtggttgagaaatcccctggtgaagaagctggaataaaatcagctaccattgaattagaaggaagatatgcctatgggtatctctctggggagaaagggacacacagaattgttcgtcagtccccattcaatgctaaagggcttaggcagacaagctttgctggtgttgaagtaatgcctctactgccagaagagtccatggatgtagaaatacccgaagaggatctggagataagcttcactagagcaggcggcaaaggaggccagaatgtgaacaaggtggagacggctgttcgcatggtccatatacccacgggcatcgctgttcgttgcacagaggagaggagccagttggccaacaagataaaggccctgagccggctgaaggcgaagctgctggtgatcgccgaggagcagcgggcgtcggagatcaagcagatccgcggcgacgcggtgaaggcggagtgggggcagcagatccgcaactacgtcttccacccctacaagctcgtcaaggacgtccgcaccgcctgcgagacgtcggacatcaccggcgtcatggacggcgagctggacaccttcatcagagcctacctcaagtacaagctctctgccgctgctgaggagcaaagcgtcaagtga

SEQ ID NO: 73688 - protein, 460 aa, Oryza sativa (japonica cultivar-group)
MSCSRSAAMIDCPRLLLAAARASPYPSSAAHRRVCTAGVPPVPVYCRVSHRRRSSVPVQSASSGSGSQSSVAESSEATEWAMQDFYALRKDVELAVARVSEVRQSAGLDQLEEEIASLEKKSADSSLWDDPSKAQEILVALTEVKDRVKLLNDLKLQVEEAETIVKLTEELDSIDTGLLEEASKIIKALNKALDNFEMTQLLSGPYDKEGAVINITAGAGGTDAQDWADMLLRMYVRWGEKQRYKTRVVEKSPGEEAGIKSATIELEGRYAYGYLSGEKGTHRIVRQSPFNAKGLRQTSFAGVEVMPLLPEESMDVEIPEEDLEISFTRAGGKGGQNVNKVETAVRMVHIPTGIAVRCTEERSQLANKIKALSRLKAKLLVIAEEQRASEIKQIRGDAVKAEWGQQIRNYVFHPYKLVKDVRTACETSDITGVMDGELDTFIRAYLKYKLSAAAEEQSVK

SEQ ID NO: 73689 - DNA, 1104 bp, Leptospira interrogans serovar Copenhageni str. Fiocruz L1-130
  CDS (1)..(1104): transl_table=11
atggaagttaaatcggcaaaagaactcaaaagaatctctaaagaattacaagagaattttttaaaccgttggaaattgttgaatttggaacaagataaagatcgtctcaagtcgctcacagaaaaagcggaagatccaaatctttggaacaatccagaagaagccagacttgtaagtcagaaaaaaaacgaactcgaaaaaaaactcaatccttggtttactattcagcaggatatattagattttcctgatttagtggatctcaccttggacgaaaaaggcgaaaacggggttggagaactttcttccgaatacaatagacttcaggaaaagttcgaggaattagaacttttaggcgctttaaaaaatccggaagatttaaaacctgcctttttaaacattcatccaggagccggcggaaccgaaagtcaagactgggcggaaatgctcctcagaatgtacacacgttatttcgaaaaaaaagggtatcagtattctctaatagacgttcaagcaggagacggcgccggtattaaaaatgccaccttacacgtaataggtgattttgcattcggatttcttaaaggcgaaaacggagttcacagactcgttcggatttctccctttgacgcgaataaaagaagacatacttctttcgtttcagttcacgtcagccccgaaatagacgacgatatagacatcaaaatcgaagagaaagatattcgtgtagacgtttatcgttcttcgggcgcgggcggtcagcacgtaaatactaccgactccgcggttcgaatcacccacatgccgagtggtatcgtagtcgcttgtcaaaatgaaaggtctcagattaaaaacagagatactgcattcaaaatgttgaaagctagactttacgagttggaacaagaaaaagcaaaggaagagttggaaaaaaaatccggagaaaaaaaagacatcacttggggttctcagattcgtagttatgtatttcatccttataatcttgtaaaagatcatagaaccgatcacgaaaccggtaacgttgcagccgtgatggacggtgacatagaaccattcattcttgcttatttgaaaacgctttaa

SEQ ID NO: 73690 - protein, 367 aa, Leptospira interrogans serovar Copenhageni str. Fiocruz L1-130
MEVKSAKELKRISKELQENFLNRWKLLNLEQDKDRLKSLTEKAEDPNLWNNPEEARLVSQKKNELEKKLNPWFTIQQDILDFPDLVDLTLDEKGENGVGELSSEYNRLQEKFEELELLGALKNPEDLKPAFLNIHPGAGGTESQDWAEMLLRMYTRYFEKKGYQYSLIDVQAGDGAGIKNATLHVIGDFAFGFLKGENGVHRLVRISPFDANKRRHTSFVSVHVSPEIDDDIDIKIEEKDIRVDVYRSSGAGGQHVNTTDSAVRITHMPSGIVVACQNERSQIKNRDTAFKMLKARLYELEQEKAKEELEKKSGEKKDITWGSQIRSYVFHPYNLVKDHRTDHETGNVAAVMDGDIEPFILAYLKTL

SEQ ID NO: 73691 - DNA, 1137 bp, Thermus thermophilus HB27
  CDS (1)..(1137): transl_table=11
ttgcgcctcgcttcgcaatctgctatcctggtaaaggtatggacctggaacgcctcgcgcaacgcctggaaggcctcagggggtatctttgacatcccccaaaaggaaacccgtctaaaagagctggagcggcgcctcgaggacccctccctctggaacgatcccgaggccgcccgcaaggtgagccaggaggccgcccgcctccggcgcaccgtagacaccttccgctccctggaaagcgacctccagggccttttggagctcatggaggagcttcccgccgaggaacgggaggccctcaagcccgagctggaggaggccgcgaagaagctggacgagctctaccaccagaccctcctcaacttcccccacgcggaaaagaacgccatcctcaccatccagcccggggccgggggcacggaggcctgcgactgggcggagatgctcctaaggatgtacacccgcttcgccgagcgccagggcttccaggtggaggtggtggacctcacccctgggcccgaggcgggcattgactacgcccagatcctggtcaagggggagaacgcctacggcctcctttcccccgaggccggggtgcaccgcctggtgcgcccttccccctttgacgcctcgggccgccgccacacctccttcgccggggtggaggtgatccccgaggtggacgaggaggtggaggtggtgctcaagcccgaggagctccgcattgacgtgatgcgggcctcggggcccgggggccagggggtgaacaccacggactcggcggtgcgggtggtccacctgcccacggggatcaccgtgacctgccagaccacgcggagccagatcaagaacaaggaactcgccctcaagatcctcaaggcccgcctctacgagctggagcggaagaagcgggaggaagagctcaaggccctgaggggcgaggtgcggcccatagagtggggaagccagatccggagctacgtcctggacaagaactacgtcaaggaccaccgcaccgggctcatgcgccacgacccggaaaacgtcctggacggggacctcatggacctgatctgggcgggcctggagtggaaggcgggccgccgccaggggacggaggaggtggaggcggagtag

SEQ ID NO: 73692 - protein, 378 aa, Thermus thermophilus HB27
MRLASQSAILVKVWTWNASRNAWKASGGIFDIPQKETRLKELERRLEDPSLWNDPEAARKVSQEAARLRRTVDTFRSLESDLQGLLELMEELPAEEREALKPELEEAAKKLDELYHQTLLNFPHAEKNAILTIQPGAGGTEACDWAEMLLRMYTRFAERQGFQVEVVDLTPGPEAGIDYAQILVKGENAYGLLSPEAGVHRLVRPSPFDASGRRHTSFAGVEVIPEVDEEVEVVLKPEELRIDVMRASGPGGQGVNTTDSAVRVVHLPTGITVTCQTTRSQIKNKELALKILKARLYELERKKREEELKALRGEVRPIEWGSQIRSYVLDKNYVKDHRTGLMRHDPENVLDGDLMDLIWAGLEWKAGRRQGTEEVEAE

SEQ ID NO: 73693 - DNA, 981 bp, Parachlamydia sp. UWE25
  CDS (1)..(981): transl_table=11
atgggagaaagctcgttttggaataattctgaacaagcgcaattaattattaatgaatgccgcgatttgcgagcttggactgtcccttatcaggaacttaaaacaaaatttgaaaattgcaaagagttacttcctgaagcctatgaattaaatgaagaatcttttattgaagaacttttaagagatttagattctattgagaaagtgctgggagatttagaagttcagcgaatgttatctggagaaatggataacaaagattgctatttgacgattaattcaggagctgggggaacagaagcttgtgattgggctcagatgttgtcgaggatgtaccaacgctgggcggctaagaagggatggaaaattgaaattatcgattttgtcgatggagacgtggttggtttaaaaagtattactctgcgttttcaaggctcttatgcttatggttatagcaaagctgaaaaaggcgtacatcgtttagtgcgcatttcccctttcgacagtaatgctaagaggcataccagttttgcatcagtggatgtttctccagaaataactactgacattcaagttgaaattaaacctgaggatgttagagttgatacttttagatcttcaggagctggagggcagcacgtaaacaaaacagattctgctgtacgtttaacccacatgcctacaggaattgttgtttcttgtcaaactcaacgaagtcaagtacaaaataaagaagcttgttatcagatgcttcgttcaaagttatatgaaatggaagttttagagcgtgaaaaagccctaaataacctaaaaggggaaaaaaaagaaaacgcttggggtagccaaatccgcaattatgtttttcaaccttatacgcttgttaaagacacaaggacgaaagctgaaagtggtaacatacaagccgtaatggatggtgaattagatgaatttgttaacgcttatttaaaggagtttggctga

SEQ ID NO: 73694 - protein, 326 aa, Parachlamydia sp. UWE25
MGESSFWNNSEQAQLIINECRDLRAWTVPYQELKTKFENCKELLPEAYELNEESFIEELLRDLDSIEKVLGDLEVQRMLSGEMDNKDCYLTINSGAGGTEACDWAQMLSRMYQRWAAKKGWKIEIIDFVDGDVVGLKSITLRFQGSYAYGYSKAEKGVHRLVRISPFDSNAKRHTSFASVDVSPEITTDIQVEIKPEDVRVDTFRSSGAGGQHVNKTDSAVRLTHMPTGIVVSCQTQRSQVQNKEACYQMLRSKLYEMEVLEREKALNNLKGEKKENAWGSQIRNYVFQPYTLVKDTRTKAESGNIQAVMDGELDEFVNAYLKEFG

SEQ ID NO: 73695 - DNA, 1116 bp, Desulfovibrio vulgaris subsp. vulgaris str. Hildenborough
  CDS (1)..(1116): transl_table=11
atgctccacctacccgaattgcgtacacgcagcacaacccttttcgaacaattctccacgctatgggggcgtcttgacctcgcgggcaacagacaccgcctctccgagatagagaagcagctttccacgccggacgcgtggaacaatcccgaaaagctcacccccgtcctgcaggagaagagcatgctcgaaggcgagatcaatcgccttgaagcgctcgagacctgccgtaacgatgtctccgaatggctgctgctcgccgaagaggacgaaagcgcagaggccctcgaatcgctcgaagagcagatcatccgcctcgagcagctcatcgaggagaccgagatgaacctgctgctctccggcaaggaggacaggttcgccgccctgctcgaaatccatcccggagcgggtggcaccgaagcgcaggactgggccgagatgctgctgcgcatgtacctgcgctgggccgatacacacggctacaagacggaatacctcgactatctcgacggtgacgaggcgggcatcaagagcgtcacgctgcgcattgccggccccaacgcctacggccttctcaagggcgaacggggcatccacagactcatccgcatttcgccgttcgacgcttcggggcgcaggcatacgtcgttcgcctcggtggacgtcatccccgacgtagggcaggatatcaagatcgagatcaaggataccgacctgcgcatcgacgtcttccgttcaagcggccccggcgggcagagcgtcaacaccacaagttccgcagtgcgtgtgacgcacatccccaccggtatcgtggcccagtgccagaacgagaagtcgcagcaccacaacaaggattccgcccttcagattcttcgcggtcgactctatgagctcgaattgaggaaactcgaagaagagaagaaggcgcagtacggagcgaaggacgccatcggcttcggcagccagatacgcacctataccctccagccctatcggcttgtgaaagaccacagaaccaacaccgaagtgggcgatgtcgaagcggtgctcgacggcagactcgacaaactgttgcgggactacctgctgtacctgcatggacaaaagacgaactga

SEQ ID NO: 73696 - protein, 371 aa, Desulfovibrio vulgaris subsp. vulgaris str. Hildenborough
MLHLPELRTRSTTLFEQFSTLWGRLDLAGNRHRLSEIEKQLSTPDAWNNPEKLTPVLQEKSMLEGEINRLEALETCRNDVSEWLLLAEEDESAEALESLEEQIIRLEQLIEETEMNLLLSGKEDRFAALLEIHPGAGGTEAQDWAEMLLRMYLRWADTHGYKTEYLDYLDGDEAGIKSVTLRIAGPNAYGLLKGERGIHRLIRISPFDASGRRHTSFASVDVIPDVGQDIKIEIKDTDLRIDVFRSSGPGGQSVNTTSSAVRVTHIPTGIVAQCQNEKSQHHNKDSALQILRGRLYELELRKLEEEKKAQYGAKDAIGFGSQIRTYTLQPYRLVKDHRTNTEVGDVEAVLDGRLDKLLRDYLLYLHGQKTN

SEQ ID NO: 73697 - DNA, 969 bp, Bartonella quintana str. Toulouse
  CDS (1)..(969): transl_table=11
atgatgcgtgagcgtcaacgtcttgatgattcaatcagtggtattcaatcatttacaaagactcttgaagaatgcattgaactcatcgcgatgggtgaagaagaaagtgatgtcgaaattatcactgatgcagaaaatttaatacgtaatcttaaaaatgagatagataaaaggcaaattgatatgcttctttcaagagaagcagatccaaatgatacttatttagaggttcatgctggtgcaggtggcactgaaagccaggattgggcttcaatgctcttacgcatgtatatgcgctgggctgaacagcataaaatgaaggttgaaatcttagaaatacacgatggagaagaagcgggaataaaatcagctactattttcgtaaaagggcataatgcttatggtctgttgaaaacagaatcaggcgttcatcgtttggtgcgcatttcaccgtatgattccaatgcaaaacgccatacctctttcgcaagtatctgggtttatccggttattgatgataatattgaggttgatgtttctgaatcggatgttcgtattgatacatatcgctcctcaggagctggagggcagcatgtcaatacgacggattctgcagttcgcatcacgcatataaaaacggggattgttgtccaatgtcaaacagaacgttctcaacataaaaatcgagcaactgcatggtctatgttacgcgcacggctttatgaacaagagctcaaaaaaagggaagaaaaaacgaatgctgttgaatcttctaaaacagaaataggatggggacaccaaattagatcttatgttcttcagccctatcagcttgtcaaagatttgcgcacaggcgttgaaaacactgatccacaatcggtactgaatggcaacttggatgcgtttatagaggcagcacttgcccaacgcatttacggaaaagatcaagaaattgaagatattgattga

SEQ ID NO: 73698 - protein, 322 aa, Bartonella quintana str. Toulouse
MMRERQRLDDSISGIQSFTKTLEECIELIAMGEEESDVEIITDAENLIRNLKNEIDKRQIDMLLSREADPNDTYLEVHAGAGGTESQDWASMLLRMYMRWAEQHKMKVEILEIHDGEEAGIKSATIFVKGHNAYGLLKTESGVHRLVRISPYDSNAKRHTSFASIWVYPVIDDNIEVDVSESDVRIDTYRSSGAGGQHVNTTDSAVRITHIKTGIVVQCQTERSQHKNRATAWSMLRARLYEQELKKREEKTNAVESSKTEIGWGHQIRSYVLQPYQLVKDLRTGVENTDPQSVLNGNLDAFIEAALAQRIYGKDQEIEDID

SEQ ID NO: 73699 - DNA, 969 bp, Bartonella henselae str. Houston-1
  CDS (1)..(969): transl_table=11
atgatgcgtgagcgtcagcgtcttgatgattccattaatggcattcgatcatttacaaaaacacttgaagagtgcattgagttaatcgcaatgggtgaagaagaaagtgatatcgaaattatcacggatgcagaaaattcaatacgcaatcttaagagtgaaatagataaaagacaaattgatgcgcttctttcaggagaagccgaccagaatgatacttatctagaagtgcatgctggtgcaggaggtacggaaagccaagattgggcttctatgctgttacgcatgtatatgcgctgggctgaacagcataaaatgaaggttgaaatcttagaaattcacgatggagaagaagccggaataaaatcagcgactcttcttgtaaaagggcataatgcgtatggtatgttgaagacggaatcaggtgtgcatcgtttggtacgcatttcgccgtttgattcaaatgcaaaacgtcatacttcttttgcaagcatttgggtctacccagttattgacgataatattgaagttgatgtttcagaagcagatgtgcgtattgatacatatcgtgcgtcaggagctggaggacaacatgtcaatacgacagattctgcagtgcgcatcacacatataaaaacaggtattgttgttcaatgtcaaacagagcgttctcagcataaaaatcgagcaattgcctggtctatgttgcgtgcaagactttatgaagaagagctcaaaaagagagaagaagaaacaaatgctgttgaagcttctaaaacagaaatcggatggggacatcaaattagatcatatgttcttcagccctatcaacttgtcaaagatttacgcacaggtgttgaaaatacggatccccaatccgtacttaatggcaatttagattcctttatagaagctgcacttgctcgacgcatctacggaaaagacccagaaattgaggatattgattaa

SEQ ID NO: 73700 - protein, 322 aa, Bartonella henselae str. Houston-1
MMRERQRLDDSINGIRSFTKTLEECIELIAMGEEESDIEIITDAENSIRNLKSEIDKRQIDALLSGEADQNDTYLEVHAGAGGTESQDWASMLLRMYMRWAEQHKMKVEILEIHDGEEAGIKSATLLVKGHNAYGMLKTESGVHRLVRISPFDSNAKRHTSFASIWVYPVIDDNIEVDVSEADVRIDTYRASGAGGQHVNTTDSAVRITHIKTGIVVQCQTERSQHKNRAIAWSMLRARLYEEELKKREEETNAVEASKTEIGWGHQIRSYVLQPYQLVKDLRTGVENTDPQSVLNGNLDSFIEAALARRIYGKDPEIEDID

SEQ ID NO: 73701 - DNA, 1014 bp, Acinetobacter sp. ADP1
  CDS (1)..(1014): transl_table=11
ctgaaaaaagagcgtttagaagaagttttacgtgaacttgaagatcctgcgatctggaatgatcagagtcgtgcacaagccatggccaaagaaaaaggcgagcttgaaaacgtactgaatgtgctagataaccttgctgaacagttagaagatgccaaggcgatgctggatctggcggtcgaagccgatgatgaaagtttactggttgatgtggaatcagaacttgcaacggctgaggacgaactcgccaagcttgaattccgtcgtatgtttagtaatccgatggatccaaatccgtgttatgtggaaattcaggcgggttcaggtggaacagaggctcaggattgggcttctatgttgctgcgtatgtacatgcgctggattgagcgtcacggctttaaagctgaattgatggaagagtctgatggtgatgttgcaggcattaaatcagcaacgattcgtgtagaaggtgagtacgcatatggctggttacgtaccgagtcgggtgtacatcgtctcgttcgaaaatctccttttgacagtggtaaccgtcgtcatacctcgtttagtgcggtgtttgtttcgccagaaattgatgacaacattgaaattgagatcaatcctgcggatgtgcgtaccgacacctatcgtgcttctggagccggtggtcagcatattaacaaaaccgattcggctgtgcgtttgacgcatgcgccaacaggtattgttgttgcatgtcaaaaccagcgttcacaacatgccaaccgtgatcatgcatggaaacagttacgtgccaagttgtatgaactggaaatgagtaagcgtaatgaagctgctcaggcacttgaagattccaaatcggacatcggttggggtagccagatccgctcgtacgtactggatgattctcgtattaaagatttgcgtacaggtgtcgaaaactcaaatacaggtgctgttctggatggtgatttggataaatttatcgaagccagcttgaaacagggtctctaa

SEQ ID NO: 73702 - protein, 337 aa, Acinetobacter sp. ADP1
MKKERLEEVLRELEDPAIWNDQSRAQAMAKEKGELENVLNVLDNLAEQLEDAKAMLDLAVEADDESLLVDVESELATAEDELAKLEFRRMFSNPMDPNPCYVEIQAGSGGTEAQDWASMLLRMYMRWIERHGFKAELMEESDGDVAGIKSATIRVEGEYAYGWLRTESGVHRLVRKSPFDSGNRRHTSFSAVFVSPEIDDNIEIEINPADVRTDTYRASGAGGQHINKTDSAVRLTHAPTGIVVACQNQRSQHANRDHAWKQLRAKLYELEMSKRNEAAQALEDSKSDIGWGSQIRSYVLDDSRIKDLRTGVENSNTGAVLDGDLDKFIEASLKQGL

SEQ ID NO: 73703 - DNA, 1098 bp, Erwinia carotovora subsp. atroseptica SCRI1043
  CDS (1)..(1098)
atgtttgaaattaatccggtaaaaaaccgcattcaggatctggctgaacgtagcgccgttcttcgggggtatcttgactatgatgccaagaaagagcgcctcgaagaagtaaacgccgaactggagcagcctgatgtctggaatgagcctgaacgtgctcaggcattaggaaaagaacgctcctcgctggaagctatcgtagacaccatcgatcaactggctcagggtctggaagatgtgaccggtttgcttgagctcgcggtggaagaagatgacgaagacacttttaatgaaacctcggcagaactggacgtgctggagaataaattaggccagctcgaattccgtcgcatgttctctggtgagtacgacagcgcggattgctatctggatattcaggcgggatctggcggtacggaagcgcaggactgggccagcatgctggtacgtatgtacctgcgttgggcggaagccaaaggatttaaaaccgaaattattgaagagtcagacggtgacgtggcgggtacgaaatctgccaccatcaagatcatcggtgactatgcgtttggctggctgcgtacggaaaccggtgtacaccgtctggtgcgtaagagcccgttcgattccggcggtcgccgccacacctcattcagctccgcgtttgtctacccggaagtggatgacgatatcgatatcgaaatcaatccggccgatctgcgtattgacgtttaccgcgcatccggtgcgggtggtcagcacgttaaccggacagaatccgcggtgcgtattacccaccttccgaccaacattgtcacgcagtgtcagaatgaccgttcccagcataaaaacaaagatcaggcgatgaaacagctgaaagccaagctgtacgagtttgagatgcaaaagaaaaatgctgagaaacaggtgatggaagacaacaagtctgatatcggctggggcagtcagattcgttcctatgttctggatgattcgcgcatcaaagacttacgtaccggagtggaaacacgtaacactcaggccgtacttgatggcgatctggacaaatttattgaagcaagtttaaaagcggggttataa

SEQ ID NO: 73704 - protein, 365 aa, Erwinia carotovora subsp. atroseptica SCRI1043
MFEINPVKNRIQDLAERSAVLRGYLDYDAKKERLEEVNAELEQPDVWNEPERAQALGKERSSLEAIVDTIDQLAQGLEDVTGLLELAVEEDDEDTFNETSAELDVLENKLGQLEFRRMFSGEYDSADCYLDIQAGSGGTEAQDWASMLVRMYLRWAEAKGFKTEIIEESDGDVAGTKSATIKIIGDYAFGWLRTETGVHRLVRKSPFDSGGRRHTSFSSAFVYPEVDDDIDIEINPADLRIDVYRASGAGGQHVNRTESAVRITHLPTNIVTQCQNDRSQHKNKDQAMKQLKAKLYEFEMQKKNAEKQVMEDNKSDIGWGSQIRSYVLDDSRIKDLRTGVETRNTQAVLDGDLDKFIEASLKAGL

SEQ ID NO: 73705 - DNA, 624 bp, Erwinia carotovora subsp. atroseptica SCRI1043
  CDS (1)..(624)
atgatattacttcaactctccgccgcgcagggaccggacgaatgcatgctggcaacggcaaaagcgttgcacgctctgacgcgagatgccgcgcggcaaggcatcgagtgcgaaatcatcgaaacagaagtagggaaacgtgccggtacattacgttccgcactggttctgttaaacggtgagcaggcagaaccgctggctgcaagctggtgcggtacgcttcagtggacgtgcaatagcccttggcgcaaaggtggcggacgtaagaactggtttatcggcgtcgcacgttttcatcaggaacaggcgtttgccgatgacgagattcgttttgaaaccactaaatcctccggccccggcggacagcatgtgaataaaaccgagtctgccgtccgcgctacccatgtcgctagcggtatcacggtgaaggtgcagagtgaacgcagccagcacgctaacaagcgtctggcgtgttatctcatcgcctatcgtctggaagcgttacaacagcagcagcacgccgaactacgggcacagcggcgtctgttccatcatcagatagaacgcggcaatccggtaaaagtcttcaagggcgaagattttacgttggccacctcgcgctaa

SEQ ID NO: 73706 - protein, 207 aa, Erwinia carotovora subsp. atroseptica SCRI1043
MILLQLSAAQGPDECMLATAKALHALTRDAARQGIECEIIETEVGKRAGTLRSALVLLNGEQAEPLAASWCGTLQWTCNSPWRKGGGRKNWFIGVARFHQEQAFADDEIRFETTKSSGPGGQHVNKTESAVRATHVASGITVKVQSERSQHANKRLACYLIAYRLEALQQQQHAELRAQRRLFHHQIERGNPVKVFKGEDFTLATSR

SEQ ID NO: 73707 - DNA, 1107 bp, Propionibacterium acnes KPA171202
  CDS (1)..(1107): transl_table=11
gtggcattggtagaccttcagcagaccgttgaggacctcgacgcatccctgtcctcgattgagaatgttctcgatccggaggctaagaaagcggagatcgcggacctcgagaggcaggtggccgttcccaatctctgggacgaccaagagaatgcgcagcgggtgacttctcgactgtcggccctgcaggctgagattgaacgtctggagcggttgcgcgcgcggatcgaggatgtccacgtgctgttggaattcgcggctgctgatgacgacaaggaatccctagctgaggcgacgaccgagacggttaagcttcgtgaggagattgacgctctcgaggtgaggaccttgctgtcggggcaatacgacgagcgcgaggccgtcgtcacgattcgttcagaggctggcggtgttgacgctgccgattttgcggagatgctgctacgcatgtacctgcgttggtccgaacgtcacggctacaaggttgaaatcctcgacacttcgtacgctgaagaggcaggcattaagtcggcgacgttcgtcgttcatgcccccttcgcctacggcactctttcggtcgagcagggcacccaccgtctggtgcgcattagtcccttcgacaaccaggggcgccgtcagacatcctttgccggtgtcgaggtgttgcccgtcgttgaggagaccgaccacgtcgacatcccagagtccgatctgcgcgttgacgtcttccatgcctcgggccctggtggccagggtgtgaataccaccgactctgccgttcgtctgacacaccttccgaccggcatcgtagtgagctgtcagaatgagcgttcccaaattcagaacaaggccgccgccttgcgagttcttcaggccaagctgcttgagaaagcccgtgaggaacaggaagccgaaatgaattcattgaagtcggagggcaactcttggggagcccagatgcgctcctacgtgctgcatccctaccaaatggtcaaggatttgcgtacgaatcatgaggtcggtaacactgatgccgtcttcgacggagatatcgacgacttcatcgacgctggtattcgttggcgtcgcaagaacgaaaccgactga

SEQ ID NO: 73708 - protein, 368 aa, Propionibacterium acnes KPA171202
MALVDLQQTVEDLDASLSSIENVLDPEAKKAEIADLERQVAVPNLWDDQENAQRVTSRLSALQAEIERLERLRARIEDVHVLLEFAAADDDKESLAEATTETVKLREEIDALEVRTLLSGQYDEREAVVTIRSEAGGVDAADFAEMLLRMYLRWSERHGYKVEILDTSYAEEAGIKSATFVVHAPFAYGTLSVEQGTHRLVRISPFDNQGRRQTSFAGVEVLPVVEETDHVDIPESDLRVDVFHASGPGGQGVNTTDSAVRLTHLPTGIVVSCQNERSQIQNKAAALRVLQAKLLEKAREEQEAEMNSLKSEGNSWGAQMRSYVLHPYQMVKDLRTNHEVGNTDAVFDGDIDDFIDAGIRWRRKNETD

SEQ ID NO: 73709 - DNA, 1119 bp, Leifsonia xyli subsp. xyli str. CTCB07
  CDS (1)..(1119): transl_table=11
atgattgaactcgacctcaccgcgcagatcgccgagctgcgctccaccctcgccgacatcaccgctgttgtggacgtcgacaagctccgcgctgccatcgccgacctcagtgagcgggcgggagcgccggacctctgggacgaccccgtgaacgcgcagaaggtcaccagcgcgctcagccatcgccagtccgagctcgcccgcatcacggcgatccagcagcgcctcgacgacctggaagtgctcgtcgagcttgccaacgagggcgacgatgaggaatccgccgctgaggcccgcgccgaactcgaagccctgcagaaggcgctcggcgatctcgaagtgcagacgctgctgagtggcgagtatgacgagcgcgccgccatcgtcaccatccgctctggcgccggaggcgacgacgccaccgatttcgccgagatgctgctgcggatgtacctgcgctgggccgagcagcacaagtacccggtcacggtcatggacacgtcttacgcggagggcgcgggcatcaagtccgcgaccttcgaggtcgatatgccctacgctttcggcacgctctcggtcgaagcgggcacccatcgcctggctcgcatcagcccgttcgggtcggccgacaagcgtcagacgtcgttcgcggcggttgaggtcatcccgctgatggaagaggccaatcaggtggacgtccccgagggcgacatccgtgttgatgtcttccggtcttccggtccgggcggtcaatcggtcaacacgaccgattcggccgtgcgcctcacccacctcccgaccggcatcgtggtgtcgatgcagaacgagaagtcgcagatccagaaccgggccgcggcgatgcgcgtgctccagacccgtctgctcctgcttcagaaggaggaggaagcggccaagaagaaagagctcgccgggaacatcaccgcgagctggggcgaccagatgcgctcctactttctgtacggtcagcagctggtcaaggatctccgcaccgggtatgagtcgggcaacccggcgaccgttttcgacggcgacctcgacggcttcatagccgcgggcatccgctggcgcgcggggagcaaagcggaggctcaggggtag

SEQ ID NO: 73710 - protein, 372 aa, Leifsonia xyli subsp. xyli str. CTCB07
MIELDLTAQIAELRSTLADITAVVDVDKLRAAIADLSERAGAPDLWDDPVNAQKVTSALSHRQSELARITAIQQRLDDLEVLVELANEGDDEESAAEARAELEALQKALGDLEVQTLLSGEYDERAAIVTIRSGAGGDDATDFAEMLLRMYLRWAEQHKYPVTVMDTSYAEGAGIKSATFEVDMPYAFGTLSVEAGTHRLARISPFGSADKRQTSFAAVEVIPLMEEANQVDVPEGDIRVDVFRSSGPGGQSVNTTDSAVRLTHLPTGIVVSMQNEKSQIQNRAAAMRVLQTRLLLLQKEEEAAKKKELAGNITASWGDQMRSYFLYGQQLVKDLRTGYESGNPATVFDGDLDGFIAAGIRWRAGSKAEAQG

SEQ ID NO: 73711 - DNA, 858 bp, Desulfotalea psychrophila LSv54
  CDS (1)..(858): transl_table=11
atgcttcttgagatggccgccgaagagggtgaccaggaaattgagcaggaaattgcgctgaagctagggagctttgccaacgccctggccgccatcgagctggagtgcatgttcatcggtgaacatgacagctgcaacgccattatttctatccacgcaggtgccggtggaaccgaggcccaggattggactgatattctcctacgtatgtatctgcgctgggcggaacgccataaatttaagaccgagatccttgatttactccccggtgatgaggcaggtaccaagagtattaccattctgatcaaggggcaatgggcctatggttatctgcgttcagagcttggcatccatcgcctggtacggatctctccctttgacaccagtggcagacgccacacctcctttgcctcggtgatggtcatgccagaactcgataatacggttgatgttgatatcgacgaaaaagatctgcgggtagatacctatcgtgccagtggcgcaggtggtcagcatgtaaataagaccgactcggcaattcgtttaacccatctgccgaccggcgttgttgtccagtgccaaaatgaaaggtctcaacatcgcaataaagagatggcaatgaagatgcttattgcccagatatatcagctcgaaaagcaaaaaaaagcagatcagcaggaaggactgcacggcgagaagaagggcatctcctggggaagccagattcgttcctatgtactgcaaccatatcgtctaattaaggatcatcgtacagattttgaggcaggtaatgtcgatgctgtacttgacggcggtctcgatggctttatcaaggccttcctactctggggaaaataa

SEQ ID NO: 73712 - protein, 285 aa, Desulfotalea psychrophila LSv54
MLLEMAAEEGDQEIEQEIALKLGSFANALAAIELECMFIGEHDSCNAIISIHAGAGGTEAQDWTDILLRMYLRWAERHKFKTEILDLLPGDEAGTKSITILIKGQWAYGYLRSELGIHRLVRISPFDTSGRRHTSFASVMVMPELDNTVDVDIDEKDLRVDTYRASGAGGQHVNKTDSAIRLTHLPTGVVVQCQNERSQHRNKEMAMKMLIAQIYQLEKQKKADQQEGLHGEKKGISWGSQIRSYVLQPYRLIKDHRTDFEAGNVDAVLDGGLDGFIKAFLLWGK

SEQ ID NO: 73713 - DNA, 1023 bp, Rickettsia typhi str. Wilmington
  CDS (1)..(1023): transl_table=11
ataagacttacagaattagaagaattaacagcagatccaagtttatggaataataatgctaatgcacaaatattactaagagaaaaaactaatatagaagaaaaactaaatgtttttaataacctcaaatcaaattttgaagatattttagaacttgaagcaatggctgaagtcgaaaatgatttcgagactcttaatcaaattgaacaagactttaaaaaattaagtatcattgccgctaaacttgaaactgagtgcttattttcagatgaatcagactacaataactgctttttagaaattaatgctggagcaggaggaactgaaagtcatgattgggcatcgattatgatgcgtatgtatttacgttttgctgaacgacttggttttaaaacacaaataataaatatgattaatggcgaagaagtaggcattaaatcatgtacgattagaataataggtaaacgagcttacggctggtttaaaacagaagcaggagtgcataggctagtgcgcatttctccatttaatgcagcaggcaaaaggatgactagctttgcaagtagctgggtatatccagaaattgatgatgatatagcaatcactattgaagataaagatttaagaatcgatacttttagagcatcaggtgcaggcggacaacacgttaatacaacagattctgcagtacgtatcacgcatataccaacaaatacggtaacacaatgtcaaagtgacagatcacaacataagaataaagctcaagcaatgaagatgcttcaagcaaaactctataagcttgaaatgcagaaacgtactgacagtgttgataaacagaatgctaataaaaccgataatagttgggggcatcaaattagatcatatgttttgcaaccttatcaaattgtaaaagatctacgtactgattacgaaacttccgatactaaaggagtacttgacggtaaccttgaaaattttgtctccgcaagccttgctatgaatgctagtggtaataaaaaataa

SEQ ID NO: 73714 - protein, 340 aa, Rickettsia typhi str. Wilmington
MRLTELEELTADPSLWNNNANAQILLREKTNIEEKLNVFNNLKSNFEDILELEAMAEVENDFETLNQIEQDFKKLSIIAAKLETECLFSDESDYNNCFLEINAGAGGTESHDWASIMMRMYLRFAERLGFKTQIINMINGEEVGIKSCTIRIIGKRAYGWFKTEAGVHRLVRISPFNAAGKRMTSFASSWVYPEIDDDIAITIEDKDLRIDTFRASGAGGQHVNTTDSAVRITHIPTNTVTQCQSDRSQHKNKAQAMKMLQAKLYKLEMQKRTDSVDKQNANKTDNSWGHQIRSYVLQPYQIVKDLRTDYETSDTKGVLDGNLENFVSASLAMNASGNKK

SEQ ID NO: 73715 - DNA, 1101 bp, Yersinia pseudotuberculosis IP 32953
  CDS (1)..(1101): transl_table=11
atgtttgaaataaacccggtaaaaaaccgaattcaggacctgtctgatcggacagccgttctcagggggtatctttttgactatgatgccaagaaagagcgactggaagaagtaaacgccgagctggaacagcccgacgtctggaatgaacccgaacgcgctcaagcgttgggcaaagagcgttctacgctggaagagattgtcaccaccattgatcaattagagcaaggcttggaagacgtgtccggcctgctggaattagccgttgaagctgatgatgaagaaacctttaacgaaacaattgctgagttagaggttcttgatggcaagctgggccagctcgaattccgtcgtatgttctctggcgaatatgatcgcgccaactgctatctggacttacaagcaggttctggtggcactgaagctcaggactgggccagtatgttactgcgtatgtacttgcgctgggctgagtctagaggctttaaaactgagatcatcgaagaatctgacggtgatgttgctggtttaaaatctgccaccgtcaaaataattggtgaatatgccttcggttggttacgtactgaaactggcgtacaccgtctggtacgtaaaagcccatttgattcgggcggtcgccgccatacctctttcagttcagcctttgtctatccagaagttgatgacgatattgatattgaaattaacccggcagacctgcgtattgacgtttaccgtgcatccggtgcgggtggtcagcacgtcaacaaaacagaatctgcggtgcgaattactcatattccaaccaatatcgtgactcaatgccagaatgaccgttcgcagcataaaaacaaagatcaagcgatgaaacagctgaaagctaagctgtatgagtttgagatgcaaaagaaaaatgctgataaacaggttttggaagacaataagtccgatatcggctggggtagccagatccgttcttatgtattggatgactcccgtattaaagatttgcgtaccggtgtggaaacacgcaacacgcaagctgtactggatggcgatctggacaaatttattgaagcaagcttgaaagccgggctatga

SEQ ID NO: 73716 - protein, 366 aa, Yersinia pseudotuberculosis IP 32953
MFEINPVKNRIQDLSDRTAVLRGYLFDYDAKKERLEEVNAELEQPDVWNEPERAQALGKERSTLEEIVTTIDQLEQGLEDVSGLLELAVEADDEETFNETIAELEVLDGKLGQLEFRRMFSGEYDRANCYLDLQAGSGGTEAQDWASMLLRMYLRWAESRGFKTEIIEESDGDVAGLKSATVKIIGEYAFGWLRTETGVHRLVRKSPFDSGGRRHTSFSSAFVYPEVDDDIDIEINPADLRIDVYRASGAGGQHVNKTESAVRITHIPTNIVTQCQNDRSQHKNKDQAMKQLKAKLYEFEMQKKNADKQVLEDNKSDIGWGSQIRSYVLDDSRIKDLRTGVETRNTQAVLDGDLDKFIEASLKAGL

SEQ ID NO: 73717 - DNA, 1053 bp, Borrelia garinii PBi
  CDS (1)..(1053): transl_table=11
ttgaacaagccgaaggcatttggaggaagctttgacaaaaaagaaattcaagataaaatagaaaaatacgaaaaagaaatacaccagaaaaatttttggaatgatcctaaaagagcccaagaagttataaaagctcaaagtatcttgaaaaataaaattgatccgtgggaagagctaataaacaaaatcaaagatttaagcgatctttgtgaaattgttgaaaatgaaaaagatattaacagcttagaaatcgaatttaatgtacttgaaaaacagtacaaaaatttactcacaatttcttactttaaagaagagcttgacataaacagcgcttttttaactattcattctggtgctggaggcactgaagcatgtgactgggttgcaatgctttacagaatgtactcaagatatgctgagagaaaaaaatataaaacagaactgattgatttgcttgaagcagaaggtggaattaaatctattacaatagaaatcaaaggtgaatatgcttatggacttttaaaaagtgaagttggaatacatcgccttataagaatttctccgtttgatgctgctaaaaaaagacatacctcttttgcatcagtatttgttgaccctgttattgatgagaaaatagaaataataattaaaccagaagatataagaattgatacatatagagcatcgggagctggggggcaacacgtcaacaaaacatcctctgctgtaagaataactcacattgaaacaggaatagtaactcaatctcaaagcgaccgaagtcagcacaaaaacaaagatatggcaatgaaagttttaaaatcaagactttacgaatactataagaataaagaagataaaaaaaataaatccaagcaagaagtaaaaaaagaaatttcttggggcaaccaaataagatcttacgtatttcaaccttacaatttagtaaaagatcacagaacaaaatttgaaaattcaaacaccacttcggttatggacggcaatatagataatttcatagaagagtatttaaaatggaaaagtttaaactaa

SEQ ID NO: 73718 - protein, 350 aa, Borrelia garinii PBi
MNKPKAFGGSFDKKEIQDKIEKYEKEIHQKNFWNDPKRAQEVIKAQSILKNKIDPWEELINKIKDLSDLCEIVENEKDINSLEIEFNVLEKQYKNLLTISYFKEELDINSAFLTIHSGAGGTEACDWVAMLYRMYSRYAERKKYKTELIDLLEAEGGIKSITIEIKGEYAYGLLKSEVGIHRLIRISPFDAAKKRHTSFASVFVDPVIDEKIEIIIKPEDIRIDTYRASGAGGQHVNKTSSAVRITHIETGIVTQSQSDRSQHKNKDMAMKVLKSRLYEYYKNKEDKKNKSKQEVKKEISWGNQIRSYVFQPYNLVKDHRTKFENSNTTSVMDGNIDNFIEEYLKWKSLN

SEQ ID NO: 73719 - DNA, 927 bp, Symbiobacterium thermophilum IAM 14863
  CDS (1)..(927): transl_table=11
gtggaacagctggagtccttccggcgccggctggacgacctggaggtcatgatcgacctcgccgaggaggcgtccgacgccgagatggccgcggaggccagagcggaggccgacgccctggaggaacaggtccggcagttcgagctgcaggtcctgctgaacgggaagtacgacgcgtacaacgccatcctaaccatccacgccggggccggcggtaccgaggcacaggactgggcggagatgttgctgcgcatgtacgtccgctgggccgagcggcgcggcttcaaggtggaggagctggaccggctggacggggacgaggccggcatcaagtcggtcacgatcgcggtgcggggcccctacgcgtacggtttcctccggccggagatgggcgtccaccggctggtgcgcatctcgcccttcgacgcgtccggccggcggcacacctcgttcgccgcggtggaggtcatgcccgagatcgaggatgacgtggacgacatcgagatccggcccgaggacctgcgcatcgatacgttccggtccagcggcgcgggcggccagcacgtcaacaagaccgagtcggcggtgcggatcacccacctgcccaccggtatcgtggtatcgtgccagcaggagcgctcgcagatgcagaaccgcgccgtggcgatgatgatgctccgctccaagctggtggagctgaagatcgaggagcagaacaaggagatggcccagatccggggcccgcagatggagatcgcctggggcagccagatccgcagctacgtcttccagccttacaccctggtgaaagaccaccgcagcggggtggaggtgggcaacgcccaggcggtgatcgacggcgagctggatcccttcatctacgggtacctggagaagagggccaacggcgagctcgcccggccgtaa

SEQ ID NO: 73720 - protein, 308 aa, Symbiobacterium thermophilum IAM 14863
MEQLESFRRRLDDLEVMIDLAEEASDAEMAAEARAEADALEEQVRQFELQVLLNGKYDAYNAILTIHAGAGGTEAQDWAEMLLRMYVRWAERRGFKVEELDRLDGDEAGIKSVTIAVRGPYAYGFLRPEMGVHRLVRISPFDASGRRHTSFAAVEVMPEIEDDVDDIEIRPEDLRIDTFRSSGAGGQHVNKTESAVRITHLPTGIVVSCQQERSQMQNRAVAMMMLRSKLVELKIEEQNKEMAQIRGPQMEIAWGSQIRSYVFQPYTLVKDHRSGVEVGNAQAVIDGELDPFIYGYLEKRANGELARP

SEQ ID NO: 73721 - DNA, 978 bp, Mannheimia succiniciproducens MBEL55E
  CDS (1)..(978): transl_table=11
ttggaacaacctgacgtatggaacgaaccggaaaaagcgcaggctttaggaaaagagcgttccgcattggaaaccgttgtgaacaccattaaaaagctcgatcaggggctggaagacgttgacggactattggaattagccgttgaaggagaagatgaagaaacctttaacgaagccgttaccgaattagacgaattggaacagcagttggctaaattggaattccgccggatgttcagcggcgagcacgatgcctgcgactgttatatcgatctgcaagcgggttccggcggcacggaagcgcaggactggacggaaatgctgttacgtatgtatttgcgttgggcggaaagcaaaggctttaaaaccgaattgatggaagtctccgacggcgatgtagccggtttaaaatccgctacggtgaaagtatcaggcgaatatgcgttcggctggctacgcaccgaaacgggcattcaccgtttagtgcgcaaaagcccgtttgacagcaataaccgtcgtcacacctcttttgccgccgcctttatttatcctgaaattgacgatgatattgatattgagatcaatccggcagatttgcgtatcgacgtatatcgcgcctccggagccggcgggcaacacgtaaaccggacggaaagtgcggtacggattacccatattccaagcggcattgtagtgcaatgtcaaaacgatcgttctcagcataaaaataaagatcaatgtatgaagcaattgaaagcgaaactttatgaaatggaattgcaaaagaaaaacgcagataaacaggcgttggaagattcaaaatcggatatcggctggggcagccagattcgttcctatgtgcttgatgattcccgcatcaaagatctgcgtacaggcgtagaaaaccgcaatacccaagcggtattggacggcgatctagatcgttttatcgaagccagtttaaaagcgggattgtaa

SEQ ID NO: 73722 - protein, 325 aa, Mannheimia succiniciproducens MBEL55E
MEQPDVWNEPEKAQALGKERSALETVVNTIKKLDQGLEDVDGLLELAVEGEDEETFNEAVTELDELEQQLAKLEFRRMFSGEHDACDCYIDLQAGSGGTEAQDWTEMLLRMYLRWAESKGFKTELMEVSDGDVAGLKSATVKVSGEYAFGWLRTETGIHRLVRKSPFDSNNRRHTSFAAAFIYPEIDDDIDIEINPADLRIDVYRASGAGGQHVNRTESAVRITHIPSGIVVQCQNDRSQHKNKDQCMKQLKAKLYEMELQKKNADKQALEDSKSDIGWGSQIRSYVLDDSRIKDLRTGVENRNTQAVLDGDLDRFIEASLKAGL

SEQ ID NO: 73723 - DNA, 984 bp, Bacillus licheniformis ATCC 14580
  CDS (1)..(984): transl_table=11
atggctgaccccgacttttggggagatcagcagaaagcgcagacgatcattaatgaagcgaatgcgttaaaagactatgtcaacacgtacaaaagtttaagcgagtctcatgaagaactgcaaatgacacatgatcttttaaaagaagatcctgaccaggacctgcaaaatgaactggtcaacgagctgaaaagcttaacaaagcagtttaatgaatttgagctccagctattgttaagcgagccttatgataaaaacaatgcgatccttgagcttcacccgggagccggcggcaccgaatcacaggattggggttcaatgcttctcagaatgtacaccaggtgggcagagcgccgcggattcaaggtggaaacccttgattaccttccaggagatgaggcgggaatcaagtctgtcactctcctgattaaaggccacaatgcctacggttatttaaaagccgaaaaaggcgtgcacaggctcgtcagaatttctccgtttgactcttcagggcgcaggcacacgtcgtttgtgtcttgtgatgtcatgcctgaattcaacgaagaaatcgacattgagatccgtacggaagatattaaagtcgatacgtacagggcaagcggcgccggcggccagcacgtcaatacgacagactccgccgtcaggatcacccacttgccgacaggcgtcatcgtcacttgtcagacagagcgatcacaaattaaaaaccgcgaacgtgccatgaaaatgctgaaatcgaagctgtatcagcgcagaatcgaggagcagcaggcacagctggacgaaattcgcggcgaacaaaaagaaatcggctggggaagccagatccgctcatacgttttccacccgtattctctagtgaaggatcatcgaaccaacacggaaatggggaacgtgcaggcggttatggacggagacattgactctttcattgacgcatatttgcgttccaagctttcctaa

SEQ ID NO: 73724 - protein, 327 aa, Bacillus licheniformis ATCC 14580
MADPDFWGDQQKAQTIINEANALKDYVNTYKSLSESHEELQMTHDLLKEDPDQDLQNELVNELKSLTKQFNEFELQLLLSEPYDKNNAILELHPGAGGTESQDWGSMLLRMYTRWAERRGFKVETLDYLPGDEAGIKSVTLLIKGHNAYGYLKAEKGVHRLVRISPFDSSGRRHTSFVSCDVMPEFNEEIDIEIRTEDIKVDTYRASGAGGQHVNTTDSAVRITHLPTGVIVTCQTERSQIKNRERAMKMLKSKLYQRRIEEQQAQLDEIRGEQKEIGWGSQIRSYVFHPYSLVKDHRTNTEMGNVQAVMDGDIDSFIDAYLRSKLS

SEQ ID NO: 73725 - DNA, 621 bp, Bacteroides fragilis YCH46
  CDS (1)..(621): transl_table=11
atggaaaagacgtatttacaaatcacttcaggacgtggtcctgtagagtgttgccgtgtagtggctttggtactcgaaaaaatattgagagaagcacagaaacggaaattgagagtagaaatcctggaaaaagagactggtcctgtcaatcgcactttgttgtcggtagtcgttgcactcgaaggtgcaggttgcgatgtattggctgacgaatgggaagggactgtgctgtggattgcccgtagcccgtatcggattcatcacaggcggaagaactggtttgtcggtgtgcagacttttctcctgtccgaaagtcgtgaggctaccgaagatgatatccggtatgaaaccttacgggcgtccgggcccggagggcaacatgtcaacaagacagaatctgccgtaagagctgttcatatccccagcggaatcagtgtagtggcatccgaccagcgttcgcaatggcagaataaaaaactggctactgaacgattgttggtcaagctgaccgcttggaacatagagcaagcgatgattcaggcacagaccaattggagcaatcacaacagccttcaaaggggaaacccggtgaagatcattcaggaagaactccggttttaa

SEQ ID NO: 73726 - protein, 206 aa, Bacteroides fragilis YCH46
MEKTYLQITSGRGPVECCRVVALVLEKILREAQKRKLRVEILEKETGPVNRTLLSVVVALEGAGCDVLADEWEGTVLWIARSPYRIHHRRKNWFVGVQTFLLSESREATEDDIRYETLRASGPGGQHVNKTESAVRAVHIPSGISVVASDQRSQWQNKKLATERLLVKLTAWNIEQAMIQAQTNWSNHNSLQRGNPVKIIQEELRF

SEQ ID NO: 73727 - DNA, 1104 bp, Burkholderia mallei ATCC 23344
  CDS (1)..(1104): transl_table=11
atggaagcggaacgtctgaacgcgatcgaaagctccctcgcggacctgcgccggcgcgcgggcgagctacgggggtatcttgactacgacgtcaagtccgaacgtctagccgaagtcaacaagcaactcgaagatccgaacgtctggaacgactcgaagaacgcccaggcgctcggccgcgagaagaaatcgctcgagagcgtcgtcacgacactcaccgcgctcgataacgacctgcgcgacgcgcaggacctgttcgagctcgcgcacgaggaaggcgacgaggaaacgctcgtcgcaaccgaatccgacgcggcgaagctcgaggcgcgcgtcgccgacatcgaattccgccggatgttctcgaacccggccgacccgaacaactgcttcatcgacatccaggcgggcgcgggcggcaccgaggcgtgcgactgggcgtcgatgctgctgcgccagtatctgcgctactgcgagcgcaagggcttcaaggccgaagtgctcgaggaatccgacggcgacgtcgcgggcatcaagaacgcgacgatcaaggtctccggcgaatacgcatacggctacctgcgcaccgaaacgggcatccaccgcctcgtgcgcaagtcgccgttcgattcgtcgggcggccgccacacgtcgttctcgtcggtgttcgtctatccggaaatcgacgattcgatcgaagtcgagatcaacccggccgacctgcgcatcgatacctaccgcgcgtcgggcgcgggcggtcagcacatcaacaagaccgattcggccgtgcggatcacgcacatgccgacgggcatcgtcgtccagtgccagaacgaccgctcgcagcaccgcaaccgcgcggaggcgatggcgatgctcaagtcgcgcctcttcgaagccgagctgcgcaagcgccaggccgagcaggacaagctcgaatcgagcaagaccgatgtgggctggggccaccagatccgctcgtacgtgctcgaccagagccgcgtgaaggatctgcgcacgaacgtcgaaatgagcaacacgaaagccgtgctcgacggcgacctcgacgacttcatcagcgcgagcctcaaacagggcgtgtaa

SEQ ID NO: 73728 - protein, 367 aa, Burkholderia mallei ATCC 23344
MEAERLNAIESSLADLRRRAGELRGYLDYDVKSERLAEVNKQLEDPNVWNDSKNAQALGREKKSLESVVTTLTALDNDLRDAQDLFELAHEEGDEETLVATESDAAKLEARVADIEFRRMFSNPADPNNCFIDIQAGAGGTEACDWASMLLRQYLRYCERKGFKAEVLEESDGDVAGIKNATIKVSGEYAYGYLRTETGIHRLVRKSPFDSSGGRHTSFSSVFVYPEIDDSIEVEINPADLRIDTYRASGAGGQHINKTDSAVRITHMPTGIVVQCQNDRSQHRNRAEAMAMLKSRLFEAELRKRQAEQDKLESSKTDVGWGHQIRSYVLDQSRVKDLRTNVEMSNTKAVLDGDLDDFISASLKQGV

SEQ ID NO: 73729 - DNA, 1098 bp, Methylococcus capsulatus str. Bath
  CDS (1)..(1098): transl_table=11
atgcgcgaactcaatcccctctacaatcagatcaaagacctgaagagccgccaggatgctcttagggggtatcttgacttcgacaccaaacaggaacgcctgaccgaagtcctgcgcgaactggaagacccaagaatctgggacaacccggaacgtgcccaggcgctcggcaaagaacggacccaactggaaggtgtggtcaatcggctgaacgagatcgcggccggcatcgacgacgcggcagagctgctccaactcgcggtcgaggaagacgacgaggacagcgtcgaatcggtcgccgcggatctggcgcactatgaaagcgtcgtcgccgaaatggaattccgtcgcatgttctccggtgagatggacccgaacaatgcgttcctggacatccaggccggctccggcggcaccgaggcccaggattgggcgcagatgctggagcgcatgtacctgcgctggggagagcgcaaaggcttcaagaccgaactggtggaagagtcgccgggcgaggtcgccggcatcaagagcgcgaccatccgcttcgaaggcgaatacgcctacggctggctgcgtaccgaaaccggcgtccaccgactggtgcggaagtcgcctttcgactccggcaaccgccgccatacctcgttttcctcggtgttcgtctcaccggagatcgacgacaacatcgacatcgacatcaacccggccgacctgcgcaccgacgtctaccgggccagcggcgccggcggacagcacgtcaaccgaaccgaatcggcggtgcgaatcacccatctccccaccggtatcgtggtgcaatgccagaatcagcgttcccagcacgccaaccgcgactggtgtatgaagcagctgcgcgccaaactttatgaattggaaatgcagaagcgcaataccgagaagcagaagctggaagactccaaatccgacatcggctggggcagccagatccgctcctatgtgctggaccagtcgcgcatcaaagatctgcgcaccaacgtggaaaccggcaacccccaggcggtgctcgacggcgacctggacatgttcatcgaagccagcctgaagagcggcctgtaa

SEQ ID NO: 73730 - protein, 365 aa, Methylococcus capsulatus str. Bath
MRELNPLYNQIKDLKSRQDALRGYLDFDTKQERLTEVLRELEDPRIWDNPERAQALGKERTQLEGVVNRLNEIAAGIDDAAELLQLAVEEDDEDSVESVAADLAHYESVVAEMEFRRMFSGEMDPNNAFLDIQAGSGGTEAQDWAQMLERMYLRWGERKGFKTELVEESPGEVAGIKSATIRFEGEYAYGWLRTETGVHRLVRKSPFDSGNRRHTSFSSVFVSPEIDDNIDIDINPADLRTDVYRASGAGGQHVNRTESAVRITHLPTGIVVQCQNQRSQHANRDWCMKQLRAKLYELEMQKRNTEKQKLEDSKSDIGWGSQIRSYVLDQSRIKDLRTNVETGNPQAVLDGDLDMFIEASLKSGL

SEQ ID NO: 73731 - DNA, 1119 bp, Nocardia farcinica IFM 10152
  CDS (1)..(1119): transl_table=11
gtgcatcctgacgtttccgctgatctcgccgaactcgacgccaccctcaagacggtcgagtcggtcctcgacatcgaggaactgcgccgccgcatcgatgagctcgaacaccaggccgcggacccggacctgtggaacgaccaggaccatgcccagcgcgtgaccagcgaactctcccacgcgcagggcgagttgcgccgggtcgaagacctgcgcaggcggctcgaggacctgccggtgctctacgaactcgccgagggcgaggagggcgaggccaggacggccgcgctcgaggaggccgacgccgagcgcgccgcgctgcacagcgacgtggaggcgatggaggtccgcaccctgctctcgggcgagtacgacaagcgcgaggcgctggtcaacatccgttccggcgccggtggcgtggacgccgcggactgggccgagatgctgatgcgcatgtacatccgctgggccgaccggcacggctacccggtggaggtctacgacacctcctacgccgaggaggccgggatcaagagcgccaccttcgcggtgaagaccccctacgcctacggcaccctctcggtcgagatgggcacccaccggctggtgcggatcagcccgttcgacaaccagggccgcaggcagacctccttcgccgaggtcgaggtgctgccggtggtggagaccaccgaccacatcgaggtgcccgagaccgagatccgcgtcgacgtctaccgttcgtcgggtccgggcggccagtcggtcaacaccaccgactccgcggtgcgcatcacccacatccccaccggcatcgtcgtgacctgccagaacgagaaatcgcagctgcagaacaagatctcggccatgcgcgtgctgcaggccaagctgctcgaacgcaagcggcaggaggagcgcgccgagatggacgccctcaagaccaacgagggcgcgtcctggggcaaccagatgcggtcgtacgtgctgcacccgtaccagatggtcaaggacctgcgcaccaactacgaggtgaacaatccctcggccgtgctcaatggtgacatcgacggcttcatcgagagcggcatccgctggcgcatgcgcgagagtcaggcgagttag

SEQ ID NO: 73732 - protein, 372 aa, Nocardia farcinica IFM 10152
MHPDVSADLAELDATLKTVESVLDIEELRRRIDELEHQAADPDLWNDQDHAQRVTSELSHAQGELRRVEDLRRRLEDLPVLYELAEGEEGEARTAALEEADAERAALHSDVEAMEVRTLLSGEYDKREALVNIRSGAGGVDAADWAEMLMRMYIRWADRHGYPVEVYDTSYAEEAGIKSATFAVKTPYAYGTLSVEMGTHRLVRISPFDNQGRRQTSFAEVEVLPVVETTDHIEVPETEIRVDVYRSSGPGGQSVNTTDSAVRITHIPTGIVVTCQNEKSQLQNKISAMRVLQAKLLERKRQEERAEMDALKTNEGASWGNQMRSYVLHPYQMVKDLRTNYEVNNPSAVLNGDIDGFIESGIRWRMRESQAS

SEQ ID NO: 73733 - DNA, 1008 bp, Legionella pneumophila str. Paris
  CDS (1)..(1008): transl_table=11
ttggaagaagtaattcgcgaattggaatcatccaatgtgtgggacaatccggaacaggctcaggcattgggacgtgaaagaactcagctggaaactatagtccactcattaagccaattaagccaatcaattagtgatcagagagaactgtttgaattggctcgagaagaagatgatgagcaaaccatcatcgacattggtgatgaattaaaatcaattgagcaacaagtcgccagtttggaatttagaagaatgttttctggcaaaatggaccactccaatgcttatcttgatattcaagcaggttctggcggcactgaagcgcaagattgggctgaaatgttattacgaatgtatttacgttggggagaacatcacggatttaccaccgagttgatagaatgctctcctggtgaagtggcaggaattaaaagtgcgactattcattttacaggtgaatatgcgtttggttggttaaggactgaaacaggtgtccatcgtttagtgagaaagtcgccatttgattctggcaacaggagacacacttcgtttgcagctgtttttgtctctcctgaaattgacgatgatatcgaaattgaaattaatccagctgatttgcggattgatacttacagagcttccggggctggcgggcagcatgttaaccgtactgattctgccgtaaggattacacatatccctagtgggatagtcgttcaatgccagaatgatcgaagccagcataaaaacaaagaccaggcaatgaagcaattgagggcgaagctttatgagttggaaatgcaaaagaaaaatgcagagcagcaagcattggaagctaccaaatctgacattggttggggatcacaaattcgttcttacgtattagaccaatctcgtataaaagatttgcgcaccggtgttgaaaccagtaatactcaggcagtattggatggttcattagatcaatttattgaagccagtttaaaggcaggagtagggcaagcatga

SEQ ID NO: 73734 - protein, 335 aa, Legionella pneumophila str. Paris
MEEVIRELESSNVWDNPEQAQALGRERTQLETIVHSLSQLSQSISDQRELFELAREEDDEQTIIDIGDELKSIEQQVASLEFRRMFSGKMDHSNAYLDIQAGSGGTEAQDWAEMLLRMYLRWGEHHGFTTELIECSPGEVAGIKSATIHFTGEYAFGWLRTETGVHRLVRKSPFDSGNRRHTSFAAVFVSPEIDDDIEIEINPADLRIDTYRASGAGGQHVNRTDSAVRITHIPSGIVVQCQNDRSQHKNKDQAMKQLRAKLYELEMQKKNAEQQALEATKSDIGWGSQIRSYVLDQSRIKDLRTGVETSNTQAVLDGSLDQFIEASLKAGVGQA

SEQ ID NO: 73735 - DNA, 1062 bp, Photobacterium profundum SS9
  CDS (1)..(1062): transl_table=11
atgtatcagcacgtactgacatccttagggggtacctttgactatgatgctaagaaagagcaactagaagaggtcaatgcagaactagagcaaccagctgtatggaatgagccagaacgcgctcaagctctaggtaaatcacgcgcagcattagaagccgtggttgaaactatcgatcaactagacctgggcgtagaagacgttgcgggtttacttgaattagcggtagaagaagacgatcaagaaacatttgatgaaattgagccagaactggcagagctggaagcgaagctagccaagcttgaattccgccgtatgttctcgggtgaatacgattcatcagattgttacatcgacctacaagctggttcgggcggtacagaagctcaggactggacatcaatgatgttacgtatgtatttacgttgggctgatgcaaaaggctttaaaacagagattatcgaagtctctgctggtgatgttgcgggtcttaaatcagcaaccattcgccttgtcggtgagtatgcctacggctggctacgtactgaaactggtgttcaccgtttagtgcgtaaatcaccgtttgattcaggtggtcgccgccatacgtcatttgcttctgcgtttgtttacccagaaattgatgacaacattgttattgatattaacccttctgatttgcgtatcgatgtataccgcgcatcaggagcgggtggtcagcacgtaaacaccacggaatctgcggtacgtattacgcacgttccaaccaacattgtggtgcagtgtcagaatgaccgttctcagcataagaataaagatcaagcgatgaagcagctgaaagcaaaactgtttgagtttgagatgcaaaagaaaaatgctgagaagcaagccaatgaagactctaagtcagacattggttggggcagccaaattcgttcatacgtattggatgactcacgcattaaagatttacgtacaggggtggagaatcgtaacacccaagctgtacttgacggcgatttagaccgttttattgaagctagcctgaaatcaggtctctaa

SEQ ID NO: 73736 - protein, 353 aa, Photobacterium profundum SS9
MYQHVLTSLGGTFDYDAKKEQLEEVNAELEQPAVWNEPERAQALGKSRAALEAVVETIDQLDLGVEDVAGLLELAVEEDDQETFDEIEPELAELEAKLAKLEFRRMFSGEYDSSDCYIDLQAGSGGTEAQDWTSMMLRMYLRWADAKGFKTEIIEVSAGDVAGLKSATIRLVGEYAYGWLRTETGVHRLVRKSPFDSGGRRHTSFASAFVYPEIDDNIVIDINPSDLRIDVYRASGAGGQHVNTTESAVRITHVPTNIVVQCQNDRSQHKNKDQAMKQLKAKLFEFEMQKKNAEKQANEDSKSDIGWGSQIRSYVLDDSRIKDLRTGVENRNTQAVLDGDLDRFIEASLKSGL

SEQ ID NO: 73737 - DNA, 1014 bp, Streptococcus thermophilus LMG 18311
  CDS (1)..(1014): transl_table=11
ttggaagaggacattgcgctccttgaaaaccgaatgactgagccagatttttggaatgataatattgcggctcaaaagacctctcaagagttaaatgagctcaaaatgaaatatgaaactttcaacaacatgaaagagctctctgacgagacagagctttatttggaaatgttggaagaagatgatagcgttcaagaggaactcgaagaaacgctcgaaaaacttgataagattatgacaagttacgagatgacgttgcttttatctgagccatatgaccataacaatgccattcttgaaattcatccaggatctggtggaactgaagctcaggactgggcagaaatgttactccgtatgtaccagcgttatggaaatgccaaaggtttcaaagttgagactttggattatcaggctggtgatgaggctggaatcaaatctgtaactcttgcttttgagggacctaatgcatatggattcctcaagtcagaaatgggtgttcaccgtttggttcgtatctcaccatttgactctgctaagcgtcgtcacacttcatttacatcagtggaagtcatgcctgaattagatgataccattgaagtcgaaatccgtgatgacgatatcaagatggatactttccgatcaggtggtgcaggtggtcagaacgtcaataaggtttctaccggtgtgcgtttgactcacattccaacaggtattgttgtagcttctacggttgaccgtacacaatacggaaacagagaccgtgctatgaagatgcttcaagctaagctctatcaaatggagcaagaaaaaaaagcagaagaagtgaatgccttgaaaggtgataagaaagaaatcacttggggaagtcaaattcgctcatatgttttcaccccatataccatggttaaagatcaccgtacaggctatgaagttgcccaggttgataaagtaatggatggggatattgaaggtttcatcgatgcctacctcaagtggcgtatggaagaatag

SEQ ID NO: 73738 - protein, 337 aa, Streptococcus thermophilus LMG 18311
MEEDIALLENRMTEPDFWNDNIAAQKTSQELNELKMKYETFNNMKELSDETELYLEMLEEDDSVQEELEETLEKLDKIMTSYEMTLLLSEPYDHNNAILEIHPGSGGTEAQDWAEMLLRMYQRYGNAKGFKVETLDYQAGDEAGIKSVTLAFEGPNAYGFLKSEMGVHRLVRISPFDSAKRRHTSFTSVEVMPELDDTIEVEIRDDDIKMDTFRSGGAGGQNVNKVSTGVRLTHIPTGIVVASTVDRTQYGNRDRAMKMLQAKLYQMEQEKKAEEVNALKGDKKEITWGSQIRSYVFTPYTMVKDHRTGYEVAQVDKVMDGDIEGFIDAYLKWRMEE

SEQ ID NO: 73739 - DNA, 984 bp, Geobacillus kaustophilus HTA426
  CDS (1)..(984): transl_table=11
atggccgcgccaaacttttgggatgatcaaaaatcggcgcaggcggtcatttccgaagcgaatgcgctcaaagatctcgtcgaggaattttcctcgcttgaagaacggtttgacaacttggaagtgacgtacgaattgctcaaggaagagccggatgacgagctccaagctgaactcgtcgaggaagcgaaaaagctgatgaaagacttcagcgagttcgagctgcagctgctgctcaacgaaccgtacgaccaaaacaacgccattttggaactccatcccggcgcaggcggcaccgagtcgcaagactgggcgtcgatgcttttgcgcatgtatacgcgctgggcggagaaaaaagggtttaaagtggagacgctcgattacctgccgggcgaggaagccgggattaaaagcgtcacgctgctcattaaagggcacaacgcctacggctatttaaaagcggaaaaaggggtgcatcggctggttcgcatctcgccgtttgacgcctcaggccgccgccatacgtcgttcgtgtcgtgcgaggttgtgccggaattggatgataacattgaaattgagatccggccggaagagctgaaaatcgacacgtaccgctcaagcggcgcgggcgggcagcacgtcaacacgaccgactcggccgtgcgcatcacccacttgccgaccgggatcgtcgtcacgtgccaatcggagcggtcgcaaatcaaaaatcgcgaaaaagcgatgaatatgttgaaggcgaaattgtaccaaaagaaactcgaggagcagcaagccgaactcgctgagctgcgcggcgagcaaaaagaaatcggctggggcaaccaaattcgttcgtacgtcttccatccgtattcgcttgtcaaagaccatcggacgaacgtcgaggtcggcaatgtgcaagcggtgatggatggggaaattgatgtgtttattgacgcgtatttgcgtgcgaagttgaagtaa

SEQ ID NO: 73740 - protein, 327 aa, Geobacillus kaustophilus HTA426
MAAPNFWDDQKSAQAVISEANALKDLVEEFSSLEERFDNLEVTYELLKEEPDDELQAELVEEAKKLMKDFSEFELQLLLNEPYDQNNAILELHPGAGGTESQDWASMLLRMYTRWAEKKGFKVETLDYLPGEEAGIKSVTLLIKGHNAYGYLKAEKGVHRLVRISPFDASGRRHTSFVSCEVVPELDDNIEIEIRPEELKIDTYRSSGAGGQHVNTTDSAVRITHLPTGIVVTCQSERSQIKNREKAMNMLKAKLYQKKLEEQQAELAELRGEQKEIGWGNQIRSYVFHPYSLVKDHRTNVEVGNVQAVMDGEIDVFIDAYLRAKLK

SEQ ID NO: 73741 - DNA, 1017 bp, Anaplasma marginale str. St. Maries
  CDS (1)..(1017): transl_table=11
ttggaggagttagactcccgttgctcatctgcctccttgtgggacgatcaagagaacgcaaagaaattacttagtgaaagagcaagggtagaggaggttctggcttcgttccgtgccttggagaaggagtatgctgagtgcgtcgagttgcttgacttggcagatgaaagcgatagcgagtttctcgacggtttgtggagcgcgttaacccagttggagcgtcgtgtcagccagaaaaaggctgagtgcatgttttctggggaggccgacggcagtgggtgcttcctggttatccgtcctggtgctgggggcacggagagtaatgactgggctgctatgctgctccgcatgtacgtaagatgggcagggacctttcacgggtttactacagaaattgtggataagattgacggtgaagccgcaggattgaaatcggtgacggttaagatatccggaaatggggcgtacggttgggcgaagactgagagcggtgtacataggctggtgcggatatctccgtttgactcttcatcaaggcgccatacaagctttgccagcgtggaagtgtcaccaatagctgatgataaaattgatattgagatacttgagaaggatctgcgtattgacacatacagggcctctggggcgggcggacagcacgtaaataaaaccgagagcgcagtgcgcatcactcacatgccgtcgggtatagtggtgcagtgccagaccagtaggtcccagcatcaaaaccgcgcagaggcgtacagtttgctacgaagtcgcctttacgaaatggagcttcaagaaaaggaaaagaaaatggcccaggaacatgacagcagatgcgatataggatggggtcaccaaatcaggtcgtacgtaatgcacccgtaccgcatggttaaagatttgagaaccgggcacgaaacgggagatgtggatgccgtgctcgacggggatctggataagtttattgctgcggctctgacttacaaattatcccaagcacagaaataa

SEQ ID NO: 73742 - protein, 338 aa, Anaplasma marginale str. St. Maries
MEELDSRCSSASLWDDQENAKKLLSERARVEEVLASFRALEKEYAECVELLDLADESDSEFLDGLWSALTQLERRVSQKKAECMFSGEADGSGCFLVIRPGAGGTESNDWAAMLLRMYVRWAGTFHGFTTEIVDKIDGEAAGLKSVTVKISGNGAYGWAKTESGVHRLVRISPFDSSSRRHTSFASVEVSPIADDKIDIEILEKDLRIDTYRASGAGGQHVNKTESAVRITHMPSGIVVQCQTSRSQHQNRAEAYSLLRSRLYEMELQEKEKKMAQEHDSRCDIGWGHQIRSYVMHPYRMVKDLRTGHETGDVDAVLDGDLDKFIAAALTYKLSQAQK

SEQ ID NO: 73743 - DNA, 1056 bp, Idiomarina loihiensis L2TR
  CDS (1)..(1056): transl_table=11
gtgagcgtagtaattcgcttagggggtatctttgactacgatgctaagttagagcgtctggaagaagttactcgtgagatggaacagcccaatgtgtgggatgatccacccaaggcgcaagctttaggtaaagagcgtgcggcattagagcaagtggtacaaaccctggataaacttcagcaggggctggatgatgtcgagggtcttgttgatcttgcggtagaagcagaagacgaagacacttttaacgaagctcatgaagagctgtccggtttagtgaaacagctggaagctttagagtttcgtcgtatgttttcaaaagacaacgactcggcagactgctacctggatattcagtcaggctccggcggaaccgaagctcaggactgggctaatatgttgctacgcatgtatttgcgctgggcagaagcgcatgactttaaagcggaaattactgagctgtcagaaggcgatgtcgctggtataaaatcggccacggtacgtgtggtcggagaatacgcctacggctggctgcgtactgaaaccggtgtgcaccgtttagtacgtaaatcccccttcgactcaggtaatcgccgccatacatcgttcgcgtcggtttttgtttacccggaagtagatgacgacattgatattgagattgatccgtctgacctgcgggtggatacctatcgggcatcgggtgccggtggtcagcacgttaaccgtaccgattctgcggttcgtttaacgcacgaaccaacaggcattgtggtgcaatgtcagagtgaccgttcgcagcacaagaaccgcgactcagcaatgaaacagctgaaagcgaaattgtacgaatttgaattacagaaacagaacgaagagaaacaggcattagaagactcaaaagctgatatcggctggggcagtcaaattcgctcttatgttctggacgatgcgcgtatcaaagatttacgtacgggtatcgaaaaccgtaatacccaggctgtgcttgatggcgcacttgacccgtttattgaagccagcttgaaaagcgggctgtaa

SEQ ID NO: 73744 - protein, 351 aa, Idiomarina loihiensis L2TR
MSVVIRLGGIFDYDAKLERLEEVTREMEQPNVWDDPPKAQALGKERAALEQVVQTLDKLQQGLDDVEGLVDLAVEAEDEDTFNEAHEELSGLVKQLEALEFRRMFSKDNDSADCYLDIQSGSGGTEAQDWANMLLRMYLRWAEAHDFKAEITELSEGDVAGIKSATVRVVGEYAYGWLRTETGVHRLVRKSPFDSGNRRHTSFASVFVYPEVDDDIDIEIDPSDLRVDTYRASGAGGQHVNRTDSAVRLTHEPTGIVVQCQSDRSQHKNRDSAMKQLKAKLYEFELQKQNEEKQALEDSKADIGWGSQIRSYVLDDARIKDLRTGIENRNTQAVLDGALDPFIEASLKSGL

SEQ ID NO: 73745 - DNA, 1104 bp, Azoarcus sp. EbN1
  CDS (1)..(1104): transl_table=11
atggaagccgaacgcctcaacgccatcgcccagcaactcgacgacctgcgtgcccgcggtcgcgaactccggaggtatcttgactacgacgagaaatcgtcgaaactcgaagaagtaacccgcgctctcgaagacccggccgtctggaacaacgccgagaaggcgcaggaactcggcaaggagaagcgccaactcgaagacgtggtgcacaacctgcgcgatatcgaaagcctgtcttccgacctgaaggacctcttcgatctcgccgaagccgaagacgacgaagacacactcgccgcggtcgaagccgacatcggggagcttcaggcgaaagtgcatgcgctcgaattccgccggatgttctccaatccgatggacccgaacccctgcttcatcgaaatccaggccggggccggcggcaccgaggcgcaggactgggccggcatgctcgaacgcatgtacctgcgctactgcgagcgcaagggcttcaacgtcgagttgatggaagaatccgaaggcgaagtcgccggcatcaagggcgcgacgatcaaggtcagcggcgactacgcgtacggcttcctgcgcaccgaaaccggcatccaccgtctcgtgcgcaagagcccgttcgactcgaacgcgcggcgccacaccagcttctcgtcggtgttcgtgtatccggaagtcgatgattcgatccagatcgacatcaacccggccgacctgcgcatcgacacctatcgcgcttccggcgcgggcggccagcacatcaacaagaccgactccgcggtgcgcatcacgcacgagccgaccggcgtcgtcgtgcagtgccagaacgaccgctcgcagcacaagaacaaggccgaggcgatgtcgatgctgaaagcgcggctgtacgaactggaactgcgcaagcgccagagcgagcagcaaaagctcgaagactcgaagagcgacatcggctggggccaccagatccgctcctacgtgctcgaccagtcgcgcatcaaggatctgcgcacgaactttgaggtcggcaacacccaggccgtgctcgacggcgacctcgacgacttcatcgcggcgagcctgaaacagggcgtctga

SEQ ID NO: 73746 - protein, 367 aa, Azoarcus sp. EbN1
MEAERLNAIAQQLDDLRARGRELRRYLDYDEKSSKLEEVTRALEDPAVWNNAEKAQELGKEKRQLEDVVHNLRDIESLSSDLKDLFDLAEAEDDEDTLAAVEADIGELQAKVHALEFRRMFSNPMDPNPCFIEIQAGAGGTEAQDWAGMLERMYLRYCERKGFNVELMEESEGEVAGIKGATIKVSGDYAYGFLRTETGIHRLVRKSPFDSNARRHTSFSSVFVYPEVDDSIQIDINPADLRIDTYRASGAGGQHINKTDSAVRITHEPTGVVVQCQNDRSQHKNKAEAMSMLKARLYELELRKRQSEQQKLEDSKSDIGWGHQIRSYVLDQSRIKDLRTNFEVGNTQAVLDGDLDDFIAASLKQGV

SEQ ID NO: 73747 - DNA, 1128 bp, Zymomonas mobilis subsp. mobilis ZM4
  CDS (1)..(1128): transl_table=11
atgcgcgccgaagcgcaagcccatgtcgaccatattcaagaatctttggcgctgcttaggcgcttcctcgactgggatagagccttgcggcggctggatgaattgaacgcccgcgtcgaagaccccagcctttgggatgatgcccgcgcggcgcaagaagtgatgcgcgaaagaggacgcttggatgagtccattgcggccacgcgtgctattgcgacagagcttcaggaaaatatcgagctgatcgaaatggccgaggcagaaggtgaagaagaaatggtgcaggacgccatttctgcactggaaagccttgctgagcgcgccgatcgtgacaaagtaaaggctttgctgtctggtgaagccgatggcaatgatacctatattgaagtcaatgccggagccggtggcactgaaagtcaggattgggcagaaatgcttagtcggatgtatcagcgttgggctgaacgccaaggtttcaaggtcgaattggttgactatcatgccggagaacaggccggtattaaatcagcaaccctattggtcaaaggcgaaagtgcctatggctatgccaagaccgaaaacggggtgcatcgtctggtgcgcatttcacctttcgatagtaacgcacgtcgtcacaccagctttgcttctgttgctgtttaccctgtggtagatgacgatattgatatcgaagttttggataaagatttaaaaattgatacctatcgttcatcgggtgccggtggtcagcatgtgaatacgacggattctgccgttcgtattacccatatgccgacgggtattgtcgttgcctgccagaaccagcgttcccagcataagaaccgtgccgaagcgatgaagcagttgaaggcgcgcctttatgaacgcgaattacaaattcgtgaagccgaagccagtgccggttatgctgccaagagcgaaatcggatgggggcatcagatccgttcttatgtcttgcaaccttatcagctggtaaaagatttacgaactggcattacttcgacggctccggctgatgtgctggatggtaatttggatgcctttattgctgcggctttggcgcaacggattaccggtgaaaccgttgaagtcgaagatgtagaatag

SEQ ID NO: 73748 - protein, 375 aa, Zymomonas mobilis subsp. mobilis ZM4
MRAEAQAHVDHIQESLALLRRFLDWDRALRRLDELNARVEDPSLWDDARAAQEVMRERGRLDESIAATRAIATELQENIELIEMAEAEGEEEMVQDAISALESLAERADRDKVKALLSGEADGNDTYIEVNAGAGGTESQDWAEMLSRMYQRWAERQGFKVELVDYHAGEQAGIKSATLLVKGESAYGYAKTENGVHRLVRISPFDSNARRHTSFASVAVYPVVDDDIDIEVLDKDLKIDTYRSSGAGGQHVNTTDSAVRITHMPTGIVVACQNQRSQHKNRAEAMKQLKARLYERELQIREAEASAGYAAKSEIGWGHQIRSYVLQPYQLVKDLRTGITSTAPADVLDGNLDAFIAAALAQRITGETVEVEDVE

SEQ ID NO: 73749 - DNA, 1128 bp, Silicibacter pomeroyi DSS-3
  CDS (1)..(1128): transl_table=11
atgcgcgccgaaatccagaacgttgtcaccgatatccagaaatccctgcgcctgcttgcacagcggatggatcaggagaccgcgcagcatcggctggaggagttcaacgcgcgtgttgaggatccgaacctgtgggacaatcccgaaaacgcgcagaaactgatgcgcgagcgtcagacgctggtcgatgcgctggacatctacaaggggatcgagaccgatcttgccgacaatatcgagctgatcgaactgggcgaaatggaagacgaccaggatgtgatcaaggatgccgaggcggcgctgaaggctctgcgcgagcgcgccgccgagaaggagctggaagcactcttggacggcgaggccgatggcaatgacacctttctggagatcaacgcgggtgccggcgggaccgagagctgcgactgggcctcgatgctggcgcggatgtatgtgcgctgggccgagaagaagggctataaggtcgaactgcaatccgagagcgcgggcgacgaggccgggatcaaatcggcggcctacaagatttccggccacaacgcctatggctggctgaaatcggaaagcggcgtgcaccggctggtgcggatttcgccctatgacgcggcggccaagcggcacacctcgttcagctcggtctgggtctatccggtggtcgacgacaatatcgagatcgaggtgaaccccagcgatatccgcatcgatacctaccggtcatccggcgcgggcgggcagcacgtgaacacgacggactcggcggtgcggatcacgcacatcccgaccggcatcgtggtgaccagttccgagaaatcgcagcaccagaaccgcgacatcgccatgaaggcgctgaaatcgcggctctaccagcaggagctggaccgccgcaacgccgagatcaacgccgcgcatgaggccaagggcgatgccggctggggcaaccagatccggtcctacgtgttgcagccctatcagatggtcaaggacctgcgcaccggacacgagaccagcgataccaagggggttctcgacggtgctctggacgggttcatggcggcgacgctggccatgaaggtttccggcaaaagccgcgccgacgcccagtccgaagactga

SEQ ID NO: 73750 - protein, 375 aa, Silicibacter pomeroyi DSS-3
MRAEIQNVVTDIQKSLRLLAQRMDQETAQHRLEEFNARVEDPNLWDNPENAQKLMRERQTLVDALDIYKGIETDLADNIELIELGEMEDDQDVIKDAEAALKALRERAAEKELEALLDGEADGNDTFLEINAGAGGTESCDWASMLARMYVRWAEKKGYKVELQSESAGDEAGIKSAAYKISGHNAYGWLKSESGVHRLVRISPYDAAAKRHTSFSSVWVYPVVDDNIEIEVNPSDIRIDTYRSSGAGGQHVNTTDSAVRITHIPTGIVVTSSEKSQHQNRDIAMKALKSRLYQQELDRRNAEINAAHEAKGDAGWGNQIRSYVLQPYQMVKDLRTGHETSDTKGVLDGALDGFMAATLAMKVSGKSRADAQSED

SEQ ID NO: 73751 - DNA, 978 bp, Francisella tularensis subsp. tularensis Schu 4
  CDS (1)..(978): transl_table=11
atggagctagaagatggttctatttgggataatccagagtatgcacaaaacttgggtaaacaaaaagtagaacttgagaacgttgtacacaattgtgagtatatctcagaaactctagaaactttaagtgaactgcttgagcttggtgaagaagatgaatctttaatgcaagaaattgctaaagatacacaaaatgttgctagtgaaattgagaagcttgagtttcgtcgcatgttttcaggtaaaatggatgctaataacgcctttttggatattcagtcaggttctggaggtacagaggcgcaagattgggcagagatgctgatgcggatgtatatgcgttgggcagatagtcacggcttcaaggtaaccgttgatgatgtatcagatggtgatgttgcgggtataaaaggctgcaccttaaaaatagagggagagtatgcttatggttggttgcgtaccgaaactggtattcataggttagtacgcaaatcaccttttgactcaaacagtaaacgtcatacatcttttgcatcggtgtttatctcacctgaggttgatgatgatattgatattgagataaatcctactgatttacgagtcgatacttatcgtgcatcaggtgctggtggtcagcatgtcaacaaaacagactctgctgtgagaataacgcatattccgacaaatattgtggtacaaagtcaaagtgatagatctcagcataaaaatagagataatgccatgaaacagcttaagtcaaagctatatgaaatggagttacaaaagcgtaatgctgaaaagaatgcactcgaagactcaaaggcagatattggttggggtagtcagattcgttcgtacgtgttggatcagtcacgaattaaggatttaagaacaggagttgagaatactaatacacaagcggtattagatggtgatttggataagtttattgaggctagcttaaaaagtgggttataa

SEQ ID NO: 73752 - protein, 325 aa, Francisella tularensis subsp. tularensis Schu 4
MELEDGSIWDNPEYAQNLGKQKVELENVVHNCEYISETLETLSELLELGEEDESLMQEIAKDTQNVASEIEKLEFRRMFSGKMDANNAFLDIQSGSGGTEAQDWAEMLMRMYMRWADSHGFKVTVDDVSDGDVAGIKGCTLKIEGEYAYGWLRTETGIHRLVRKSPFDSNSKRHTSFASVFISPEVDDDIDIEINPTDLRVDTYRASGAGGQHVNKTDSAVRITHIPTNIVVQSQSDRSQHKNRDNAMKQLKSKLYEMELQKRNAEKNALEDSKADIGWGSQIRSYVLDQSRIKDLRTGVENTNTQAVLDGDLDKFIEASLKSGL

SEQ ID NO: 73753 - DNA, 987 bp, Bacillus clausii KSM-K16
  CDS (1)..(987): transl_table=11
atggctgatcctgatttttggaatgaccaggagcaagcgcaagcgatcattaatgaaacaaatggtttaaaagaacaagtccatacattcaaagacatggctgaaagctatgacgacttggaagtcagttatgagcttgttcgggaagaggacgacactgaactggcaagtgaactggaatcgggccttgctgcgcttaaacaaaaaatgaaccaatttgagttgcaattgcttttaagtgccccttacgataaaaacaatgccattttagaactccatcctggcgcaggcggaactgaatcccaggattgggcttctatgttgctaaggatgtacacgcgctgggcagaaaagcgtgggtttgctgtcgagacgctcgactatctccctggtgaggaggccggcgtcaaaagcgtcacgctgcttataaaagggcataacgcatatggctatttaaaagcagagaaaggtgtgcaccgcctcgtgcgaatttcgccatttgactcatccgggaggcggcatacgtcctttgtgtcatgcgaagtgatgccggaattagatgatgcagttgacattgaactaaatagcgaagacttaaaaatcgatacgtatcgtgcgagtggggcgggcggccagcatgtcaacacgactgactcggctgtgcggattacccacttgccgaccaatacggttgtgacttgtcagagcgaacgttcccaaattaaaaaccgggaacaagcaatgaaaatgatgaaagcgaaactgtatcaactgcggattgaagagcaagagcgtgaacttgctgaaattcgtggcgaacaaaaagaaattgggtggggaagccaaattcgctcctatgtgttccatccttattcaatggtgaaagaccaccgcactggctttgaaattggcaatacgaacagtgtcatggatggagagattgacgggtttattgacgcttacctgagacaatcgctggcaatgtag

SEQ ID NO: 73754 - protein, 328 aa, Bacillus clausii KSM-K16
MADPDFWNDQEQAQAIINETNGLKEQVHTFKDMAESYDDLEVSYELVREEDDTELASELESGLAALKQKMNQFELQLLLSAPYDKNNAILELHPGAGGTESQDWASMLLRMYTRWAEKRGFAVETLDYLPGEEAGVKSVTLLIKGHNAYGYLKAEKGVHRLVRISPFDSSGRRHTSFVSCEVMPELDDAVDIELNSEDLKIDTYRASGAGGQHVNTTDSAVRITHLPTNTVVTCQSERSQIKNREQAMKMMKAKLYQLRIEEQERELAEIRGEQKEIGWGSQIRSYVFHPYSMVKDHRTGFEIGNTNSVMDGEIDGFIDAYLRQSLAM

SEQ ID NO: 73755 - DNA, 1104 bp, Ehrlichia ruminantium str. Welgevonden
  CDS (1)..(1104): transl_table=11
atggtaactaaatcttatattgacgaagaattagtaaacttaaataaagctttacaactaattcgaggttaccttgacattgataatctgacaagcttattagttgatcttaatacaaagtgtgctgatacgtctttatggaatgataatttaacagcacatcatgttttatctgaacgtgctagaatatctaagatcgtaggtttatttacagaattagaagaagaatatcagtattacaatgaactactttctgtcataagtaatgatagcgatagcctacttgatgatttatctaaaggcttagaagcattaaaagaaaaagtcaaaaaaaaagaagttgaatgtttgttttctgatgaagcagatcaaaacgattgttttatagaaattcaatctggtgctggtggtacagaaagtaatgattggtctaatatgctcttacgaatgtacataaggtgggcagaaatatatcataattttaaaacacaagttgtgtataagttagacggtgaagaaactggtgtaaaatctgccattattaaagttataggatacaatgcatatggatggtcaaaaaccgaaagtggtattcacagattagtacgtatatcaccatttaattcaaatgcaaagcgtcatactacatttgcaagtgtattagtatctccagttacaaatgagaattttgatattcaaattcacgataaagatctacgtatagatacatatagagcatctggagcaggtggacaacacgtcaacaaaacagaaagtgctgttcgtattacacacattccatcaggaatcgtagttcaatgtcaaaataatagatctcaacatcaaaatttgggtgaagcatacaacttgttaagaagcagattgtatcaattaaaattacaagagaaagaaaaaaaaatggcacaagaacatagccaaagatgtgatataggatggggaaaccaaattaggtcatatgtcatgcacccatatcaaatggtaaaagatatacgtacaggatatgaaactggtaatgtcaactcagtactagatggagacttagatgcgtttattatagcaacattaacaaaaaaaattacataa

SEQ ID NO: 73756 - protein, 367 aa, Ehrlichia ruminantium str. Welgevonden
MVTKSYIDEELVNLNKALQLIRGYLDIDNLTSLLVDLNTKCADTSLWNDNLTAHHVLSERARISKIVGLFTELEEEYQYYNELLSVISNDSDSLLDDLSKGLEALKEKVKKKEVECLFSDEADQNDCFIEIQSGAGGTESNDWSNMLLRMYIRWAEIYHNFKTQVVYKLDGEETGVKSAIIKVIGYNAYGWSKTESGIHRLVRISPFNSNAKRHTTFASVLVSPVTNENFDIQIHDKDLRIDTYRASGAGGQHVNKTESAVRITHIPSGIVVQCQNNRSQHQNLGEAYNLLRSRLYQLKLQEKEKKMAQEHSQRCDIGWGNQIRSYVMHPYQMVKDIRTGYETGNVNSVLDGDLDAFIIATLTKKIT

SEQ ID NO: 73757 - DNA, 1089 bp, Dehalococcoides ethenogenes 195
  CDS (1)..(1089): transl_table=11
atgcaagacatattaagtgaacttaagagccgcattctttccgatatggtgcgacttgacattgctgctaaagaactggaaataaccgaactggaaagtgcctctgccagccctgatttctggcaggaccagcaaaatgcccagaaggctatgaaaaagctggccgccaacaagcgggtttcagaggtttggcggggtttggagcagcgggtaaatgacctcttggagctgtttgcattaactcacgaagacccttctttagggaatgaaatagagcgtgaggtgaatactcttactgccgagattgatactctggaagtaggcttagctttttccggccagtatgacagccggaatgccttgcttacggtgcatgccggagcgggcggggtggagtctcaggactgggctggtatgcttctgcggatgtttatgcgctgggcagaaaagaagggttttggtatggaagtactagaccagagccccggtgaagaagccggtataaagagtgccactctgcagatagagggtgaatatgcttatggctttctgaagagcgagcatggggtgcatcgccttatcaggctttccccatttgacgctgaccacgcccgccatacttcgtttgctttggtagaggtaatgcctgaagccgaagacagtgtggatattgatataaaaccggaagatattaaaattgatatgttccgttccagcggtccgggcggacagaatgttcagaaagtttcaacagcggtgcgggttacccacataccttcggggattgtggttgccagccagacagagcgcagccagcaccagaaccgtgaaattgccatgcggatactggcctccaagctgctggcggtggagattgccaagcgggcggaagaacgtgccaagattaaaggtgagcgtatttctgccgaatggggcaatcagatacgcagttacgtgctccacccctataaaatggtcaaagaccaccggacagattatgaggtgggtaatgcggaagctgtacttgaaggtgaactggacggctttataaatgcctatctcaggcagaatataggaagggaagaatga

SEQ ID NO: 73758 - protein, 362 aa, Dehalococcoides ethenogenes 195
MQDILSELKSRILSDMVRLDIAAKELEITELESASASPDFWQDQQNAQKAMKKLAANKRVSEVWRGLEQRVNDLLELFALTHEDPSLGNEIEREVNTLTAEIDTLEVGLAFSGQYDSRNALLTVHAGAGGVESQDWAGMLLRMFMRWAEKKGFGMEVLDQSPGEEAGIKSATLQIEGEYAYGFLKSEHGVHRLIRLSPFDADHARHTSFALVEVMPEAEDSVDIDIKPEDIKIDMFRSSGPGGQNVQKVSTAVRVTHIPSGIVVASQTERSQHQNREIAMRILASKLLAVEIAKRAEERAKIKGERISAEWGNQIRSYVLHPYKMVKDHRTDYEVGNAEAVLEGELDGFINAYLRQNIGREE

SEQ ID NO: 73759 - DNA, 1128 bp, Rhodobacter sphaeroides 2.4.1
  CDS (1)..(1128)
atgcgcaccgagacccagaaccaagtcgaggccatccggcgctcgctcgcgctgctcggccagcgcatggatctcgagaccgcgccgcaccggctcgaggaattcgacgcgatgatcgaggacggcaacctgtggaacgatccggcccgcgcgcagaagctgatgcgcgagcgccagcagctcatggaccagctctcgacctacaggctgatcgacaccgggctgcgcgacaatgtcgagctgatcgagctcggcgaggccgagggcgacgaggagatcgtgaccgaggccgaggcgtcgatccgcgcgttggtcgagacggcccgcgcgaaggagctcgaggcgctgctcgacggcgaggcggacggcaacgacacgttcctcgagatcaatgcgggcgcgggcggcaccgagagctgcgactgggcctcgatgctggcgcggatgtatgtccgctgggccgaacgcaagggctacaaggtcgagctgcagtcggaatcggcgggcgaggaggcgggcatcaagtcggctgcctacaagatctcggggccgaacgcctatggctggctgaagtcggagagcggcgttcaccggctggtgcggatctcgccctacgactcggcggcgcggcggcacacctccttctcgtcggtctgggtctatccggtggtggacgacaatatcgagatcgagatccctgcgaacgacatccgcatcgacacctatcgctcgtccggtgcgggcggacagcacgtcaacaccaccgactcggcggtgcggatcacccaccttcccaccaatatcgtcgtgacctcctcgatgaagtcgcagcaccagaaccgcgaggcggcgatgaacgcgctgaaggcccggctctaccaactcgagctcgacaagcggaacgccgcgatcaacgcccagcacgaggccaagggcgaggcgggctggggcaaccagatccgctcctatgtccttcagccctatcagatggtgaaggacctgcggacgggcgtcgagacctcggacacgcagggcgtgctcgacggcgatctggaccggttcatgcaggcgacgctcgcgcaggatgtggccggcaagagccgcgcggaagccaacgccgaagagtaa

SEQ ID NO: 73760 - protein, 375 aa, Rhodobacter sphaeroides 2.4.1
MRTETQNQVEAIRRSLALLGQRMDLETAPHRLEEFDAMIEDGNLWNDPARAQKLMRERQQLMDQLSTYRLIDTGLRDNVELIELGEAEGDEEIVTEAEASIRALVETARAKELEALLDGEADGNDTFLEINAGAGGTESCDWASMLARMYVRWAERKGYKVELQSESAGEEAGIKSAAYKISGPNAYGWLKSESGVHRLVRISPYDSAARRHTSFSSVWVYPVVDDNIEIEIPANDIRIDTYRSSGAGGQHVNTTDSAVRITHLPTNIVVTSSMKSQHQNREAAMNALKARLYQLELDKRNAAINAQHEAKGEAGWGNQIRSYVLQPYQMVKDLRTGVETSDTQGVLDGDLDRFMQATLAQDVAGKSRAEANAEE

SEQ ID NO: 73761 - DNA, 1017 bp, Xylella fastidiosa Dixon
  CDS (1)..(1017)
atgacccgtgagctggaaagccccacgatctggaatactccagactatgcgcagcaactgggccgggaacgttcgctactggataagaccgtcaccggcattgctcatgtgctgaacggggtcgctgaagccagcgaatttttggatctggctgaaatagagcaagatcaggagatgttgcaggctgtcctgaacgacgtggacatctatcaacttcaggtcgagaaactggagtttcagcgcatgttttccgggaagatggacggtgccaatgcgtttgttgacatccaggcgggtgctggagggaccgaggcccaagattgggcagagatgctgctgcgtatgtatttgcgttgggccgaggggcgtggttggaaggccgaattgcttgaagtttctggcggtgaagtggccggcatcaaatcagccacgtttcgcgtggagggcgattttgcctacggttggttgaagacggagactggggtgcatcgtttggtgcgtaagtcgccatttgattcggataaccgtcgccatacgagttttacctctgtctttgtttccccggaggtcgatgacaacatcgacattgagattaacccggccgacttgaagaccgatgtataccgctcctctggggctggtggtcagcacgtgaacaagactgagtctgcagtacgtatcacccacgtaccgagtgggattgtggtggcctgccagacggaacgtagtcagcatgctaaccgtgatcgtgcgatgaagatgctggcggccaagttgtacgagtcggagatccagaagcggaatgccgaaaaagacgtacttgaggcctctaagtctgatatcggctgggggagtcagattcgcaattacgtattggatcagagtcggattaaagatcttcgtactggcgttgagcgcagcgatactcagaaagtacttgacggcgatttagatgagtttattgaagcgagtttgaaggctggtttggaagcaggcgctaaacgcgccgatgcatga

SEQ ID NO: 73762 - protein, 338 aa, Xylella fastidiosa Dixon
MTRELESPTIWNTPDYAQQLGRERSLLDKTVTGIAHVLNGVAEASEFLDLAEIEQDQEMLQAVLNDVDIYQLQVEKLEFQRMFSGKMDGANAFVDIQAGAGGTEAQDWAEMLLRMYLRWAEGRGWKAELLEVSGGEVAGIKSATFRVEGDFAYGWLKTETGVHRLVRKSPFDSDNRRHTSFTSVFVSPEVDDNIDIEINPADLKTDVYRSSGAGGQHVNKTESAVRITHVPSGIVVACQTERSQHANRDRAMKMLAAKLYESEIQKRNAEKDVLEASKSDIGWGSQIRNYVLDQSRIKDLRTGVERSDTQKVLDGDLDEFIEASLKAGLEAGAKRADA

SEQ ID NO: 73763 - DNA, 999 bp, Lactobacillus gasseri
  CDS (1)..(999)
atggcagaacctggtttttgggatgatcaagaacaagcacaaagtttaattaatgaaactaatcggatgaaagaaaagagtgaaaattttaaacgactagaagagaagtttgaagatgctcagacagccttagaattacttaaagctgatccagatcccgagttaagtgaagaactatctaaagaaatgttttcattatcacaaagttttcatgattatgaattatcattattgttatcagataaatatgaccaacataatgctttaatggaaatccaccctggtgcaggtggtacagaagccatggattgggctgacatgcttttaagaatgtatcaacgctatgcagctaatcataatttgaaatttgaaatcgaagattatgaacctggtgaagaagcaggagttaaaagtgtaagtgtcagaattcaaggtaagaatgcttttggattacttaagtcggaaaatggtgtccaccggctagtcagaatctctccctttgattccgctaaaagacgacacacatcttttgcttcggttgaggttatacctgagattgatcagagcattgaagttgatattaatccagatgatttaaggattgatgtttatcgttcaagcggtgcaggtggtcaacatattaacaagacttcaagtgctgttagaattactcacttacctactggaattgttacatcatcacaagcgcaacgttctcaattgcaaaatagagaaactgcaatgaatatgttgcgtgcaaaattgttccagctagaagaggaaaaaaagaagaaacaaacagaagaactcaaaggtaatcaaaaagaaattggttttggctctcaaattcgttcatatgtctttcatccttataatatggtgaaggaccatcgaactaattttgaaacaagtgacgtgaatggcgtaatggatgggaaattagatgattttatctatgcgtatttacagtggcttttaagtcaaaaaaatccaaactaa

SEQ ID NO: 73764 - protein, 332 aa, Lactobacillus gasseri
MAEPGFWDDQEQAQSLINETNRMKEKSENFKRLEEKFEDAQTALELLKADPDPELSEELSKEMFSLSQSFHDYELSLLLSDKYDQHNALMEIHPGAGGTEAMDWADMLLRMYQRYAANHNLKFEIEDYEPGEEAGVKSVSVRIQGKNAFGLLKSENGVHRLVRISPFDSAKRRHTSFASVEVIPEIDQSIEVDINPDDLRIDVYRSSGAGGQHINKTSSAVRITHLPTGIVTSSQAQRSQLQNRETAMNMLRAKLFQLEEEKKKKQTEELKGNQKEIGFGSQIRSYVFHPYNMVKDHRTNFETSDVNGVMDGKLDDFIYAYLQWLLSQKNPN

SEQ ID NO: 73765 - DNA, 1119 bp, Leuconostoc mesenteroides subsp. mesenteroides ATCC 8293
  CDS (1)..(1119)
atggaaattatcgatgcaaagcatgccgtcagtgatatgcaggagaatatcgaacgttttcgcggaacgctcgatatggaagcacttacggaagaaattgctgattatgaaaatcgtatgacggaacctgatttttggaacgacaatgaaaaagcgcaaaaggttattgaagaaaataatgttttaaaaaatcgtcgtgattcatttttgaatttaacaaatcaagttgaagaattagaactattaatagaaatggctgtggaagatcctgaggatgaggacacgctaggtgaacttgaagcaggggttgcgaaggcgcaaaaagatattgatgcttataatttagagcaactattaactgagccgtatgatgcaaataatgccattttagaaattcatccaggttctggtggtactgagtcgacagactggggtgctaacctatatcgtatgtacacgcgttgggcacagcaacatgattttcaagttgaaaccttagattatcatgcaggagatgaagcgggtattgatagtgcaacgattaaagtaactggacataatgcctatggctttttacgaagcgaaaaaggtgtgcaccgtttcgtaagaatttctccttttgatagcgctggtcgacgtcatacgagtttcgtatcagttgatgtaatgcctgagctagacgattcaattgaggttgaggtacgtgatgatgatgttaaaatggatgtgttccgttctggtggcgccggtggacaaaacgtcaacaaagtttcaacaggtgttcgtctaacgcatgaaccgacaggaattgttgtttcatcaactgtagagcgtactcagtatggtaaccgtgattatgccatgcgtctgttgaaaagtaagctataccagttggaattagagaaaaaagaagctgagcgtgcggcgttgacaggcgaaaaaatggaaaatggttggggatcacagattcgctcttacgttttgcacccctatcaaatggttaaggatcatcgaacaaattatgaaactaaccaaccacaagcagtactggatggtgatttagatcctttcatcaatgcgtacttgcagtggcagttatcacttaaaaatcctaattaa

SEQ ID NO: 73766 - protein, 372 aa, Leuconostoc mesenteroides subsp. mesenteroides ATCC 8293
MEIIDAKHAVSDMQENIERFRGTLDMEALTEEIADYENRMTEPDFWNDNEKAQKVIEENNVLKNRRDSFLNLTNQVEELELLIEMAVEDPEDEDTLGELEAGVAKAQKDIDAYNLEQLLTEPYDANNAILEIHPGSGGTESTDWGANLYRMYTRWAQQHDFQVETLDYHAGDEAGIDSATIKVTGHNAYGFLRSEKGVHRFVRISPFDSAGRRHTSFVSVDVMPELDDSIEVEVRDDDVKMDVFRSGGAGGQNVNKVSTGVRLTHEPTGIVVSSTVERTQYGNRDYAMRLLKSKLYQLELEKKEAERAALTGEKMENGWGSQIRSYVLHPYQMVKDHRTNYETNQPQAVLDGDLDPFINAYLQWQLSLKNPN

SEQ ID NO: 73767 - DNA, 948 bp, Desulfitobacterium hafniense DCB-2
  CDS (1)..(948)
atgatgcaggagctttcttatcaacaggagaaagtcaaaacctattacaccttgcagcagcagctggatgatatgctcaccctctatcaaatggcggtggaagaaaaggatgaatccctggagcctgaacttgaggaaggaatcctggctctgcagcaacggctggatggtttggagctggagattctgctcagcggtccctatgatcggaataatgccatagttaccctgcatgcgggagccggcggcacagaagcccaggactgggtatccatgctgtatcggatgtatatccgctatggagaacgccacggttataaagtggaaaccatggatttcctgcccggcgatgaagcagggattaagagtgcgaccttatcctttgcgggagaaaatgccttcggctatttgaaagcggagaaaggggttcaccgtttagtgcggatatctccctttgacgcttcgggacgccgtcatacctcttttgcctctgtggatgttatacctgaggtgatggaggataatgctgaaattcagattccgcccgaagatctcaaggtggatacctaccgggccagcggtgcggggggacagcatgtcaataagaccagttctgcggtccggatcactcacttacccacggggattgtggtccagtcccaaagtgagcgttctcagattcagaacagggcctactgcttgcgcatcctgcaagccaagctcctggagctgaagcgcaaacagcaggaagatgaaatttcggagattcgcggggaacaacaggagatcgcgtggggaagccagattcgctcctatgtgttccatccttataatatggttaaggatcaccggaccaatgaggaaacagcgaataccggagctgtcatggacggagagattgaccagtttatcgctgcttatctgcaaaagaccaaagctgttcagtaa

SEQ ID NO: 73768 - protein, 315 aa, Desulfitobacterium hafniense DCB-2
MMQELSYQQEKVKTYYTLQQQLDDMLTLYQMAVEEKDESLEPELEEGILALQQRLDGLELEILLSGPYDRNNAIVTLHAGAGGTEAQDWVSMLYRMYIRYGERHGYKVETMDFLPGDEAGIKSATLSFAGENAFGYLKAEKGVHRLVRISPFDASGRRHTSFASVDVIPEVMEDNAEIQIPPEDLKVDTYRASGAGGQHVNKTSSAVRITHLPTGIVVQSQSERSQIQNRAYCLRILQAKLLELKRKQQEDEISEIRGEQQEIAWGSQIRSYVFHPYNMVKDHRTNEETANTGAVMDGEIDQFIAAYLQKTKAVQ

SEQ ID NO: 73769 - DNA, 867 bp, Nostoc punctiforme PCC 73102
  CDS (1)..(867)
ttggagttagaaaccgatgaggcactactccaagaagcagaatctaccatcactaaactgaatcgtgatctggatcagtgggagttacaacagttactttccggcccctatgatgcggaaggcgctgtactgacgattagtgctggtgctggtggcacagatgctcaggactgggcatttatgctgatgcggatgtacacccgttggggcgaagctcacggctataaggtaactttagctgaagagtcggagggtgatgaagccggaattaaatcggcaaccctagaaattactggtcgctatgcctatggttacttgcgttcagagatgggtacacatcgcttagtgcggatttcaccttttaatgccaacggcaaacgacaaaccagttttgcaggggtggaagtgatgccgcagattgataactctgtgcaattggagattccagataaggatttggaaatcaccacaactcgttctggtggtaaaggtgggcaaaacgtcaacaaagtagaaactgcggtgcggattgttcacattcctactggtcttgccgtgcgctgtacagaagagcgatcgcagttgcaaaataaagaaaaagccctaaatcgtctcaaagcaaagctgttggtcatcgccaaagagcaacgcgcccaagaaattgccgagattcgtggcgatatggtggaagcctcctggggaaaccaaatccgtaactatgtgtttcacccttaccaaatggtgaaagatttacgtacaaatacagaaacaacggcgattggcgatgtgatgaatggcgaactcgatccattcattcaagcttatttgcgtcaagaaaacaaattagtagaaaacactaactcataa

SEQ ID NO: 73770 - protein, 288 aa, Nostoc punctiforme PCC 73102
MELETDEALLQEAESTITKLNRDLDQWELQQLLSGPYDAEGAVLTISAGAGGTDAQDWAFMLMRMYTRWGEAHGYKVTLAEESEGDEAGIKSATLEITGRYAYGYLRSEMGTHRLVRISPFNANGKRQTSFAGVEVMPQIDNSVQLEIPDKDLEITTTRSGGKGGQNVNKVETAVRIVHIPTGLAVRCTEERSQLQNKEKALNRLKAKLLVIAKEQRAQEIAEIRGDMVEASWGNQIRNYVFHPYQMVKDLRTNTETTAIGDVMNGELDPFIQAYLRQENKLVENTNS

SEQ ID NO: 73771 - DNA, 990 bp, Pseudomonas syringae pv. syringae B728a
  CDS (1)..(990)
atgaaccgcgagctcgaagatccaaacgtctggaacaacccggcctacgctcaggaactggggcgcgagcgctccctgctggcgcagatcgtcgaaaccctggacgaaatgtcctcgggtctggccgatgccaaagacctgttgctgatgtctgccgaagaagaagaccaggctgccgtcgatgacgtcgctgccgaagtcgagcgcctgcgcgaatcgctggaaaagctcgaattccgccgcatgttcagcggcgacatggaccccaacaacgcctacctggacatccaggccggctccggcggtaccgaagcgcaggactgggcgaacatcctgctgcgcatgtacctgcgctgggccgacaagcgcggtttcgacgccaccatcatggaactgtccgccggtgaagtcgccggtatcaagggcgctaccgtgcacatcaagggcgagtacgccttcggctggctgcgtaccgagatcggcgttcatcgtctggtgcgcaagagcccgttcgactccggcaaccgtcgccacacctcgttctcggccgtgttcgtttcgccggaaatcgatgacaacatcgaaatcgacatcaacccggcggacctgcgcatcgacacctaccgctcctccggtgccggtggtcagcacgtaaacaccactgactcggcggtgcgtatcacccacgttccgaccaacaccgtggtcagttgccagaacgagcgttcccagcatgcgaacaaggacaccgccatgaaaatgctgcgggcccgtttgtatgagcaggaagtgcagaagcgcaacgcggcgtcccaggcgctcgaagacaccaagtccgatatcggctggggtcaccagattcgctcctacgtactggacgcctcgcgtatcaaggacctgcggaccaacatcgaacgcagcgactgcgacaaggtgcttgatggcgatatcgacgaatacctgatcgcgagcctcaagcaagggctgtaa

SEQ ID NO: 73772 - protein, 329 aa, Pseudomonas syringae pv. syringae B728a
MNRELEDPNVWNNPAYAQELGRERSLLAQIVETLDEMSSGLADAKDLLLMSAEEEDQAAVDDVAAEVERLRESLEKLEFRRMFSGDMDPNNAYLDIQAGSGGTEAQDWANILLRMYLRWADKRGFDATIMELSAGEVAGIKGATVHIKGEYAFGWLRTEIGVHRLVRKSPFDSGNRRHTSFSAVFVSPEIDDNIEIDINPADLRIDTYRSSGAGGQHVNTTDSAVRITHVPTNTVVSCQNERSQHANKDTAMKMLRARLYEQEVQKRNAASQALEDTKSDIGWGHQIRSYVLDASRIKDLRTNIERSDCDKVLDGDIDEYLIASLKQGL

SEQ ID NO: 73773 - DNA, 1077 bp, Desulfovibrio desulfuricans G20
  CDS (1)..(1077)
atgcccttctccagcagtttgaaacgctctgggggcgcctttgaccacgcgcagagtaaatacaggctggaagagatagaaaaacagctgtccagtccagacgcgtggaatgcgccggaaaaacttacgccggtgctgcgggaaaaaagtcagcttgaaaacagcgttgcgcggctggacgcactgcggcaggccaaggacgacatgcagggctggcttgagctggctgaagaagaaaatacgcaggaagttcttgaacaactggaagaacaggccggaattctggaagctctgctggaagagaccgaagtcggcctgctgctttcagcagaagaagacaagcacgctgccattcttgaaattcatcccggtgccggaggcacggaagcacaggactgggcggaaatgttgctgcgcatgtatgtgcgctgggcggaaagccatgaatttaaagccgaataccttgattatcttgacggagatgaagccggcatcaaaagcgtgacgctgaagattgacggcaccaatgcctacgggctgcttaaaggtgaaaaaggtatccacagacttatccgtatatcgccttatgatgcctccggcagacgtcatacatcctttgcatcggtagatgtaattccagatgcaggcgaagagatcaccatcgatatcaaggattctgacctgcgcattgatattttccgctccagcggaccgggaggacagagcgtaaacaccacaagctccgccgtgcgtgtgacacatatccccaccggtatcactgcccagtgccagaacgaaaaatcgcagcatcacaataaagagactgccatgcagatattgcgggcgcggttgtatgaggctgaaatacgccggcgtgacgctgaaaagcaggcggactacgccagcaaggaagccatcggctggggcagccagatacgcacctatacgctgcagccgtacaggctggtgaaggatcaccgttccaactttgaagtgggcgatgtggaagcggtgcttgacggcgagcttgatgcgctgatgcgcaaccacctgctctaccagcatgagcgacgatag

SEQ ID NO: 73774 - protein, 358 aa, Desulfovibrio desulfuricans G20
MPFSSSLKRSGGAFDHAQSKYRLEEIEKQLSSPDAWNAPEKLTPVLREKSQLENSVARLDALRQAKDDMQGWLELAEEENTQEVLEQLEEQAGILEALLEETEVGLLLSAEEDKHAAILEIHPGAGGTEAQDWAEMLLRMYVRWAESHEFKAEYLDYLDGDEAGIKSVTLKIDGTNAYGLLKGEKGIHRLIRISPYDASGRRHTSFASVDVIPDAGEEITIDIKDSDLRIDIFRSSGPGGQSVNTTSSAVRVTHIPTGITAQCQNEKSQHHNKETAMQILRARLYEAEIRRRDAEKQADYASKEAIGWGSQIRTYTLQPYRLVKDHRSNFEVGDVEAVLDGELDALMRNHLLYQHERR

SEQ ID NO: 73775 - DNA, 870 bp, Haemophilus somnus 2336
  CDS (1)..(870)
ttggaagatgtcgatggcttactggaactttctgtagaagcggaagatgaaacaacgtttaatgaagctgtcgcagaagcggaagaattggaaaaaaaacttgccacccttgagttccgtcgtatgttcagcggacaacatgataactgtgattgttatgttgacctacaagcaggctccggcggaacagaagctcaggattggacagaaatgctattgcgtatgtatttacgttgggcagaaagcaagggctttaaaaccgaattagttgaagtttccagtggcgatgttgcaggcttgaaatctgccactattcgtattgcaggcgaatacgctttcggttggttaagaacagaaacaggtattcaccggttagtacgtaaaagtccatttgattccaataatcgtcgccatacttctttcgcagctgccttcgtttatcctgaaattgatgatgatattgaaatagaaatcaatcctgcagatttacgtattgatgtttatcgtgcatcaggcgccggcggacaacacgttaataaaacagaaagtgcggtgcgtattactcatattcctagcggtattgtggtgcaatgccaaaatggacgatctcaacatcagaataaagatcaagccatgaagcagctaaaagcaaaactgtacgaaatggaaatgatgaaaaaaaatgctgataaacaagccatggaagacagtaaatctgatatcggctggggtagtcaaatccgctcctatgtgctggatgattcccgtattaaagatttgcgaacaggtgttgaaaatcgcaatactcaagctgtattggacggcgatttggatcgttttattgaagccagcttaaaagccggactataa

SEQ ID NO: 73776 - protein, 289 aa, Haemophilus somnus 2336
MEDVDGLLELSVEAEDETTFNEAVAEAEELEKKLATLEFRRMFSGQHDNCDCYVDLQAGSGGTEAQDWTEMLLRMYLRWAESKGFKTELVEVSSGDVAGLKSATIRIAGEYAFGWLRTETGIHRLVRKSPFDSNNRRHTSFAAAFVYPEIDDDIEIEINPADLRIDVYRASGAGGQHVNKTESAVRITHIPSGIVVQCQNGRSQHQNKDQAMKQLKAKLYEMEMMKKNADKQAMEDSKSDIGWGSQIRSYVLDDSRIKDLRTGVENRNTQAVLDGDLDRFIEASLKAGL

SEQ ID NO: 73777 - DNA, 906 bp, Actinobacillus pleuropneumoniae serovar 1 str. 4074
  CDS (1)..(906)
atggtggtcaatacgatccgtacactagatcaaggtgtggaagatgttgaaggcttaatcgaattagccgtagaagcggaagatgaagatacgtttaacgaagcacaagctgaagcaaacgaattagaagaaaaattagcgaaacttgaatttcaacgaatgtttagcggtcagcacgatgcggcagattgctatgtcgatttacaagccggctcaggcggtacggaagcacaagactggacggaaatgctactgcgtatgtatttacgctgggcggaaagcaaaggctttaaaaccgaattaatcgaggtgtcggacggtgatgttgccggattgaaatcagcaaccgtgaaaatcactggtgaatatgcgttcggctggttgcgtaccgaaaccggtattcaccgtttggtgcgtaaatcgccatttgattcgaataaccgccgccatacttcatttgcggctgctttcgtttatccggaaattgatgatgatattgatatcgaaatcaatccggcggatttacgtattgacgtgtatcgagcttcaggagcaggtggtcagcacgtcaataaaaccgaatcggcggtgcgtattactcatattccatccggtattgtggtgcaatgtcagaacggtcgttcgcaacaccaaaacaaagatcaatgtatgaagcagcttaaagcgaaattatacgagatggaaatgatgaagaagaatgcggaaaaacaagcgatggaagaaagtaaatcggatatcggctggggcagccaaattcgttcatacgtattagacgactctcgtatcaaagatttgcgtaccggcgttgaaaatcgcaatacccaagcggtacttgacggtgacttagacaaatttattgaagccagccttaaagcggggctttaa

SEQ ID NO: 73778 - protein, 301 aa, Actinobacillus pleuropneumoniae serovar 1 str. 4074
MVVNTIRTLDQGVEDVEGLIELAVEAEDEDTFNEAQAEANELEEKLAKLEFQRMFSGQHDAADCYVDLQAGSGGTEAQDWTEMLLRMYLRWAESKGFKTELIEVSDGDVAGLKSATVKITGEYAFGWLRTETGIHRLVRKSPFDSNNRRHTSFAAAFVYPEIDDDIDIEINPADLRIDVYRASGAGGQHVNKTESAVRITHIPSGIVVQCQNGRSQHQNKDQCMKQLKAKLYEMEMMKKNAEKQAMEESKSDIGWGSQIRSYVLDDSRIKDLRTGVENRNTQAVLDGDLDKFIEASLKAGL

SEQ ID NO: 73779 - DNA, 903 bp, Pseudomonas aeruginosa UCBPP-PA14
  CDS (1)..(903)
atggtggaaaccctggacgacctgaccagcggcctggccgactcccgcgacctgctggacatggcggtcgaggaagacgacgagggcgccgtcgacgacgttgccaacgaagtcgagcgtctgcgcgagatcctcgagaagctggagttccgccgcatgttcagcggcgagatggacccgaacaacgcctacctggacatccaggccggctccggcggcaccgaggcccaggactgggccaacatgctgctgcgcatgtacctgcgctgggccgacaagcacggcttcgacgccactatcatcgagctgtccgagggcgaggtcgccggcatcaagggcgccaccgtgcacatcaagggcgagtacgccttcggctggctgcgcaccgagatcggcgtgcaccgcctggtgcgcaagagtccgttcgactccggcaaccgtcgccacacctcgttcaccgcggtgttcgtatcgccggaaatcgacgacaacatcgagatcgagatcaacccggccgacctgcgcatcgatacctaccgctcctccggcgcgggcggtcagcacgtgaacaccaccgattcggcggtgcggatcacccacgtgccgaccaataccgtggtggcgtgccagaacgaacgctcccagcacgccaacaaggacaccgcgatgaagatgctgcgggccaagttgtacgagctggaaatgcagaagcgtaccgccgcgtcccaggccctggaggactccaagtccgacatcggctggggccaccagatccgctcctacgtgctcgaccagtcgcggatcaaggacctgcgtaccggtatcgagcgcagcgactgcgacaaggtgctcgacggcgatctagacgaatacctcgaagccagcctcaaacaggggctgtaa

SEQ ID NO: 73780 - protein, 300 aa, Pseudomonas aeruginosa UCBPP-PA14
MVETLDDLTSGLADSRDLLDMAVEEDDEGAVDDVANEVERLREILEKLEFRRMFSGEMDPNNAYLDIQAGSGGTEAQDWANMLLRMYLRWADKHGFDATIIELSEGEVAGIKGATVHIKGEYAFGWLRTEIGVHRLVRKSPFDSGNRRHTSFTAVFVSPEIDDNIEIEINPADLRIDTYRSSGAGGQHVNTTDSAVRITHVPTNTVVACQNERSQHANKDTAMKMLRAKLYELEMQKRTAASQALEDSKSDIGWGHQIRSYVLDQSRIKDLRTGIERSDCDKVLDGDLDEYLEASLKQGL

SEQ ID NO: 73781 - DNA, 927 bp, Fusobacterium nucleatum subsp. vincentii ATCC 49256
  CDS (1)..(927): transl_table=11
atgaattttgaaaaaaatatagtttcaagatatgaaaagttagcgactgaaattgacgatgaagaagttttaattgactttgttgaaagtggagaagcttcttttgaaaatgaattacaaactaaacataaaattttaaaatctgatatagaagaatttgaaatcaatttgttattagatggagaatacgatataaataatgccattgtaacaatacattctggtgcaggaggaacagaagcttgtgattgggctgatatgctttacagaatgtatttaagatggtgtaatttaaaaggatataaggtatcagaacttgattttatggaaggagatagtgtaggaataaaatcagttacatttttagttgaaggaataaatgcttatggctatttaaaatcagaaaaaggggtacatagacttgtaagaatttctccttttgatgccaataaaaaaagacatacatcatttgcctctgttgaagttgtaccagaggttgatgaaaatgtagaagttgaaataaatcctgctgatattagaatagatacatacagagcaagtggagcaggtggacaacatgttaatatgacagactctgctgtaagaataactcattttccaagtggaatagttgtaacttgtcaaaaagaaagatctcaattaagtaatagagaaactgctatgaagatgttaaaatcaaaattacttgaattagaaattaagaaaaaagaagaagaaatgaaaaaaattcaaggagaacaatctgatattggttggggtaatcaaataagatcttatgtatttcaaccttatgccttggtaaaagatcataggactaatactgaaattggaaatgtaaaagctgttatggatggaagtatagatgattttataaattcatatttaagatggataaagaataattaa

SEQ ID NO: 73782 - protein, 308 aa, Fusobacterium nucleatum subsp. vincentii ATCC 49256
MNFEKNIVSRYEKLATEIDDEEVLIDFVESGEASFENELQTKHKILKSDIEEFEINLLLDGEYDINNAIVTIHSGAGGTEACDWADMLYRMYLRWCNLKGYKVSELDFMEGDSVGIKSVTFLVEGINAYGYLKSEKGVHRLVRISPFDANKKRHTSFASVEVVPEVDENVEVEINPADIRIDTYRASGAGGQHVNMTDSAVRITHFPSGIVVTCQKERSQLSNRETAMKMLKSKLLELEIKKKEEEMKKIQGEQSDIGWGNQIRSYVFQPYALVKDHRTNTEIGNVKAVMDGSIDDFINSYLRWIKNN

SEQ ID NO: 73783 - DNA, 1050 bp, Psychrobacter sp. 273-4
  CDS (1)..(1050)
atgggcaggacttgcggaggtatctttgacttcgatggtaagcaagaacgcttagaagaagtcaatttagagctggaaaatcctgagctatggaatgatccagaacgcgcgaccaagattaataaagaaaaaagtcagcttgatggggtgattgatgtggtggtgtcgcttgaaaccacattggaagatgcgtctgcgatgctagagcttgcagtagaagaagaagacgagtcattgcttgctgatgtgcaagccgaattagacaacgctgaaaaacgcgtggcagatttagagttccgccgcatgtttagcggtgagatggatccgaataattgctatttggatatccagtcaggtagtggcggtacagaggcacaagattgggcagagatgttgctgcgtatgtatacgcgttgggcagaagcacatggttttaaagtagacgttatcgaagtgtctgctggcggagtcgctggtatcaagtcagcaaccattgagattaaaggcgattatgcttttggttggttacgtaccgaaatcggcgtgcatcgcttagtacgtaaatcaccatttgacagtaataacggtcgtcatacttcatttgcggctgtttttgtgtcgcctgaaattgatgataatatcgagattgatgtcaatccggcagatttgcgtattgatacttatcgctcatcgggggctggtggtcagcacgtaaacaccaccgattctgctgtgcgtatcactcatgaaccgagtggcgtggtggtgacttgtcaaaacgagcgcagccagcatggcaataaagccacggcaatgaaaatgctgcgtgctaagctatatgagcttgaaatgcaaaaacggatggaatcccagcaagccgttgaagatggtaagtcggatgttggctggggcagtcaaattcgctcgtatgtccttgatgactcacgtatcaaggacttacgtactggcgttgaaacctttaacactggtgcggtgctcgatggcgaccttgatcaatttatcgaagcgagtctaaaagcgggtctgtaa

SEQ ID NO: 73784 - protein, 349 aa, Psychrobacter sp. 273-4
MGRTCGGIFDFDGKQERLEEVNLELENPELWNDPERATKINKEKSQLDGVIDVVVSLETTLEDASAMLELAVEEEDESLLADVQAELDNAEKRVADLEFRRMFSGEMDPNNCYLDIQSGSGGTEAQDWAEMLLRMYTRWAEAHGFKVDVIEVSAGGVAGIKSATIEIKGDYAFGWLRTEIGVHRLVRKSPFDSNNGRHTSFAAVFVSPEIDDNIEIDVNPADLRIDTYRSSGAGGQHVNTTDSAVRITHEPSGVVVTCQNERSQHGNKATAMKMLRAKLYELEMQKRMESQQAVEDGKSDVGWGSQIRSYVLDDSRIKDLRTGVETFNTGAVLDGDLDQFIEASLKAGL

SEQ ID NO: 73785 - DNA, 978 bp, Dechloromonas aromatica RCB
  CDS (1)..(978)
atggaagacccgaagatctgggatgacgccaaacgcgcccaggaactcggtcgcgagaagaaatcgctggaaaacatcgtgctggtgctggaagaagtccagtccgggctcaacgatggccgcgaactgttcgacatgggcaaggaagacggcgacgaagacaccctgctctccgtcgaggccgacaatgccgaactcgagaagaaggttgcggccctcgaattccgccgcatgttcaacaacccgtccgacccgatgccctgcttcctggaaatccaggctggcgccggcggcaccgaagcccaggactgggcctcgatgctgctgcgcatgtacctgaagtatggcgagaagaagggtttcaccgttgaggtgatggaagaatcggaaggcgatgtcgccggtctgaagagcgctaccgtcaagttcaccggcgactacgcctacggcacgctgcgcaccgaaaccggcattcaccgcctggtccgcaagtcgccgttcgactccaacgcccgccgccacaccagcttcacctcggtattcgtgttcccggaagtcgatgactcgatcgagatcaacatcaatccggccgacgtgcgcaccgacacctaccgcgcctccggcgccggcggtcagcacatcaacaagaccgactcggccgtccgtctgacccacgtcccgaccggcatcgtcgtccagtgccagaacgaccgttcgcagcaccgcaaccgcgacgaagcctggcagatgctgcgtgcccgcatctacgagttcgaattgcgcaagcagcaggccgaacagcagaagctggaagacgccaagtccgacatcggctggggccatcagatccgttcctacgtgctcgaccagtcgcgcatcaaggatctgcgtaccaaccacgaaaccggcaatacccaggccgtgcttgatggcgacctcgatcccttcatcgaagccagcctgaagcaaggcgtctaa

SEQ ID NO: 73786 - protein, 325 aa, Dechloromonas aromatica RCB
MEDPKIWDDAKRAQELGREKKSLENIVLVLEEVQSGLNDGRELFDMGKEDGDEDTLLSVEADNAELEKKVAALEFRRMFNNPSDPMPCFLEIQAGAGGTEAQDWASMLLRMYLKYGEKKGFTVEVMEESEGDVAGLKSATVKFTGDYAYGTLRTETGIHRLVRKSPFDSNARRHTSFTSVFVFPEVDDSIEININPADVRTDTYRASGAGGQHINKTDSAVRLTHVPTGIVVQCQNDRSQHRNRDEAWQMLRARIYEFELRKQQAEQQKLEDAKSDIGWGHQIRSYVLDQSRIKDLRTNHETGNTQAVLDGDLDPFIEASLKQGV

SEQ ID NO: 73787 - DNA, 858 bp, Rickettsia rickettsii
  CDS (1)..(858)
atggctgaagctgaaaacgatttagaaacactttcacaaattgaacaggacttaaaaaatttaagcatcattgctgccaaatttgaaacggaatgtttgttttcaggtgaagcagacggtaataattgctttttagagattaatgctggagccgggggaactgaaagccatgactgggcgtctattatgatgcgtatgtatttgcgttttgccgaaagactcggctttaaaaccgaaataatcaatatgattaacggcgaagaggcaggcattaaatcatgcacgattaggataataggaaagcgtgcttacggctggtttaagaccgaagctggcgttcacagattagtgcgtatttctccgtttaatgcagccggtaaaagaatgactagctttgcaagtagctggatatatcccgaaattgatgataatatagcaattactattgaggataaagatttaagaatcgatacttttagagcatcgggagccggcgggcagcacgttaatactaccgattcagctgtacgtatcactcatataccgaccggtacggtaacacaatgccaaagcgatagatcgcagcataaaaataaagctcaagctatgaaaatgcttcaagccaaactctatgagcttgaaatgcaaaaacgtactgatagcgttaacgagcagaatgccgctaaaaccgataatagctggggacatcaaattagatcatatgttttgcaaccttatcaaatggtaaaagatttacgtaccgattatgaaacttccgatactaaaggagtgcttgacggtgaccttgaagaatttgtttccgcaaaccttgctatgaatgcaggtggtaagaagtag

SEQ ID NO: 73788 - protein, 285 aa, Rickettsia rickettsii
MAEAENDLETLSQIEQDLKNLSIIAAKFETECLFSGEADGNNCFLEINAGAGGTESHDWASIMMRMYLRFAERLGFKTEIINMINGEEAGIKSCTIRIIGKRAYGWFKTEAGVHRLVRISPFNAAGKRMTSFASSWIYPEIDDNIAITIEDKDLRIDTFRASGAGGQHVNTTDSAVRITHIPTGTVTQCQSDRSQHKNKAQAMKMLQAKLYELEMQKRTDSVNEQNAAKTDNSWGHQIRSYVLQPYQMVKDLRTDYETSDTKGVLDGDLEEFVSANLAMNAGGKK

SEQ ID NO: 73789 - DNA, 879 bp, Anabaena variabilis ATCC 29413
  CDS (1)..(879)
atggttgagttgttggagttggaaaccgacgaagcactattgcaagaagcggaatctactatcactaagctcaatcgagaccttgaccagtgggaattacaacagttactttctggcccctatgatgcggaaggggcagtattaacgattaacgctggtgctggcggaacagatgcccaagattgggcatttatgttgctgagaatgtacacccgttgggctgaagaccaaggctacaaggtagctttagcagaagagtcagaaggtgatgaggcgggaattaaatcagccaccttagaaattactggtcgctatgcctacggttacttgcggtcagaaacaggcactcatcgcttagtgagaatttcccctttcaacgccaacggcaagcggcaaactagttttgctggggtggaagttatgccgcaattagataatacggtgcagttggatattccagacaaagatttggaaatcactacaactcgttctggtggtaaaggtggacagaacgtcaacaaagtagaaacagcagtgcgagtggttcaccttcccacaggcattgctgtacgctgtacggaagaacgttcccagctacaaaataaagagaaagccctcgcccgcctgaaagctaagttgttggttattgctcaagagcaaaaagctcaagaaattgcccaaattcgcggcgatatggtagaagcttcttggggaaaccaaattcgtaactacgtattccatccttaccagatggtaaaggatttacgtaccaatgcagaaacaactgcgatcgctgatgtgatgaatggtgaactagatatgttcatccaagcctatctacgtcaggagaatcaagttgtagaaggtgaagctagttag

SEQ ID NO: 73790 - protein, 292 aa, Anabaena variabilis ATCC 29413
MVELLELETDEALLQEAESTITKLNRDLDQWELQQLLSGPYDAEGAVLTINAGAGGTDAQDWAFMLLRMYTRWAEDQGYKVALAEESEGDEAGIKSATLEITGRYAYGYLRSETGTHRLVRISPFNANGKRQTSFAGVEVMPQLDNTVQLDIPDKDLEITTTRSGGKGGQNVNKVETAVRVVHLPTGIAVRCTEERSQLQNKEKALARLKAKLLVIAQEQKAQEIAQIRGDMVEASWGNQIRNYVFHPYQMVKDLRTNAETTAIADVMNGELDMFIQAYLRQENQVVEGEAS

SEQ ID NO: 73791 - DNA, 915 bp, Synechococcus elongatus PCC 7942
  CDS (1)..(915)
atggactggcaacaactcgacgccgatatcaccgccattctggagttgctggcgattgagcccgaccctgccctatttgaagaagcggaaaccaacgtccagcgactgcagcgcgagctggatcagtgggaactacagcaactgctatcgggcccttatgatgctgagggagcgatcctctcgattaacgctggggctggcggcaccgatgcccaagactgggccgagatgttgctgcggatgtatacccgctgggccgaagaccaaggctacaaggtacggattaccgagctgtccgaaggggaggaagcgggcattaaatcggtcaccttggagattgagggcaagtacgcctacggctatctcaaagccgagaaggggacccatcgcctcgtccgcatttctcccttcaacgctaacgacaagcgccagaccagctttgctggggtagaggtgatgccggtgctcgacactgatatcgacctggagattcctgagaaagacctcgagatcaccacctcccgcgccggtggcaaaggcggccagaacgtcaacaaagtcgagaccgccgtgcggattgttcacctgccgacgggcctcgcagtacgctgtaccgaagagcgatcgcagctgcagaacaaagagaaagccctggtcattctcaaggcgaaattactggtcgttttgcaggaacagaaagccaaggaagtcgcggaaattcgcggcgatatggtggaagcagcctggggcaatcaaattcgcaactacgtcttccatccctatcagctggttaaggatctccgaactggcgtagaaaccaaggcgatcgccgatgtgatgaatggcgacctcaatccctttatccaggcctatctgcgccaagataaccaaatgttgatcgaaaccactgtctaa

SEQ ID NO: 73792 - protein, 304 aa, Synechococcus elongatus PCC 7942
MDWQQLDADITAILELLAIEPDPALFEEAETNVQRLQRELDQWELQQLLSGPYDAEGAILSINAGAGGTDAQDWAEMLLRMYTRWAEDQGYKVRITELSEGEEAGIKSVTLEIEGKYAYGYLKAEKGTHRLVRISPFNANDKRQTSFAGVEVMPVLDTDIDLEIPEKDLEITTSRAGGKGGQNVNKVETAVRIVHLPTGLAVRCTEERSQLQNKEKALVILKAKLLVVLQEQKAKEVAEIRGDMVEAAWGNQIRNYVFHPYQLVKDLRTGVETKAIADVMNGDLNPFIQAYLRQDNQMLIETTV

SEQ ID NO: 73793 - DNA, 981 bp, Ralstonia eutropha JMP134
  CDS (1)..(981)
ttgctggaagacccggacgtctggaacaaccccaagcgcgcccaggatctcggcaaggaaaagaaagcactcgagggcgtggtaagcgttctcggcaagctcacggacgacctcaacggtgccgatgagctgtttgaactcgccaaggaagaaggcgacgacgaaacgctcgagtcgatcgagaccgacgtcaagggcttcgaggaaatcgtcgccggcatggaattccgccgcatgttcgcgggcgagatggaccaggccaacgcctttatcgacatccaggccggcgccggcggcaccgaagcgtgcgactgggcgtcgatgctgctgcgccagtacctgaagtactgcgagcgcaagggcttcaaggccgaggtgctcgaagagtccgaaggcgacgtggccggcatcaagagtgcgacgatcaagatcgaaggcgaatacgcgttcggctacctgcgcaccgaaaccggcgtgcaccgcctcgtgcgcaagtcgccgttcgattcgtcgggcgggcgccatacgtcgttctcgtcggtgttcgtatacccggaagtcgacgactcgttcgaggtcgaggtcaacccggccgatctgcgcgtcgatacctaccgcgcttcgggcgccggcggccagcacatcaacaagaccgattcggccgtgcgtatcacgcacatcccgaccggcatcgtcgtgcagtgtcagaacgaccgttcgcagcaccgcaaccgtgccgaggccatgtcgatgctgaagtcgcgcctgtacgagcacgagatgcgcaagcgccaggccgaagccgacaagctcgaagccggcaagaccgatgtgggctggggccaccagatccgttcgtacgtgctggatcaaagccgtatcaaggacctgcgtaccaacgtcgaaatgtccaacacccagaaggtgctggacggcgacctggacccgttcatcgaggccagcctcaagcagggactgtaa

SEQ ID NO: 73794 - protein, 326 aa, Ralstonia eutropha JMP134
MLEDPDVWNNPKRAQDLGKEKKALEGVVSVLGKLTDDLNGADELFELAKEEGDDETLESIETDVKGFEEIVAGMEFRRMFAGEMDQANAFIDIQAGAGGTEACDWASMLLRQYLKYCERKGFKAEVLEESEGDVAGIKSATIKIEGEYAFGYLRTETGVHRLVRKSPFDSSGGRHTSFSSVFVYPEVDDSFEVEVNPADLRVDTYRASGAGGQHINKTDSAVRITHIPTGIVVQCQNDRSQHRNRAEAMSMLKSRLYEHEMRKRQAEADKLEAGKTDVGWGHQIRSYVLDQSRIKDLRTNVEMSNTQKVLDGDLDPFIEASLKQGL

SEQ ID NO: 73795 - DNA, 1065 bp, Methylobacillus flagellatus KT
  CDS (1)..(1065)
atgatcttgcggagcgccaccaggccttacgggggtatctttgacttcgataccaagcagcaacgtctggaagaggtttctcagcttttagaagaccccaacatctggaacgataacgaacgctctcagaagcttggcaaggaaagacgggagctggagttcgttgtcaattcgctgacggaagtggagaacggcgtgcgcgacagccgcgagctgtttgagatggcgcgcgaggaaaacgatgacgacaccctgcgcagcattgatgccgatacgcaggcgctggaaaaaatcgttgcggaaatggagttccgccgcatgttttcccatccgatggatcagaacaattgcttcctggatatccaggctggctcgggcggtaccgaagcgcaggattgggcgtccatgctgctgcgcatgtatttgcgttattgcgagaacaagggcttcaaggtcgaagtgttggaggagtcggaaggagacgtggccgggatcaagagtgcgtccctgaaaatctccggtgactatgcctatgggttcctgcgtaccgagagcggcgtgcatcgcctggtgcgcaaatcgccattcgattccggcaaccgccggcatacctcgttcgcgagcgtgttcgtctaccccgaggtggacgattccatcgtggtggaaatcaatcctgctgacttgcgtattgacacttatcgcgcctcgggagcgggtggtcagcatatcaacaagaccgattccgctgtccgtattactcacttgccgaccaatactgtcgtgcagtgccagaatgaccgctctcagcatcgcaacaaggatgaggcgatgaatatgctgaaggcgcagttgtatgcattggaactccgcaagcgcaacgaggaaaagcaagcgatggaagatgccaagaccgacattggttgggggcaccagattcgttcctatgtgctcgaccaatcccgcatcaaggatttgcgcaccaatgttgaggtcggcaacacccagggggtactcgatggcgacctggatccatttatttctgaaagtttgaagcagggagtgtaa

SEQ ID NO: 73796 - protein, 354 aa, Methylobacillus flagellatus KT
MILRSATRPYGGIFDFDTKQQRLEEVSQLLEDPNIWNDNERSQKLGKERRELEFVVNSLTEVENGVRDSRELFEMAREENDDDTLRSIDADTQALEKIVAEMEFRRMFSHPMDQNNCFLDIQAGSGGTEAQDWASMLLRMYLRYCENKGFKVEVLEESEGDVAGIKSASLKISGDYAYGFLRTESGVHRLVRKSPFDSGNRRHTSFASVFVYPEVDDSIVVEINPADLRIDTYRASGAGGQHINKTDSAVRITHLPTNTVVQCQNDRSQHRNKDEAMNMLKAQLYALELRKRNEEKQAMEDAKTDIGWGHQIRSYVLDQSRIKDLRTNVEVGNTQGVLDGDLDPFISESLKQGV

SEQ ID NO: 73797 - DNA, 1101 bp, Exiguobacterium sp. 255-15
  CDS (1)..(1101)
atggaattagcagaaatacgcaataccgccgagtggatggaaaagaaactcgatgaatacaaggcatcactcgatctcgagacgaagatctcacgcatcgaggagcttgaaaacgagatgacgtacccggacttctggaacaatcaggagtcggctcaaaaagtcatcgacgaatcaaacggtctgaaagcgatggtcgataaataccagcacctcgcggacggtcacgaaaacatcgttttaacgtacgaattgattaaagaagagccggacgttgaacttcaggaagaactggagtcggaactcggcgacatcaaaaagaaatttgatgagttcgaacttcaaatcttattgaacggcgaatacgatgccaacaacgcgattctcgaattgcacccgggcgccggcggaaccgagtcacaggactgggcgtcgatgttgttacggatgtatcaacgtttctgcgacaagcagggctggaaagtcgaaacgatggactatcagccgggtgacgaagccggtgtgaaatcggtcacgctccggatccaggggcacaacgcctatgggtatttgaaagcggaaaaagggattcaccgtctcgtgcggatttctccgttcgactcgtcaggccgtcgccatacgtcgttcgtgtcgtgtgacgtcatgccggaattcaacgatgatatcgatatcgagatccggacagaagacttgcgtgtcgatacgtaccgggcatccggtgccggtggacagcacatcaatacgacggactctgctgttcggattacgcacgttccgacaggtgtcgtcgtttcatgtcagcaggaacggtcgcaaatcaagaaccgtgaagcggcaatgaagatgttgaaagcaaaactttatcaacgtgaaatcgaagaaaaacaaaagaaactcgacgaaatccgtggtgaaaaatcagatatcgcctggggcagtcagattcgttcatacgtcttccacccatacagcatggttaaggatcaccggacgaactacgaagtcgggaatacgcaaggcgcgatggatggggacatcatgggcttcatcgatgcgtacctgcgcttaatgaatatgtaa

SEQ ID NO: 73798 - protein, 366 aa, Exiguobacterium sp. 255-15
MELAEIRNTAEWMEKKLDEYKASLDLETKISRIEELENEMTYPDFWNNQESAQKVIDESNGLKAMVDKYQHLADGHENIVLTYELIKEEPDVELQEELESELGDIKKKFDEFELQILLNGEYDANNAILELHPGAGGTESQDWASMLLRMYQRFCDKQGWKVETMDYQPGDEAGVKSVTLRIQGHNAYGYLKAEKGIHRLVRISPFDSSGRRHTSFVSCDVMPEFNDDIDIEIRTEDLRVDTYRASGAGGQHINTTDSAVRITHVPTGVVVSCQQERSQIKNREAAMKMLKAKLYQREIEEKQKKLDEIRGEKSDIAWGSQIRSYVFHPYSMVKDHRTNYEVGNTQGAMDGDIMGFIDAYLRLMNM

SEQ ID NO: 73799 - DNA, 1095 bp, Rubrobacter xylanophilus DSM 9941
  CDS (1)..(1095)
atggacgagcaggtcgtcaagctggcaaaggagacggtggcgcgctacagggagctcacggaggagctctccgacccggccatcttcaacgaccagcgccgctacgccgaggtcgcccgggagcactcccggatgcggcgcggggccgagctgagcgagcgctttctcgaggcgttgcgggaggagcgggaggcccgggagctgatcccggccgccgagagcgccgaggagcgggagttcttcgccggggaggcccgggaggccgggaggcgggcgggggagctggccgaggagataagatcggagctcatcgaccgcgacccgaacgacgacaaggacgtgatcctggagatccgggccgggaccggcggggacgaggcggcgctgttcgccggcgacctctacgagatgtacgcccgctacgcggataggctgggcttcaggcaccgggtgctggacgccagcccggccgaggtcggcgggtacaaggagatcatcgtggagatcgagggcgacggcgcctattcggtcttcaagcacgagggcggcacccaccgggtccagagggtccccaagaccgagagccaggggcggatacacacctccaccgccacggtggccgtgctgccggaggccgaggaggtggaggtcgagataaacccgaacgacctggagatagacgtctaccgctccagcggccccggcgggcagagcgtgaacaccaccgactcggcggtcaggatcacccacaagccgacgggcctggtggtcacctgccagaacgagaagagccagctgcagaacaaggagcaggccctgaggatcctccgctcccgcctgctggagcgcgagatgcgcgagcgccaggagagggagggccagatgcggctggcgcagttcggctctggcgacaggtcggccaagatccgcacctacaacttcccgcagggcaggatcacggaccaccgcgtcggcctcaccgtccacaacctggaggcggtgctgggcggcgagctggaggagttcaccaaggccctggccgccaaggagcgggccgaccggctggcggcctccgcgaccggaagccctggctga

SEQ ID NO: 73800 - protein, 364 aa, Rubrobacter xylanophilus DSM 9941
MDEQVVKLAKETVARYRELTEELSDPAIFNDQRRYAEVAREHSRMRRGAELSERFLEALREEREARELIPAAESAEEREFFAGEAREAGRRAGELAEEIRSELIDRDPNDDKDVILEIRAGTGGDEAALFAGDLYEMYARYADRLGFRHRVLDASPAEVGGYKEIIVEIEGDGAYSVFKHEGGTHRVQRVPKTESQGRIHTSTATVAVLPEAEEVEVEINPNDLEIDVYRSSGPGGQSVNTTDSAVRITHKPTGLVVTCQNEKSQLQNKEQALRILRSRLLEREMRERQEREGQMRLAQFGSGDRSAKIRTYNFPQGRITDHRVGLTVHNLEAVLGGELEEFTKALAAKERADRLAASATGSPG

SEQ ID NO: 73801 - DNA, 1101 bp, Rubrobacter xylanophilus DSM 9941
  CDS (1)..(1101)
atgccggagctgagggagaagatctcggacctgagccagcgcctcgacgagctggaggcgttcttcgacgtggggcggctgcgcgagcgcgcggcgaggctctcggaggagatgagccgcccggggttctgggacgacccggaccgggcgaagggggtcgcggcggagttctcccgcacggaggaccggctgaagctcatggaggagctgcggggccggcttgaggactctagcgagctcctggagctggccgagggcgaccgggagctgctcgaggaggtggagcgggagctcgaggggatcgagcggcggatcgaggagcaggaggtcgcccgcctgttcacgggggagtacgacgagggcgacgcgatcctgaccataaactccggggccggcggggtggactcccaggactgggcggagatgctggcccggatgtaccggcgctgggccgagcggcgcggcttcgggctggaggtgatcgagtacaccgagggggaggaggcggggatcaagagcgccaccttctcggtctcggggccctacgccttcgggctgctctccgccgagcggggcgtgcaccgcctggtgcgcatcagcccgttcgacgcctcctcgcggcggcacacgagcttcgcctccgtcgcggtggccccggccatcgacgacgcggtggaggtggagatagacgagaaggacctgaaggtggacacctacagggcctcgggggcgggggggcagcacgtgaacaagacggactcggcggtgcgcatcacgcacctgcccaccggtatcgtggtgcagtgccagaacgagcgcagccagcaccagaaccgggagacggcgctacgggtcctgaaggcgcgcctgttcgagctggagcgggagaagcgggagcaggagatcgccgcccagagcggggagaaggcggagatcgggtggggctcccagatccgctcgtacgtcctgcacccctaccgcatggtgaaggacctgcgcaccggggaggagacgggagacgtggaccgggttctggacggcgacctggaccgctttatctacgcctacctgaagcgccgggcgcaggcggcgaggcagtag

SEQ ID NO: 73802 - protein, 366 aa, Rubrobacter xylanophilus DSM 9941
MPELREKISDLSQRLDELEAFFDVGRLRERAARLSEEMSRPGFWDDPDRAKGVAAEFSRTEDRLKLMEELRGRLEDSSELLELAEGDRELLEEVERELEGIERRIEEQEVARLFTGEYDEGDAILTINSGAGGVDSQDWAEMLARMYRRWAERRGFGLEVIEYTEGEEAGIKSATFSVSGPYAFGLLSAERGVHRLVRISPFDASSRRHTSFASVAVAPAIDDAVEVEIDEKDLKVDTYRASGAGGQHVNKTDSAVRITHLPTGIVVQCQNERSQHQNRETALRVLKARLFELEREKREQEIAAQSGEKAEIGWGSQIRSYVLHPYRMVKDLRTGEETGDVDRVLDGDLDRFIYAYLKRRAQAARQ

SEQ ID NO: 73803 - DNA, 969 bp, Mesorhizobium sp. BNC1
  CDS (1)..(969)
atgcgcgagcgccagtctctcgaagaaaacatcaatgcgatcaatggtctcagccgatctcttgatgacaatgtagagctgatcaagctcggagaggaagaaggggacgcggggatcgtcgaggaggcggaatccgctattcgctcgctgcgcggggagatttcggcgcgccagatcgagacgcttctttccggagaggccgacgccaacgacacatatctggaggttcatgccggcgcgggcggcacggaaagccaggactgggccttgatgctgcttcggatgtatacgcgctgggcggagcggcggggcatgaaggtcgagacgcttgaggtgcatgacggtgaggaggccggcatcaaatcggccaccattctcgtccacggccacaatgcttacggctggctcaagaccgaatcgggcgtgcaccggctggtgcggatctcgcctttcgacagcaatgcacgccggcacacgtcattcgcgagcatctgggtttatccggttatcgacgattcgatcgagatcgaaatcccggaatcagaggtgcggatcgacacctatcgctcttccggcgctggcggacagcacgtgaatacgacggattcggccgtgcgcattacacacatcccgacgggcatcgcagtcgcctgccagcaggagcgctcgcagcacaagaaccgggcgaaggcgtgggagatgctgcgcgctcggctttatgagctggagctcaagaagcgcgaggaggcggcgaacgccaccgaggcgtcaaagagcgacatcggctgggggcaccagatacgctcctacgtgctgcagccatatcagctcgttaaggatctgcgcaccggtgtggagagtcctagcccgcaggacgtgctggacggggacctggacgaattcatgaaggcttcgctttcgcagcgtgtgggcggtgttgagccggcggaagttgcggatatcgactga

SEQ ID NO: 73804 - protein, 322 aa, Mesorhizobium sp. BNC1
MRERQSLEENINAINGLSRSLDDNVELIKLGEEEGDAGIVEEAESAIRSLRGEISARQIETLLSGEADANDTYLEVHAGAGGTESQDWALMLLRMYTRWAERRGMKVETLEVHDGEEAGIKSATILVHGHNAYGWLKTESGVHRLVRISPFDSNARRHTSFASIWVYPVIDDSIEIEIPESEVRIDTYRSSGAGGQHVNTTDSAVRITHIPTGIAVACQQERSQHKNRAKAWEMLRARLYELELKKREEAANATEASKSDIGWGHQIRSYVLQPYQLVKDLRTGVESPSPQDVLDGDLDEFMKASLSQRVGGVEPAEVADID

SEQ ID NO: 73805 - DNA, 1077 bp, Crocosphaera watsonii WH 8501
  CDS (1)..(1077)
ttggttcgcgcctggggcaaacccaggactatctttgacttacctgcactcaaagcagttattaaagatctggaaaatacctccgcacaaccgcagttttgggatcaaccagaaacggcacaaaccaccctacaagagttaaatgatcttaaatcccaattagaacagtatcaacaatggtgtcttcaattagacgataccaaggcgatcgctgaattattggaattggaagatgatgccactttacgtcaagaggccgaagataacatcattcaacttaaccataatctcgatcgctgggaattacagcagttattatccggcatttatgatacaaagggggccgtattaactattaatgctggtgccgggggaacggatgctcaagactgggcgcaaatgctattacgaatgtacacccgttggggagaacaacagggttataaggtccatttaactgaactctcggaaggggatgaagctggtattaaatccgctactttggaaatagaaggccgttatgcttttggttatttaaaaggggaaaaaggaacccatcgactggtaagaatttctccgtttaatgctaatggcaaacgtcaaactagcttcgctggaatagaaatcatgccagcattagaagaagatgatcttaaggtagatattcccgataaagacttagacattagtacctctcgttctgggggaaaagggggacaaaatgttaataaagtggaaactgccgtgcgtgttgtccatgttcctacgggtattgccgttcgttgtacccaagaacgttcccaactccaaaataaagaaaaagccttggcattattgaaggcaaaactattaattattgccgaagaacaacgggcccaagaaattgctgaaattcgtggggatattgtagaagcagcttggggaacccaaattcgtaattatgtttttcatccctatcaaatggtgaaagatttacgaactaatatagaaacaactgatgttaatggggtgatggatggtagtttagatgagtttatcgaagcttatttacgttttgatactgcccctaaagggtag

SEQ ID NO: 73806 - protein, 358 aa, Crocosphaera watsonii WH 8501
MVRAWGKPRTIFDLPALKAVIKDLENTSAQPQFWDQPETAQTTLQELNDLKSQLEQYQQWCLQLDDTKAIAELLELEDDATLRQEAEDNIIQLNHNLDRWELQQLLSGIYDTKGAVLTINAGAGGTDAQDWAQMLLRMYTRWGEQQGYKVHLTELSEGDEAGIKSATLEIEGRYAFGYLKGEKGTHRLVRISPFNANGKRQTSFAGIEIMPALEEDDLKVDIPDKDLDISTSRSGGKGGQNVNKVETAVRVVHVPTGIAVRCTQERSQLQNKEKALALLKAKLLIIAEEQRAQEIAEIRGDIVEAAWGTQIRNYVFHPYQMVKDLRTNIETTDVNGVMDGSLDEFIEAYLRFDTAPKG

SEQ ID NO: 73807 - DNA, 1116 bp, Magnetospirillum magnetotacticum MS-1
  CDS (1)..(1116)
atgcgggccgagatcgaggcactcgcccaggatatccggcggtcggccgctctgttgaagcgtcatctcaattgggacgaggccttgatgcggctcgacgagctgaacgcctcggccgagaatcccgatctgtggaatgatgccggggccgcgcagaagatcatgcgcgagcgcaatgacctggacagcgccatccagggctgccgcgccttggagcgcgaactggccgatctgatcgagctgatcgaactgggcgagatggaaggcgaccagacggtcatcgacgacgccgaggagcagatccgcgccgtcaaggagcgcgccgccaagatggagctggaaaccctgctctcgggcgaggccgaccacaacgactgctacatggaaatcaatgctggcgctggcggcaccgagtcccaggactgggccgaaatgctgctgcgcatgtatacccgctgggccgagaagcacggctataaggtggaatggctggaagaaagctcgggcgagcaggcgggcatcaagtcggccaccatccgcatcctcggccataacgcctatggctggctgaagaccgaaagcggcgtccaccggctggtgcgcatttcgccctatgacagcgcggcgcgccgccataccagcttttcctcggcctgggtttacccggtgatcgacgattccatcgatatccagatcaatgagagcgagtgccgcatcgacacctaccgtgcctcgggcgcgggcggccagcacatcaacaagaccgattcggcggtccgcatcacccatatccccaccggcatcgccgtggcctgccagatggagcgttcgcagcaccagaatcgggcgcgggcctgggacatgctgcgcgcacgcctttacgaggccgagctgcaaaaacgcgaagccgccgcccaggctttggaagaccagaagaccgatatcggctggggccaccagatccgctcctatgtgttgcagccctaccagatggtcaaggatctgcgcaccaatgtggagacttcggatacccagggcgttctcgacggcgatcttgacatgttcatggccgcatccctggccgcccgcgtccagggcgatgtttcccaaggttaa

SEQ ID NO: 73808 - protein, 371 aa, Magnetospirillum magnetotacticum MS-1
MRAEIEALAQDIRRSAALLKRHLNWDEALMRLDELNASAENPDLWNDAGAAQKIMRERNDLDSAIQGCRALERELADLIELIELGEMEGDQTVIDDAEEQIRAVKERAAKMELETLLSGEADHNDCYMEINAGAGGTESQDWAEMLLRMYTRWAEKHGYKVEWLEESSGEQAGIKSATIRILGHNAYGWLKTESGVHRLVRISPYDSAARRHTSFSSAWVYPVIDDSIDIQINESECRIDTYRASGAGGQHINKTDSAVRITHIPTGIAVACQMERSQHQNRARAWDMLRARLYEAELQKREAAAQALEDQKTDIGWGHQIRSYVLQPYQMVKDLRTNVETSDTQGVLDGDLDMFMAASLAARVQGDVSQG

SEQ ID NO: 73809 - DNA, 1008 bp, Ehrlichia canis str. Jake
  CDS (1)..(1008)
ttgctagttgatcttaatgtacaatgttctagtacatctttatggaccgataatgcattagcacaaaacatattatccgaacgtgctagagtatctaaaattataacttcgtttacagaactagaagaagaattcaactattatactgaattactagatgttgtaaaaaacgatacagatgaactacttaatgacatagaaataggtttaacaaagctaaaagaaagaattcaaaaaaaagaagttgaatgtttattctcaaatgaagcagatcaaaacgattgctttatagaaattcaatccggagctggtggtacagaaagtaacgactggtcctgtatgcttctcagaatgtatgtaagatgggcagaaatataccacaacttcacaacagaaattgtttacaagttagatggcgaagaagtaggaataaaatctgcaacaataaaagtaactggcgataatgcatatggttggtcaaaaactgaaagtgggatccacaggttagtacggatttccccttttaattcaaatgctaaacgtcacaccactttttcaagcatattagtttctccaataacagatgaaaatattaatattgaaactttagataaggatttacgaatagatacatatagagcatctggtgcaggtggtcaacatgtcaacaaaacagaaagtgctgtacggatcacacatataccatctggaattgtagtacaatgtcaaaataatagatcacaacatcaaaacttagctgaagcacataatttactaaaaagcagactttatcaattaaaattacaagaaaaagaaaaaaaaatggcagaagaacataataaaagatgcaatataggttggggaaaccaaattagatcttatataatgcatccataccaaatggtaaaggacgtacgtacaggacatgaaattggcaacgtaaattctgtattagatggcaatttagacccatttattatatcagcattaacagcaaaaatattataa

SEQ ID NO: 73810 - protein, 335 aa, Ehrlichia canis str. Jake
MLVDLNVQCSSTSLWTDNALAQNILSERARVSKIITSFTELEEEFNYYTELLDVVKNDTDELLNDIEIGLTKLKERIQKKEVECLFSNEADQNDCFIEIQSGAGGTESNDWSCMLLRMYVRWAEIYHNFTTEIVYKLDGEEVGIKSATIKVTGDNAYGWSKTESGIHRLVRISPFNSNAKRHTTFSSILVSPITDENINIETLDKDLRIDTYRASGAGGQHVNKTESAVRITHIPSGIVVQCQNNRSQHQNLAEAHNLLKSRLYQLKLQEKEKKMAEEHNKRCNIGWGNQIRSYIMHPYQMVKDVRTGHEIGNVNSVLDGNLDPFIISALTAKIL

SEQ ID NO: 73811 - DNA, 615 bp, Burkholderia cepacia R18194
  CDS (1)..(615)
atgctgatgcagatttcttcggcgcacggcccgctcgaatgccagctggccgcggccaatgcgttgcggcgcctgcaggcggaagccgatgcgcagcgtgtcgtcgtcacggtgctcgatgcggagccgggcgaacggcccggtacgctgcgctcggcgctgctcgatctcgacggcgccggcgcgcaggcgctcgcggaccgctggaccggcacgctgcaatggatttgcgcgagcccgtaccggttgcgccatccgcgcaagaactggttcatcggcgtcacgcgctgtgccgacgcgcagccgctgccggatggcgacgtgcggttcgaagcgatgcgcgcacgcgggccgggcggccagcacgtgaacaagacgagctctgcgattcgtgcgacccatgtcgcgaccggcctgtcggtgcgcgtggaaagcgagcgcagccagcacgcgaacaagcgcctggcgctgcagttgctgcaggttcgactgcagcaggaagccgaccgtcacgcatcggatgcgcgccggcagcggcggatgcagcactttgcgctggagcgcggcaaccccgtgcgcgtgtttcacggggcggcgttcgtgccggctgattga

SEQ ID NO: 73812 - protein, 204 aa, Burkholderia cepacia R18194
MLMQISSAHGPLECQLAAANALRRLQAEADAQRVVVTVLDAEPGERPGTLRSALLDLDGAGAQALADRWTGTLQWICASPYRLRHPRKNWFIGVTRCADAQPLPDGDVRFEAMRARGPGGQHVNKTSSAIRATHVATGLSVRVESERSQHANKRLALQLLQVRLQQEADRHASDARRQRRMQHFALERGNPVRVFHGAAFVPAD

SEQ ID NO: 73813 - DNA, 747 bp, Burkholderia cepacia R1808
  CDS (1)..(747)
atgttctcgaacccggccgacccgaacaactgcttcatcgacatccaggccggcgccggcggcaccgaggcgtgcgactgggcgtcgatgctgctgcgccagtacctgcgctactgcgagcgcaagggcttcaaggccgaagtgctcgaagaatccgacggcgacgtcgccggcatcaagaacgcgacgatcaaggtgtcgggcgaatacgcgtacggcttcctgcgcaccgaaaccggcattcaccggctcgtgcgcaagtcgccgttcgactcgtcgggcggccgccacacgtcgttctcgtcggtgttcgtgtatcccgaaatcgacgactcgatcgaagtcgaggtgaacccggccgacctgcgcatcgacacctaccgcgcctcgggcgcgggcggccagcacatcaacaagaccgactccgcggtgcggatcacgcacatgccgaccggcatcgtcgtgcagtgccagaacgaccgttcgcagcaccgcaaccgcgccgaagcgatggccatgctgaagtcgcgcctgtacgaagccgagatgcgcaagcgccaggccgagcaggacaagctcgaatcgagcaagaccgacgtgggctggggccaccagatccgttcgtacgtgctcgaccagagccgcgtgaaggatctccgcacgaacgtcgaaatgagcaacacgaaagccgtgctcgacggcgatctcgacgacttcatcagcgcgagcctcaaacagggcgtgtaa

SEQ ID NO: 73814 - protein, 248 aa, Burkholderia cepacia R1808
MFSNPADPNNCFIDIQAGAGGTEACDWASMLLRQYLRYCERKGFKAEVLEESDGDVAGIKNATIKVSGEYAYGFLRTETGIHRLVRKSPFDSSGGRHTSFSSVFVYPEIDDSIEVEVNPADLRIDTYRASGAGGQHINKTDSAVRITHMPTGIVVQCQNDRSQHRNRAEAMAMLKSRLYEAEMRKRQAEQDKLESSKTDVGWGHQIRSYVLDQSRVKDLRTNVEMSNTKAVLDGDLDDFISASLKQGV

SEQ ID NO: 73815 - DNA, 984 bp, Listeria monocytogenes str. 4b H7858
  CDS (1)..(984): transl_table=11
atgttagatccgaatttttggaatgaccaacaagcggcacagaaagtaattaatgagtcaaacggatataaagaaacataccaagcttttcatgcgctagaagaagaacaagaaagtatggaaattagtctagaattattaaaagaagaagcagatgaagatttacaagaagaattagaaaaagatattaaagcttacatggcgactattagtgagtttgaattaaaactgatgctaagtgatccatatgacaaaaataatgctattttagaacttcatccaggtgctggtggtacagaatcacaagactggggttcgatgttacttcgtatgtatcaacgttggtctgagaagaaaggctttaaagtagagatgcttgattaccaagcaggggacgaagctggaataaaaagtgtcacgttacttataaaaggccacaatgcttacggctatttaaaagcggaaaaaggggtgcatcgtctagtgcgtatttcgccatttgactcatccggcagacgtcatacatcattcgtttccgtggatgtaatgcctgaattagatgatgatattgaaattgaagtacgtacagaagacttgaaaattgatacgtaccgcgcaactggtgcaggtggacaacatatcaatacaactgactcagctgttaggatgacacatattccatccggcatcgttgtaacgtgccaatctgagcgttctcagcttaaaaaccgtgaacaggcaatgaaaatgttaaaaacaaaattataccaaaaagaacaagaggaaaaagaacgcgagctagcagaaattcgaggagaacaaaaagaaattggttggggaagccaaattcgttcctatgttttccacccttactccatggtgaaagatcatcgcacaaattacgaaaccggtaatattcaagcggtaatggatggagacttagatgaatttatcaatgcatatttgcgttctaggattggataa

SEQ ID NO: 73816 - protein, 327 aa, Listeria monocytogenes str. 4b H7858
MLDPNFWNDQQAAQKVINESNGYKETYQAFHALEEEQESMEISLELLKEEADEDLQEELEKDIKAYMATISEFELKLMLSDPYDKNNAILELHPGAGGTESQDWGSMLLRMYQRWSEKKGFKVEMLDYQAGDEAGIKSVTLLIKGHNAYGYLKAEKGVHRLVRISPFDSSGRRHTSFVSVDVMPELDDDIEIEVRTEDLKIDTYRATGAGGQHINTTDSAVRMTHIPSGIVVTCQSERSQLKNREQAMKMLKTKLYQKEQEEKERELAEIRGEQKEIGWGSQIRSYVFHPYSMVKDHRTNYETGNIQAVMDGDLDEFINAYLRSRIG

SEQ ID NO: 73817 - DNA, 1017 bp, Listeria monocytogenes str. 1/2a F6854
  CDS (1)..(1017): transl_table=11
atggaagttcgaattgctgagttagaagaccaaatgttggatccgaatttttggaacgaccaacaagcagcgcaaaaagtaatcaatgaatccaatggatataaagaaacataccaagcgttccatgccctagaagaagaacaagaaagcatggaaattagtctggaactgttaaaagaagaagcggatgaagatttacaagaagaattagaaaaagatattaaagcttacatggcgactattagtgaatttgaattaaaactgatgctaagtgatccatatgacaaaaataatgctattttagaacttcatccaggtgctggtggtacagaatcacaagactggggttcgatgttacttcgtatgtatcaacgttggtctgagaaaaaaggctttaaagtagagatgctcgattaccaagcaggggacgaagctggaataaaaagtgttacgctacttataaaaggccacaatgcttacggctatttaaaagcggaaaaaggagtacatcgtctagtgcgtatttcaccatttgactcatctggcaggcgtcatacatcattcgtttccgtggatgtaatgcctgaattagatggcgatattgaaattgaagtacgtacagaagacttgaaaattgatacgtaccgcgcaactggtgcaggtggacagcatatcaatacaaccgactctgcagttcggatgacgcatattccgtccgggattgtcgtaacctgtcaatctgaacgttcacagcttaaaaaccgtgaacaagcaatgaaaatgttaaaaacaaagctgtatcaaaaagaacaagaagaaaaagaacgcgagctagcagaaattcgtggagaacaaaaagaaattggttggggaagccaaattcgttcctatgttttccacccttactccatggtgaaagatcatcgcacaaattacgaaaccggtaatattcaagcagtaatggatggagacttagatgactttatcaatgcatatttgcgttctaggattggataa

SEQ ID NO: 73818 - protein, 338 aa, Listeria monocytogenes str. 1/2a F6854
MEVRIAELEDQMLDPNFWNDQQAAQKVINESNGYKETYQAFHALEEEQESMEISLELLKEEADEDLQEELEKDIKAYMATISEFELKLMLSDPYDKNNAILELHPGAGGTESQDWGSMLLRMYQRWSEKKGFKVEMLDYQAGDEAGIKSVTLLIKGHNAYGYLKAEKGVHRLVRISPFDSSGRRHTSFVSVDVMPELDGDIEIEVRTEDLKIDTYRATGAGGQHINTTDSAVRMTHIPSGIVVTCQSERSQLKNREQAMKMLKTKLYQKEQEEKERELAEIRGEQKEIGWGSQIRSYVFHPYSMVKDHRTNYETGNIQAVMDGDLDDFINAYLRSRIG

SEQ ID NO: 73819 - DNA, 981 bp, Bacillus cereus G9241
  CDS (1)..(981): transl_table=11
atgatgggcgcaggattttgggatgatcaacaaggcgcacaagctgtcattaacgaagcaaatgcgttaaaagatatggttgggagtttccgtcagttagatgagacattcgaaaatttagaaataacacatgaacttttaaaagaagagtatgatgaagatttacatgaggagcttgaatcagaagtaaaaggcttaattcaagaaatgaatgagtatgagcttcagttactattaagtgatccttatgataaaaataacgccattttagaattacacccaggtgcaggtggaacagagtcacaagactggggttctatgttattacgtatgtacacacgttgggctgaaaaacgtgggtttaaagtagaaactgttgactacttaccaggtgatgaagctggtattaagagcgttactttattaattaaaggtcataacgcttacggttacttaaaagctgagaaaggtgtacatcgtcttgtacgtatttcaccattcgattcttcaggccgtcgtcatacatcgttcgtatcttgtgaagttgtacctgaattcaatgatgaagttgaaattgaaatacgtacagaagacttgaaaattgatacgtatcgtgcaagtggagcgggtggacagcacgtcaatacgacagattcagcagttcgtattacgcatacaccgacaaatacggttgtaacgtgtcagtcagagcgttctcaaattaaaaaccgtgagcatgcgatgaaaatgttaaaagcgaaattatatcaaaagaaattagaagagcaacaagcggagttagatgaaattcgcggagaacaaaaagaaatcggatggggtagccaaatccgttcttacgtattccacccatattctcttgtgaaagaccaccgtacaaatacagaagtcggtaacgtgcaagcagttatggatggagaaattgatccgtttattgatgcttacttacgttctcgcatctaa

SEQ ID NO: 73820 - protein, 326 aa, Bacillus cereus G9241
MMGAGFWDDQQGAQAVINEANALKDMVGSFRQLDETFENLEITHELLKEEYDEDLHEELESEVKGLIQEMNEYELQLLLSDPYDKNNAILELHPGAGGTESQDWGSMLLRMYTRWAEKRGFKVETVDYLPGDEAGIKSVTLLIKGHNAYGYLKAEKGVHRLVRISPFDSSGRRHTSFVSCEVVPEFNDEVEIEIRTEDLKIDTYRASGAGGQHVNTTDSAVRITHTPTNTVVTCQSERSQIKNREHAMKMLKAKLYQKKLEEQQAELDEIRGEQKEIGWGSQIRSYVFHPYSLVKDHRTNTEVGNVQAVMDGEIDPFIDAYLRSRI

SEQ ID NO: 73821 - DNA, 1068 bp, Rubrivivax gelatinosus PM1
  CDS (1)..(1068)
ttgctgacctgcgcgagcgcacggcccagctccgggggtatctttgactacgatgaaaagtcgcgccgcctgagcgaggtcaacgccgcgctcgaggatccgacggtctggaacgacccgaagaacgcccaggccctgggacgggagaagaagtcgctcgagacggtggtcgacaccatcgcgtcgctggagcgcaacctcgccgacaacgccgagctctacgagatgagcaaggaagaaggcgacgaggacggcctgcgcgccatcgaggccgagacgctggggttggccgcgcaggtggagcagctcgagttccgccgcatgttcagcaaccccgccgacccgagcaactgcttcatcgacatccaggccggcgccggcggcaccgaggcgtgcgactgggccagcatgctgctgcgccagtacctcaagtactgcgaacgcaagggcttcaaggccaccatcgaggacgagaccgagggcgacactgccggcatcaagagcgcgacgatcaaggtcgagggcgactacgccttcggccacctgcgcaccgagaccggcgtgcaccgcctggtgcgcaagagcccgttcgattcctcgggcgggcgccacaccagcttcgcgtcgctgttcgtctacccggaggtcgacgactcgatcgagatcgagatcaacccggccgacgtgcgcaccgacaccttccgcgccagcggtgcgggtggccagcacatcaacaagaccgactcggcggtgcggttgacgcacatcccgaccggcatcgtcgtgcagtgccaggacggccgcagccagcacagcaaccgcgacgtggcgtggaagcggctgcgttcgcgcctctacgaccacgagatgcgcaagcgccaggaagagcagcagaagctggaagacaccaagaccgacgtcggctggggccaccagatccgctcctacgtgctggacaacagccgcatcaaggacctgcgcaccaacgtcgagatctccaacacgcagaaggtgctcgatggcgacctggacgccttcatcgaggccagcctgaagcagggcgtctga

SEQ ID NO: 73822 - protein, 355 aa, Rubrivivax gelatinosus PM1
MLTCASARPSSGGIFDYDEKSRRLSEVNAALEDPTVWNDPKNAQALGREKKSLETVVDTIASLERNLADNAELYEMSKEEGDEDGLRAIEAETLGLAAQVEQLEFRRMFSNPADPSNCFIDIQAGAGGTEACDWASMLLRQYLKYCERKGFKATIEDETEGDTAGIKSATIKVEGDYAFGHLRTETGVHRLVRKSPFDSSGGRHTSFASLFVYPEVDDSIEIEINPADVRTDTFRASGAGGQHINKTDSAVRLTHIPTGIVVQCQDGRSQHSNRDVAWKRLRSRLYDHEMRKRQEEQQKLEDTKTDVGWGHQIRSYVLDNSRIKDLRTNVEISNTQKVLDGDLDAFIEASLKQGV

SEQ ID NO: 73823 - DNA, 747 bp, Pseudomonas fluorescens PfO-1
  CDS (1)..(747)
atgttcagccacgagatggacccgaacaacgcctacctggacatccaggccggttccggcggcaccgaagcccaggactgggccaacatcctgctgcgcatgtacctgcgctgggccgacaagcgcggtttcgacgcaaccatcatggagctgtcggccggtgaagtcgccgggatcaagggtgcgaccgtgcacatcaagggcgaatacgcctttggctggctgcgtaccgagatcggcgtgcaccgtctggtgcgcaagagcccgttcgactccggcaaccgtcgccacacctcgttctccgcggtttttgtctcgcccgagatcgacgacaaggtggaaatcgaaatcaacccggcagacctgcggatcgacacctatcgttcctccggtgccggtggtcagcacgtaaacaccaccgactcggccgtacgtatcacccacgtaccgaccaacaccgtggtgagctgccagaacgaacgttcccagcacgccaacaaggacaccgccatgaaaatgctgcgggccaagttgtacgagcaggaaatgcagaagcgcaacgcggcgtcccaggcgctggaagacaccaagtcggacatcggctggggtcaccagatccgttcgtatgtgctcgatgcgtcgcggatcaaggatctgcgtaccaacatcgaacgcagcgactgcgacaaggtactcgacggcgacatcgacgaatacctggaagccagcctgaaatcgggcctgtaa

SEQ ID NO: 73824 - protein, 248 aa, Pseudomonas fluorescens PfO-1
MFSHEMDPNNAYLDIQAGSGGTEAQDWANILLRMYLRWADKRGFDATIMELSAGEVAGIKGATVHIKGEYAFGWLRTEIGVHRLVRKSPFDSGNRRHTSFSAVFVSPEIDDKVEIEINPADLRIDTYRSSGAGGQHVNTTDSAVRITHVPTNTVVSCQNERSQHANKDTAMKMLRAKLYEQEMQKRNAASQALEDTKSDIGWGHQIRSYVLDASRIKDLRTNIERSDCDKVLDGDIDEYLEASLKSGL

SEQ ID NO: 73825 - DNA, 969 bp, Rhodospirillum rubrum
  CDS (1)..(969)
atgcgcgagcgcacccatctggagcaatcggtcgccggctatcgcgcccttgagcgcgaggtcgacgacgcggcgacgctgatcgaactgggcgatgccgaggacgatgccgaaagcatcgccgagggcgagcgcatgctgcacagcgccgcccagaaagcccgcaagcaggagcttgaaagcctgctgtcgggcgaagccgatcataacgacgcctatttggaagtccatgccggggccggtggcaccgaggcccaggattgggcgctgatcttgctgcgcatgtatacgcgctgggccgaagcccacggccacaaggtggaattccttgaagaaagcgccggggaagaagccgggatcaaatcggcgacgatcaagatcgtcggccataacgcctatggttggctgaagaccgaaagcggcgtgcaccggctggtgcgcatttcgcccttcgacagctcggcgcggcgccataccagcttttcctcgatctgggtctatccggtggtcgatgacaccatcgagatcgatatcgaagaaaaggattgccgcatcgatacctaccgggcctcgggcgccggtggtcagcacgtcaaccggacggaatcggcggtgcgcatcacccatattccgaccggcatcgtcgtgcagtgccaatccgaacgctcgcagcaccagaacaaggattattgctggtcgatgctgcgcgcccgcttgtacgagcatgagctgcaaaagcgcgaagaaaagaccaaggccctggaagacaccaagaccgatatcggctggggtcaccagatccgctcctatgttctgcagccctatcagatgatcaaggacacgcggaccaacgttgaaacctctgatacccagggcgtgctcaacggcgatcttgatcaattcatggccgcgtcgctggccgcccgcatcgtcggcgccggcgacgccatggccgatatcgccaagtaa

SEQ ID NO: 73826 - protein, 322 aa, Rhodospirillum rubrum
MRERTHLEQSVAGYRALEREVDDAATLIELGDAEDDAESIAEGERMLHSAAQKARKQELESLLSGEADHNDAYLEVHAGAGGTEAQDWALILLRMYTRWAEAHGHKVEFLEESAGEEAGIKSATIKIVGHNAYGWLKTESGVHRLVRISPFDSSARRHTSFSSIWVYPVVDDTIEIDIEEKDCRIDTYRASGAGGQHVNRTESAVRITHIPTGIVVQCQSERSQHQNKDYCWSMLRARLYEHELQKREEKTKALEDTKTDIGWGHQIRSYVLQPYQMIKDTRTNVETSDTQGVLNGDLDQFMAASLAARIVGAGDAMADIAK

SEQ ID NO: 73827 - DNA, 981 bp, Ralstonia metallidurans CH34
  CDS (1)..(981)
ttgctcgaagaccccgacgtctggaacaaccccaagcgagcccaggacctgggcaaggaaaagaaggcgctggaaggcgtcgtgcaggtactcggcaagctgaccgacgacctcaacggcacggacgagctgttcgagcttgcccgcgaggaaggcgacgacgagacactcgaatccatcgaggccgacgtctctggcttcgaggccctggtggcggacatggagttccgccgcatgttctcgggcgagatggaccaggccaatgcgttcatcgacatccaggcgggcgccggcggcaccgaggcctgcgactgggcgtcgatgctgctgcgccagtacctgaagtactgcgagcgcaagggtttcaaggccgaagtgctggaagaatccgaaggcgacgtagccggcatcaagagcgcgacgatcaaggtcgagggcgaatacgcgttcggctacctgcgcacggaaaccggtgtgcatcgcctggtgcggaagtcgccgttcgattcgtcgggcgggcgccatacgtcgttctcgtcggtcttcgtctaccccgaggtggatgattcgttcgaggtggaggtcaacccggccgatctgcgcgtggatacctaccgcgcgtcgggtgccggtggtcagcacatcaacaagaccgactccgccgtgcggattacgcacatgcctaccggcatcgtcgtgcagtgccagaacgaccgttcgcagcaccgcaaccgcgccgaggccatgtccatgctgaagtcgcgcctgtacgagcatgaaatgcgcaagcgtcaggcggaagccgacaagctcgaagccggcaagacggacgtgggctggggccaccagatccgctcgtacgtgctggaccagagccgtatcaaggacctgcgcaccaacgtggaaatgtccaacacccagaaggtgctggatggtgacctcgacccgttcatcgaggccagcctgaaacaggggttgtaa

SEQ ID NO: 73828 - protein, 326 aa, Ralstonia metallidurans CH34
MLEDPDVWNNPKRAQDLGKEKKALEGVVQVLGKLTDDLNGTDELFELAREEGDDETLESIEADVSGFEALVADMEFRRMFSGEMDQANAFIDIQAGAGGTEACDWASMLLRQYLKYCERKGFKAEVLEESEGDVAGIKSATIKVEGEYAFGYLRTETGVHRLVRKSPFDSSGGRHTSFSSVFVYPEVDDSFEVEVNPADLRVDTYRASGAGGQHINKTDSAVRITHMPTGIVVQCQNDRSQHRNRAEAMSMLKSRLYEHEMRKRQAEADKLEAGKTDVGWGHQIRSYVLDQSRIKDLRTNVEMSNTQKVLDGDLDPFIEASLKQGL

SEQ ID NO: 73829 - DNA, 843 bp, Burkholderia fungorum LB400
  CDS (1)..(843)
atggcccgcgaagaaggcgacgaggaaactctcctcgcctgcgaatccgacgcgcaaggcatcgaacagcgcgtggcggacatggaattccgccgcatgttcgcgaacccggccgatccgaacaatgcgttcctggacatccaggccggcgccggcggcaccgaagcgtgcgactgggcggccatgctgctgcgccaatacctgcgctactgcgagcgcaagggcttcaagaccgaagtgctggaacagaccgacggcgacgtcgcgggcatcaagaacgccacgatcaagatcgaaggcgaatacgcgtatggctttctgcgcaccgagaccggcgtgcaccgcctcgtgcgcaagtcgccgttcgactcgtcgggcggccgccacacgtcgttctcctcggtgttcgtgtacccggaaatcgacgactcgatcgaagtggacatcaacccggccgatctgcgcatcgacacgtaccgcgcgtccggcgcgggcggtcagcacatcaacaagaccgactccgcggtgcgtatcacgcacttgccgtcgggcatcgtcgtgcagtgccagaacgaccgttcgcagcaccgcaaccgcgccgaagcgatggccatgctgaaatcgcgcctgtacgaggcggaaatccgcaagcgtcaggccgagcaggacaagctcgaagccggcaagaccgacgtgggctggggtcatcagatccgctcgtacgtgctggacaacagccgtatcaaggatctgcgcacgaacgtcgaaatcagcaataccaagagcgtgctcgacggcgacctcgatccgttcatcagcgccagcctgaaacagggcgtctga

SEQ ID NO: 73830 - protein, 280 aa, Burkholderia fungorum LB400
MAREEGDEETLLACESDAQGIEQRVADMEFRRMFANPADPNNAFLDIQAGAGGTEACDWAAMLLRQYLRYCERKGFKTEVLEQTDGDVAGIKNATIKIEGEYAYGFLRTETGVHRLVRKSPFDSSGGRHTSFSSVFVYPEIDDSIEVDINPADLRIDTYRASGAGGQHINKTDSAVRITHLPSGIVVQCQNDRSQHRNRAEAMAMLKSRLYEAEIRKRQAEQDKLEAGKTDVGWGHQIRSYVLDNSRIKDLRTNVEISNTKSVLDGDLDPFISASLKQGV

SEQ ID NO: 73831 - DNA, 519 bp, Enterococcus faecium
  CDS (1)..(519): n means a or g or c or t/u
atgggaaaaaataaggaaaaaaggncccaanggggggatttccaaaaggaagttttgttttgganccccttgctgattaaaggacataacgcttttggttatctaaaatcagaaaaaggtgttcatcgccttgtacggatttcgccttttgactcagcgaaacgacgtcatacttctttttgttcggtagatgtgatgccagagcttgatgaaacgatcgatatagaaatcaatccagatgatttgaaaatcgatacgtaccgagcaagtggtgcaggtggtcagcacatcaataaaacagaatctgctgtacggatcactcacttgcctacaggaacagtagtagctagtcaggcacaacgctcacaattgaaaaaccgtgagcaagcgatggggatgttaaaagctaagctttatcaattagaagtggaaaagaaagaacaagaagcagctgcacttcgaggagaacaaaagaaatcggctggggttcacagatccgttcttatgttttccatctag

SEQ ID NO: 73832 - protein, 172 aa, Enterococcus faecium
  misc_feature (9)..(9): Xaa can be Thr or Pro or Ala or Ser
  misc_feature (11)..(11): Xaa can be Arg or Gly or Trp
  misc_feature (22)..(22): Xaa can be Asn or Thr or Ser or Ile
MGKNKEKRXQXGDFQKEVLFWXPLLIKGHNAFGYLKSEKGVHRLVRISPFDSAKRRHTSFCSVDVMPELDETIDIEINPDDLKIDTYRASGAGGQHINKTESAVRITHLPTGTVVASQAQRSQLKNREQAMGMLKAKLYQLEVEKKEQEAAALRGEQKKSAGVHRSVLMFSI

SEQ ID NO: 73833 - DNA, 1140 bp, Magnetococcus sp. MC-1
  CDS (1)..(1140)
atgcgcagcaatggaacgaacgccgtggaagagaatatacaaagaacctttgaggccattggggagaagcttaccctattgcgtggtcatttaaactatgagcaggggaaagagcgtctgagcgagctggaatccctggctcaagatcccaatctatggggggattctgagcgtgcgcgcaccgtgatgacggagaaaaaccgtctggaaaaaaccattggtgagtgggatgcgctcaatagcgaatccaccgatgcccgtgatctgctggagatggcccaggaggagggcgatagcggcatgatcgctgaggtaacggcgcaggtggctgccattctcaaacggttagaggggctggagctggcacgcatgctctccggcgaggccgacgccaacaactgctttatcgagatccatcccggtgctgggggtacagagtcccaggattgggcctctatcctgctacgcatgtatctgcgttattgcgagaaatccggctttaaaaccgaagaggttgactatctggccggggatgaggcgggcattaaatcggtcaccatcaaggttgagggtgactacgcttacggctatctcaaggtggaaagtggggtgcatcgcctggtgcgcatcagcccctttgactcctcggcgcggcggcacacctcgtttacctcggtcaacgtctatccagaaattgatgactccatcgagattgagatcctcgataaagatctgcgggtggataccttccgtgcctctggagcgggtgggcagcacgtcaataaaaccgattcggccatccgtattacccaccagcccaccggtattgtggtgcagtgccaatcggggcgctctcagcaccgtaaccgggatgaggcgatgaaaatgctacgggcgcggctgtttcagttagagatggataaacgggccgaggccgcccaagcggtggccgacgccaagagtgacattgcttgggggcaccagatccgctcctatgtgctggccccttatcggctggttaaagatctacgtaccagctatgaaaccggcaataccgatgcggtattggatggcgagttggatggctttattaaggcggccctctcgcaacgcattgttggggatgaccatagcggttaa

SEQ ID NO: 73834 - protein, 379 aa, Magnetococcus sp. MC-1
MRSNGTNAVEENIQRTFEAIGEKLTLLRGHLNYEQGKERLSELESLAQDPNLWGDSERARTVMTEKNRLEKTIGEWDALNSESTDARDLLEMAQEEGDSGMIAEVTAQVAAILKRLEGLELARMLSGEADANNCFIEIHPGAGGTESQDWASILLRMYLRYCEKSGFKTEEVDYLAGDEAGIKSVTIKVEGDYAYGYLKVESGVHRLVRISPFDSSARRHTSFTSVNVYPEIDDSIEIEILDKDLRVDTFRASGAGGQHVNKTDSAIRITHQPTGIVVQCQSGRSQHRNRDEAMKMLRARLFQLEMDKRAEAAQAVADAKSDIAWGHQIRSYVLAPYRLVKDLRTSYETGNTDAVLDGELDGFIKAALSQRIVGDDHSG

SEQ ID NO: 73835 - DNA, 1128 bp, Thermobifida fusca
  CDS (1)..(1128)
atggcagaactagaccccgcagagcagatcaaggaactcacatccacgctggagaacatcgaggccgtactggacctcgacgccaagcgcacggaaattgagcagctgcgggagcagtcagccgatcccgagctgtggaacgaccaggccaatgcgcagaaggtcacgcggcggctctcctttttggagtcggaagtctccaaggtcgagaacatccgcagccggatcgatgacctcggtgtgctcttcgagctcgcggcggcagagaacgacgccgaaacccttgccgaggcccgcagggagctggccgcgctgcgcaaggacatcagcgatcttgaggtgcgcaccctgctatcgggcccctacgacgagcgtgaagcactgatcagcatcaacgctcaggcgggtggggtcgacgcggcagactggacgcagatgctgcagcggatgtacctccgctgggcggagcgccacggctacccgacggagatctacgagacctcctacgctgaggaagccggcatcaagtccacgacgttcgtggtcaaggcgccctacgcctacggcatgctgcgcggcgagcacggtacgcaccgcctggtgcggatctcgccgttcgacaaccagagccgccgtcagacctcgttcgccggagtcgatgtggtcccggtcgtcgagcagagcgaccacattgagattgacgaaagcgaactgcggatcgacgtgtaccgctcttcagggcccggcggccagggcgtcaacaccaccgactcggcggtgcggatcacccacctgccgaccgggatcgtggtctcctgccagaacgaacgctcccagttgcaaaaccgcgctaccgcgatgtcgatcctccaggccaagctgctggaacgcaaacgccaggaggaggaggccgagctcgccgcgctccgcggtgagtccgcgcgggcgtggggaacccagatgcgcaactacgtgctccacccctaccagagcgtcaaagacatccgcaccggggtggagaccgggaacaccagcgctgtcctcgacggagagatcgacgagttcatcaacgctgggatccgctggctgcggagccgggagagggacgagcagaagaaagcgggataa

SEQ ID NO: 73836 - protein, 375 aa, Thermobifida fusca
MAELDPAEQIKELTSTLENIEAVLDLDAKRTEIEQLREQSADPELWNDQANAQKVTRRLSFLESEVSKVENIRSRIDDLGVLFELAAAENDAETLAEARRELAALRKDISDLEVRTLLSGPYDEREALISINAQAGGVDAADWTQMLQRMYLRWAERHGYPTEIYETSYAEEAGIKSTTFVVKAPYAYGMLRGEHGTHRLVRISPFDNQSRRQTSFAGVDVVPVVEQSDHIEIDESELRIDVYRSSGPGGQGVNTTDSAVRITHLPTGIVVSCQNERSQLQNRATAMSILQAKLLERKRQEEEAELAALRGESARAWGTQMRNYVLHPYQSVKDIRTGVETGNTSAVLDGEIDEFINAGIRWLRSRERDEQKKAG

SEQ ID NO: 73837 - DNA, 1017 bp, Geobacter metallireducens GS-15
  CDS (1)..(1017)
atggaggcccatatcgcggcccccggcttctgggatgacaacgagaaggcccagcaactcctcagggaacggacgcggatcgagaagatcctggagctctgggaccgtctgacccgtcaggccgacgatatccgggtgctgatcgagctgggcgaggaggccggggacgagggaaccctcgacgaggtccgggcactcaatgaccagctggaaaaggatgtggagggggccgagttccagcggatgctctcgggcacccacgacaagaacgcctgctacttttccatcaacgccggcgcagggggtaccgaggcccaggactgggccgagatgctgctcaggatgtatctccgctactgcgagcgcaaggggtggaaaacggagatcaccgactatcagggcggcgacgaggctggggtcaagtcggccacctttaccgttgacggtgagtatgcatacggctatcttaaggccgaagccggcatccaccgcctcgtgcggatttctcctttcgattccaatgcccggcgacatacctccttcgcctcggtcttcgccttccccgagatcgaggacgatatcgaggtaacgatcaacgaagcagatctgagaatcgacacctaccgctccagcggggccggcggccagcacgtgaatactaccgattcagccgtccggatcacccatatccccacgggcctcgtggctgccagccagtgcgagcggagccagcacatgaacaaggcgaccgccatgaagatgctccgggccaagctctacgagaaggagcttcaggagcgggaggccaaggccgccgagatcggcggtgagaagaaggagatcggctggggaagccagattcgctcctatgtccttcatccctacaagatggtgaaggatctgaggaccggcgttgaaaccggcaaccccgacgcggttctggacggcgatctcgaggagttcatcgtcgccttcctcatgggggtacgccgggacgttaaggacaccgtagactga

SEQ ID NO: 73838 - protein, 338 aa, Geobacter metallireducens GS-15
MEAHIAAPGFWDDNEKAQQLLRERTRIEKILELWDRLTRQADDIRVLIELGEEAGDEGTLDEVRALNDQLEKDVEGAEFQRMLSGTHDKNACYFSINAGAGGTEAQDWAEMLLRMYLRYCERKGWKTEITDYQGGDEAGVKSATFTVDGEYAYGYLKAEAGIHRLVRISPFDSNARRHTSFASVFAFPEIEDDIEVTINEADLRIDTYRSSGAGGQHVNTTDSAVRITHIPTGLVAASQCERSQHMNKATAMKMLRAKLYEKELQEREAKAAEIGGEKKEIGWGSQIRSYVLHPYKMVKDLRTGVETGNPDAVLDGDLEEFIVAFLMGVRRDVKDTVD

SEQ ID NO: 73839 - DNA, 1128 bp, Novosphingobium aromaticivorans DSM 12444
  CDS (1)..(1128)
atgcgtgccgaagggcaggcccatatcgaccgcatcgaggccgcactggcgctggtgcgcaagttcctcgactgggaccgcgcggttcgccgccttgacgagctgaacgcgcgcgtcgaggaccccaagctgtgggacgatcccaagaaggccgaggaagtgatgcgcgagcgtcgccggctggaagcctcgatcggcaccgtcaaccagatcggccaggaaatggccgatgccatcgagttcgtcgaactcggcgaaatggaaggcgacgaggacacgatcaacgaaggcctcgcgacgcttgccgcgctggccgagcgtgccgacaacgacaaggtccaggccctgctggcgggcgaggctgatgccaacaacgccttcctcgaagttcacgcgggcgcgggcggcaccgaaagccaggactgggccgagatgctccagcgcatgtacacgcgctgggccgagcggcacggatacaaggttgaactggtcgactatcacgctggcgaggctgccgggatcaagtcggccacgctgctgatcaagggcgagaacgcctatggctatgccaagaccgagagcggcgtgcaccgcctcgtgcgcatcagcccctatgacagctcggcgcggcgccacacctcgttcagctcggtctgggtctatcccgagatcgacgacaacatcgaggtcgagatcaatccggccgacctcaagatcgacacctaccgcgcgtcgggcgcgggtgggcagcacgtgaacacgaccgactccgcggtccgcatcacccacgtgcccaccggcatcatcgtcgccagccagaacgaccgcagccagcacaagaaccgcgcaaccgcgatgggcatgctgaaggcgcgcatctacgaggcggaactggccaagcgcgaggccgcggccagcggcgaatatgcggccaagaccgagatcggctggggccaccagatccgctcctacgtgttgcagccctaccagcaggtgaaggacctgcgcacgggcgttgtctccaccaatcccaccgaagtgctcgacggcgcgctcgacccgttcatggcggcggcgctttcgcagcgcgtgaccggcgagaaggtgacggtggaggacgacgattga

SEQ ID NO: 73840 - protein, 375 aa, Novosphingobium aromaticivorans DSM 12444
MRAEGQAHIDRIEAALALVRKFLDWDRAVRRLDELNARVEDPKLWDDPKKAEEVMRERRRLEASIGTVNQIGQEMADAIEFVELGEMEGDEDTINEGLATLAALAERADNDKVQALLAGEADANNAFLEVHAGAGGTESQDWAEMLQRMYTRWAERHGYKVELVDYHAGEAAGIKSATLLIKGENAYGYAKTESGVHRLVRISPYDSSARRHTSFSSVWVYPEIDDNIEVEINPADLKIDTYRASGAGGQHVNTTDSAVRITHVPTGIIVASQNDRSQHKNRATAMGMLKARIYEAELAKREAAASGEYAAKTEIGWGHQIRSYVLQPYQQVKDLRTGVVSTNPTEVLDGALDPFMAAALSQRVTGEKVTVEDDD

SEQ ID NO: 73841 - DNA, 1077 bp, Cytophaga hutchinsonii
  CDS (1)..(1077)
atgactaacgaccaactaaaggaattaaaagcgagtattcttgcattacggggatatcttggctatgattctaaaatggacgaaataaaagcagagcaggaattatcgctggcgcctacattttgggatgactcaaaagaagctgaaaaaattcttagaagtataaaaaataaaaaagtatggacagatccatacgatgcattgcttacaaaattaggcgaccttgaagcattgaatgaattttaccaggcaggcgacattgacgacaaagaaatggatgctgaattcgcagctgttgctaaagtactggaagaacttgaattcaaaaaaatgctgagcgcggaagaagatcagctgagcgcagtacttgaaataaaccctggcgcaggcggaacggaaagcaacgactgggcagacatgctgatgcggatgtacatcatgtggggtgaaaaaaacgggtataccgtacgtgaaattgtaaaccagccgggtgaagttgcagggatcaaatttgcttcgttaggaatcgaaggccagtttgcttacggaaatttaaaatcagagattggcgtgcaccgtttggtacgtgactctccgttcaatgcagatggtaaaagacaaacatcctttgcttcggtgtatgtatatccggaagtagatgaaaccatcaacattgagatcaacatgggcgatgtggaatgggataccttcagagcaggcggtgccggcggacaaaatgtaaacaaggttgaaacggccgtccggttgaaacacaaaccatccggtttgatcatcgaatgccagcaggaacgttctcagatccagaataaagataaagccttaaaattattaaagtcccgtttatatcagattgagatagacaaacgcaacgaggctaaagcggcagtggaaggaacaaaaaagaaaatcgactttggctcccagatccgaaactatgtattgtttccgtacaaacttattaaagatgtgcgtacaggcgttgaacgcacagacgttgacaacgtgcttgcgggagatctgaacgaatacatcaaagcatatttgctgatgaaataa

SEQ ID NO: 73842 - protein, 358 aa, Cytophaga hutchinsonii
MTNDQLKELKASILALRGYLGYDSKMDEIKAEQELSLAPTFWDDSKEAEKILRSIKNKKVWTDPYDALLTKLGDLEALNEFYQAGDIDDKEMDAEFAAVAKVLEELEFKKMLSAEEDQLSAVLEINPGAGGTESNDWADMLMRMYIMWGEKNGYTVREIVNQPGEVAGIKFASLGIEGQFAYGNLKSEIGVHRLVRDSPFNADGKRQTSFASVYVYPEVDETINIEINMGDVEWDTFRAGGAGGQNVNKVETAVRLKHKPSGLIIECQQERSQIQNKDKALKLLKSRLYQIEIDKRNEAKAAVEGTKKKIDFGSQIRNYVLFPYKLIKDVRTGVERTDVDNVLAGDLNEYIKAYLLMK

SEQ ID NO: 73843 - DNA, 1074 bp, Clostridium thermocellum ATCC 27405
  CDS (1)..(1074)
atgaaatggggaaatctctttgacatcgccagtataggcaatcaaattgaggaacttgaacaaaaagcttcagaacctgatttctggaatgataccgagaattctcagaaaattttgcaaaagattaaatctttaagaagcaaagtggaaagatacaacaagctggtttcccagtgggaagatttgatcactttgtgtgagcttggaattgaagagcaggatgaaagtgtgattcctgaggcggtggaaggttttaaggcctttaaaaaggaatttgaagctttaagacttgagacacttcttaccggacaatatgacaaaaacaatgccctcctgaccttgcatgccggggcgggaggaactgaggcccaagactgggtgcagatgcttttcagaatgtatacccggtgggcggagaagaagggatttactgtaaaggtactggattatcttgacggagaggaagcaggtattaaaagtgttactttccaggttatcggagagaatgcttacggttttttaaaatccgaaaagggagtacaccggcttgtcagaatttctccctttgatgcttcgggaagaaggcatacttcctttgcttcactggatgttatgccggagctgaatgatgatattgaagtacacataaacccggatgaccttcgcattgacacttaccgttccagcggtgccgggggtcagcatataaataaaaccgaatcggccgtaagaattacccatatacccacgggtatagtggtttcatgtcagagcgaacgctctcagttccagaacaaagatactgccatgaaaatgcttaaggcaaagcttatggagctgaaagagcgcgaaaacaaggaaaagatagaggacttgaaaggtatacagttggaaatagcatggggaagccaaataaggtcctatgtgttttgcccgtatacccttgtgaaagaccacagaaccaattatgaagaaataaatgtggatgccgttatggacggggaattggatggatttataaattcttatctttcaagtgtgtcgaaagacaacaataaagaaaaagtaggataa

SEQ ID NO: 73844 - protein, 357 aa, Clostridium thermocellum ATCC 27405
MKWGNLFDIASIGNQIEELEQKASEPDFWNDTENSQKILQKIKSLRSKVERYNKLVSQWEDLITLCELGIEEQDESVIPEAVEGFKAFKKEFEALRLETLLTGQYDKNNALLTLHAGAGGTEAQDWVQMLFRMYTRWAEKKGFTVKVLDYLDGEEAGIKSVTFQVIGENAYGFLKSEKGVHRLVRISPFDASGRRHTSFASLDVMPELNDDIEVHINPDDLRIDTYRSSGAGGQHINKTESAVRITHIPTGIVVSCQSERSQFQNKDTAMKMLKAKLMELKERENKEKIEDLKGIQLEIAWGSQIRSYVFCPYTLVKDHRTNYEEINVDAVMDGELDGFINSYLSSVSKDNNKEKVG

SEQ ID NO: 73845 - DNA, 1044 bp, Microbulbifer degradans 2-40
  CDS (1)..(1044)
atgtgcttagggggtatctttgaatacgctgaaaagaaagagcgcttagccgaagtagagctagagctagcagagcccgatgtatgggatgatcctgcccgcgcgcaagcgctaggcagtgaacgcagctcgctcgagctggtagtagaaactatcgaaaccctcgaaaacggcgttgccgattgccgcgagctgctcgaaatggcaattgaagagagcgacgaagatagctttctagaaatttgcagcgaagcagaccgcttagaagcccatttggctacgctagagttccgccgtatgttctctggcgaaatggacccgaataacgcctacctcgatattcaagccggttcgggtggtacagaggcgcaggactgggccgagatgctattgcgtatgtatttgcgctggggtgaagacaagggctttaagacgacgcttgaagaagcatcggcaggtgatgtggcgggtattaaaagtgccactattcgctttgaaggggaatacgcctttggctggctgcgcactgaaacgggcgtgcatcgattagtgcgtaaatcaccgttcgactctggcaatcgtcgtcacacttctttttcttctgtattcgtgtcgccagaaattgacgacaatatcgatatagaaataaacaaagccgatgtgcgagaagatacttaccgcgcgtcgggtgcgggtggtcagcacgttaacaaaaccgattcggctgtgcgcttaactcacgcgccaacgggaatagttgtgcagtgccaaagcgaacgttcgcagcactctaaccgcgataaagcatggaaaatgctccgcgctagggtttacgagcaagagatgcaaaagcgcaatgcagaaaagcaggcgttagaagacagtaaatctgatattggttggggcagtcaaattcgatcttacgtattggatgaccagcgcattaaagatttgcgtaccaatgttcaaaccagtaactgcaatgccgtgcttgatggcaagcttgacgattttattgtcgcgagtttaaaagcgggcttataa

SEQ ID NO: 73846 - protein, 347 aa, Microbulbifer degradans 2-40
MCLGGIFEYAEKKERLAEVELELAEPDVWDDPARAQALGSERSSLELVVETIETLENGVADCRELLEMAIEESDEDSFLEICSEADRLEAHLATLEFRRMFSGEMDPNNAYLDIQAGSGGTEAQDWAEMLLRMYLRWGEDKGFKTTLEEASAGDVAGIKSATIRFEGEYAFGWLRTETGVHRLVRKSPFDSGNRRHTSFSSVFVSPEIDDNIDIEINKADVREDTYRASGAGGQHVNKTDSAVRLTHAPTGIVVQCQSERSQHSNRDKAWKMLRARVYEQEMQKRNAEKQALEDSKSDIGWGSQIRSYVLDDQRIKDLRTNVQTSNCNAVLDGKLDDFIVASLKAGL

SEQ ID NO: 73847 - DNA, 747 bp, Microbulbifer degradans 2-40
  CDS (1)..(747)
atggaagtgaacccaatagaagtaaagtcgaaagcaacaagatcggaaacaactaaaggctacccacaagcaaattcagttgaatggctgcagctaaccgcaggccaagggccaaaggagtgtggctgggtagtggcgcaattgttaaaagtaatgctcgtacaggcgcaagcccgtggcatagatgtagaagtagtcgaatcgctcgccttcgacaaaatgttacgcaaccaacacatagtcatgccagatgcatatctatcggtattactgcgtatagagggcgagcaagcgcagctgtttgccaacgagtggtgcggtacgcataagtggcagggcgaaagtatttatcggcctaaacacaaacgcattaactggtttgttggcgtagagcgcataacaccggttaaacccgttgagaccagtattaattaccagcaattacagcggcaattggtgttcgaatctatgaagtcatctggcgcgggtgggcagcatgttaataccactaatagtgcggtaagagctacccacacacccagtggtattaccgtaagggtagataccgatagatcgcagcatcgcaataaacgcctagcgttagagcggatagccatgcttctactgagcgcagaaaaagaaggagcaaacaaacaagtgaacgagcgctggttacaacattatcaagttaaacggggcagcccagttaaaacatttattgggcaagaatttaaagaaattaattag

SEQ ID NO: 73848 - protein, 248 aa, Microbulbifer degradans 2-40
MEVNPIEVKSKATRSETTKGYPQANSVEWLQLTAGQGPKECGWVVAQLLKVMLVQAQARGIDVEVVESLAFDKMLRNQHIVMPDAYLSVLLRIEGEQAQLFANEWCGTHKWQGESIYRPKHKRINWFVGVERITPVKPVETSINYQQLQRQLVFESMKSSGAGGQHVNTTNSAVRATHTPSGITVRVDTDRSQHRNKRLALERIAMLLLSAEKEGANKQVNERWLQHYQVKRGSPVKTFIGQEFKEIN

SEQ ID NO: 73849 - DNA, 1119 bp, Oenococcus oeni PSU-1
  CDS (1)..(1119)
atggaattagcacaagcaagaaattcaatcagcgacatgcaggaacaaatagatggttttcgttctactttagacctggacgctctcgatgcatcaattgcggaaaatgaagataagatgagccaaccgggtttttgggatgatcagcagtctgctcaaaaaatcattgatgaaactaatactttgaaaaatcggcgtgattcctttttgagtctgcaaaaatcggttgaagatctgactgcaatggcggaactgctgtcggaggaggatgatgcggatatgcacgctgaactcgacacggatatcgaaaaaaccgaaaaggatttggaaaaatataatctgaatcaacttttaactgaaaagtacgattcaaataatgcaattttggaaattcatccgggcgagggtggtactgaatcaaccgattgggccagtaatctttaccgaatgtacactcgttgggctcaagcccatgatttcaaagtcgaagtgacggattaccaaaccggtgatgtagccggaatcgactcggctacgctgcgaattatcggtcacaacgcatatggctttttgcgaagcgaaaaaggagttcaccgtttcgttcgtatcagtcccttcgactcggctgggcgccgacatacatcgtttgtttccatcgatgttatgcccgaattagatgatgacgagattgaaatagagattaaacctcaggatgtcaaaatggatgtgtaccgttccgggggcgccggtggccaaaatgtcaacaaagtttcaactgccgttcgtttgactcatattccaactggaatcgttgtagcttcccaggttgaaagaactcagtatggtaatagagacattgcaatgaagatgttaaaggccaaactttatgagcaggaagaacaaaagcgtgaagaagaacatgccaaattatcaggcacgaaattggatgttgcctggggatcacaaattcgctcatatgtttttcaaccctatcgaatggtaaaggacttacgttcgggttatgaaaccggtgatacagatggagttatggatggtaatttggatccgtttattaatgcttatctaaaatggaagctctcccaaaaaaatccggagtaa

SEQ ID NO: 73850 - protein, 372 aa, Oenococcus oeni PSU-1
MELAQARNSISDMQEQIDGFRSTLDLDALDASIAENEDKMSQPGFWDDQQSAQKIIDETNTLKNRRDSFLSLQKSVEDLTAMAELLSEEDDADMHAELDTDIEKTEKDLEKYNLNQLLTEKYDSNNAILEIHPGEGGTESTDWASNLYRMYTRWAQAHDFKVEVTDYQTGDVAGIDSATLRIIGHNAYGFLRSEKGVHRFVRISPFDSAGRRHTSFVSIDVMPELDDDEIEIEIKPQDVKMDVYRSGGAGGQNVNKVSTAVRLTHIPTGIVVASQVERTQYGNRDIAMKMLKAKLYEQEEQKREEEHAKLSGTKLDVAWGSQIRSYVFQPYRMVKDLRSGYETGDTDGVMDGNLDPFINAYLKWKLSQKNPE

SEQ ID NO: 73851 - DNA, 999 bp, Pediococcus pentosaceus ATCC 25745
  CDS (1)..(999)
atggcagagcctaacttttgggataatcaagaacaggctcaaattgtcatcaatgaaaataatgagttaaaacaaaaatacgataattttaaaaatttaaccgaccatgttgaaaacttagaggtaactgctgaattattggaaatggaagatgatcctgacgttcaaagtgagtttgagagtgaattagccgccacggctaaattattgcaggattaccgtttaggattattgcttaatggtaaatatgatgccaataacgcaattatagaaattcaccccggagcgggaggaacagaatctcaagattggggttccatgttgctaagaatgtacacgcgttgggctgagcagcatcagtttaaggttcaaattgaagattaccaagcaggtgaagtggcaggaattagtagtgtaaccatgcgaattgtcggtcacaacgcatatggttatttacgctctgaaaagggagttcatcggctagtaagactatcaccatttgattctgctggacgacggcatacttcttttgcatcagtcgacgttatgccggaattggatgattcggttgaagttaacattaaccaagatgatttacgggtggatgtatatcgttctagtggtgctggtggacagcatattaacaagacttcttcagcggtgcgaattacgcatttgccaactggaattgtagttgcgagtcaagcagaacgttctcaattacaaaaccgggctaccgctatgagtatgttgaaggctaagctatttgagcttgaagaacaaaagaaagcagaagaaaaggctaaaatagaaggcattcaacttgaaataggatggggatcgcagattcgttcttacgttttccatccctattctatggttaaagatcatcgaagcaactttgagacggctaacgttcaaggtgtgatggacggggatttcgatgattttatcaatgcttatttgcaatggaaattgaaagaagataatccaaaatag

SEQ ID NO: 73852 - protein, 332 aa, Pediococcus pentosaceus ATCC 25745
MAEPNFWDNQEQAQIVINENNELKQKYDNFKNLTDHVENLEVTAELLEMEDDPDVQSEFESELAATAKLLQDYRLGLLLNGKYDANNAIIEIHPGAGGTESQDWGSMLLRMYTRWAEQHQFKVQIEDYQAGEVAGISSVTMRIVGHNAYGYLRSEKGVHRLVRLSPFDSAGRRHTSFASVDVMPELDDSVEVNINQDDLRVDVYRSSGAGGQHINKTSSAVRITHLPTGIVVASQAERSQLQNRATAMSMLKAKLFELEEQKKAEEKAKIEGIQLEIGWGSQIRSYVFHPYSMVKDHRSNFETANVQGVMDGDFDDFINAYLQWKLKEDNPK

SEQ ID NO: 73853 - DNA, 867 bp, Trichodesmium erythraeum IMS101
  CDS (1)..(867)
ttggaactagaaacagatgaatctttactagcagaagctaatttaacaattgctaatctcaaccaggagttagaccaatgggagttgcagcaattattatctggtctatatgaccaaaatggagcagtggtgactattaatgctggggcaggaggtacagatgctcaagattgggcagaaatgttgttgcggatgtatactcgctggggagaagagcataagtataaggtgcagttggccgaaatttctgagggggatgaagcaggtcttaagtctgcaactttagaaattattggtcggtatgcttatggttacttgaaggcggaaaaaggtactcatcgcttagtcagaatttcaccttttaatgctaatggcaaacgacaaactagttttgctggtgtggaggtgatgcccatattagaccattctgtagaattggatattccagagaaggatctcgaaattacaacttctcgttctgggggtaagggtggtcaaaatgtgaataaagtagaaacggcggtgcgagtagttcatattcctacaggtctttctgtgcgttgtacccaagagcgtagtcagttacaaaataaggataaagctttggcattattgaaagctaggttactgataattgctcaagagcaacgtgctcaagaaattaatgaaattcgcggtgatatggtagaagctgcttggggtaatcaaattcgtaactatgttttccatccttatcaaatggttaaagatttacggactcagaaggaaactactgctattaatgatgtgatgaatggtgagttagaccaatttattgaggcttatttacgccaggaaaatcaaatggtcgaaagtcagtctacttaa

SEQ ID NO: 73854 - protein, 288 aa, Trichodesmium erythraeum IMS101
MELETDESLLAEANLTIANLNQELDQWELQQLLSGLYDQNGAVVTINAGAGGTDAQDWAEMLLRMYTRWGEEHKYKVQLAEISEGDEAGLKSATLEIIGRYAYGYLKAEKGTHRLVRISPFNANGKRQTSFAGVEVMPILDHSVELDIPEKDLEITTSRSGGKGGQNVNKVETAVRVVHIPTGLSVRCTQERSQLQNKDKALALLKARLLIIAQEQRAQEINEIRGDMVEAAWGNQIRNYVFHPYQMVKDLRTQKETTAINDVMNGELDQFIEAYLRQENQMVESQST

SEQ ID NO: 73855 - DNA, 993 bp, Moorella thermoacetica ATCC 39073
  CDS (1)..(993)
atgctggccccgggtttctgggaagaccgcgcccgggccgaggccgtaggcaagcgcctcacctacctcaaggagaagctggcccgctaccgggagttagagagcaagtgcgccgacgtccgggagctatggcaactggccctggccgaagacgaccactccctggaagaagaaatagccagggacctggctgctgtcgaaggcaaagtggagggtcagctcctggcgaccctgctgaacggcccctatgaccgccataacgccatcctctccctccatccaggcgccgggggaacggagtcccaggattgggccgccatgctgttacgcatgtataatcgctggtgcgaagaccgcggctaccaggtggaactcctggattacctggagggtgaagaagccggactaaagagcgccaccatcctcgtcaaaggggagaacgcctacggctacctccaggcggagaagggggtgcaccgtctggtccggatctcgccctttgacgccgccggtcgccgccatacctcctttgcctcggtggatgttatcccggaagtggaggccgacgaggaagtcgaaattaatcccgacgatttaaagatcgacaccttccgctcccagggagccgggggacagcacgttaacaagacggactcggcggtgcggatcacccacctgcccacggggatagtggtaacctgccagaacgagcgctcccagcacgccaaccgtttgagcgccatgaagatcctccaggccaggctggcggctctaaagcgccaggaacaggaggcggagctggcccagatccggggtgaacagcgggagatcgcctgggggagccagatccgttcctatgtctttcatccctacagcctggttaaagatcaccgcaccggggtggaaacaggtaatatccaggccgttatggacggccagatcgacccctttatccaggcttatttacactggcagcgtagaaagcaaggctaa

SEQ ID NO: 73856 - protein, 330 aa, Moorella thermoacetica ATCC 39073
MLAPGFWEDRARAEAVGKRLTYLKEKLARYRELESKCADVRELWQLALAEDDHSLEEEIARDLAAVEGKVEGQLLATLLNGPYDRHNAILSLHPGAGGTESQDWAAMLLRMYNRWCEDRGYQVELLDYLEGEEAGLKSATILVKGENAYGYLQAEKGVHRLVRISPFDAAGRRHTSFASVDVIPEVEADEEVEINPDDLKIDTFRSQGAGGQHVNKTDSAVRITHLPTGIVVTCQNERSQHANRLSAMKILQARLAALKRQEQEAELAQIRGEQREIAWGSQIRSYVFHPYSLVKDHRTGVETGNIQAVMDGQIDPFIQAYLHWQRRKQG

SEQ ID NO: 73857 - DNA, 978 bp, Streptococcus suis 89/1591
  CDS (1)..(978)
atgacggagccagatttctggaatgataatttggcagcccagaagacgtctcaggagttgaatgaattaaaaaatacttatggaaatttccatcagatgttggatttatatgatgaatctgaaattttgctagattttctagcagaagatgagtctgtgcgggatgagttggttgaaaagttagtggaattggacaaaaccatgactgcttacgaaatgaccttgctcttatcagacccctatgatcacaataacgctatcttggaaatccatccaggttcgggtggtaccgaggcacaagactggggagaaatgctcctgcggatgtatcagcgttatggaaatgccaaaggttttatagtagaaacattggattatcaagctggtgatgaggcaggtattaagtctgtgactctaagctttactggtccaaacgcctatggcttgcttaagtcagaaatgggtgttcatcgtttggtgcgcatctcaccttttgactcagctaagcgtcgtcatacttcctttacatctgtggaggtaatgcctgagttggatgataccattgaaattgaaatcagagatgatgaagtgaagatggataccttccggtcaggaggtgctggtggacagaacgtcaataaggtttcaacgggtgttcgattgacgcacattccgacagggattgtgactcagtccacagttgaccgtactcagtatggaaaccgagaccgtgcaatgaaactcttgcaggctaaattgtatcaattggagcaggagaagaaagcggcagaagtagactcacttaagggtgacaagaaagagatcacttggggaagtcagattcgttcttatgtctttacaccttatacaatggtaaaagaccaccgtactggttatgaggtggctcaagtcgataaggttatggacggagacttggacggctttatagatgcttatttaaaatggcgaattagctaa

SEQ ID NO: 73858 - protein, 325 aa, Streptococcus suis 89/1591
MTEPDFWNDNLAAQKTSQELNELKNTYGNFHQMLDLYDESEILLDFLAEDESVRDELVEKLVELDKTMTAYEMTLLLSDPYDHNNAILEIHPGSGGTEAQDWGEMLLRMYQRYGNAKGFIVETLDYQAGDEAGIKSVTLSFTGPNAYGLLKSEMGVHRLVRISPFDSAKRRHTSFTSVEVMPELDDTIEIEIRDDEVKMDTFRSGGAGGQNVNKVSTGVRLTHIPTGIVTQSTVDRTQYGNRDRAMKLLQAKLYQLEQEKKAAEVDSLKGDKKEITWGSQIRSYVFTPYTMVKDHRTGYEVAQVDKVMDGDLDGFIDAYLKWRIS

SEQ ID NO: 73859 - DNA, 1050 bp, Thiobacillus denitrificans ATCC 25259
  CDS (1)..(1050)
atgcaacccagctcagggggtttctttgactaccctgtcaagaaagaccgcctagaagaagtcgtccgcctgtccgaagcgcccgatttctggaacgacgccgcgcgcgcccaggaactcgggcgcgaacgcaagtcgctcgaggacgtcgtcctcgtgctcgaccgcgtgacctcgggcctcaaggacgccggtgaactgttcgagatggcgcgcgaggagaacgacgacgacacgctcgcggcggtgcaggccgacatcgacggcctcgagaaggacgtcgcgacgctcgagttccgccgcatgttcagcaacccggcggacccgtccaactgcttcctcgacatccaggccggcgcgggcggcaccgaggcctgcgactgggcgtcgatgctgttgcggcaatatctcaaatatgccgagcgcaagggcttcaaggccgagctgctcgaggaatccgaaggcgacgtcgccggcatcaagtcggcgtcgatcaagatcgagggcgactacgcctacggctacctgcgcaccgagaccggcgtgcaccgcctcgtgcgcaagtcgccgttcgactcctcgggcgggcgtcacacctcgttcgcgagcgtgttcgtctatcccgaggtcgacgactcgatcgaagtcgagatcaatccggccgacctcagggtcgacacctaccgcgcgtcgggcgccggcggccagcacatcaacaagaccgactcggccgtgcgcatcacgcacattccgtcgggcatcgtcgtccagtgccagaacgaccgctcgcagcacaagaaccgcgccgaggcgatgtcgatgctgaagtcgaagctctacgaagccgagctgcgcaagcgccaggccgaacaggacaagctcgaagccggcaaggccgacgtcggctggggccaccagatccgctcctacgtgctcgacaattcgcggatcaaggacctgcgcaccaacgtcgaagtctccgcgacgcagaaagtgctcgacggcgacctcgacgtgttcatcgaagcaagcctcaaacaaggcgtctag

SEQ ID NO: 73860 - protein, 349 aa, Thiobacillus denitrificans ATCC 25259
MQPSSGGFFDYPVKKDRLEEVVRLSEAPDFWNDAARAQELGRERKSLEDVVLVLDRVTSGLKDAGELFEMAREENDDDTLAAVQADIDGLEKDVATLEFRRMFSNPADPSNCFLDIQAGAGGTEACDWASMLLRQYLKYAERKGFKAELLEESEGDVAGIKSASIKIEGDYAYGYLRTETGVHRLVRKSPFDSSGGRHTSFASVFVYPEVDDSIEVEINPADLRVDTYRASGAGGQHINKTDSAVRITHIPSGIVVQCQNDRSQHKNRAEAMSMLKSKLYEAELRKRQAEQDKLEAGKADVGWGHQIRSYVLDNSRIKDLRTNVEVSATQKVLDGDLDVFIEASLKQGV

SEQ ID NO: 73861 - DNA, 1131 bp, Silicibacter sp. TM1040
  CDS (1)..(1131)
atgcccatgcgcgccgagatccagaccatcgtggccgatatcgaaaaatcgctcgacctgcttgcccagcggatgaactgggagacggcggaattccggcttgaggaattcaacgcgcgggtcgaagatcccaacctctgggatgaccctgcagcggcgcaaaagctgatgcgggaccgtcagtccctcgtggacgcaatggacacctacaagagcatccgccaggaccttcaggacagcgttgagctgatcgagcttggcgagatggaagaggatgccgaagtcgtcaaagacgccgaagacacccttaaggcactgaaggaaaaagccgcccagaaagagcttgaagcgcttctggacggtgaaaccgaccccaatgacgccttcctcgagatcaaggcgggcgcgggcggcaccgaggcctgcgactgggcgtcgatgttggcgcgcatgtatgtgcgctgggccgagagccgaggcttcagcgtcgagctgcaggaagagcaggcgggcgccgaggccggcattaaatccgccacctatcagatcaagggtcacaacgcctatggctggctgaagtccgagagcggcacccaccgtcttgtgcggatttcgccctttggcaaaggcacgcgcgagacgtcatttgccgccgtgggcgcctatccggtgatcgatgacaacatcgaaattgaggtcaacccggccgatatccgcatcgacacctaccgttcgtcaggcgcgggcggtcagcacgtcaacaccaccgactcggcggtgcggatcactcacgaacccacgggcattgtagtgacctcctcggagaaatcgcagcaccagaaccgcgacatcgccatgaaggcgctgaaatcgcggctctaccagctcgaacttgatcgccgcaacgccgaagtaaacgcgctgcacgaggcaaagggcgatgcggggtggggtaaccagatccgatcctatgtgatgcagccctaccagatggtcaaagacctgcgcaccaaccatgagaccgccgacaccaaaggcgtgctggatggcgaccttgatgggttcatggcggcgacgctggcgatgaaggttgccggcaaaagccgcgccgacgcgcagggcgaggattaa

SEQ ID NO: 73862 - protein, 376 aa, Silicibacter sp. TM1040
MPMRAEIQTIVADIEKSLDLLAQRMNWETAEFRLEEFNARVEDPNLWDDPAAAQKLMRDRQSLVDAMDTYKSIRQDLQDSVELIELGEMEEDAEVVKDAEDTLKALKEKAAQKELEALLDGETDPNDAFLEIKAGAGGTEACDWASMLARMYVRWAESRGFSVELQEEQAGAEAGIKSATYQIKGHNAYGWLKSESGTHRLVRISPFGKGTRETSFAAVGAYPVIDDNIEIEVNPADIRIDTYRSSGAGGQHVNTTDSAVRITHEPTGIVVTSSEKSQHQNRDIAMKALKSRLYQLELDRRNAEVNALHEAKGDAGWGNQIRSYVMQPYQMVKDLRTNHETADTKGVLDGDLDGFMAATLAMKVAGKSRADAQGED

SEQ ID NO: 73863 - DNA, 858 bp, Rickettsia akari str. Hartford
  CDS (1)..(858)
atggctgcatccgaaaacgatttagaaacactttcacaaattgaacaggacttaaaaaatttaagcatccttgctgccaaatttgaaaccgaatgtttattttcaggtgaagcggacggtaataactgttttttagagattaatgctggcgcaggaggaactgaaagccacgactgggcatctattatgatgcgtatgtatttgcgttttgcagaaagactcggctttaaaaccgaaataatcaatatgcttaacggcgaagaagtaggcattaaatcatgcacgattaggataataggcaagagggcttacggctggtttaaaaccgaagcaggagttcataggctggtacgtatttccccgtttaatgctgcaggtaaaagaatgactagctttgcaagtagctgggtataccctgcaattgacgataatatagcaattactattgaggataaagatttaaggatcgatacttttagagcatcgggagcaggcggacagcacgttaatactactgattctgccgtacgtatcacccatataccgaccggtacggtaacacaatgtcaaagcgatagatcgcaacataaaaataaagctcaagctatgaagatgcttcaagcaaaactctatgagcttgaaatgcaaaaacgcacagacagcgttaacgagcaaaatgctgctaaaactgatagtagctggggatatcaaattagatcatacatcctacatccttaccaaatggtgaaagatttacgcaccgattacgaaacttccgacactaaaggagtgcttgacggtgaccttgaagaattcgtctcagcaaaccttgctatgaatgcgggcggtaagagttag

SEQ ID NO: 73864 - protein, 285 aa, Rickettsia akari str. Hartford
MAASENDLETLSQIEQDLKNLSILAAKFETECLFSGEADGNNCFLEINAGAGGTESHDWASIMMRMYLRFAERLGFKTEIINMLNGEEVGIKSCTIRIIGKRAYGWFKTEAGVHRLVRISPFNAAGKRMTSFASSWVYPAIDDNIAITIEDKDLRIDTFRASGAGGQHVNTTDSAVRITHIPTGTVTQCQSDRSQHKNKAQAMKMLQAKLYELEMQKRTDSVNEQNAAKTDSSWGYQIRSYILHPYQMVKDLRTDYETSDTKGVLDGDLEEFVSANLAMNAGGKS

SEQ ID NO: 73865 - DNA, 843 bp, Azotobacter vinelandii
  CDS (1)..(843)
atggccgtcgaagagaacgacgagggtgcggcgaacgatgtcgccgccgaagtcgagcgcctgcgcggcatcctcgagaaactcgagttccgccgcatgttcagcggcgaaatggacgccaggaacgcctacctcgacgtccaggccggctccggcggcaccgaggcccaggactgggccaacatgctgctgcgcatgtacctgcgctgggccgacaagcacggcttcgacaccgagatcgtcgaactgtcggaaggcgaggtcgccggcatcaagagcgcgaccgtgcacgtcaggggcgagtacgccttcggctggctgcgtaccgagatcggcgtgcaccgcctggtgcgcaagagcccgttcgactccggcaaccgccggcacacctcgttctccgcggtattcgcctcgccggaagtcgacgacaacatcgagatcgacatcaatccggccgatctgcgcgtcgatacctaccgctcgtccggggccggcggccagcacgtgaacaccaccgactccgcggtgcgcatcacccacctgccgaccaacaccgtggtgagctgccagaacgagcgctcccagcacgccaaccgggaccgcgccatgaagatgctgcgcgccaagctgtacgagctggaggtcatgaagcgcaacgtcgccgcccaggcgctggaggacaccaagtcggacatcggctggggccaccagatccgctcctacgtgctcgaccagtcgcggatcaaggatctgcgcaccggcatcgagaacagcaactgcgatgcggtgctggacggcgatctcgacgagttcatcgaggccagcctcaagaagggcctgtga

SEQ ID NO: 73866 - protein, 280 aa, Azotobacter vinelandii
MAVEENDEGAANDVAAEVERLRGILEKLEFRRMFSGEMDARNAYLDVQAGSGGTEAQDWANMLLRMYLRWADKHGFDTEIVELSEGEVAGIKSATVHVRGEYAFGWLRTEIGVHRLVRKSPFDSGNRRHTSFSAVFASPEVDDNIEIDINPADLRVDTYRSSGAGGQHVNTTDSAVRITHLPTNTVVSCQNERSQHANRDRAMKMLRAKLYELEVMKRNVAAQALEDTKSDIGWGHQIRSYVLDQSRIKDLRTGIENSNCDAVLDGDLDEFIEASLKKGL

SEQ ID NO: 73867 - DNA, 609 bp, Chloroflexus aurantiacus
  CDS (1)..(609)
atgagcgaaggcgaagaggcaggaatcaagagtgcgactatcgagattcgtggcccttacgcttacggctacgcccgcgccgaggccggtgtccatcgcctgattcgcctgtcgccgttcaacgctgcgcacacccgccagaccagctttgcgcgcgtcgaggtgatgccagaagttgatgatgcgcctgaagtagagatcaaaccggaagacctgcgcattgatgtcttccgcagtgggggtcatggcgggcaaggcgtgaataccaccgattcggcggtacgcattacccacctgccaaccggaattgtggttacctgtcagaatgaacgttcgcagatacagaaccgcgaactggccatgcgcgtgttacgggcgcgactgctcgaacgcgaattgcagcgtcaggccgaagaacgtgcgcgactccggggtgaatatcgcgaggccgcatttggtaaccagatgcgaacctattacctccatccttcaacgctggtcaaagatcatcgcaccgattacgaaacgagcaacgtacaggcagtgctcgatggcgagatcgatccgtttattgaagccttcctacgggcaaacgtgcgggagacgtga

SEQ ID NO: 73868 - protein, 202 aa, Chloroflexus aurantiacus
MSEGEEAGIKSATIEIRGPYAYGYARAEAGVHRLIRLSPFNAAHTRQTSFARVEVMPEVDDAPEVEIKPEDLRIDVFRSGGHGGQGVNTTDSAVRITHLPTGIVVTCQNERSQIQNRELAMRVLRARLLERELQRQAEERARLRGEYREAAFGNQMRTYYLHPSTLVKDHRTDYETSNVQAVLDGEIDPFIEAFLRANVRET

SEQ ID NO: 73869 - DNA, 903 bp, Polaromonas sp. JS666
  CDS (1)..(903)
atggtgcatgtcatcgaccggctcacgcaggagttggccgacaacaccgagttgttcgagatgtccaagggcgaaggcgacgaagccggcatgctggccattgaagacgaagccggcaaggtggccaccgaagtcgaaaagatggaattccgccggatgttcaacaacccggccgatccgctgccctgctttctggacattcaggccggcgccggcggcaccgaagcctgtgactgggccagcatgctgctgcgccagtacctcaagtacgccgagcgcaagggcttcaagaccaccattgaagatgaaaccgcgggcgacacggccggcatcaagggcgccaccatcaagatcgagggcgaatacgcttttggcctgctgcgcaccgaaaccggcgtgcaccgcctggtccgcaagtcaccgtttgactcctccggcgggcgccacacctcgtttgcctcggtgtttgtctaccccgagattgatgactcgatcgagatcgacatcaacccatcggatgtgcgcaccgacaccttccgcgccagcggcgccggcggccagcacatcaacaagaccgattcggccgtgcgtttgacgcacatcccgaccggtatcgtggtgcaatgccaggacggccgttcgcagcacagcaaccgcgatgtggcgtggaagcgcctgcgctcgcgcctgtatgaccacgagatgcgcaaacgccaggccgagcagcaaaagctcgaagacagcaagaccgacgtgggctggggccaccagatccgcagctatgtgctcgaccagagccgcatcaaggacctgcgcaccaactacgaaacctcggccacgcaaaaggtgcttgacggcgacctcgacccgtttatcgaggcttccctgaagcagggcgtctga

SEQ ID NO: 73870 - protein, 300 aa, Polaromonas sp. JS666
MVHVIDRLTQELADNTELFEMSKGEGDEAGMLAIEDEAGKVATEVEKMEFRRMFNNPADPLPCFLDIQAGAGGTEACDWASMLLRQYLKYAERKGFKTTIEDETAGDTAGIKGATIKIEGEYAFGLLRTETGVHRLVRKSPFDSSGGRHTSFASVFVYPEIDDSIEIDINPSDVRTDTFRASGAGGQHINKTDSAVRLTHIPTGIVVQCQDGRSQHSNRDVAWKRLRSRLYDHEMRKRQAEQQKLEDSKTDVGWGHQIRSYVLDQSRIKDLRTNYETSATQKVLDGDLDPFIEASLKQGV

SEQ ID NO: 73871 - DNA, 1362 bp, Cucumis sativus
  CDS (1)..(1362)
atggacgttcttcaccgcaccttgtggctcggcacctcccccatttttcttccacttcccaaatttcaaagtaccggagcttccatctccctacaattccgaccaacttccccttctccccactttcgcacttctctctcaactcactctcgtttttctctcgttccatttgcaacgcacgagagcccggtgggtgaggcaatcgacactgatacgcgagaatgggcaacgcaagatttttatacattacggaaagaagtggaaacaacctcagagcgtgtggaagagataaggaactctgctggtttgttacagttggaccaagaacttgcggacttggagtctaaggctgctgacaactctttttgggatgacagatctaaggctcaaaaagttctcatggccatgactgatgtaaaagataaaataaagatgcttactgatttcaaaacacaggttgaagaagcagaaacaatcgttaaactgactgaagagatggactctgtagatgttgggcttcttgaagaggcaactaaaatcattaaagacctaaacaaggcactggatcaatttgaattatctgaacttctttctggtccttatgacaaagaaggagctgtcatctctatctctgctggagctgggggcactgatgcacaggattgggctgacatgctcttgaggatgtacgtgagatggggagagaagcaaagatataaaacaagagtagttgagaaatctgctggagaggaagctggaataaaatcagctacaattgaaattgaaggccgttatgcttatggatatatatctggggagaaaggaacgcacaggatagtgcgacagtctccttttaactctaaaggacttcgacagacaagcttttctggtgtggaagtcatgcctctccttcccgacgagtccatgaatgttgaactgccagaagaggacctggaaataagcttttcaagggcggggggaaaaggaggtcaaaatgttaacaaggttgaaacggctgtccgcatcactcatatccctacaggagtcacggttcgatgcacagaggagagatcgcagctggcaaacaagatcaaggcattaagccggttgaaagccaagttgctagtcatagctgaagagcaacgtgcatccgaaatcaagcaaatacgaggagatgccgtaaaggccgagtgggggcaacaaataaggaattatgtgtttcatccatacaagctagtgaaagatgttaggacaggatatgagacatcagacattgtctctgtaatggatggcgaattggagcccttcatcaaagcttacctaaaatacaaatatagcattgcattatcgacaggagattaa

SEQ ID NO: 73872 - protein, 453 aa, Cucumis sativus
MDVLHRTLWLGTSPIFLPLPKFQSTGASISLQFRPTSPSPHFRTSLSTHSRFSLVPFATHESPVGEAIDTDTREWATQDFYTLRKEVETTSERVEEIRNSAGLLQLDQELADLESKAADNSFWDDRSKAQKVLMAMTDVKDKIKMLTDFKTQVEEAETIVKLTEEMDSVDVGLLEEATKIIKDLNKALDQFELSELLSGPYDKEGAVISISAGAGGTDAQDWADMLLRMYVRWGEKQRYKTRVVEKSAGEEAGIKSATIEIEGRYAYGYISGEKGTHRIVRQSPFNSKGLRQTSFSGVEVMPLLPDESMNVELPEEDLEISFSRAGGKGGQNVNKVETAVRITHIPTGVTVRCTEERSQLANKIKALSRLKAKLLVIAEEQRASEIKQIRGDAVKAEWGQQIRNYVFHPYKLVKDVRTGYETSDIVSVMDGELEPFIKAYLKYKYSIALSTGD

SEQ ID NO: 73873 - DNA, 894 bp, Candidatus Portiera aleyrodidarum
  CDS (1)..(894): transl_table=11
ataaaaactgttgagaatggtatttataataatgctgagttattacacttagctataactgagttagattcaaaaccgctaagttttataaaacaagacataaatttttttgaaaaagaactggcaaagttagatgctgttcggttgttttcaggcgactttgataaaaataatgcttatgttgaaattaaagcaggttctggcggtgtagagtcacaagactgggcaaatatgttattacgcatgtattcaagatgggcagtaactcatgattttaaaacagaaacagtaaatttaaatataggtgatttgttaggagtaaaatctgcaactcttcatataaaaggtgactatgcttttggatggatgcgtactgaaaaaggtattcatcgcttagttcgtaaaagtccttttgattcaagtaaacggcggcatacttcttttacatctgtttttgtttatccagaaataacaatgaaagtacataatataaaaataaatacaaatgaattaagaattgacacttacagatcaagtggtgcaggcgggcaacatgtaaacactactgattccgctgtaagaataacgcatttgcctacaaagatcgttgttgaatgtcaaagtgaacgctctcaacatagtaataaagaacgagcattaacgctattaaaaacaaaattatacgattttgacaaaaaaaaaggtgaagtagaaagaataaatatagaaaaaaaaaaagcaggaatatgttggggtaatcaaattagatcatatgtgttagatgctcagagaataaaagatttacgtaccggagtcaaaaataataattgtgaaaaagtattaaatggtgagttagatttgtttatagaggcaagtataaagcaaggattataa

SEQ ID NO: 73874 - protein, 297 aa, Candidatus Portiera aleyrodidarum
MKTVENGIYNNAELLHLAITELDSKPLSFIKQDINFFEKELAKLDAVRLFSGDFDKNNAYVEIKAGSGGVESQDWANMLLRMYSRWAVTHDFKTETVNLNIGDLLGVKSATLHIKGDYAFGWMRTEKGIHRLVRKSPFDSSKRRHTSFTSVFVYPEITMKVHNIKINTNELRIDTYRSSGAGGQHVNTTDSAVRITHLPTKIVVECQSERSQHSNKERALTLLKTKLYDFDKKKGEVERINIEKKKAGICWGNQIRSYVLDAQRIKDLRTGVKNNNCEKVLNGELDLFIEASIKQGL

SEQ ID NO: 73875 - DNA, 882 bp, Citrobacter freundii
  CDS (1)..(882): transl_table=11
atgagccagggcctggaagatgtctccggcctgctggaactggctgtagaagccgacgacgaagaaacctttaacgaagccgtagcagaacttgatacgctggaagataagctggcccaactggaattccgtcgtatgttctccggtgaatatgatagcgcagattgctatctcgatattcaggctggctcaggcggtacggaagcacaggactgggcaagcatgctgatgcgtatgtacctgcgttgggctgaagcgcgcggctttaagactgaaattattgaagaatctgaaggtgaagtggcgggtattaaatccgtgaccatcagaattgctggcgaatatgcttacggttggttgcgtaccgaaaccggtgtacatcgcctggtgcgtaaaagcccgttcgactccggcggtcgtcgccatacgtcgttcagctctgcgtttgtctacccggaagttgacgatgatattgatatcgatatcaacccggcggacctgcgtattgacgtttaccgcgcttctggtgcgggcggtcagcacgttaaccgtaccgaatctgcggtgcgtatcacccacatcccgaccgggattgtgacgcagtgtcagaacgaccgttcccagcacaagaacaaagaccaggccatgaagcagatgaaagcgaagctttatgaactggaaatgcagaagaagaatgccgagaaacaggcgatggaagatactaaatcagatatcggctggggtagccagattcgttcttatgtccttgatgactcccgcatcaaagatctgcgtaccggggttgaaacccgcaacacgcaggcggtgctggatggcagcctggatcaatttatcgaagcaagtttgaaagcagggttatga

SEQ ID NO: 73876 - protein, 293 aa, Citrobacter freundii
MSQGLEDVSGLLELAVEADDEETFNEAVAELDTLEDKLAQLEFRRMFSGEYDSADCYLDIQAGSGGTEAQDWASMLMRMYLRWAEARGFKTEIIEESEGEVAGIKSVTIRIAGEYAYGWLRTETGVHRLVRKSPFDSGGRRHTSFSSAFVYPEVDDDIDIDINPADLRIDVYRASGAGGQHVNRTESAVRITHIPTGIVTQCQNDRSQHKNKDQAMKQMKAKLYELEMQKKNAEKQAMEDTKSDIGWGSQIRSYVLDDSRIKDLRTGVETRNTQAVLDGSLDQFIEASLKAGL

SEQ ID NO: 73877 - DNA, 1116 bp, Lactobacillus delbrueckii
  CDS (1)..(1116): transl_table=11
atggaaatcagtgaaattcaaaatgctttagacgagtgcggacccggcttaaccacttcagggggtctctttgacttcgataatattagcgaaagcattgaaatcaacgaagccaagatggcggaaccgggcttttgggacaatcaggaaaaggcacagaaattgatcagtgagaccaacctgctcaaggaaaagcgggactccttcctggctctgaaaaaagacctgaccgatgaagaaacggccctggaattgctgcgcctggaagcagacgcggacctgcaaaaggacaccgaagaccagctggccaagctgcaggaagagttccatcagtatgaattgaacctgctcttgtcgggcgagtacgatgaccataacgccttgatggaaatccacccgggggccggcggcactgaagccatggactgggggaacatgctgctccggatgtaccagcgctattgcgactcccgtggccttaagtttgaagtcaacaactttgaaccaggtgatgaagccggtttaaagagcgtcagcgtccggatttccggcaagaatgcctacgggctgctgaagtctgaacacggcgttcaccgcctggtccggatttcgccttttgactcagccaaaagacggcacacttcttttgcctcggttgaagttatccccgaagtcgatgactccattgaaatcgacattgatcctaaggacctaagaattgacgtctaccggtcatccggggcgggcggccagcacattaacaagacttccagtgccgtccggattacccacatcccaaccgggatcgtgacgacttcccaggcccagcggtcccagttccagaaccgggacacggccatgaatgaaatgcgggccaagcttttccacctggaagaagagaagaagcgcaaggaaaaggcggccttgaagggtgagcaattggacattgcctggggctcgcagatccggtcttacgtcttccacccatacagcatggtcaaagaccaccggaccggctatgaaaccgccgatgtgggcggggtgatggacgggaagctggatcccttcatctacgcctacctgcagtggcgtttgagccaggaaaatccagaataa

SEQ ID NO: 73878 - protein, 371 aa, Lactobacillus delbrueckii
MEISEIQNALDECGPGLTTSGGLFDFDNISESIEINEAKMAEPGFWDNQEKAQKLISETNLLKEKRDSFLALKKDLTDEETALELLRLEADADLQKDTEDQLAKLQEEFHQYELNLLLSGEYDDHNALMEIHPGAGGTEAMDWGNMLLRMYQRYCDSRGLKFEVNNFEPGDEAGLKSVSVRISGKNAYGLLKSEHGVHRLVRISPFDSAKRRHTSFASVEVIPEVDDSIEIDIDPKDLRIDVYRSSGAGGQHINKTSSAVRITHIPTGIVTTSQAQRSQFQNRDTAMNEMRAKLFHLEEEKKRKEKAALKGEQLDIAWGSQIRSYVFHPYSMVKDHRTGYETADVGGVMDGKLDPFIYAYLQWRLSQENPE

SEQ ID NO: 73879 - DNA, 1281 bp, Arabidopsis thaliana
  CDS (1)..(1281)
atggaatcaaaatttcttagatttggtaattacgcttattctgggagtagtttcgcttccagtactcgatcattgagctcagaagctgtagctgtggcagcgacttgtgatggacttactgtggaacgaattatagctaatcagtggccgattttagatgagaatgaaggtgattggaagagtcacgctgcagcaattgcacagtctattcaagtcatcaagagacgattacagtggaagaaactcttggtgaggctgaaagttttatctgcagagttgaacaagtctgatctttgggatgatccaactcatgctggtaagataagccgggagcacggctcgcttacgggaaaaatgaaaggagttatgacatttgagagagagcttcttgaacacattgacatgttgaaactcgctaaagaggagaacgattcagagttagaatcggaaactttaaaggcattgatagatatgagaagggtgtcaaaagagaaagaactcgaggctttattatctgcggataatgatccttgttcttgttatatcgaggttcaagctggagctggaggaacagagagcaatgattgggcagctatggtaatggaaatgtacaaaacatgggctcaacgacgcaaattttcagtcactgtggttgatgaagctcctggggagatagcaggaatcaagcgtgctacaatcaaagtgaacggtgaatacgcatacggatacgccaaagcagaagttggagtacataggctggtgcgtatatccccgtttgacagtggaaaacggagacacacttcgtttgcggcagttgcggtgattccaattctaggtgatgggtccacccgtgtggagatcaatgactccgatctccggattgagcggttccgttctggaggagccggtgggcagcacgctaacacgacagacagtgctgttagaatcgttcacataccaactggcataacagcaacttgtcagaatgaaaggtcacaacatagtaacaaggcttcagcaatggcagtactacaatcacggttagaccaactggaaatggctcgtcagacagcaatgaacgctcaacatacacaatcactaacagagatcagctggggaaaccagatacgaacttatgttctccatccatacagaatggtgaaggatctgcgaaccaactacgaggtctctgatcctgactcggttcttgaaggagacttagatggtttcatcttgagcttcttatcttcttctttagacaaagatgatcctgaacattag

SEQ ID NO: 73880 - protein, 426 aa, Arabidopsis thaliana
MESKFLRFGNYAYSGSSFASSTRSLSSEAVAVAATCDGLTVERIIANQWPILDENEGDWKSHAAAIAQSIQVIKRRLQWKKLLVRLKVLSAELNKSDLWDDPTHAGKISREHGSLTGKMKGVMTFERELLEHIDMLKLAKEENDSELESETLKALIDMRRVSKEKELEALLSADNDPCSCYIEVQAGAGGTESNDWAAMVMEMYKTWAQRRKFSVTVVDEAPGEIAGIKRATIKVNGEYAYGYAKAEVGVHRLVRISPFDSGKRRHTSFAAVAVIPILGDGSTRVEINDSDLRIERFRSGGAGGQHANTTDSAVRIVHIPTGITATCQNERSQHSNKASAMAVLQSRLDQLEMARQTAMNAQHTQSLTEISWGNQIRTYVLHPYRMVKDLRTNYEVSDPDSVLEGDLDGFILSFLSSSLDKDDPEH

SEQ ID NO: 73881 - DNA, 1125 bp, Xanthomonas campestris
  CDS (1)..(1125): transl_table=11
atgatcgaaaccaatccgatccgccagcgcatcaccgatctcaacgatcgcgtgctctcgctcagggggtatcttgactacgacgtcaagaaagagcgtctagaggaagtcagccgggagcttgagagccccgatgtctggaacgacgccgagcgcgcccaggcgctgggacgcgagcgctccatgctggaaaagaccgtcatcggcatcgccgatgtgctggccggcctcaccgatgccggcgagttgctggacctggccgagagcgagcaggacgaagacaccgccgtggcggtgatcgccgacctggacaagtaccaggcacacgtcgaaaagctggaattccagcgcatgttctccgggcagatggacggcgccaacgcgttcgtcgacatccaggccggcgccggcggtaccgaagcccaggactgggcggaaatcctgctgcgcatgtatctgcgctgggccgagtcgcgcggctggaagaccgagctgatggaagtgtccggcggcgaagtcgcgggcatcaagtcggccacgatccgcatcgaaggcgagtacgcctatggctggttgaagaccgagatcggcgtgcaccggctggtgcgcaagtcgccgttcgactccgacaaccgccggcataccagcttcacctcggtgttcgtgtcgccggaagtggacgacaacatcgagatcgacatcaatccggccgatctgcgtaccgacgtttaccgctcctcgggtgccggcggccagcacgtcaacaagaccgagtcggcggtgcgcatcacgcatattccgaccaataccgtggtcgcctgccagaccggccgcagccagcaccagaaccgcgacaacgcgatgaagatgctggccgccaagttgtacgagctggaagtgcagaagcgcaacgtcgagcgcgatgcgctggaagcgaccaagtccgacatcggctggggcagccagatccgcaactatgtgctcgaccagagccgtatcaaggatctgcgcaccggcatcgaacgcagcgacacccagaaggtgctcgatggcgatctggacgaattcgtcgaagccagcctcaaggccggcctggcggcgggctccaagcgcctggatgcctga

SEQ ID NO: 73882 - protein, 374 aa, Xanthomonas campestris
MIETNPIRQRITDLNDRVLSLRGYLDYDVKKERLEEVSRELESPDVWNDAERAQALGRERSMLEKTVIGIADVLAGLTDAGELLDLAESEQDEDTAVAVIADLDKYQAHVEKLEFQRMFSGQMDGANAFVDIQAGAGGTEAQDWAEILLRMYLRWAESRGWKTELMEVSGGEVAGIKSATIRIEGEYAYGWLKTEIGVHRLVRKSPFDSDNRRHTSFTSVFVSPEVDDNIEIDINPADLRTDVYRSSGAGGQHVNKTESAVRITHIPTNTVVACQTGRSQHQNRDNAMKMLAAKLYELEVQKRNVERDALEATKSDIGWGSQIRNYVLDQSRIKDLRTGIERSDTQKVLDGDLDEFVEASLKAGLAAGSKRLDA

SEQ ID NO: 73883 - DNA, 1170 bp, Caenorhabditis elegans
  CDS (1)..(1170)
atgcttaaacgacatcagcagctactttttcgtctgatccggcaatctgttcttcatcaatcatctccaacatcttcttcagcttcatctactttattgaacagtgaaaacggggagaagtttgtgaaaactgtcgtggatcgtttggcacaatgccaagcaggaaatgctactgctgcccctgagcaaatcagttactgggagtcaatttctaaacaatctgcaaaagtttcggatggacgctctgaactttctcagctacgaactataatcaatgatcccaaggaaacagaagaaatgagaaagttggcagaagttgatgtagaatcaattgaggagaatttagagacggaattacaagaattagcggttaaaatcgttcctctaaataatctagatgtattatcaaaatgtcaaattgaattgagttgtggagctggtggacaagaagctatgctattcacaggagaacttttagatatgtatcaaaagttggcagctgttaattcctggaaatgggatcctttgcaggtagacaacgttccacttggaggagttcgaagtgctctcatcgcagtgtctggggagaaagtctacgcaaaaatgcgcttcgaagcaggcgttcatcgagttcagcgagttcctgtcaacgattctcgaatgcatacaagcacggcgagtatctcggtgctccccgagccagaagaggtttctgtggtggttccaagtgattcggtgaagattgaagcaatgcgagcgtctggacctggcggtcagaatgtgaataagcgatcgacagccgtacggatgacacataaagagacgggaattgctgtgcattgtatggatgagagatttcaacatttaaatattcagattgcctataaacgtctcgcagccattttgatgcaaaaacaagttgatgccatgctggaaaagatcgtttcaaaacgaaaacttcaagttggatccaaagctcgcgctgaaaaaattcgaacgtacaatttccaacacgacagagtcactgatcatcggattcaaatgtctatcacaggagttgcagagttcttatcagctggagagacacttcaaacaatgattgaaagacttcaggaacaacatttagaagatagattagatcatattattgagaattgtattgttgagtag

SEQ ID NO: 73884 - protein, 389 aa, Caenorhabditis elegans
MLKRHQQLLFRLIRQSVLHQSSPTSSSASSTLLNSENGEKFVKTVVDRLAQCQAGNATAAPEQISYWESISKQSAKVSDGRSELSQLRTIINDPKETEEMRKLAEVDVESIEENLETELQELAVKIVPLNNLDVLSKCQIELSCGAGGQEAMLFTGELLDMYQKLAAVNSWKWDPLQVDNVPLGGVRSALIAVSGEKVYAKMRFEAGVHRVQRVPVNDSRMHTSTASISVLPEPEEVSVVVPSDSVKIEAMRASGPGGQNVNKRSTAVRMTHKETGIAVHCMDERFQHLNIQIAYKRLAAILMQKQVDAMLEKIVSKRKLQVGSKARAEKIRTYNFQHDRVTDHRIQMSITGVAEFLSAGETLQTMIERLQEQHLEDRLDHIIENCIVE

SEQ ID NO: 73885 - DNA, 1083 bp, Bordetella bronchiseptica
  CDS (1)..(1083): transl_table=11
atgaaaccgtccatgcgcagccgactcgagcagttggcccaccgtctcatcgaagtcgacgccttgctggccgagccggaaacggcggccgatatggaccgttttcgcaagctgtcgcgcgagcgcgccgagctggagccggtcgtcgaggcgttcaatgcgttcctgggcgtcgaggccgatgtggccaccgcgcaggagatgctgtccgatcccgacatgaaggccatggccgaggacgagatcaagaccggacgcgcgcgcatcgaggagatggaggcggcgttgcagttgctgctgctgccgcgcgatcccgacgatggccgcagcctgttcctggaaatccgtgccggcacgggcggcgacgaaagcgcgctgttctccggcgacctgctgcgcatgtatacgcgctacgcggaaacgcggggttggcgcgtggagatcatgtcggagagcgagtcggagctgggcggctacaaggaagtgatcgcgcgcatcgatggcgacggcgcctatggccggctgaagttcgagtccggcgcgcatcgcgtgcagcgcgtgccggccacggaggcgcagggccgcatccatacgtcggcatgcacggtggcggtgatgcccgaggccgacgcgatgtccgacatcgtgatcaaccccagcgatctgcgcatcgatacgttccgcgccagcggggcgggcgggcagcacatcaacaagaccgattcggcggtgcgcatcacgcacgtgccgaccggcctggtggtggagtgccaggacgaccgctcgcagcaccgcaacaaggacaaggccatgcaggtgctggccgcgcgcctgaaggacaaggaaatgcgcgaacgccagagcaaggaggccgccgagcgcaagagcctgatcggctcgggcgaccgctccgagcgcatccgcacctataactatccgcagggccgcgtgaccgaccatcgcatcaacctgacgctgtacaagctgcagcagatcatggaaggcgacctggacgagctgaccggcgcgctgctggccgagcaccaggccgagcaactggcggcgctgggccacgatctgtga

SEQ ID NO: 73886 - protein, 360 aa, Bordetella bronchiseptica
MKPSMRSRLEQLAHRLIEVDALLAEPETAADMDRFRKLSRERAELEPVVEAFNAFLGVEADVATAQEMLSDPDMKAMAEDEIKTGRARIEEMEAALQLLLLPRDPDDGRSLFLEIRAGTGGDESALFSGDLLRMYTRYAETRGWRVEIMSESESELGGYKEVIARIDGDGAYGRLKFESGAHRVQRVPATEAQGRIHTSACTVAVMPEADAMSDIVINPSDLRIDTFRASGAGGQHINKTDSAVRITHVPTGLVVECQDDRSQHRNKDKAMQVLAARLKDKEMRERQSKEAAERKSLIGSGDRSERIRTYNYPQGRVTDHRINLTLYKLQQIMEGDLDELTGALLAEHQAEQLAALGHDL

SEQ ID NO: 73887 - DNA, 1083 bp, Bordetella parapertussis
  CDS (1)..(1083): transl_table=11
atgaaaccgtccatgcgcagccgactcgagcagttggcccaccgtctcatcgaagtcgacgccttgctggccgagccggaaacggcggccgatatggaccgttttcgcaagctgtcgcgcgagcgcgccgagctggagccggtcgtcgaggcgttcaatgcgttcctgggcgtcgaggccgatgtggccaccgcgcaggagatgctgtccgatcccgacatgaaggccatggccgaggacgagatcaagaccggccgcgcgcgcatcgaggagatggaggcggcgctgcagttgctgctgctgccgcgcgatcccgacgatggccgcagcctgttcctggaaatccgtgccggcacaggcggcgacgaaagcgcgctgttctccggcgacctgctgcgcatgtatacgcgctacgcggaaacgcggggttggcgcgtggagatcatgtcggagagcgagtcggagctgggcggctacaaggaagtgatcgtgcgcatcgatggcgacggcgcctatggccggctgaagttcgagtccggcgcgcatcgcgtgcagcgcgtgccggccacggaggcgcagggccgcatccatacgtcggcatgcacggtggcggtgatgcccgaggccgacgcgatgtccgacatcgtgatcaaccccagcgatctgcgcatcgatacgttccgcgccagcggggcgggcgggcagcacatcaacaagaccgattcggcggtgcgcatcacgcacgtgccgaccggcctggtggtggagtgccaggacgaccgctcgcagcaccgcaacaaggacaaggccatgcaggtgctggccgcgcgcctgaaggacaaggaaatgcgcgaacgccagagcaaggaggccgccgagcgcaagagcctgatcggctcgggcgaccgctccgagcgcatccgcacctataactatccgcagggccgcgtgaccgaccatcgcatcaacctgacgctgtacaagctgcagcagatcatggaaggcgacctggacgagctgaccggcgcgctgctggccgagcaccaggccgagcaactggcggcgctgggccacgatctgtga

SEQ ID NO: 73888 - protein, 360 aa, Bordetella parapertussis
MKPSMRSRLEQLAHRLIEVDALLAEPETAADMDRFRKLSRERAELEPVVEAFNAFLGVEADVATAQEMLSDPDMKAMAEDEIKTGRARIEEMEAALQLLLLPRDPDDGRSLFLEIRAGTGGDESALFSGDLLRMYTRYAETRGWRVEIMSESESELGGYKEVIVRIDGDGAYGRLKFESGAHRVQRVPATEAQGRIHTSACTVAVMPEADAMSDIVINPSDLRIDTFRASGAGGQHINKTDSAVRITHVPTGLVVECQDDRSQHRNKDKAMQVLAARLKDKEMRERQSKEAAERKSLIGSGDRSERIRTYNYPQGRVTDHRINLTLYKLQQIMEGDLDELTGALLAEHQAEQLAALGHDL

SEQ ID NO: 73889 - DNA, 1074 bp, Chlorobium tepidum
  CDS (1)..(1074): transl_table=11
atgtttgacaagcttcagtccatcaaggataaattccagaccatcgagcagcagctttccgatccggaggtggtcgccgaccagaatcgcttcaggaagctgaacaaggagtacagcagcctgaaggagatcgtgcgcgcttacgacgagtggagccgaaccaaaaagcagctcgacgaggcgcattcgatgcagaaaaacgaaaatgatccggaaatgcgcgccctcgtcgaagaggaggccggcgaactccaggagcgcctcccgaagcttgagcagcagctcaaaatcctgctgctgccaaaagacgaggccgacagccgcaacgccatcattgaaatccgcgcgggaaccggtggcgacgaagcggggctgttcgctgccgacctgatgcgcatgtaccagcgctatgccgaacggcaggggtggagctgccagacgctcgaagtgagcgaaggctcagtgcccggcagcctcaaggaggtttcgcttgaagtgagcggccacaacgtctacggtatcctcaagttcgagagcggtgtgcaccgcgtgcagcgcgtgcccgaaaccgaaacgcaggggcgcatccacacctcggcggccagcgtcgccgtactccccgaagccgaagaggtggacgtggagatccgcaaggaagatttgctgatagacacctttcgcagtggcggcaaaggcggccagaacgtcaacaaggtggaaaccgccgtgcgaatcacccacgtcccgagcggcatcgtcgtcgcctgccaggaggaacgctcgcagctccagaaccgcgagcgggccatgaagatgctgcgctcgaagctctacgacctccagatcgccgagcagcaaaagagccgcgccgacctgcgccgctcgatggtaaccaccggcgaccggagcgccaagatcaggacctacaactttccccagtcgcgcgtgaccgaccaccgcatcggcttcaccagccacgccctgccgcaaatcatgcagggcgagctcgacccgctcatcgaggcgctgcgaatgcacgaccaggccgagcgcttgcaggccgaaaccgcctga

SEQ ID NO: 73890 - protein, 357 aa, Chlorobium tepidum
MFDKLQSIKDKFQTIEQQLSDPEVVADQNRFRKLNKEYSSLKEIVRAYDEWSRTKKQLDEAHSMQKNENDPEMRALVEEEAGELQERLPKLEQQLKILLLPKDEADSRNAIIEIRAGTGGDEAGLFAADLMRMYQRYAERQGWSCQTLEVSEGSVPGSLKEVSLEVSGHNVYGILKFESGVHRVQRVPETETQGRIHTSAASVAVLPEAEEVDVEIRKEDLLIDTFRSGGKGGQNVNKVETAVRITHVPSGIVVACQEERSQLQNRERAMKMLRSKLYDLQIAEQQKSRADLRRSMVTTGDRSAKIRTYNFPQSRVTDHRIGFTSHALPQIMQGELDPLIEALRMHDQAERLQAETA

SEQ ID NO: 73891 - DNA, 1122 bp, Aquifex aeolicus
  CDS (1)..(1122): transl_table=11
atgatgatggtagagttaaagggtaaagtagaagaacttagaaaacggcttgaagacgtaaagaagatactttctcctgagaaacttgagagtgaattaaaagaactcgaccagaagatgtcagaaccaaacttctgggaggatcaggaaaaggccaagcaggtaatacagagaaggaagtgggtagaggaaactctgaataaattgaaaaaccttgaaaagagtgtaaaggatttagaggagctagtggagataacttccgaagaggacacggaaacctgggcgatgatggacgaagaaatcaaagaagtggaaaggactctaagagaactcgaactaaagacttacctttccggagagatggacgccaagaacgcgtatctcaccatacaggcgggtgcgggaggaacggaagcctgtgactgggccgatatgctcttcaggatgtacaagagatgggctgaaaagaaagggtacgaggttgaactcatagacataactcccgacgacgtagccggtataaagagcgttacagtcctcgtaaaaggtccatacgcttacggatacctgaagggagagcagggagttcacagactcgtgaggatttctcccttcgacgcgaacgcaaggagacacacctcctttgcggcagtctccgttatgccccagatagacgaggacataaagatagaaataaaacctgaggacctgaagatagaaaccttcagggcttcgggagcgggaggacagtacgtaaacaaaaccgatactgcggttaggattacacacattcccacaggcataacagtatcctgtcagcaagaaaggtctcagtaccagaacaagagaaaagcacttgaacttctgaaggctaaactctatcagctcgagatgaagaaactggaagaaaagaaaaagcagtacgaaggcgagaaaacggacataggctggggtcaccagatcagatcctacgtctttcacccctacaaactaataaaggacctcagaacgggttacgagacgggaaacgtggaagcagtaatggacggagagatagacgagttcatagaaagttacctaaagtggaaagctcaaaaggaaaaagaatcatccaacaactaa

SEQ ID NO: 73892 - protein, 373 aa, Aquifex aeolicus
MMMVELKGKVEELRKRLEDVKKILSPEKLESELKELDQKMSEPNFWEDQEKAKQVIQRRKWVEETLNKLKNLEKSVKDLEELVEITSEEDTETWAMMDEEIKEVERTLRELELKTYLSGEMDAKNAYLTIQAGAGGTEACDWADMLFRMYKRWAEKKGYEVELIDITPDDVAGIKSVTVLVKGPYAYGYLKGEQGVHRLVRISPFDANARRHTSFAAVSVMPQIDEDIKIEIKPEDLKIETFRASGAGGQYVNKTDTAVRITHIPTGITVSCQQERSQYQNKRKALELLKAKLYQLEMKKLEEKKKQYEGEKTDIGWGHQIRSYVFHPYKLIKDLRTGYETGNVEAVMDGEIDEFIESYLKWKAQKEKESSNN

SEQ ID NO: 73893 - DNA, 1101 bp, Bacillus subtilis
  CDS (1)..(1101): transl_table=11
atggaattatcagaaattagagcagagctcgaaaatatggcttctcgtttagcggactttagggggtctcttgacctcgaatcaaaggaggcccgcattgctgagctagatgaacaaatggctgatccggaattctggaatgatcagcaaaaagctcaaacggttataaatgaagcaaacggtttaaaggattatgtcaattcgtataaaaaattgaatgaatcccacgaagaattacaaatgactcatgatcttttgaaagaagagccggacactgatctccagcttgagcttgaaaaagaactaaagtcattaacaaaagagttcaatgagtttgagcttcagcttcttctcagcgagccgtatgataaaaataacgcgattttagaactgcaccctggtgctggcggtacagagtcacaggactggggctctatgcttcttagaatgtatacaagatggggagagcgccgcggctttaaagtagagactctcgattaccttccaggtgacgaggcgggaatcaagtcagtgacattgctcatcaaaggacacaacgcttacgggtatctcaaagcagaaaaaggtgttcatcgtcttgtgcggatctcaccatttgattcatcaggccgccgccacacatctttcgtttcatgtgaagtcatgcctgaatttaacgatgaaattgatattgatattcgtacggaggatattaaagttgacacgtaccgtgcaagcggcgcgggcggacagcacgtcaatacgacggattcagccgttcggattactcacttgccgacgaacgtagttgtgacatgccaaacggagcgctcacaaattaaaaaccgtgaaagagccatgaaaatgctgaaggccaagctgtatcagcgcagaattgaagagcagcaggcagagctggatgaaattcgcggtgaacaaaaagaaatcggctggggcagccaaatccgttcttatgtattccatccgtattccatggtaaaagaccatcggaccaatacagaaatggggaacgttcaagctgtaatggatggtgacattgatacgtttattgatgcctacctgcgttctaagctttcataa

SEQ ID NO: 73894 - protein, 366 aa, Bacillus subtilis
MELSEIRAELENMASRLADFRGSLDLESKEARIAELDEQMADPEFWNDQQKAQTVINEANGLKDYVNSYKKLNESHEELQMTHDLLKEEPDTDLQLELEKELKSLTKEFNEFELQLLLSEPYDKNNAILELHPGAGGTESQDWGSMLLRMYTRWGERRGFKVETLDYLPGDEAGIKSVTLLIKGHNAYGYLKAEKGVHRLVRISPFDSSGRRHTSFVSCEVMPEFNDEIDIDIRTEDIKVDTYRASGAGGQHVNTTDSAVRITHLPTNVVVTCQTERSQIKNRERAMKMLKAKLYQRRIEEQQAELDEIRGEQKEIGWGSQIRSYVFHPYSMVKDHRTNTEMGNVQAVMDGDIDTFIDAYLRSKLS

SEQ ID NO: 73895 - DNA, 1116 bp, Caulobacter crescentus
  CDS (1)..(1116): transl_table=11
atgtcgaggccgctgcggccgacatcgagcagtccgtgggactgctcaggaggcgtctttgactgggacgtcgctctccgcaagctcgatgagctgaacgcccgggtcgaggacccgaccctgtgggaccgtccgtccgaggcccaggccgtgtcgcgcgagcgcgcgaacctggcggccaaggtcgaggccgtgcagtcgatcgagcgcgacctcaaggacgccctcgaatatgccgagctggccgagatggagtccgacgaggactcgctgaacgacgcccgcgctcagctgaagtcgctgaaggaacgcgccggtcgcgccgaactggaggcgctgctgtcgggcgaggctgacggcaacgactgctatgtcgaaatcaactccggcgccgggggcactgagtcctgcgactgggccggcatcctgctgcgcatgtacacccgctgggccaacgcccacggtatgaccaccgagctgatcgaagaaaccgatggcgatcaggccggcatcaagtccgcgaccctgctggtcaagggcgccaacgcctatggctggctgaagaccgaggcgggcgtgcaccgcctggtgcggatcagtccctatgacagcagcgcgcgccgtcacacctcgttcgcctcggcctgggtctatcccgtggtcgacgacaatatcgagatcgagatcaatccgtccgatgtgcgtaccgacacctaccgcgcctccggcgccggcggtcagcacatcaacaagaccgactcggcggtgcgtctcacgcacattccgaccggcatcgccgtggcctgccaggccggccgctcgcagcaccagaaccgcgaagaggcctggaaaatgctgcgcgcgcgcctctatgaggccgagctccagaagcgcgaagccgcgcaacaggcgctggaagaccagaagaccgacatcggctggggtcaccagatccgcagctacgtcctgcagccctaccagatggtcaaggacctgcggaccaacgtcgagacctccgacacccaaggggtccttgacggcgatctcgacgccttcatggccgcgtccctggctcagcgcgtgggtcacacccgcgacggcggcgaggcgtcttaa

SEQ ID NO: 73896 - protein, 371 aa, Caulobacter crescentus
MSRPLRPTSSSPWDCSGGVFDWDVALRKLDELNARVEDPTLWDRPSEAQAVSRERANLAAKVEAVQSIERDLKDALEYAELAEMESDEDSLNDARAQLKSLKERAGRAELEALLSGEADGNDCYVEINSGAGGTESCDWAGILLRMYTRWANAHGMTTELIEETDGDQAGIKSATLLVKGANAYGWLKTEAGVHRLVRISPYDSSARRHTSFASAWVYPVVDDNIEIEINPSDVRTDTYRASGAGGQHINKTDSAVRLTHIPTGIAVACQAGRSQHQNREEAWKMLRARLYEAELQKREAAQQALEDQKTDIGWGHQIRSYVLQPYQMVKDLRTNVETSDTQGVLDGDLDAFMAASLAQRVGHTRDGGEAS

SEQ ID NO: 73897 - DNA, 1110 bp, Chlamydia trachomatis
  CDS (1)..(1110): transl_table=11
atgcatgagaattttgacaaacgattggaacttttgcttgaaggtttggctttaactcggaggtctctttttgacccggaaggaaaagaaaatgagttaaaggaattggaacagcaggcggtgcaagatggtttttgggacgatgttgttcgtgcagggaaaatttccgaaaggatcgctcgattaaaacaacagttatcagaatttaatgaattaaaaaacaaagtttccgcgatacaattctttttagaagatgaagagtcttctaaagatttagaaatgcaaaaagaattagaaaaagaatttgttttttgtgaaaagaaaataacagaatgggaaacactcagacttctttctggtgagttagatcgaaattcctgttttctatccattaatgcaggagcaggggggaccgaatcttgtgactgggtagagatgctgctgcgcatgtatatgcgatgggctagtagtcatagctggaggatagaagtgatcgatcgattggatggggaagtcgctgggattaagcatatcaccctgaagctcgtcggtgaatatgcctacggctatgctaaagcagagagcggagtgcatcgtctggtacgcatatctcctttcgatagcaatgcgaaacggcatactagttttgcatcagtagaagtgtttccagagattgatgataaaatagaagttgagatccgtcccggagatattcgtattgatacgtatcgttcttctggagctggaggacaacatgtaaacgtaacagattcagcggtacggattacacacttccctacgggaattgtagtgtcatgtcagaatgagcgtagtcaaattcaaaaccgagaagcttgtatgaatatgctgcgcgctaggatttaccagaagttgttacaagaacgtttagagaaacagaatatagatagaaaaaataaaaaagaaatcagctggggatctcagattcgtaattatgtatttcagccttatacgctggtgaaagatgtaaggactggatatgaagtgggcaacatccaagcaatgatggatggggagctcctagatgcttttatcaaagcctacctggttgattatggagaaattacatga

SEQ ID NO: 73898 - protein, 369 aa, Chlamydia trachomatis
MHENFDKRLELLLEGLALTRRSLFDPEGKENELKELEQQAVQDGFWDDVVRAGKISERIARLKQQLSEFNELKNKVSAIQFFLEDEESSKDLEMQKELEKEFVFCEKKITEWETLRLLSGELDRNSCFLSINAGAGGTESCDWVEMLLRMYMRWASSHSWRIEVIDRLDGEVAGIKHITLKLVGEYAYGYAKAESGVHRLVRISPFDSNAKRHTSFASVEVFPEIDDKIEVEIRPGDIRIDTYRSSGAGGQHVNVTDSAVRITHFPTGIVVSCQNERSQIQNREACMNMLRARIYQKLLQERLEKQNIDRKNKKEISWGSQIRNYVFQPYTLVKDVRTGYEVGNIQAMMDGELLDAFIKAYLVDYGEIT

SEQ ID NO: 73899 - DNA, 1098 bp, Escherichia coli
  CDS (1)..(1098): transl_table=11
atgtttgaaattaatccggtaaataatcgcattcaggacctcacggaacgctccgacgttcttagggggtatcttgactacgacgccaagaaagagcgtctggaagaagtaaacgccgagctggaacagccggatgtctggaacgaacccgaacgcgcacaggcgctgggtaaagagcgttcctccctcgaagccgttgtcgacaccctcgaccaaatgaaacaggggctggaagatgtttctggtctgctggaactggctgtagaagctgacgacgaagaaacctttaacgaagccgttgctgaactcgacgccctggaagaaaaactggcgcagcttgagttccgccgtatgttctctggcgaatatgacagcgccgactgctacctcgatattcaggcggggtctggcggtacggaagcacaggactgggcgagcatgcttgagcgtatgtatctgcgctgggcagaatcgcgtggtttcaaaactgaaatcatcgaagagtcggaaggtgaagtggcgggtattaaatccgtgacgatcaaaatctccggcgattacgcttacggctggctgcgtacagaaaccggcgttcaccgcctggtgcgtaaaagcccgtttgactccggcggtcgtcgccacacgtcgttcagctccgcgtttgtttatccggaagttgatgatgatattgatatcgaaatcaacccggcggatctgcgcattgacgtttatcgcacgtccggcgcgggcggtcagcacgttaaccgtaccgaatctgcggtgcgtattacccacatcccgaccgggatcgtgacccagtgccagaacgaccgttcccagcacaagaacaaagatcaggccatgaagcagatgaaagcgaagctttatgaactggagatgcagaagaaaaatgccgagaaacaggcgatggaagataacaaatccgacatcggctggggcagccagattcgttcttatgtccttgatgactcccgcattaaagatctgcgcaccggggtagaaacccgcaacacgcaggccgtgctggacggcagcctggatcaatttatcgaagcaagtttgaaagcagggttatga

SEQ ID NO: 73900 - protein, 365 aa, Escherichia coli
MFEINPVNNRIQDLTERSDVLRGYLDYDAKKERLEEVNAELEQPDVWNEPERAQALGKERSSLEAVVDTLDQMKQGLEDVSGLLELAVEADDEETFNEAVAELDALEEKLAQLEFRRMFSGEYDSADCYLDIQAGSGGTEAQDWASMLERMYLRWAESRGFKTEIIEESEGEVAGIKSVTIKISGDYAYGWLRTETGVHRLVRKSPFDSGGRRHTSFSSAFVYPEVDDDIDIEINPADLRIDVYRTSGAGGQHVNRTESAVRITHIPTGIVTQCQNDRSQHKNKDQAMKQMKAKLYELEMQKKNAEKQAMEDNKSDIGWGSQIRSYVLDDSRIKDLRTGVETRNTQAVLDGSLDQFIEASLKAGL

SEQ ID NO: 73901 - DNA, 1092 bp, Helicobacter pylori J99
  CDS (1)..(1092): transl_table=11
gtggataattacacctatagcgaattgttaaaaagcttgcaaaacaaatgcgataatatcgccttaatcatcaagcctgaaaagatcaagcaagaattagaacgcattgaaaaagagcaagaagaccctaatttttggcaagatgttttaaaagccagagacaccaataaagaaaaagtacgcttgaaccgcttgctagaaacctatcaaaaaatgaaaaattctttagatgaaagcgtggaattgtttgaactcgctcaaaacgatagcgatgaggttactttatccttgctctatgaagaggctcctactttagaacacagcgtgcaaaaagtggaaattgaaatcatgttaagcggtgaaaacgacgcttcaaacgccattattaccattcagcctggagcgggggggactgaaagccaggattgggcgagtattttgtatcgcatgtatttgaggtgggcagaaagaaagagttttaaaagcgagattttagattatcaagatggcgaagaagcgggcattaaaggggtcgcctttatcattaagggcgaaaacgcttatggctatttgaaaaatgaaaacggggtgcataggcttgtaaggatttcgccctttgatgcgaacgccaaacggcacacgagttttgcgagcgtgcaaattagccctgaattggacgatgatattgatatagaaattgatgaaaaagatgtccgttatgattattatagagccagtggggcaggcggtcagcatgtcaataaaacagaaagcgcggttagaatcacgcatttccctaccggtattgtggtgcaatgccaaaacgacaggagccagcataaaaacaaggcgagcgcgttaaaaatgcttaaatccaagctttatgaattggaattagaaaaacagcaaagcagtgccaaaaatgaagaaaaaagcgagatcggctgggggcatcaaataagaagttatgttctagccccctaccagcaagtcaaagacgcgcgctccaatatcgcttatagcaatgtggaagcgatattagacggcgatattgatgcgattttagagggcgttttgattgctaaagcttaa

SEQ ID NO: 73902 - protein, 363 aa, Helicobacter pylori J99
MDNYTYSELLKSLQNKCDNIALIIKPEKIKQELERIEKEQEDPNFWQDVLKARDTNKEKVRLNRLLETYQKMKNSLDESVELFELAQNDSDEVTLSLLYEEAPTLEHSVQKVEIEIMLSGENDASNAIITIQPGAGGTESQDWASILYRMYLRWAERKSFKSEILDYQDGEEAGIKGVAFIIKGENAYGYLKNENGVHRLVRISPFDANAKRHTSFASVQISPELDDDIDIEIDEKDVRYDYYRASGAGGQHVNKTESAVRITHFPTGIVVQCQNDRSQHKNKASALKMLKSKLYELELEKQQSSAKNEEKSEIGWGHQIRSYVLAPYQQVKDARSNIAYSNVEAILDGDIDAILEGVLIAKA

SEQ ID NO: 73903 - DNA, 1092 bp, Helicobacter pylori
  CDS (1)..(1092): transl_table=11
gtggataactacacctatagcgaattgttaaaaagcttgcaaaacaaatgcgataatatcgctttaatcatcaagcctgaaaagatcaaacaagaattagaacgcattgaaaaagagcaagaagatcctaatttttggcaagatgtcttaaaggctagagacaccaataaagaaaaagtgcgcttgaaccgcttgctagaaacctatcaaaaaaccaaaaattctttagatgaaagcgtagaattgtttgaactcgctcaaaacgataacgatgaggttactttatccttgctctatgaagaggctcccattttagagaacagcgtccaaaaagtagaaattgaaatcatgttaagcggtgaaaacgatgcctcaaacgctattatcaccattcagcctggagcgggggggactgaaagccaggattgggcgagtattttgtatcgcatgtatttgagatgggcggaaagaaggggctttaaaagcgagattttagactatcaagatggcgaagaagcgggcattaaaggggtcgcctttatcattaagggcgaaaacgcttatggctatttgaaaaacgaaaacggggtgcataggcttgtaaggatttcgccctttgatgcgaacgccaaacggcacacaagttttgcgagcgtgcaaattagccctgaattagacgatgacattgatatagaaattgatgaaaaagatgtccgttacgattattatagatccagtggggcaggcggtcagcatgtcaataaaacagaaagcgcggttaggatcacgcattttcctaccggtattgtggtgcaatgccaaaacgacaggagccagcataaaaacaaagcgagcgcgttaaaaatgcttaaatccaagctttatgaattggaattagaaaagcagcaaagcagcgccaaaaatgaagaaaaaagcgagatcggctgggggcatcaaataagaagttatgtcctagccccctaccaacaagtcaaagacgcgcgctccaataccgcttatagcaatgtggaagcgatactagatggcgatattgatgcaattttagagggcgttttgattgctaaagcttaa

SEQ ID NO: 73904 - protein, 363 aa, Helicobacter pylori
MDNYTYSELLKSLQNKCDNIALIIKPEKIKQELERIEKEQEDPNFWQDVLKARDTNKEKVRLNRLLETYQKTKNSLDESVELFELAQNDNDEVTLSLLYEEAPILENSVQKVEIEIMLSGENDASNAIITIQPGAGGTESQDWASILYRMYLRWAERRGFKSEILDYQDGEEAGIKGVAFIIKGENAYGYLKNENGVHRLVRISPFDANAKRHTSFASVQISPELDDDIDIEIDEKDVRYDYYRSSGAGGQHVNKTESAVRITHFPTGIVVQCQNDRSQHKNKASALKMLKSKLYELELEKQQSSAKNEEKSEIGWGHQIRSYVLAPYQQVKDARSNTAYSNVEAILDGDIDAILEGVLIAKA

SEQ ID NO: 73905 - DNA, 1098 bp, Lactococcus lactis
  CDS (1)..(1098): transl_table=11
atggaattatcagaaattagaaatttacttgaaggatatgctgagaagattaatggctttcgggaatcattagatcttgagcgtttggaagaagaaatagctcttttagaaaacgatatggctcaacctgaattttggaatgatcaagcagcggctcaaaaagtgattgatgaatcaaatgctttgaaagccaagtatgacaattatcaagcgatgaataatatgcttgaggaagcgcaaacgatgcttgagatgcttcaagaagaagctgacgaagagatgcaagctgagttagaggaaatgacaattgcgctcggtcaaaaaattgaatcttatgagcttgaaattatgctcaatcaaccttatgaccatatgaatgctgttcttgaaattcacccaggttctgggggaacagagtcgcaggactggggctcaatgttgatgcggatgtacactcgttggggcgaagcacatggatttaaggttgaaattctcgactatcaagacggagatgttgccggattgaaatcagttgcccttcgatttgttggacgaaatgcttatggttttttgagaggagaaaaaggagtacatcgtttagtacgtatttcaccttttgattcagccaatcgtcgtcatacttcatttacctcagttgatgtgatgcctgagttggacgattctattgaagtagatgttcgtgatgccgatgttaaaatggatactttccgttcgggtggagctggtggacaaaatgtcaataaagtctctactggtgtgcgtttgactcacatcccaacgggaattgttgtgcaatctacaatggatagaacgcaatatggtaaccgggataaagcgatggctatgctgaaatcgaaactctatcaattagaaatggataaaaagcaagctgaagttgatgaacttcgtggcgaccaatcagaaatttcttggggaagtcaaattcgttcatacgtattcatgccttatcaattagttaaagatacgcgtactggttatgaaactggacaaatttcaaatgtgatggacggagaattggacgggtttataaatgcctatctccgttggaacttgtag

SEQ ID NO: 73906 - protein, 365 aa, Lactococcus lactis
MELSEIRNLLEGYAEKINGFRESLDLERLEEEIALLENDMAQPEFWNDQAAAQKVIDESNALKAKYDNYQAMNNMLEEAQTMLEMLQEEADEEMQAELEEMTIALGQKIESYELEIMLNQPYDHMNAVLEIHPGSGGTESQDWGSMLMRMYTRWGEAHGFKVEILDYQDGDVAGLKSVALRFVGRNAYGFLRGEKGVHRLVRISPFDSANRRHTSFTSVDVMPELDDSIEVDVRDADVKMDTFRSGGAGGQNVNKVSTGVRLTHIPTGIVVQSTMDRTQYGNRDKAMAMLKSKLYQLEMDKKQAEVDELRGDQSEISWGSQIRSYVFMPYQLVKDTRTGYETGQISNVMDGELDGFINAYLRWNL

SEQ ID NO: 73907 - DNA, 1074 bp, Lactobacillus plantarum
  CDS (1)..(1074): transl_table=11
gtgctgtcgacgactttagggggtcgctttgacttagatgctttgaacgaaagcattcaagaaaatgaagctcgaatggccgaacccggtttttgggacgaccaggctgccgcccagaaagtcatcgatgagaataacgtgttgaaaggaaagtatgatacgtttaagcaattagctgatgaagtcggtgacttggcagtcgcttatgagttactgagtgaggaacccgatgctgagatgcaggctgagtttgaaacggactttcagcacgctgaacatgatttacaacagtaccggctcaacttacttttggacggtccgtacgaccgcaataacgctattttagaaatccatcctggagctggtgggaccgaatcccaagattggggtgcgatgctactaagaatgtacacgcgctgggctgcgagtcacaatttcaaagtcgagactgttgactaccaagctggtgatgaggcaggcattaagagtgtgactttattaattagcggccacaatgcttacggttatttgcggtcagaaaaaggggttcatcgtcttgttcggatttcgccgttcgatgcggctggtcggcgccacacatcttttgcgagtgttgatgtgatgcctgagttagatgataccgtggatgttgatattcgacctgaagatttgaagattgacgtttatcgagccagtggggccggtggacaacatgtcaataagacttcttcagcggttcggattacccacgtgccaacgggaattgtcgttgccagtcaagcgcaacggtcacaattacagaaccgacaaacagcattgaacatgttacgagcgaagttgtacgaacgtgaagaagagaagaaggctaaggaacgggcggccatccaaggtgagcaaatggacattgggtggggctcacaaattcgctcctacgtttttcatccgtatacgatggtcaaggatcaccggactaattatgaatcacatcatgggcaggctgtcatggatggtgatcttgatccgtttatggatgcttacttacaatggaaattagcccaacgtaatccgcaatag

SEQ ID NO: 73908 - protein, 357 aa, Lactobacillus plantarum
MLSTTLGGRFDLDALNESIQENEARMAEPGFWDDQAAAQKVIDENNVLKGKYDTFKQLADEVGDLAVAYELLSEEPDAEMQAEFETDFQHAEHDLQQYRLNLLLDGPYDRNNAILEIHPGAGGTESQDWGAMLLRMYTRWAASHNFKVETVDYQAGDEAGIKSVTLLISGHNAYGYLRSEKGVHRLVRISPFDAAGRRHTSFASVDVMPELDDTVDVDIRPEDLKIDVYRASGAGGQHVNKTSSAVRITHVPTGIVVASQAQRSQLQNRQTALNMLRAKLYEREEEKKAKERAAIQGEQMDIGWGSQIRSYVFHPYTMVKDHRTNYESHHGQAVMDGDLDPFMDAYLQWKLAQRNPQ

SEQ ID NO: 73909 - DNA, 1125 bp, Mycobacterium leprae
  CDS (1)..(1125): transl_table=11
gtggaacctgaccgacaaaccgacatcgctgctcttgactccaccttgaccacggtggagcgggtgctcgacgtggagggtctgcgcacccgcatcgagaaacttgagcatgaggcgtccgatccgaaactgtgggatgaccaagtccgcgcgcaacgtgtgaccagcgagttatctcacgctcagggcgagctgcgccgaatcgaggagctgcggcgacgtttagatgacttgccggtactctacgaattagcggctgaggaaagggctgcggccgccgctagcggaatggaggccttcgctgaggctgatgccgaactcaaggcgctgcgcgtcgatatcgaagccaccgaggtgcgcacgctgttgtcaggcgaatatgacgagcgcgaagcgctgatcaccatacgttccggtgctggcggagtggatgccgcggactgggccgaaatgctgatgcggatgtatattcgatgggcagagcagcacaaatacggcgtcgaggtgttagacacctcctatgccgaagaagccggtgtcaaaagtgccacgttcgccgtgcacgcgccgttcgcctatggcacgttggcgagcgagcagggcacccaccggctggtccggatcagcccgttcgacaaccagagtcggcggcagacctcgttcgctgaggtcgaagtgttgcctgtggtggagatcaccgatcacatcgacattcccgaaggcgatgtgcgcgtcgatgtctaccgatccagcggtcctggcggccagtcggtcaacaccaccgactctgcggtacggctaactcacgtcccaaccggtcttgtcgttacctgccagaacgagaaatcgcagctgcagaacaaggtatcggcgatgcgcgtgctgcaagcaaagttgttggagcgtaagcgtttagaagaacgcgctgagctagatgcattaaagggtaggggtggcagctcgtggggcaatcagatacggtcctatgtactgcacccttatcagatggtcaaggatctgcgaaacgagtacgaggtgggtaacccgacagctgtacttgacggagacatcgacgggttcctggaagccgggattcgttggcgcaacagacgtgatatcagctaa

SEQ ID NO: 73910 - protein, 374 aa, Mycobacterium leprae
MEPDRQTDIAALDSTLTTVERVLDVEGLRTRIEKLEHEASDPKLWDDQVRAQRVTSELSHAQGELRRIEELRRRLDDLPVLYELAAEERAAAAASGMEAFAEADAELKALRVDIEATEVRTLLSGEYDEREALITIRSGAGGVDAADWAEMLMRMYIRWAEQHKYGVEVLDTSYAEEAGVKSATFAVHAPFAYGTLASEQGTHRLVRISPFDNQSRRQTSFAEVEVLPVVEITDHIDIPEGDVRVDVYRSSGPGGQSVNTTDSAVRLTHVPTGLVVTCQNEKSQLQNKVSAMRVLQAKLLERKRLEERAELDALKGRGGSSWGNQIRSYVLHPYQMVKDLRNEYEVGNPTAVLDGDIDGFLEAGIRWRNRRDIS

SEQ ID NO: 73911 - DNA, 1104 bp, Neisseria meningitidis
  CDS (1)..(1104): transl_table=11
atggaagccgaagtaatcaaccagctcaacaataccctgaacgatttggaaaagcgcagcgaagacatccgagtttatatggattatcagggtaagaaagaccgattggaagaagttatcggtctttccgaagaccccgaactttggaacgacccgaaacgcgcccaagaaatcggcaaagagcgcaaaatcctcgaaggcatcgtgttgacgctcgacaacatcgcttcgggcatcgaagacaaccgcatgctgattgaaatgaccgtcgaagaaaacgacgaagaaggttttgccgccgtgcaggaagacgtagcggggctggaaaaacagatggcggatttggagttcaaacggatgttcaaccagcccgccgacccgaacaactgctttatcgacatcaccgcaggcgcgggcggtacggaagcggaagactgggcgggtatgctgttccgtatgtacagccgctacgccgagcgcaaaggcttcagaatcgaaatccttgaagaagacgacggcgaaatcgcaggcatcaaccgcgccaccatccgtgtggaaggcgaatacgcttatggtttgctgcgtaccgaaaccggcgttcaccgcttggtgcgttactcgccgtttgactcgaacaacaaacgccatacctcgtttgcctccgtgttcgtttaccctgaaatcgacgattccatcgaaatcgaaatcaaccccgccgatttgcgcatcgacacctatcgcgcatcgggtgcgggcggtcagcacatcaataaaaccgactccgccgtgcgcattacccacgagccgacggggattgtggtgcaatgtcaaaacgaccgttcgcaacacgccaacaaagccgctgcgatggaaatgttgaagtccaaactgtatgaattggaaatgcgcaaacgcaatgaagagaaacaggcgttggaagaaggtaaatccgatgtaggttggggcagccaaatccgttcgtatgttttggattcctcacgtatcaaagacttgcgtacaggctacgaagtcggcaacaccaaagccgtattggatggcgacttggacggcttcatcgaagccagcctgaaacagggcgtgtag

SEQ ID NO: 73912 - protein, 367 aa, Neisseria meningitidis
MEAEVINQLNNTLNDLEKRSEDIRVYMDYQGKKDRLEEVIGLSEDPELWNDPKRAQEIGKERKILEGIVLTLDNIASGIEDNRMLIEMTVEENDEEGFAAVQEDVAGLEKQMADLEFKRMFNQPADPNNCFIDITAGAGGTEAEDWAGMLFRMYSRYAERKGFRIEILEEDDGEIAGINRATIRVEGEYAYGLLRTETGVHRLVRYSPFDSNNKRHTSFASVFVYPEIDDSIEIEINPADLRIDTYRASGAGGQHINKTDSAVRITHEPTGIVVQCQNDRSQHANKAAAMEMLKSKLYELEMRKRNEEKQALEEGKSDVGWGSQIRSYVLDSSRIKDLRTGYEVGNTKAVLDGDLDGFIEASLKQGV

SEQ ID NO: 73913 - DNA, 1110 bp, Rickettsia prowazekii
  CDS (1)..(1110): transl_table=11
atgcgagctgaaatagaaaactatatcaaaaaaattgagcaatctttagacctaatttggaggtcacttgacattgaagcattaactgtaagactgacagaattagaagaattaacagcagatccaaatttatggaataataatgctaatgcacaaacattactaagagaaaaaaataatctcgaagaaaaacttaatgtgtttaataaactcaaatcaaatttaaaagagattttagaacttgaagcaatggctgaagtcgaaaatgatttagagaccctgaatcaaattgaacaggactttaaaaaattaagtatcattacagcaaaatttgaaactgagtgcttattttcaggtgaaacagactgcaataactgctttttagaaattaatgctggagcaggaggaacggaaagtcacgattgggcatcgattatgatgcgtatgtatttacgttttgcagaacgacttggttttaaaaccaaaataataaatatgattaatggagaagaagtaggcattaaatcatgtacgattagaataataggtaaacgagcttacggttggtttaaaaccgaatcaggagtgcataggctagtgcgtatttctccatttaatgcagcaggcaaaagaatgactagctttgcaagtagctggatatatccagaaattgatgatgatatagcaatcactattgaagataaagatttaagaatcgatacttttagatcatcaggagcaggcggacaacacgttaatacaacagattctgcagtacgtatcacacatataccaacaaatacagtaacacaatgtcaaagtgatagatcacaacataagaataaagctcaagcaatgaagatgcttcaagcaaaactctataagcttgaaatgcagaaacgtaatgaaaatgttgataaacagaatgccaataaaaccgataatagctggggacatcaaattagatcatatgtcttgcaaccttatcaaattgtaaaagatctacgtactaattacgaaacttccgatactaaaggagtacttgacggtaaccttgaagactttgtctctgcaagcctttctatgaataatagcggtaataaaacataa

SEQ ID NO: 73914 - protein, 369 aa, Rickettsia prowazekii
MRAEIENYIKKIEQSLDLIWRSLDIEALTVRLTELEELTADPNLWNNNANAQTLLREKNNLEEKLNVFNKLKSNLKEILELEAMAEVENDLETLNQIEQDFKKLSIITAKFETECLFSGETDCNNCFLEINAGAGGTESHDWASIMMRMYLRFAERLGFKTKIINMINGEEVGIKSCTIRIIGKRAYGWFKTESGVHRLVRISPFNAAGKRMTSFASSWIYPEIDDDIAITIEDKDLRIDTFRSSGAGGQHVNTTDSAVRITHIPTNTVTQCQSDRSQHKNKAQAMKMLQAKLYKLEMQKRNENVDKQNANKTDNSWGHQIRSYVLQPYQIVKDLRTNYETSDTKGVLDGNLEDFVSASLSMNNSGNKT

SEQ ID NO: 73915 - DNA, 1110 bp, Staphylococcus aureus
  CDS (1)..(1110): transl_table=11
atggaattatcagaaatcaaacgaaatatagataagtataatcaagatttaacacaaattagggggtctcttgacttagagaacaaagaaactaatattcaagaatatgaagaaatgatggcagaacctaatttttgggataaccaaacaaaagcgcaagatattatagataaaaataatgcgttaaaagcaatagttaatggttataaaacactacaagcagaagtagatgacatggatgctacttgggatttattacaagaagaatttgatggagaaatgaaagaagacttagagcaagaggtcattaattttaaggctaaagtggatgaatacgaattgcaattattattagatggacctcacgatgccaataacgcaattctagagttacatcctggtgcaggtggcacggaatctcaagattgggctaatatgctatttagaatgtatcaacgttattgtgagaagaaaggttttaaagttaaaactgttgattatttacctggagatgaagcagggattaaaagtgtaacattgctcatcaaagggcataatgcttatggttatttaaaagctgaaaaaggtgtacaccgactagtacgaatttctccatttgattcatcaggacgtcgtcatacatcatttgcatcatgtgacgtgattccagattttaataatgatgaaatagagattgaaatcaatccggatgatattacagttgatacattcagagcttctggtgcaggtggtcagcatattaacaaaactgaatcggcaatacgaattacccatcacccctcaggtatagttgttaataaccaaaatgaacgttctcaaattaaaaaccgtgaagcagctatgaaaatgttaaagtctaaattatatcaattaaaattggaagagcaggcacgtgaaatggctgaaattcgtggcgaacaaaaagaaatcggatggggaagccaaattagatcatatgttttccatccatactcaatggtgaaagatcatcgtacgaacgaagaaacaggtaaggttgatgcagtgatggatggagacattggaccatttatcgaatcatatttaagacagacaatgtcgcacgattaa

SEQ ID NO: 73916 - protein, 369 aa, Staphylococcus aureus
MELSEIKRNIDKYNQDLTQIRGSLDLENKETNIQEYEEMMAEPNFWDNQTKAQDIIDKNNALKAIVNGYKTLQAEVDDMDATWDLLQEEFDGEMKEDLEQEVINFKAKVDEYELQLLLDGPHDANNAILELHPGAGGTESQDWANMLFRMYQRYCEKKGFKVKTVDYLPGDEAGIKSVTLLIKGHNAYGYLKAEKGVHRLVRISPFDSSGRRHTSFASCDVIPDFNNDEIEIEINPDDITVDTFRASGAGGQHINKTESAIRITHHPSGIVVNNQNERSQIKNREAAMKMLKSKLYQLKLEEQAREMAEIRGEQKEIGWGSQIRSYVFHPYSMVKDHRTNEETGKVDAVMDGDIGPFIESYLRQTMSHD

SEQ ID NO: 73917 - DNA, 1107 bp, Streptomyces coelicolor
  CDS (1)..(1107)
atggcagtcgtcgatgtatccgaagagctgaagtccctctcctcgaccatggagtcgatcgaggccgtcctggacctcgacaggctgagggcagacatcgccgtgctcgaggagcaggcggccgcgccctccctgtgggacgacccggaggcggcgcagaagatcaccagcaagctctcgcacctccaggccgaggtgcggaaggccgaggccctgcgcggccggatcgacgatctcggcgtgctcttcgagatggccgaggaggaggacgacccggacacccgcgccgaggccgagtccgagctcgcggccgtccgcaaggcgctggacgagatggaggtccgcaccctgctctccggcgagtacgacgcgcgcgaggcgctcgtcaacatccgcgccgaggcgggtggcgtggacgccgccgacttcgccgagaagctccagcgcatgtacctgcgctgggccgagcagcacggctacaagaccgaggtctacgagacgtcgtacgcggaggaggccggcatcaagtcgaccaccttcgccgtgcagtcgccgtacgcctacggcaccctctccgtcgagcagggcacgcaccggctggtgcgcatctcgcccttcgacaaccaggggcgccgccagacctccttcgcgggcgtcgagatcctccccgtggtcgagcagaccgaccacatcgagatcgacgaatccgagctgcgggtagacgtataccgctcctccggccccggcggccagggcgtgaacaccaccgactcggcggtgcgcctgacccacatccccaccggcatcgtcgtctcctgccagaacgagcgctcccagatccagaacaaggccaccgccatgaacgtcctccaggccaagctcctggagcggcgccgccaggaggaacaggccaagatggacgccctcaagggcgacgggggcaactcctggggcaaccagatgcgttcgtacgtgctgcacccgtaccagatggtcaaggacctgcgcacggagcacgaagtgggtaacccggaggccgtgttcaacggcgagatcgacggtttcctggaggccggaattcgctggcgcaagcagcgggagaagtaa

SEQ ID NO: 73918 - protein, 368 aa, Streptomyces coelicolor
MAVVDVSEELKSLSSTMESIEAVLDLDRLRADIAVLEEQAAAPSLWDDPEAAQKITSKLSHLQAEVRKAEALRGRIDDLGVLFEMAEEEDDPDTRAEAESELAAVRKALDEMEVRTLLSGEYDAREALVNIRAEAGGVDAADFAEKLQRMYLRWAEQHGYKTEVYETSYAEEAGIKSTTFAVQSPYAYGTLSVEQGTHRLVRISPFDNQGRRQTSFAGVEILPVVEQTDHIEIDESELRVDVYRSSGPGGQGVNTTDSAVRLTHIPTGIVVSCQNERSQIQNKATAMNVLQAKLLERRRQEEQAKMDALKGDGGNSWGNQMRSYVLHPYQMVKDLRTEHEVGNPEAVFNGEIDGFLEAGIRWRKQREK

SEQ ID NO: 73919 - DNA, 1110 bp, Thermotoga maritima
  CDS (1)..(1110): transl_table=11
atgggtatgatcagtttcgaaaccaaaaccaagatagaagaacttgaaaagaaatacaaggatgttctttcggtggtcaacgaggatgaaatcaacaaggaactcgaagaggtagagaaaaaactcacagatccatcggtatgggatgatcaaaaaaaggcgcgtgagtacacccagaaactgaagaggttgaagaacatctctgaagatttgaagagagtgagatctctgttcgaagatctggaagttgccatagaactttccgacgaggatcaggagatggctcagcacgtggaagaaatagttcaggagctggaaggtgccgtcaaaaaactggaacttgagatcattctgaacggaaaatacgatccgaacaacgcttatctgtcggtccatccaggtgcgggtggtaccgagtctcaagactgggcgcagatgcttctcagaatgtacatgaggtgggcagagagaaaaggtttcgatgttgagattgtggagttccaaccgggagaagaggccggtatcaaggatgccacgattctcataaaaggtgaatacgcttacggttacttgaaacacgaatccggtgttcacagactggtcaggatctcacccttcgacgcggccagaagaagacacacttctttcgcttctgtgaatgtgattccggagatagatgacgacgtggatatagagatcagaccggaagatttgaagatagaaactttcagagcttctggacacggcggacaatacgtcaacaaaaccgaatctgccgtgagaatcacgcatctaccgaccgggatcgtggtctcctgtcaaaacgaaagatcgcagcaccagaacaaacaaaccgcgctgaagatactcaaagcgaaactctaccaactcgagatggaaaagaagcgaagggaaatacaagagattcagggagaactcaaggacatttcctggggaaaccagataagatcttatattttccacccgtacacgatggttaaagatcacagaaccggagtggaaactgcgaacgttgacgccgttatggatggagacatagatatgttcatagaggccgagctggtctatttcgctcgtcgatcaagttaa

SEQ ID NO: 73920 - protein, 369 aa, Thermotoga maritima
MGMISFETKTKIEELEKKYKDVLSVVNEDEINKELEEVEKKLTDPSVWDDQKKAREYTQKLKRLKNISEDLKRVRSLFEDLEVAIELSDEDQEMAQHVEEIVQELEGAVKKLELEIILNGKYDPNNAYLSVHPGAGGTESQDWAQMLLRMYMRWAERKGFDVEIVEFQPGEEAGIKDATILIKGEYAYGYLKHESGVHRLVRISPFDAARRRHTSFASVNVIPEIDDDVDIEIRPEDLKIETFRASGHGGQYVNKTESAVRITHLPTGIVVSCQNERSQHQNKQTALKILKAKLYQLEMEKKRREIQEIQGELKDISWGNQIRSYIFHPYTMVKDHRTGVETANVDAVMDGDIDMFIEAELVYFARRSS

SEQ ID NO: 73921 - DNA, 1107 bp, Treponema pallidum
  CDS (1)..(1107): transl_table=11
ttggtccacaaatcaccgccctcgaggcgcgcgtgcaggaagtatgggggagtctttgacgttgccgcatacgaggcgcgcatagcaacgcttgaggctgctgcagcagcgcctgacttttggagcgaacgcgcgcgtgccgaagcgctgttagcggaactgaaaacgctacgcgcaacgcttgagccgtggcgtgcgctgcgccgtgagagcgcagatctgcgcgcgttgtacgagcttgcccgcgaggcgcaagacgcatcgctggagccagaactttcctcccttttttcagacatttctgctcgtttcgaagaggcatcgcttacccgtctcctgcacgaagaggtagaccgcctcgacgcgtttgttaccatccactccggcgcaggaggagtggaggcctgcgactgggcacagatgctcatgcgcatgtacacgcgctgggcagagcggcgcagcttttgcgtacacatagttgacttacttgagtcagaagggggagtaaaatcggtgacgttaaaaatttgcgggtcacacgcctttggttttctcaagggagaaacgggggtacaccggctcgtgcgcatcagtccgtttgactctgccgcgcgcagacatacctcttttacctccacctacgtcttccccgtattagacgatcacgttgaggtgcacatacggagcgaagacatgcgggtagatacctaccgctcagggggagcaggcggtcaacatgtcaataaaacggactctgccgtgcgcatcacgcatctgcctacagggatagtagtcacctgccagaacgagcgcagccaaatcagcaaccgtgcaacggcgctgagcttgttacgcgcccgcctgtacgcctatgaacggcaaaaaaaacagcaggaacatcaacggtttgcttctgaaaagaaggatatttcgtggggaaatcagattcgctcgtacgtctttcatccctacaccatggttaaagatcaccgcagcaagtgcgaaacggggaatattcacgcagtcatggacggagcgttagaaccgttcatccgttcctacttggagtttctgtgtaccagtacccagtgtgtagaaccacagtga

SEQ ID NO: 73922 - protein, 368 aa, Treponema pallidum
MVHKSPPSRRACRKYGGVFDVAAYEARIATLEAAAAAPDFWSERARAEALLAELKTLRATLEPWRALRRESADLRALYELAREAQDASLEPELSSLFSDISARFEEASLTRLLHEEVDRLDAFVTIHSGAGGVEACDWAQMLMRMYTRWAERRSFCVHIVDLLESEGGVKSVTLKICGSHAFGFLKGETGVHRLVRISPFDSAARRHTSFTSTYVFPVLDDHVEVHIRSEDMRVDTYRSGGAGGQHVNKTDSAVRITHLPTGIVVTCQNERSQISNRATALSLLRARLYAYERQKKQQEHQRFASEKKDISWGNQIRSYVFHPYTMVKDHRSKCETGNIHAVMDGALEPFIRSYLEFLCTSTQCVEPQ

SEQ ID NO: 73923 - DNA, 1101 bp, Yersinia pestis
  CDS (1)..(1101): transl_table=11
atgtttgaaataaacccggtaaaaaaccgaattcaggacctgtctgatcggacagccgttctcagggggtatctttgtgactatgatgccaagaaagagcgactggaagaagtaaacgccgagctggaacagcccgacgtctggaatgaacccgaacgcgctcaagcgttgggcaaagagcgttctacgctggaagagattgtcaccaccattgatcaattagagcaaggcttggaagacgtgtccggcctgctggaattagccgttgaagctgatgatgaagaaacctttaacgaaacaattgctgagttagaggttcttgatggcaagctgggccagctcgaattccgtcgtatgttctctggcgaatatgatcgcgccaactgctatctggacttacaagcaggctctggtggcactgaagctcaggactgggccagtatgttactgcgtatgtacttgcgctgggctgagtctagaggctttaaaactgagatcatcgaagaatctgacggtgatgttgctggtttgaaatctgccaccgtcaaaataattggtgaatatgccttcggttggttacgtactgaaactggcgtacaccgtctggtacgtaaaagcccatttgattcgggcggtcgccgccatacctctttcagttcagcctttgtctatccagaagttgatgacgatattgatattgaaattaacccggcagacctgcgtattgacgtttaccgtgcatccggtgcgggtggtcagcacgtcaacaaaacagaatctgcggtgcgaattactcatattccaaccaatatcgtgactcaatgccagaatgaccgttcgcagcataaaaacaaagatcaagcgatgaaacagctgaaagctaagctgtatgagtttgagatgcaaaagaaaaatgctgataaacaggttttggaagacaataagtccgatatcggctggggtagccagatccgttcttatgtattggatgactcccgtattaaagatttgcgtaccggtgtggaaacacgcaacacgcaagctgtactggatggcgatctggacaaatttattgaagcaagcttgaaagccgggctatga

SEQ ID NO: 73924 - protein, 366 aa, Yersinia pestis
MFEINPVKNRIQDLSDRTAVLRGYLCDYDAKKERLEEVNAELEQPDVWNEPERAQALGKERSTLEEIVTTIDQLEQGLEDVSGLLELAVEADDEETFNETIAELEVLDGKLGQLEFRRMFSGEYDRANCYLDLQAGSGGTEAQDWASMLLRMYLRWAESRGFKTEIIEESDGDVAGLKSATVKIIGEYAFGWLRTETGVHRLVRKSPFDSGGRRHTSFSSAFVYPEVDDDIDIEINPADLRIDVYRASGAGGQHVNKTESAVRITHIPTNIVTQCQNDRSQHKNKDQAMKQLKAKLYEFEMQKKNADKQVLEDNKSDIGWGSQIRSYVLDDSRIKDLRTGVETRNTQAVLDGDLDKFIEASLKAGL

SEQ ID NO: 73925 - DNA, 23 bp, Primer
atgctggaaacagaaacgggccg

SEQ ID NO: 73926 - DNA, 25 bp, Primer
ttatccttcgataaaagccatccct

SEQ ID NO: 73927 - protein, 308 aa, consensus
  MISC_FEATURE (1)..(308): consensus for the disclosure of xaa see table XV
LXXXXXXXXXXXXXXXXXXXXXXXXXXXXXXXXXXXXXLXXXXXDXXXXXLXIXXGAGGTEAXDWXXMLLRMYXRWXXEXXXFXXXILEXXXXXXXXXXXXXGEXAGIKSXTIXIXGXXXXXXXXXAYGXLKXEXGXHRLVRXSPFXSXXRRXTSFXXVXVXPXIDXXDXIXIXIXXXXXXDLRIDXYRASGXGGQXVNXTDSAVRITHIPTGIXVXXQXERSQXXNRXXAMXXLXAKLXXXXXXXXXXXXXXXXXXXXXXXXWGXQIRSYVXXXXXXVKDXRTXXEXXXXXXVLDGXXLDXFIXAXL

SEQ ID NO: 73928 - protein, 32 aa, consensus
  MISC_FEATURE (1)..(32): consensus for the disclosure of xaa see table XV
XXXXXXXXXXXXXGXXXXXXXXXXXXXXXXXX

SEQ ID NO: 73929 - protein, 57 aa, consensus
  MISC_FEATURE (1)..(57): consensus for the disclosure of xaa see table XV
XXXXXXXXXXXXXXXXXXXXXXXXXXXXXGXXXXXXXXXXXXXXXXXXXXXXXXXXX

SEQ ID NO: 73930 - protein, 58 aa, consensus
  MISC_FEATURE (1)..(58): consensus for the disclosure of xaa see table XV
XXXXXXXXXXGXGGQXXNXXXXXXRXXXXXXXXXXXXXXXXXQXXNXXXXXXXXXXXX

SEQ ID NO: 73931 - DNA, 1158 bp, Escherichia coli; identical to SEQ ID NO: 48352
  CDS (1)..(1158)

SEQ ID NO: 73932 - protein, 385 aa, Escherichia coli; identical to SEQ ID NO: 48353

SEQ ID NO: 73933 - DNA, 1557 bp, Mesorhizobium loti MAFF303099; identical to SEQ ID NO: 48354
  CDS (1)..(1557): transl_table=11

SEQ ID NO: 73934 - protein, 518 aa, Mesorhizobium loti MAFF303099; identical to SEQ ID NO: 48355

SEQ ID NO: 73935 - DNA, 1665 bp, Mesorhizobium loti MAFF303099; identical to SEQ ID NO: 48356
  CDS (1)..(1665): transl_table=11

SEQ ID NO: 73936 - protein, 554 aa, Mesorhizobium loti MAFF303099; identical to SEQ ID NO: 48357

SEQ ID NO: 73937 - DNA, 870 bp, Pyrococcus horikoshii OT3; identical to SEQ ID NO: 48358
  CDS (1)..(870): transl_table=11

SEQ ID NO: 73938 - protein, 289 aa, Pyrococcus horikoshii OT3; identical to SEQ ID NO: 48359

SEQ ID NO: 73939 - DNA, 1599 bp, Mycobacterium tuberculosis H37Rv; identical to SEQ ID NO: 48360
  CDS (1)..(1599): transl_table=11

SEQ ID NO: 73940 - protein, 532 aa, Mycobacterium tuberculosis H37Rv; identical to SEQ ID NO: 48361

SEQ ID NO: 73941 - DNA, 1554 bp, Mycobacterium tuberculosis H37Rv; identical to SEQ ID NO: 48362
  CDS (1)..(1554): transl_table=11

SEQ ID NO: 73942 - protein, 517 aa, Mycobacterium tuberculosis H37Rv; identical to SEQ ID NO: 48363

SEQ ID NO: 73943 - DNA, 1245 bp, Rickettsia prowazekii str. Madrid E; identical to SEQ ID NO: 48364
  CDS (1)..(1245): transl_table=11

SEQ ID NO: 73944 - protein, 414 aa, Rickettsia prowazekii str. Madrid E; identical to SEQ ID NO: 48365

SEQ ID NO: 73945 - DNA, 1437 bp, Bacillus halodurans C-125; identical to SEQ ID NO: 48366
  CDS (1)..(1437): transl_table=11

SEQ ID NO: 73946 - protein, 478 aa, Bacillus halodurans C-125; identical to SEQ ID NO: 48367

SEQ ID NO: 73947 - DNA, 1620 bp, Mycobacterium tuberculosis CDC1551; identical to SEQ ID NO: 48368
  CDS (1)..(1620): transl_table=11

SEQ ID NO: 73948 - protein, 539 aa, Mycobacterium tuberculosis CDC1551; identical to SEQ ID NO: 48369

SEQ ID NO: 73949 - DNA, 1116 bp, Mycobacterium tuberculosis CDC1551; identical to SEQ ID NO: 48370
  CDS (1)..(1116): transl_table=11

SEQ ID NO: 73950 - protein, 371 aa, Mycobacterium tuberculosis CDC1551; identical to SEQ ID NO: 48371

SEQ ID NO: 73951 - DNA, 1209 bp, Rickettsia conorii str. Malish 7; identical to SEQ ID NO: 48372
  CDS (1)..(1209): transl_table=11

SEQ ID NO: 73952 - protein, 402 aa, Rickettsia conorii str. Malish 7; identical to SEQ ID NO: 48373

SEQ ID NO: 73953 - DNA, 1497 bp, Staphylococcus aureus subsp. aureus Mu50; identical to SEQ ID NO: 48374
  CDS (1)..(1497): transl_table=11

SEQ ID NO: 73954 - protein, 498 aa, Staphylococcus aureus subsp. aureus Mu50; identical to SEQ ID NO: 48375

SEQ ID NO: 73955 - DNA, 1176 bp, Bacillus subtilis subsp. subtilis str. 168; identical to SEQ ID NO: 48376
  CDS (1)..(1176): transl_table=11

SEQ ID NO: 73956 - protein, 391 aa, Bacillus subtilis subsp. subtilis str. 168; identical to SEQ ID NO: 48377

SEQ ID NO: 73957 - DNA, 1563 bp, Caulobacter crescentus CB15; identical to SEQ ID NO: 48378
  CDS (1)..(1563): transl_table=11

SEQ ID NO: 73958 - protein, 520 aa, Caulobacter crescentus CB15; identical to SEQ ID NO: 48379

SEQ ID NO: 73959 - DNA, 1473 bp, Caulobacter crescentus CB15; identical to SEQ ID NO: 48380
  CDS (1)..(1473): transl_table=11

SEQ ID NO: 73960 - protein, 490 aa, Caulobacter crescentus CB15; identical to SEQ ID NO: 48381

SEQ ID NO: 73961 - DNA, 1611 bp, Caulobacter crescentus CB15; identical to SEQ ID NO: 48382
  CDS (1)..(1611): transl_table=11

SEQ ID NO: 73962 - protein, 536 aa, Caulobacter crescentus CB15; identical to SEQ ID NO: 48383

SEQ ID NO: 73963 - DNA, 1728 bp, Caulobacter crescentus CB15; identical to SEQ ID NO: 48384
  CDS (1)..(1728): transl_table=11

SEQ ID NO: 73964 - protein, 575 aa, Caulobacter crescentus CB15; identical to SEQ ID NO: 48385

SEQ ID NO: 73965 - DNA, 1191 bp, Sinorhizobium meliloti 1021; identical to SEQ ID NO: 48386
  CDS (1)..(1191): transl_table=11

SEQ ID NO: 73966 - protein, 396 aa, Sinorhizobium meliloti 1021; identical to SEQ ID NO: 48387

SEQ ID NO: 73967 - DNA, 1614 bp, Nostoc sp. PCC 7120; identical to SEQ ID NO: 48388
  CDS (1)..(1614): transl_table=11

SEQ ID NO: 73968 - protein, 537 aa, Nostoc sp. PCC 7120; identical to SEQ ID NO: 48389

SEQ ID NO: 73969 - DNA, 2016 bp, Methanosarcina acetivorans C2A; identical to SEQ ID NO: 48390
  CDS (1)..(2016): transl_table=11

SEQ ID NO: 73970 - protein, 671 aa, Methanosarcina acetivorans C2A; identical to SEQ ID NO: 48391

SEQ ID NO: 73971 - DNA, 1323 bp, Xanthomonas campestris pv. campestris str. ATCC 33913; identical to SEQ ID NO: 48392
  CDS (1)..(1323): transl_table=11

SEQ ID NO: 73972 - protein, 440 aa, Xanthomonas campestris pv. campestris str. ATCC 33913; identical to SEQ ID NO: 48393

SEQ ID NO: 73973 - DNA, 1380 bp, Xanthomonas campestris pv. campestris str. ATCC 33913; identical to SEQ ID NO: 48394
  CDS (1)..(1380): transl_table=11

SEQ ID NO: 73974 - protein, 459 aa, Xanthomonas campestris pv. campestris str. ATCC 33913; identical to SEQ ID NO: 48395

SEQ ID NO: 73975 - DNA, 1185 bp, Xanthomonas axonopodis pv. citri str. 306; identical to SEQ ID NO: 48396
  CDS (1)..(1185): transl_table=11

SEQ ID NO: 73976 - protein, 394 aa, Xanthomonas axonopodis pv. citri str. 306; identical to SEQ ID NO: 48397

SEQ ID NO: 73977 - DNA, 1596 bp, Xanthomonas axonopodis pv. citri str. 306; identical to SEQ ID NO: 48398
  CDS (1)..(1596): transl_table=11

SEQ ID NO: 73978 - protein, 531 aa, Xanthomonas axonopodis pv. citri str. 306; identical to SEQ ID NO: 48399

SEQ ID NO: 73979 - DNA, 1371 bp, Xanthomonas axonopodis pv. citri str. 306; identical to SEQ ID NO: 48400
  CDS (1)..(1371): transl_table=11

SEQ ID NO: 73980 - protein, 456 aa, Xanthomonas axonopodis pv. citri str. 306; identical to SEQ ID NO: 48401

SEQ ID NO: 73981 - DNA, 1497 bp, Staphylococcus aureus subsp. aureus MW2; identical to SEQ ID NO: 48402
  CDS (1)..(1497): transl_table=11

SEQ ID NO: 73982 - protein, 498 aa, Staphylococcus aureus subsp. aureus MW2; identical to SEQ ID NO: 48403

SEQ ID NO: 73983 - DNA, 1167 bp, Yersinia pestis KIM; identical to SEQ ID NO: 48404
  CDS (1)..(1167): transl_table=11

SEQ ID NO: 73984 - protein, 388 aa, Yersinia pestis KIM; identical to SEQ ID NO: 48405

SEQ ID NO: 73985 - DNA, 1485 bp, Oceanobacillus iheyensis HTE831; identical to SEQ ID NO: 48406
  CDS (1)..(1485): transl_table=11

SEQ ID NO: 73986 - protein, 494 aa, Oceanobacillus iheyensis HTE831; identical to SEQ ID NO: 48407

SEQ ID NO: 73987 - DNA, 1134 bp, Shigella flexneri 2a str. 301; identical to SEQ ID NO: 48408
  CDS (1)..(1134): transl_table=11

SEQ ID NO: 73988 - protein, 377 aa, Shigella flexneri 2a str. 301; identical to SEQ ID NO: 48409

SEQ ID NO: 73989 - DNA, 1029 bp, Corynebacterium efficiens YS-314; identical to SEQ ID NO: 48410
  CDS (1)..(1029): transl_table=11

SEQ ID NO: 73990 - protein, 342 aa, Corynebacterium efficiens YS-314; identical to SEQ ID NO: 48411

SEQ ID NO: 73991 - DNA, 1143 bp, Pseudomonas putida KT2440; identical to SEQ ID NO: 48412
  CDS (1)..(1143): transl_table=11

SEQ ID NO: 73992 - protein, 380 aa, Pseudomonas putida KT2440; identical to SEQ ID NO: 48413

SEQ ID NO: 73993 - DNA, 1284 bp, Bradyrhizobium japonicum USDA 110; identical to SEQ ID NO: 48414
  CDS (1)..(1284)

SEQ ID NO: 73994 - protein, 427 aa, Bradyrhizobium japonicum USDA 110; identical to SEQ ID NO: 48415

SEQ ID NO: 73995 - DNA, 1158 bp, Salmonella enterica subsp. enterica serovar Typhi Ty2; identical to SEQ ID NO: 48416
  CDS (1)..(1158): transl_table=11

SEQ ID NO: 73996 - protein, 385 aa, Salmonella enterica subsp. enterica serovar Typhi Ty2; identical to SEQ ID NO: 48417

SEQ ID NO: 73997 - DNA, 1887 bp, Mycobacteriophage Omega; identical to SEQ ID NO: 48418
  CDS (1)..(1887): transl_table=11

SEQ ID NO: 73998 - protein, 628 aa, Mycobacteriophage Omega; identical to SEQ ID NO: 48419

SEQ ID NO: 73999 - DNA, 1386 bp, Streptomyces avermitilis MA-4680; identical to SEQ ID NO: 48420
  CDS (1)..(1386)

SEQ ID NO: 74000 - protein, 461 aa, Streptomyces avermitilis MA-4680; identical to SEQ ID NO: 48421

SEQ ID NO: 74001 - DNA, 2088 bp, Bacillus cereus ATCC 14579; identical to SEQ ID NO: 48422
  CDS (1)..(2088): transl_table=11

SEQ ID NO: 74002 - protein, 695 aa, Bacillus cereus ATCC 14579; identical to SEQ ID NO: 48423

SEQ ID NO: 74003 - DNA, 2076 bp, Bacillus anthracis str. Ames; identical to SEQ ID NO: 48424
  CDS (1)..(2076): transl_table=11

SEQ ID NO: 74004 - protein, 691 aa, Bacillus anthracis str. Ames; identical to SEQ ID NO: 48425

SEQ ID NO: 74005 - DNA, 1551 bp, Mycobacterium bovis AF2122/97; identical to SEQ ID NO: 48426
  CDS (1)..(1551): transl_table=11

SEQ ID NO: 74006 - protein, 516 aa, Mycobacterium bovis AF2122/97; identical to SEQ ID NO: 48427

SEQ ID NO: 74007 - DNA, 1170 bp, Rhodopirellula baltica SH 1; identical to SEQ ID NO: 48428
  CDS (1)..(1170): transl_table=11

SEQ ID NO: 74008 - protein, 389 aa, Rhodopirellula baltica SH 1; identical to SEQ ID NO: 48429

SEQ ID NO: 74009 - DNA, 2409 bp, Rhodopirellula baltica SH 1; identical to SEQ ID NO: 48430
  CDS (1)..(2409): transl_table=11

SEQ ID NO: 74010 - protein, 802 aa, Rhodopirellula baltica SH 1; identical to SEQ ID NO: 48431

SEQ ID NO: 74011 - DNA, 1149 bp, Rhodopirellula baltica SH 1; identical to SEQ ID NO: 48432
  CDS (1)..(1149): transl_table=11

SEQ ID NO: 74012 - protein, 382 aa, Rhodopirellula baltica SH 1; identical to SEQ ID NO: 48433

SEQ ID NO: 74013 - DNA, 1317 bp, Chromobacterium violaceum ATCC 12472; identical to SEQ ID NO: 48434
  CDS (1)..(1317): transl_table=11

SEQ ID NO: 74014 - protein, 438 aa, Chromobacterium violaceum ATCC 12472; identical to SEQ ID NO: 48435

SEQ ID NO: 74015 - DNA, 1095 bp, Gloeobacter violaceus PCC 7421; identical to SEQ ID NO: 48436
  CDS (1)..(1095): transl_table=11

SEQ ID NO: 74016 - protein, 364 aa, Gloeobacter violaceus PCC 7421; identical to SEQ ID NO: 48437

SEQ ID NO: 74017 - DNA, 1158 bp, Photorhabdus luminescens subsp. laumondii TTO1; identical to SEQ ID NO: 48438
  CDS (1)..(1158): transl_table=11

SEQ ID NO: 74018 - protein, 385 aa, Photorhabdus luminescens subsp. laumondii TTO1; identical to SEQ ID NO: 48439

SEQ ID NO: 74019 - DNA, 1218 bp, Photorhabdus luminescens subsp. laumondii TTO1; identical to SEQ ID NO: 48440
  CDS (1)..(1218): transl_table=11

SEQ ID NO: 74020 - protein, 405 aa, Photorhabdus luminescens subsp. laumondii TTO1; identical to SEQ ID NO: 48441

SEQ ID NO: 74021 - DNA, 1281 bp, Rhodopseudomonas palustris CGA009; identical to SEQ ID NO: 48442
  CDS (1)..(1281): transl_table=11

SEQ ID NO: 74022 - protein, 426 aa, Rhodopseudomonas palustris CGA009; identical to SEQ ID NO: 48443

SEQ ID NO: 74023 - DNA, 1224 bp, Rhodopseudomonas palustris CGA009; identical to SEQ ID NO: 48444
  CDS (1)..(1224): transl_table=11

SEQ ID NO: 74024 - protein, 407 aa, Rhodopseudomonas palustris CGA009; identical to SEQ ID NO: 48445

SEQ ID NO: 74025 - DNA, 1188 bp, Geobacter sulfurreducens PCA; identical to SEQ ID NO: 48446
  CDS (1)..(1188): transl_table=11

SEQ ID NO: 74026 - protein, 395 aa, Geobacter sulfurreducens PCA; identical to SEQ ID NO: 48447

SEQ ID NO: 74027 - DNA, 1242 bp, Bacillus cereus ATCC 10987; identical to SEQ ID NO: 48448
  CDS (1)..(1242): transl_table=11

SEQ ID NO: 74028 - protein, 413 aa, Bacillus cereus ATCC 10987; identical to SEQ ID NO: 48449

SEQ ID NO: 74029 - DNA, 1449 bp, Bacillus cereus ATCC 10987; identical to SEQ ID NO: 48450
  CDS (1)..(1449): transl_table=11

SEQ ID NO: 74030 - protein, 482 aa, Bacillus cereus ATCC 10987; identical to SEQ ID NO: 48451

SEQ ID NO: 74031 - DNA, 2025 bp, Mus musculus; identical to SEQ ID NO: 48452
  CDS (1)..(2025)

SEQ ID NO: 74032 - protein, 674 aa, Mus musculus; identical to SEQ ID NO: 48453

SEQ ID NO: 74033 - DNA, 1827 bp, Canis familiaris; identical to SEQ ID NO: 48454
  CDS (1)..(1827)

SEQ ID NO: 74034 - protein, 608 aa, Canis familiaris; identical to SEQ ID NO: 48455

SEQ ID NO: 74035 - DNA, 1167 bp, Thermus thermophilus HB27; identical to SEQ ID NO: 48456
  CDS (1)..(1167): transl_table=11

SEQ ID NO: 74036 - protein, 388 aa, Thermus thermophilus HB27; identical to SEQ ID NO: 48457

SEQ ID NO: 74037 - DNA, 1266 bp, Bacillus anthracis str. Sterne; identical to SEQ ID NO: 48458
  CDS (1)..(1266): transl_table=11

SEQ ID NO: 74038 - protein, 421 aa, Bacillus anthracis str. Sterne; identical to SEQ ID NO: 48459

SEQ ID NO: 74039 - DNA, 1449 bp, Bacillus thuringiensis serovar konkukian str. 97-27; identical to SEQ ID NO: 48460
  CDS (1)..(1449): transl_table=11

SEQ ID NO: 74040 - protein, 482 aa, Bacillus thuringiensis serovar konkukian str. 97-27; identical to SEQ ID NO: 48461

SEQ ID NO: 74041 - DNA, 1266 bp, Bacillus thuringiensis serovar konkukian str. 97-27; identical to SEQ ID NO: 48462
  CDS (1)..(1266): transl_table=11

SEQ ID NO: 74042 - protein, 421 aa, Bacillus thuringiensis serovar konkukian str. 97-27; identical to SEQ ID NO: 48463

SEQ ID NO: 74043 - DNA, 1497 bp, Staphylococcus aureus subsp. aureus MSSA476; identical to SEQ ID NO: 48464
  CDS (1)..(1497): transl_table=11

SEQ ID NO: 74044 - protein, 498 aa, Staphylococcus aureus subsp. aureus MSSA476; identical to SEQ ID NO: 48465

SEQ ID NO: 74045 - DNA, 1152 bp, Symbiobacterium thermophilum IAM 14863; identical to SEQ ID NO: 48466
  CDS (1)..(1152): transl_table=11

SEQ ID NO: 74046 - protein, 383 aa, Symbiobacterium thermophilum IAM 14863; identical to SEQ ID NO: 48467

SEQ ID NO: 74047 - DNA, 1137 bp, Symbiobacterium thermophilum IAM 14863; identical to SEQ ID NO: 48468
  CDS (1)..(1137): transl_table=11

SEQ ID NO: 74048 - protein, 378 aa, Symbiobacterium thermophilum IAM 14863; identical to SEQ ID NO: 48469

SEQ ID NO: 74049 - DNA, 2076 bp, Bacillus cereus ZK; identical to SEQ ID NO: 48470
  CDS (1)..(2076): transl_table=11

SEQ ID NO: 74050 - protein, 691 aa, Bacillus cereus ZK; identical to SEQ ID NO: 48471

SEQ ID NO: 74051 - DNA, 1224 bp, Legionella pneumophila subsp. pneumophila str. Philadelphia 1; identical to SEQ ID NO: 48472
  CDS (1)..(1224): transl_table=11

SEQ ID NO: 74052 - protein, 407 aa, Legionella pneumophila subsp. pneumophila str. Philadelphia 1; identical to SEQ ID NO: 48473

SEQ ID NO: 74053 - DNA, 1884 bp, Bacteroides fragilis YCH46; identical to SEQ ID NO: 48474
  CDS (1)..(1884): transl_table=11

SEQ ID NO: 74054 - protein, 627 aa, Bacteroides fragilis YCH46; identical to SEQ ID NO: 48475

SEQ ID NO: 74055 - DNA, 1638 bp, Nocardia farcinica IFM 10152; identical to SEQ ID NO: 48476
  CDS (1)..(1638): transl_table=11

SEQ ID NO: 74056 - protein, 545 aa, Nocardia farcinica IFM 10152; identical to SEQ ID NO: 48477

SEQ ID NO: 74057 - DNA, 1080 bp, Legionella pneumophila str. Lens; identical to SEQ ID NO: 48478
  CDS (1)..(1080): transl_table=11

SEQ ID NO: 74058 - protein, 359 aa, Legionella pneumophila str. Lens; identical to SEQ ID NO: 48479

SEQ ID NO: 74059 - DNA, 1689 bp, Xanthomonas oryzae pv. oryzae KACC10331; identical to SEQ ID NO: 48480
  CDS (1)..(1689): transl_table=11

SEQ ID NO: 74060 - protein, 562 aa, Xanthomonas oryzae pv. oryzae KACC10331; identical to SEQ ID NO: 48481

SEQ ID NO: 74061 - DNA, 1467 bp, Xanthomonas oryzae pv. oryzae KACC10331; identical to SEQ ID NO: 48482
  CDS (1)..(1467): transl_table=11

SEQ ID NO: 74062 - protein, 488 aa, Xanthomonas oryzae pv. oryzae KACC10331; identical to SEQ ID NO: 48483

SEQ ID NO: 74063 - DNA, 1230 bp, Salmonella enterica subsp. enterica serovar Choleraesuis; identical to SEQ ID NO: 48484
  CDS (1)..(1230): transl_table=11

SEQ ID NO: 74064 - protein, 409 aa, Salmonella enterica subsp. enterica serovar Choleraesuis; identical to SEQ ID NO: 48485

SEQ ID NO: 74065 - DNA, 1143 bp, Rhodobacter sphaeroides 2.4.1; identical to SEQ ID NO: 48486
  CDS (1)..(1143)

SEQ ID NO: 74066 - protein, 380 aa, Rhodobacter sphaeroides 2.4.1; identical to SEQ ID NO: 48487

SEQ ID NO: 74067 - DNA, 1071 bp, Nostoc punctiforme PCC 73102; identical to SEQ ID NO: 48488
  CDS (1)..(1071)

SEQ ID NO: 74068 - protein, 356 aa, Nostoc punctiforme PCC 73102; identical to SEQ ID NO: 48489

SEQ ID NO: 74069 - DNA, 1194 bp, Pseudomonas aeruginosa UCBPP-PA14; identical to SEQ ID NO: 48490
  CDS (1)..(1194)

SEQ ID NO: 74070 - protein, 397 aa, Pseudomonas aeruginosa UCBPP-PA14; identical to SEQ ID NO: 48491

SEQ ID NO: 74071 - DNA, 1182 bp, Rickettsia sibirica 246; identical to SEQ ID NO: 48492
  CDS (1)..(1182): transl_table=11

SEQ ID NO: 74072 - protein, 393 aa, Rickettsia sibirica 246; identical to SEQ ID NO: 48493

SEQ ID NO: 74073 - DNA, 1614 bp, Anabaena variabilis ATCC 29413; identical to SEQ ID NO: 48494
  CDS (1)..(1614)

SEQ ID NO: 74074 - protein, 537 aa, Anabaena variabilis ATCC 29413; identical to SEQ ID NO: 48495

SEQ ID NO: 74075 - DNA, 1233 bp, Ralstonia eutropha JMP134; identical to SEQ ID NO: 48496
  CDS (1)..(1233)

SEQ ID NO: 74076 - protein, 410 aa, Ralstonia eutropha JMP134; identical to SEQ ID NO: 48497

SEQ ID NO: 74077 - DNA, 1575 bp, Rubrobacter xylanophilus DSM 9941; identical to SEQ ID NO: 48498
  CDS (1)..(1575)

SEQ ID NO: 74078 - protein, 524 aa, Rubrobacter xylanophilus DSM 9941; identical to SEQ ID NO: 48499

SEQ ID NO: 74079 - DNA, 1170 bp, Burkholderia cepacia R18194; identical to SEQ ID NO: 48500
  CDS (1)..(1170)

SEQ ID NO: 74080 - protein, 389 aa, Burkholderia cepacia R18194; identical to SEQ ID NO: 48501

SEQ ID NO: 74081 - DNA, 1008 bp, Listeria monocytogenes str. 1/2a F6854; identical to SEQ ID NO: 48502
  CDS (1)..(1008): transl_table=11

SEQ ID NO: 74082 - protein, 335 aa, Listeria monocytogenes str. 1/2a F6854; identical to SEQ ID NO: 48503

SEQ ID NO: 74083 - DNA, 1242 bp, Bacillus cereus G9241; identical to SEQ ID NO: 48504
  CDS (1)..(1242): transl_table=11

SEQ ID NO: 74084 - protein, 413 aa, Bacillus cereus G9241; identical to SEQ ID NO: 48505

SEQ ID NO: 74085 - DNA, 1440 bp, Rubrivivax gelatinosus PM1; identical to SEQ ID NO: 48506
  CDS (1)..(1440)

SEQ ID NO: 74086 - protein, 479 aa, Rubrivivax gelatinosus PM1; identical to SEQ ID NO: 48507

SEQ ID NO: 74087 - DNA, 1188 bp, Rubrivivax gelatinosus PM1; identical to SEQ ID NO: 48508
  CDS (1)..(1188)

SEQ ID NO: 74088 - protein, 395 aa, Rubrivivax gelatinosus PM1; identical to SEQ ID NO: 48509

SEQ ID NO: 74089 - DNA, 1233 bp, Ralstonia metallidurans CH34; identical to SEQ ID NO: 48510
  CDS (1)..(1233)

SEQ ID NO: 74090 - protein, 410 aa, Ralstonia metallidurans CH34; identical to SEQ ID NO: 48511

SEQ ID NO: 74091 - DNA, 1176 bp, Burkholderia fungorum LB400; identical to SEQ ID NO: 48512
  CDS (1)..(1176)

SEQ ID NO: 74092 - protein, 391 aa, Burkholderia fungorum LB400; identical to SEQ ID NO: 48513

SEQ ID NO: 74093 - DNA, 1767 bp, Geobacter metallireducens GS-15; identical to SEQ ID NO: 48514
  CDS (1)..(1767)

SEQ ID NO: 74094 - protein, 588 aa, Geobacter metallireducens GS-15; identical to SEQ ID NO: 48515

SEQ ID NO: 74095 - DNA, 1296 bp, Trichodesmium erythraeum IMS101; identical to SEQ ID NO: 48516
  CDS (1)..(1296)

SEQ ID NO: 74096 - protein, 431 aa, Trichodesmium erythraeum IMS101; identical to SEQ ID NO: 48517

SEQ ID NO: 74097 - DNA, 1194 bp, Rickettsia akari str. Hartford; identical to SEQ ID NO: 48518
  CDS (1)..(1194)

SEQ ID NO: 74098 - protein, 397 aa, Rickettsia akari str. Hartford; identical to SEQ ID NO: 48519

SEQ ID NO: 74099 - DNA, 1179 bp, Chloroflexus aurantiacus; identical to SEQ ID NO: 48520
  CDS (1)..(1179)

SEQ ID NO: 74100 - protein, 392 aa, Chloroflexus aurantiacus; identical to SEQ ID NO: 48521

SEQ ID NO: 74101 - DNA, 1137 bp, Serratia marcescens; identical to SEQ ID NO: 48522
  CDS (1)..(1137): transl_table=11

SEQ ID NO: 74102 - protein, 378 aa, Serratia marcescens; identical to SEQ ID NO: 48523

SEQ ID NO: 74103 - DNA, 1137 bp, Serratia marcescens; identical to SEQ ID NO: 48524
  CDS (1)..(1137): transl_table=11

SEQ ID NO: 74104 - protein, 378 aa, Serratia marcescens; identical to SEQ ID NO: 48525

SEQ ID NO: 74105 - DNA, 1146 bp, Escherichia coli; identical to SEQ ID NO: 48526
  CDS (1)..(1146): transl_table=11

SEQ ID NO: 74106 - protein, 381 aa, Escherichia coli; identical to SEQ ID NO: 48527

SEQ ID NO: 74107 - DNA, 1140 bp, Salmonella enteritidis; identical to SEQ ID NO: 48528
  CDS (1)..(1140): transl_table=11

SEQ ID NO: 74108 - protein, 379 aa, Salmonella enteritidis; identical to SEQ ID NO: 48529

SEQ ID NO: 74109 - DNA, 1146 bp, Enterobacter cloacae; identical to SEQ ID NO: 48530
  CDS (1)..(1146): transl_table=11

SEQ ID NO: 74110 - protein, 381 aa, Enterobacter cloacae; identical to SEQ ID NO: 48531

SEQ ID NO: 74111 - DNA, 1146 bp, Enterobacter cloacae; identical to SEQ ID NO: 48532
  CDS (1)..(1146): transl_table=11

SEQ ID NO: 74112 - protein, 381 aa, Enterobacter cloacae; identical to SEQ ID NO: 48533

SEQ ID NO: 74113 - DNA, 1146 bp, Citrobacter freundii; identical to SEQ ID NO: 48534
  CDS (1)..(1146): transl_table=11

SEQ ID NO: 74114 - protein, 381 aa, Citrobacter freundii; identical to SEQ ID NO: 48535

SEQ ID NO: 74115 - DNA, 1146 bp, Klebsiella pneumoniae; identical to SEQ ID NO: 48536
  CDS (1)..(1146): transl_table=11

SEQ ID NO: 74116 - protein, 381 aa, Klebsiella pneumoniae; identical to SEQ ID NO: 48537

SEQ ID NO: 74117 - DNA, 1146 bp, Klebsiella pneumoniae; identical to SEQ ID NO: 48538
  CDS (1)..(1146)

SEQ ID NO: 74118 - protein, 381 aa, Klebsiella pneumoniae; identical to SEQ ID NO: 48539

SEQ ID NO: 74119 - DNA, 1146 bp, Klebsiella pneumoniae; identical to SEQ ID NO: 48540
  CDS (1)..(1146): transl_table=11

SEQ ID NO: 74120 - protein, 381 aa, Klebsiella pneumoniae; identical to SEQ ID NO: 48541

SEQ ID NO: 74121 - DNA, 1146 bp, Escherichia coli; identical to SEQ ID NO: 48542
  CDS (1)..(1146): transl_table=11

SEQ ID NO: 74122 - protein, 381 aa, Escherichia coli; identical to SEQ ID NO: 48543

SEQ ID NO: 74123 - DNA, 1134 bp, Escherichia coli; identical to SEQ ID NO: 48544
  CDS (1)..(1134): transl_table=11

SEQ ID NO: 74124 - protein, 377 aa, Escherichia coli; identical to SEQ ID NO: 48545

SEQ ID NO: 74125 - DNA, 1137 bp, Serratia marcescens; identical to SEQ ID NO: 48546
  CDS (1)..(1137): transl_table=11

SEQ ID NO: 74126 - protein, 378 aa, Serratia marcescens; identical to SEQ ID NO: 48547

SEQ ID NO: 74127 - DNA, 1146 bp, Enterobacter cloacae; identical to SEQ ID NO: 48548
  CDS (1)..(1146): transl_table=11

SEQ ID NO: 74128 - protein, 381 aa, Enterobacter cloacae; identical to SEQ ID NO: 48549

SEQ ID NO: 74129 - DNA, 1140 bp, Morganella morganii subsp; identical to SEQ ID NO: 48550
  CDS (1)..(1140): transl_table=11

SEQ ID NO: 74130 - protein, 379 aa, Morganella morganii subsp; identical to SEQ ID NO: 48551

SEQ ID NO: 74131 - DNA, 1146 bp, Escherichia coli; identical to SEQ ID NO: 48552
  CDS (1)..(1146): transl_table=11

SEQ ID NO: 74132 - protein, 381 aa, Escherichia coli; identical to SEQ ID NO: 48553

SEQ ID NO: 74133 - DNA, 1146 bp, Enterobacter cloacae; identical to SEQ ID NO: 48554
  CDS (1)..(1146): transl_table=11

SEQ ID NO: 74134 - protein, 381 aa, Enterobacter cloacae; identical to SEQ ID NO: 48555

SEQ ID NO: 74135 - DNA, 1146 bp, Enterobacter aerogenes; identical to SEQ ID NO: 48556
  CDS (1)..(1146): transl_table=11

SEQ ID NO: 74136 - protein, 381 aa, Enterobacter aerogenes; identical to SEQ ID NO: 48557

SEQ ID NO: 74137 - DNA, 1146 bp, Enterobacter aerogenes; identical to SEQ ID NO: 48558
  CDS (1)..(1146): transl_table=11

SEQ ID NO: 74138 - protein, 381 aa, Enterobacter aerogenes; identical to SEQ ID NO: 48559

SEQ ID NO: 74139 - DNA, 1146 bp, Enterobacter aerogenes; identical to SEQ ID NO: 48560
  CDS (1)..(1146): transl_table=11

SEQ ID NO: 74140 - protein, 381 aa, Enterobacter aerogenes; identical to SEQ ID NO: 48561

SEQ ID NO: 74141 - DNA, 1146 bp, Enterobacter aerogenes; identical to SEQ ID NO: 48562
  CDS (1)..(1146): transl_table=11

SEQ ID NO: 74142 - protein, 381 aa, Enterobacter aerogenes; identical to SEQ ID NO: 48563

SEQ ID NO: 74143 - DNA, 1146 bp, Citrobacter freundii; identical to SEQ ID NO: 48564
  CDS (1)..(1146): transl_table=11

SEQ ID NO: 74144 - protein, 381 aa, Citrobacter freundii; identical to SEQ ID NO: 48565

SEQ ID NO: 74145 - DNA, 1194 bp, Pseudomonas aeruginosa; identical to SEQ ID NO: 48566
  CDS (1)..(1194): transl_table=11

SEQ ID NO: 74146 - protein, 397 aa, Pseudomonas aeruginosa; identical to SEQ ID NO: 48567

SEQ ID NO: 74147 - DNA, 1146 bp, Citrobacter braakii; identical to SEQ ID NO: 48568
  CDS (1)..(1146): transl_table=11

SEQ ID NO: 74148 - protein, 381 aa, Citrobacter braakii; identical to SEQ ID NO: 48569

SEQ ID NO: 74149 - DNA, 1146 bp, Citrobacter murliniae; identical to SEQ ID NO: 48570
  CDS (1)..(1146): transl_table=11

SEQ ID NO: 74150 - protein, 381 aa, Citrobacter murliniae; identical to SEQ ID NO: 48571

SEQ ID NO: 74151 - DNA, 1146 bp, Enterobacter asburiae; identical to SEQ ID NO: 48572
  CDS (1)..(1146): transl_table=11

SEQ ID NO: 74152 - protein, 381 aa, Enterobacter asburiae; identical to SEQ ID NO: 48573

SEQ ID NO: 74153 - DNA, 1152 bp, Buttiauxella sp; identical to SEQ ID NO: 48574
  CDS (1)..(1152): transl_table=11

SEQ ID NO: 74154 - protein, 383 aa, Buttiauxella sp; identical to SEQ ID NO: 48575

SEQ ID NO: 74155 - DNA, 1803 bp, Neurospora crassa; identical to SEQ ID NO: 48576
  CDS (1)..(1803)

SEQ ID NO: 74156 - protein, 600 aa, Neurospora crassa; identical to SEQ ID NO: 48577

SEQ ID NO: 74157 - DNA, 1146 bp, Citrobacter freundii; identical to SEQ ID NO: 48578
  CDS (1)..(1146): transl_table=11

SEQ ID NO: 74158 - protein, 381 aa, Citrobacter freundii; identical to SEQ ID NO: 48579

SEQ ID NO: 74159 - DNA, 1137 bp, Serratia marcescens; identical to SEQ ID NO: 48580
  CDS (1)..(1137): transl_table=11

SEQ ID NO: 74160 - protein, 378 aa, Serratia marcescens; identical to SEQ ID NO: 48581

SEQ ID NO: 74161 - DNA, 1140 bp, Klebsiella pneumoniae; identical to SEQ ID NO: 48582
  CDS (1)..(1140): transl_table=11

SEQ ID NO: 74162 - protein, 379 aa, Klebsiella pneumoniae; identical to SEQ ID NO: 48583

SEQ ID NO: 74163 - DNA, 1128 bp, Enterobacter cloacae; identical to SEQ ID NO: 48584
  CDS (1)..(1128): transl_table=11

SEQ ID NO: 74164 - protein, 375 aa, Enterobacter cloacae; identical to SEQ ID NO: 48585

SEQ ID NO: 74165 - DNA, 1137 bp, Serratia marcescens; identical to SEQ ID NO: 48586
  CDS (1)..(1137): transl_table=11

SEQ ID NO: 74166 - protein, 378 aa, Serratia marcescens; identical to SEQ ID NO: 48587

SEQ ID NO: 74167 - DNA, 1146 bp, Escherichia coli; identical to SEQ ID NO: 48588
  CDS (1)..(1146): transl_table=11

SEQ ID NO: 74168 - protein, 381 aa, Escherichia coli; identical to SEQ ID NO: 48589

SEQ ID NO: 74169 - DNA, 1134 bp, Escherichia coli; identical to SEQ ID NO: 48590
  CDS (1)..(1134): transl_table=11

SEQ ID NO: 74170 - protein, 377 aa, Escherichia coli; identical to SEQ ID NO: 48591

SEQ ID NO: 74171 - DNA, 1134 bp, Escherichia coli; identical to SEQ ID NO: 48592
  CDS (1)..(1134): transl_table=11

SEQ ID NO: 74172 - protein, 377 aa, Escherichia coli; identical to SEQ ID NO: 48593

SEQ ID NO: 74173 - DNA, 1146 bp, Klebsiella pneumoniae; identical to SEQ ID NO: 48594
  CDS (1)..(1146): transl_table=11

SEQ ID NO: 74174 - protein, 381 aa, Klebsiella pneumoniae; identical to SEQ ID NO: 48595

SEQ ID NO: 74175 - DNA, 1146 bp, Klebsiella oxytoca; identical to SEQ ID NO: 48596
  CDS (1)..(1146): transl_table=11

SEQ ID NO: 74176 - protein, 381 aa, Klebsiella oxytoca; identical to SEQ ID NO: 48597

SEQ ID NO: 74177 - DNA, 1146 bp, Citrobacter freundii; identical to SEQ ID NO: 48598
  CDS (1)..(1146): transl_table=11

SEQ ID NO: 74178 - protein, 381 aa, Citrobacter freundii; identical to SEQ ID NO: 48599

SEQ ID NO: 74179 - DNA, 1140 bp, Morganella morganii; identical to SEQ ID NO: 48600
  CDS (1)..(1140): transl_table=11

SEQ ID NO: 74180 - protein, 379 aa, Morganella morganii [sequence omitted]

SEQ ID NO: 74181 - DNA, 1194 bp, Pseudomonas aeruginosa; identical to SEQ ID NO: 48602
  CDS (1)..(1194): transl_table=11

SEQ ID NO: 74182 - protein, 397 aa, Pseudomonas aeruginosa; identical to SEQ ID NO: 48603

SEQ ID NO: 74183 - DNA, 1167 bp, Yersinia enterocolitica; identical to SEQ ID NO: 48604
  CDS (1)..(1167): transl_table=11

SEQ ID NO: 74184 - protein, 388 aa, Yersinia enterocolitica; identical to SEQ ID NO: 48605

SEQ ID NO: 74185 - DNA, 26 bp, Primer
atgaaacgtagtctgcttttttctgc

SEQ ID NO: 74186 - DNA, 23 bp, Primer
ttaggacgcggggataaccaacg

SEQ ID NO: 74187 - protein, 266 aa, consensus; identical to SEQ ID NO: 48608
  MISC_FEATURE (1)..(266): consensus for the disclosure of xaa see table XV

SEQ ID NO: 74188 - protein, 84 aa, consensus; identical to SEQ ID NO: 48609
  MISC_FEATURE (1)..(84): consensus for the disclosure of xaa see table XV

SEQ ID NO: 74189 - protein, 109 aa, consensus; identical to SEQ ID NO: 48610
  MISC_FEATURE (1)..(109): consensus for the disclosure of xaa see table XV

SEQ ID NO: 74190 - DNA, 6039 bp, Escherichia coli
  CDS (2312)..(5461)
agatctttttgtttatttagtgagtcaagttgcgcctgcaggtccgcttttgtcggcagatcaccattcgatgacgcccgcgcaaacgccgtgttctggcataacaagacaaaaacaaaagcaataaatgctgaaaaaacaaaatgccgtgatcgtttgtaatactggaacatagtcatgatgaatgaaggtttctgaacctgaagaacgacctgaaaaagtcaaaccgcaagaatatcacgacgcagtgaaccagaatagcaacgacgaaaatgtccaggaaaaatcctggagtcagattcagggttattcgttagtggcaggattacgaagcgtggggcacaggagatacatctccagtaagatggcaacgtaatcgcgggcttcttttttaagatcaaaagattgcggggcaaagagccagttttccatcaggccggaaatatagccgcgcataataattgctgcgcgacgcgtcattaaatccgcaggcaacattttcgcttcaatacaatgttttaacgtttgttctatacggtcataactttccagacagagattacgttgtgcctgttgcacaacagccatttctccgacaaattcgcatttgtggaatataatctccatcaataatcgacgccgttcttctgtcaccgtggattcaagaacatgaattaatatctctcttaatactgagagtggatcgccagggaattttgcctgatactcaagctctagttcaccaatattggattctgacagttcccagatctcactgaacaaatccgacttgtctttaaaatgccagtagattgcaccgcgcgtaacgccagctgcttttgcaatctcgcccagcgaggtggatgataccccctgctgtgagaaaagacgtagagccacatcgaggatgtgttggcgcgtttcttgcgcttcttgtttggtttttcgtgccatatgttcgtgaatttacaggcgttagatttacatacatttgtgaatgtatgtaccatagcacgacgataatataaacgcagcaatgggtttattaacttttgaccattgaccaatttgaaatcggacactcgaggtttacatatgaacaaaaacagagggtttacgcctctggcggtcgttctgatgctctcaggcagcttagccctaacaggatgtgacgacaaacaggcccaacaaggtggccagcagatgcccgccgttggcgtagtaacagtcaaaactgaacctctgcagatcacaaccgagcttccgggtcgcaccagtgcctaccggatcgcagaagttcgtcctcaagttagcgggattatcctgaagcgtaatttcaaagaaggtagcgacatcgaagcaggtgtctctctctatcagattgatcctgcgacctatcaggcgacatacgacagtgcgaaaggtgatctggcgaaagcccaggctgcagccaatatcgcgcaattgacggtgaatcgttatcagaaactgctcggtactcagtacatcagtaagcaagagtacgatcaggctctggctgatgcgcaacaggcgaatgctgcggtaactgcggcgaaagctgccgttgaaactgcgcggatcaatctggcttacaccaaagtcacctctccgattagcggtcgcattggtaagtcgaacgtgacggaaggcgcattggtacagaacggtcaggcgactgcgctggcaaccgtgcagcaacttgatccgatctacgttgatgtgacccagtccagcaacgacttcctgcgcctgaaacaggaactggcgaatggcacgctgaaacaagagaacggcaaagccaaagtgtcactgatcaccagtgacggcattaagttcccgcaggacggtacgctggaattctctgacgttaccgttgatcagaccactgggtctatcaccctacgcgctatcttcccgaacccggatcacactctgctgccgggtatgttcgtgcgcgcacgtctggaagaagggcttaatccaaacgctattttagtcccgcaacagggcgtaacccgtacgccgcgtggcgatgccaccgtactggtagttggcgcggatgacaaagtggaaacccgtccgatcgttgcaagccaggctattggcgataagtggctggtgacagaaggtctgaaagcaggcgatcgcgtagtaataagtgggctgcagaaagtgcgtcctggtgtccaggtaaaagcacaagaagttaccgctgataataaccagcaagccgcaagcggtgctcagcctgaacagtccaagtcttaacttaaacaggagccgttaagacatgcctaatttctttatcgatcgcccgatttttgcgtgggtgatcgccattatcatcatgttggcaggggggctggcgatcctcaaactgccggtggcgcaatatcctacgattgcaccgccggcagtaacgatctccgcctcctaccccggcgctgatgcgaaaacagtgcaggacacggtgacacaggttatcgaacagaatatgaacggtatcgataacctgatgtacatgtcctctaacagtgactccacgggtaccgtgcagatcaccctgacctttgagtctggtactgatgcggatatcgcgcaggttcaggtgcagaacaaactgcagctggcgatgccgttgctgccgcaagaagttcagcagcaaggggtgagcgttgagaaatcatccagcagcttcctgatggttgtcggcgttatcaacaccgatggcaccatgacgcaggaggatatctccgactacgtggcggcgaatatgaaagatgccatcagccgtacgtcgggcgtgggtgatgttcagttgttcggttcacagtacgcgatgcgtatctggatgaacccgaatgagctgaacaaattccagctaacgccggttgatgtcattaccgccatcaaagcgcagaacgcccaggttgcggcgggtcagctcggtggtacgccgccggtgaaaggccaacagcttaacgcctctattattgctcagacgcgtctgacctctactgaagagttcggcaaaatcctgctgaaagtgaatcaggatggttcccgcgtgctgctgcgtgacgtcgcgaagattgagctgggtggtgagaactacgacatcatcgcagagtttaacggccaaccggcttccggtctggggatcaagctggcgaccggtgcaaacgcgctggataccgctgcggcaatccgtgctgaactggcgaagatggaaccgttcttcccgtcgggtctgaaaattgtttacccatacgacaccacgccgttcgtgaaaatctctattcacgaagtggttaaaacgctggtcgaagcgatcatcctcgtgttcctggttatgtatctgttcctgcagaacttccgcgcgacgttgattccgaccattgccgtaccggtggtattgctcgggacctttgccgtccttgccgcctttggcttctcgataaacacgctaacaatgttcgggatggtgctcgccatcggcctgttggtggatgacgccatcgttgtggtagaaaacgttgagcgtgttatggcggaagaaggtttgccgccaaaagaagctacccgtaagtcgatggggcagattcagggcgctctggtcggtatcgcgatggtactgtcggcggtattcgtaccgatggccttctttggcggttctactggtgctatctatcgtcagttctctattaccattgtttcagcaatggcgctgtcggtactggtggcgttgatcctgactccagctctttgtgccaccatgctgaaaccgattgccaaaggcgatcacggggaaggtaaaaaaggcttcttcggctggtttaaccgcatgttcgagaagagcacgcaccactacaccgacagcgtaggcggtattctgcgcagtacggggcgttacctggtgctgtatctgatcatcgtggtcggcatggcctatctgttcgtgcgtctgccaagctccttcttgccagatgaggaccagggcgtgtttatgaccatggttcagctgccagcaggtgcaacgcaggaacgtacacagaaagtgctcaatgaggtaacgcattactatctgaccaaagaaaagaacaacgttgagtcggtgttcgccgttaacggcttcggctttgcgggacgtggtcagaataccggtattgcgttcgtttccttgaaggactgggccgatcgtccgggcgaagaaaacaaagttgaagcgattaccatgcgtgcaacacgcgctttctcgcaaatcaaagatgcgatggttttcgcctttaacctgcccgcaatcgtggaactgggtactgcaaccggctttgactttgagctgattgaccaggctggccttggtcacgaaaaactgactcaggcgcgtaaccagttgcttgcagaagcagcgaagcaccctgatatgttgaccagcgtacgtccaaacggtctggaagataccccgcagtttaagattgatatcgaccaggaaaaagcgcaggcgctgggtgtttctatcaacgacattaacaccactctgggcgctgcatggggcggcagctatgtgaacgactttatcgaccgcggtcgtgtgaagaaagtttatgtcatgtcagaagcgaaataccgtatgctgccggatgatatcggcgactggtatgttcgtgctgctgatggtcagatggtgccattctcggcgttctcctcttctcgttgggagtacggttcgccgcgtctggaacgttacaacggcctgccatccatggaaatcttaggccaggcggcaccgggtaaaagtaccggtgaagcaatggagctgatggaacaactggcgagcaaactgcctaccggtgttggctatgactggacggggatgtcctatcaggaacgtctctccggcaaccaggcaccttcactgtacgcgatttcgttgattgtcgtgttcctgtgtctggcggcgctgtacgagagctggtcgattccgttctccgttatgctggtcgttccgctgggggttatcggtgcgttgctggctgccaccttccgtggcctgaccaatgacgtttacttccaggtaggcctgctcacaaccattgggttgtcggcgaagaacgcgatccttatcgtcgaattcgccaaagacttgatggataaagaaggtaaaggtctgattgaagcgacgcttgatgcggtgcggatgcgtttacgtccgatcctgatgacctcgctggcgtttatcctcggcgttatgccgctggttatcagtactggtgctggttccggcgcgcagaacgcagtaggtaccggtgtaatgggcgggatggtgaccgcaacggtactggcaatcttcttcgttccggtattctttgtggtggttcgccgccgctttagccgcaagaatgaagatatcgagcacagccatactgtcgatcatcattgatacaacgtgtaatcactaaggccgcgtaagcggccttttttatgcataacctacgaacattaaggagtaattgaaccaccaactcaggatctcatacgaaaaccagtattaaccacggataaaattcataaaaaatactgattgttagttaatttatattaagtagcgctaatagatttaataatccataatcatttagaggctattcttaattatttgcggtaattctttattcattcctcggttattacgtcatattcagagcaatcctggtattagtgtcaccaatttcatctggcgataatcctgaaatgttatgaatagttcgagcaaactgcttttacctgctgcgggttagtgctagtatgaaaaagtgagtcctgtcccgcttccttcctaattgtaatttttcgtaataatgcgatgaaaacctgcaaagagtggcttatagttaagctaacaaacgagagggcaagtccaggtcagtaagttttttccatcccgaaaggtgtccgttagttcaaccgctaagaaggggacgcgttatggatgaatactcacccaaaagacatgatatc

SEQ ID NO: 74191 - protein, 1049 aa, Escherichia coli [sequence omitted]

SEQ ID NO: 74192 - DNA, 3084 bp, Mesorhizobium loti MAFF303099
  CDS (1)..(3084): transl_table=11
atgagcttctccgatctcttcattcgccggcccgtcctgtcgacggtccttggctgcctgatcctgctcctgggtttccagggcatcttcaacctgtcgatccggcagtatccgaaggttgacgaaaccgcgatcaccatcacgacggcctatccaggcgccagcgccgacctgatccagggcttcatttccgccccgatcgcgcgcgccgtcgcctcgaccgagaacatcgactacgtcacctcgtccagccgtccgtcctccagcaccgtgacggtgcagatgaagcttggctccaaccccgacgtggcgctgaccgaagtgctgtccaaggtccagggcgtgcgcggcaccttgccggacgcctccaaggatccggtcatcgtcaagggcaccggccagcagttcgcgatgatgtacatctcgatgcagaatccgaacatgacgaaggagcagctgaccgaatatatcgagcgcgtcatccggccccgcatgtcgacggtcgaaggtgtcgccgacgtgcagatcttcggcgcccaggaatactcgatgcgcgtctggatagatccgatcaggcttgcagcgcgcggcgtgacggcggcggaagtgctgacggcgatcaacaattccaacttcctgtcggcgcccggcaatacccagaacgaatatgtcgtctcgtcgatcagcgtgcgctcgacgctgcagacaccggaagccttcgccgaactgcccctgcgctcgaccgacggcaatgtggtgcggctgcgcgacgtcgcccgcgtcgaactcggcgccgccaacaccgataccagggtcagcttcaacggcaagcctggtaccttcctggccatcttcccgaccccggcagccaacccgctgactacggcggcagcgctcaccaagcttgtgccgcagatccaggaaacgctgccgaaaggcatgacgatcgaggtcgtctacgacgcgaccgggcagatcagcgcctcgatcgaggaggtgttcaagaccatcggcgaggcggttgccatcgtcgtcgtggtcatcctcctgttccttggctcgttccgttcggtgatgatgccgatcatcaccattccgctgtcgttgatcggcgtctgcttcctgttgtttgcggtgggctattcgatcaaccttctgtcgctgctggccatggtgctggcgatcggtcttgtggtcgatgacgccatcgtggtggtggagaacatccaccgccacatggaagaagaccacatgacgcccatgcaggccgcgttcagcggtatgcgcgaaatcgcgtcggccattgtcgccatgaccatgacgctggccgccgtgttcgcgccgctggccttcaccggcggcctgaccggcgcgctgttccgcgaattcgcggtgacgctcgccggctcggtcgtgctgtcgggcgtcatcgccgtcaccatcaccccgatgatgtcggcgcgcctgttgaaggccggcacgccaggccgtttccagcgcattgtcgacggcattttcgcgcgggtcgagcacgtctatgagcgtgccgtcaccggttcgctgaactatcgtcctttgacgctgatcatcgtgctggcgctcgtcggcgtgaccggcttcatgttcaccaagacctcgagcgagctggcgccggaagaggatcagggcttcctgctctcgctcgtgaccgcaccgacctatgcgacatcggattacaccgaaacctatgtgaaccagatgctcggcctggtgagggatattccggaaacccgggcacaattctcggcggtcgccttcggcggcacgacgaacagcgccttcgtcggttttgccttcaaggattgggcggagcgcaagcgcaattccaaggaactgcaggccgacatcacggctcgtctcgccaaggtggcgggcgtgcaggccttcgtcttcgcaccgccgacgctgccgggctccggtggcggcctgccgatcgccctggtggtgcgctcgaccggcgattccgcggaagtgtacaaggcggccgagcagatcaagaacaaggcccaggcctccggccgtttcatcgtcgtgcagaactcgatgtcttatgactcgccgcaagtgacggtgaccatcgaccgcgaccgcgccgccgcgctcaacctgccgatcgccgatatcggccgcacgctgacgctgctggtcggcggcgccgaagtggcgcagttcgaccgcgactccaacagctacgacatcatcccccaggtgccgcagcagttccgcgacaaccccgaaaggctcggcgagtatttcgtgcgcagcgtcacgggcgagatggtaccgctgtcggccgtggtgaatatctccaacaatgcctcgccggcggcgatcgaacagttcaatcagctgaattcgtcgaccatctcggcgctgccgctgcccggcgtcaccactggcgacgggttgaaggtcctcgaggatatcgccagggagagcctgcccgacaccttcttcatcgactattccggccagtcccggcaggagaaggaacagggcaacaccatcctgatcgctttcgcagcggccgtcattgtcatctacctggtgctggcggcgcagtttgaaagcttccgcgacccgctgatcatcatgatggcggtgccgctgtcgatcttcggcgcgatcgtgccgctcaatctcggcctcggcacgctcaacatctacacgcaggtcggtctgatcacgctgatcggcctgatcaccaagcacggcatcctgctggtcgaattcgccaaccagcagcgcgaggcgcatggcatgcggcggcgcgacgccatcatcgcctcggccaaggtgcgcctgcggccgatcctgatgacgacggcggcgatggcgctgggcgtcgtaccgctgatcacatcgagcggcgccggtgcggcggcccgctattcgatgggcctggtcatcttcaccggcattctcgtcggcaccatgttcacgctcttcgtcgtgcccatgttctacaccttcatcgccagcaaggacctgccgcatcttgcggaaaagccggatccgaggctgatgccggcattgccagactga

SEQ ID NO: 74193 - protein, 1027 aa, Mesorhizobium loti MAFF303099
MSFSDLFIRRPVLSTVLGCLILLLGFQGIFNLSIRQYPKVDETAITITTAYPGASADLIQGFISAPIARAVASTENIDYVTSSSRPSSSTVTVQMKLGSNPDVALTEVLSKVQGVRGTLPDASKDPVIVKGTGQQFAMMYISMQNPNMTKEQLTEYIERVIRPRMSTVEGVADVQIFGAQEYSMRVWIDPIRLAARGVTAAEVLTAINNSNFLSAPGNTQNEYVVSSISVRSTLQTPEAFAELPLRSTDGNVVRLRDVARVELGAANTDTRVSFNGKPGTFLAIFPTPAANPLTTAAALTKLVPQIQETLPKGMTIEVVYDATGQISASIEEVFKTIGEAVAIVVVVILLFLGSFRSVMMPIITIPLSLIGVCFLLFAVGYSINLLSLLAMVLAIGLVVDDAIVVVENIHRHMEEDHMTPMQAAFSGMREIASAIVAMTMTLAAVFAPLAFTGGLTGALFREFAVTLAGSVVLSGVIAVTITPMMSARLLKAGTPGRFQRIVDGIFARVEHVYERAVTGSLNYRPLTLIIVLALVGVTGFMFTKTSSELAPEEDQGFLLSLVTAPTYATSDYTETYVNQMLGLVRDIPETRAQFSAVAFGGTTNSAFVGFAFKDWAERKRNSKELQADITARLAKVAGVQAFVFAPPTLPGSGGGLPIALVVRSTGDSAEVYKAAEQIKNKAQASGRFIVVQNSMSYDSPQVTVTIDRDRAAALNLPIADIGRTLTLLVGGAEVAQFDRDSNSYDIIPQVPQQFRDNPERLGEYFVRSVTGEMVPLSAVVNISNNASPAAIEQFNQLNSSTISALPLPGVTTGDGLKVLEDIARESLPDTFFIDYSGQSRQEKEQGNTILIAFAAAVIVIYLVLAAQFESFRDPLIIMMAVPLSIFGAIVPLNLGLGTLNIYTQVGLITLIGLITKHGILLVEFANQQREAHGMRRRDAIIASAKVRLRPILMTTAAMALGVVPLITSSGAGAAARYSMGLVIFTGILVGTMFTLFVVPMFYTFIASKDLPHLAEKPDPRLMPALPD

SEQ ID NO: 74194 - DNA, 3117 bp, Mesorhizobium loti MAFF303099
  CDS (1)..(3117): transl_table=11
gtgagcgtctccaacatattcgtccagcgtccaattgcgaccgggctgctgacgctcggcatcgtgctcgtgggcatggttgcgtacatgcttctgccgatctcgtcgctgcctcaggtcgattttccgaccatcgctgtagagtccacgttgcccggcgccaaagcggaaacgatggcgagcacggtagcgagcccgctcgaacagcaattctcgaccatacccggcctagcccagatgacgtcgacgagtacgctcggcaaaaccgacatgacgctgcagttcgatctcagccgcaatatcgacagcgcggcccaggacgttcaggcggcgatcaacgcggcgagcggctcattgccaaaggcaatgcaaagtccgcccacctaccacaaggtcaatccggcactgttcaccgtgatctccatcgtgctgcagtcggacacgatccccctcccgctggtcatggatgcggcgtctaatatggttgcccagaccttgtcccagattccgggagccggcttcgtggacatgcccggttcttcgaaatcggccatccgaatccagctcgatcccatgaagctggccagcctcgggatgagcctcgaagacgttcggtccgcgctggtagtggggacgaccaacggacccaagggcactctcgaaggcgcgcagcgctcggtcacgctcgacgccaataaccaactcctcacctcggcggacgcgagcgcggcaatcatcgcctaccgcaacggatctccgataaggatcagcgatatcggacgcgcgatcgacagcgtcgaaaacacgacgttgggtgcatggtacaataatcggaaggctgtcctcatagacgttcatctgcagtcgggcgctaacgcggttgacgtcgtgaatggcgtcaaggccgccctgccaggactgcggttgcgcctccctccctccgtccagatcatgacggcgggtgactctacggttgccgttcgcgcagccgtggccgacgtccagttcacactcatgattacgatcgggttggttgtcctcacgatcttcctattcctcaagagcatgagcgcgaccatcattccggccgtcacgattcccgtttccctgatcggcacatttggcgtgatgtatttgttgggttactcgctggacaacatttcgctgatgggactcacgatcgccgtagggtttgtcgtcgacgatgcgatcgtcgtgatcgagaacatcgtccggcacatcgagggcggcgaatcccctcttgaggccaccttgaagggggcgagcgagatcggctttacggtcgtttccatgaccgcatcgctgatcgcggtctttatcccgctgcttctgatgagcagcatggtcggccggctgttccgggagttctccgtcaccatagcggtagcgctcatcatttcggcgctcgtttcgctcacccttacgcctatgatgtgcgccctgatgatcaaaggccatggtcacgaagccaagcccaaccgcttatccagcctgctcgagcgcggcttcgacttcatccagcggggttatagccgttcgctccgcgtcgtggtcggacatccaaggcttgttctcctctgctttttcgcaacgctggctgtaacggcggagttgttcctagcgatcccgaagggcttcttcccacaacaggacctcgggctgatttccgggtccacgcaggccgcgcaggatatctccttccaagcgatggcagccaagcagcaggccgttgtcgatctcatcctgaaagatccggcggtcgacacggtccggtccaccctcggcggctccgggcgcatgaactccggcaacttgcagatcgtcctcaagccgctgtcggaacgatccgtgtccgcggatcaggtgattgcacgcctccgcaaggaaacggccggtgtgtccggcgtcagcgtgggcatgcaggctgtacagggcatcaacgtgggcgcacgcggctcccagacgcagttccagtacaccttgcaggaccccaacctgcccgaactgtacagatgggccgacacgatgaccgccgaattgcgcaagcttcctcaggtccgagacgttgcgaatgacctgcaagccgtggcgccgcatgccagcatcgctgtcgacagggacacggcatcacgcctcggcatcacgccgcaggcgatcgacgacacactctacgacgcattcggtcagcggcaggtcacgacgatcttcacccaagccgaccagcacaaaatcgtcatggagatcgatccgaaataccgagtcgatgcaggcgcgcttgatgcgatctatgtcggaagcaattcgggcaagcaggttccgctcagcgctttcgccaaggtcagtagctccgtggcgccgctgacgatcaaccatcagggcttgttcccttccgtaacgctgagtttcaatctcgcgcccaacgtcgccctcggggacgcggttacggcggtcgaagccatgcaggcacggattcgcatgtccgcgacggtgcagaccgggttccagggcaccgcacaggccttccaggcctcgctcagcacgcagccgatgctaatcgtggcagccctgatcgccgtgtacatcgttctcggcatgctttacgagagcgtgatccacccgataaccattctgtcgaccttgccttcagcgggagtgggcgccctcgcgacgcttatgcttgttggtggtcagcttgatgtcatggggcttgtcggcatcatcctgctcatcggcatcgtgaagaagaatgcgattatgatgatcgactttgcattgtcagccgagcgggaccgcggcttgccgccaaaggaagccattatccaagcctgcatcttgcggttccggcccatcacaatgaccacgctctgtgcgctgttgggcgcgctgccgctcgctttaggtactggcgtcggttcggaactcagacgcccgctcggcatcgcgatcgtgggcggactctgcgtgtcgcagctgctgacgctgtacaccacgccggtcatctacctctacatgcagcagtttgcaggcttgatgatgggcgtcaagtatcggatcatcgggcgtcggcccgcgctccccgcagtcccggcagaatag

SEQ ID NO: 74195 - protein, 1038 aa, Mesorhizobium loti MAFF303099
MSVSNIFVQRPIATGLLTLGIVLVGMVAYMLLPISSLPQVDFPTIAVESTLPGAKAETMASTVASPLEQQFSTIPGLAQMTSTSTLGKTDMTLQFDLSRNIDSAAQDVQAAINAASGSLPKAMQSPPTYHKVNPALFTVISIVLQSDTIPLPLVMDAASNMVAQTLSQIPGAGFVDMPGSSKSAIRIQLDPMKLASLGMSLEDVRSALVVGTTNGPKGTLEGAQRSVTLDANNQLLTSADASAAIIAYRNGSPIRISDIGRAIDSVENTTLGAWYNNRKAVLIDVHLQSGANAVDVVNGVKAALPGLRLRLPPSVQIMTAGDSTVAVRAAVADVQFTLMITIGLVVLTIFLFLKSMSATIIPAVTIPVSLIGTFGVMYLLGYSLDNISLMGLTIAVGFVVDDAIVVIENIVRHIEGGESPLEATLKGASEIGFTVVSMTASLIAVFIPLLLMSSMVGRLFREFSVTIAVALIISALVSLTLTPMMCALMIKGHGHEAKPNRLSSLLERGFDFIQRGYSRSLRVVVGHPRLVLLCFFATLAVTAELFLAIPKGFFPQQDLGLISGSTQAAQDISFQAMAAKQQAVVDLILKDPAVDTVRSTLGGSGRMNSGNLQIVLKPLSERSVSADQVIARLRKETAGVSGVSVGMQAVQGINVGARGSQTQFQYTLQDPNLPELYRWADTMTAELRKLPQVRDVANDLQAVAPHASIAVDRDTASRLGITPQAIDDTLYDAFGQRQVTTIFTQADQHKIVMEIDPKYRVDAGALDAIYVGSNSGKQVPLSAFAKVSSSVAPLTINHQGLFPSVTLSFNLAPNVALGDAVTAVEAMQARIRMSATVQTGFQGTAQAFQASLSTQPMLIVAALIAVYIVLGMLYESVIHPITILSTLPSAGVGALATLMLVGGQLDVMGLVGIILLIGIVKKNAIMMIDFALSAERDRGLPPKEAIIQACILRFRPITMTTLCALLGALPLALGTGVGSELRRPLGIAIVGGLCVSQLLTLYTTPVIYLYMQQFAGLMMGVKYRIIGRRPALPAVPAE

SEQ ID NO: 74196 - DNA, 3168 bp, Mesorhizobium loti MAFF303099
  CDS (1)..(3168): transl_table=11
atgatttccgatctcttcatcacccgcacccggctggcgatcgtcttgtcgatcgtcatttcgattgcgggcgcgatcgccatcttttcgctgccggtgcagcaatatccagagatcacgccgcccaccgtcagcgtcactgccttctaccccggggcgagcgcggaagtgattgccgatgtcgtcggcggccccctggagacggccatcaatggcgtccccaacatgatgtacatgtcgtcgaccagttcgaatgccgggcaatattcgctgtccgtgacgttcgaagtcggcacaaatcccgacattgcgcaggtcaatgtgcagaacagggcgcaactggcgatttcccaattgcccgccgcggtcacccagcaaggcgtgtccgtgcggtcgcgatcgcccgatttcgtgctcggcatcgccttctattctccggacagcaagctcgacgtgctgcagatcaccaatttcacctcgacgacgatcgccgatgcactctcgcgcgtcagcggtgtcggtgaggcttccgtcgtcggcgcgtccgaatactcgatgcgcatatggctgaatccggcacgcatggatgccctgggcataacggccgatgacgtggccgccgccattcagcggcagaacatccaggcctcgcttggccaggccggcgccccaccagcgcgggaaggcaccgagctgcaatatacgctcgtggctcgcggccgcctcttgagcacggatgaattcggcgacatcgtcatacgcacaggcgaggccggggcgatcgtacggttgcacgatatcgcacgtatagaactcggcgcccgcagttattcatcgagcgcgagcttcgccgggcatgacacggcgatgctgcagataaaccaggcgccgggagccaacgcgatccagaccgccaacgccgtgcgcgccgagctacagcgcctttcacccacgtttcctcccggcctgcaataccaggtcgtctacgatgcgacacggttcgtccggacgagcctctcgctcatcgtgcggatcctcggcgaggctttcctgatcgtgctcgtcgtcacctacctgttcctgcaggactggcgcgccaccctggtctcggcgctggccatgcccgtcgcgatgctgggtgccatcgccgtcctgctggcattcggatattcgataaactcgatttcgctgctggccctggtgctggcgatcggactggtcgccgacgacgccatccttgtcgtcgagaacgtcaagcatgtcatggaggacgaccccacggtcgaaacggtggcggccgcccgcaaggcgatggggcagatcacgggtccgatcatttccaccacgctcgtcctccttgccgtggtgatcccgacagctttcctgtccggcataagcgggcagctctaccgccagttcgcggtcaccttgtcggcggcgctggttatctcgtccgtcgtcggcctcacactcagcccggcactcgccgccatcctgctgaggcgcggacagcgcggataccggcgcggtccgcttggctggttcgcgcgcttcatgaacgcgacgcgtgtcggctatggccggctggtcggtttcctggtgcgcctgtggatcatacctctcgccgcgcttgccgcctgcttcctgggcgcctacctgctgttcagcggcctgccctcgaccttcctgccggacgaggaccaaggcgccctgtttgtcgatatccagcttcccaatgccgcctcgctcgatcgtacgagagcgattgtgggagaggttcaaaagaccttatcggcgacaaaaggcgtcgaaaacgtcatttcggtcgccggcttcagcatcgtgcaggggacgcaatctcccaacggagcgatggtggtcgcggcgctggatccctgggatcagcgcaacacgccggatctgcggctggacgccatcctcgcaagattgcgcgcgcaattctcgaccattccaggcgccaatgttgccgtcttttcgccgccggccatttccggcatcggcgcggtcggaggcctcgatctgcgcctgcaggctttgcaggggcagccgccggaagagatcgcggcggtagtacgagcattcgttacggcgatcaaccaggcgccggaaatcggcggcgtggcgacaaccttcagcgccgatgtgccgcagatttacgtcgatgtcgaccggacccgcgccgaagcgcttggagtgagcgtgtccgacatctattcgacgatcggcgccagcttcgggtcgcgttatgtgaatgatttcacgctgcacgggcgggtcttccaggtcaacctgcaggctgacgccgagcatcgcggggacgccgaggatatcctcaatctccatgttcgcagccggacgggcgcgatggtgccgctcagggcggtggtatcgaccagcaccgtactcgcacccttcgtcatctcccgctacaacctgtcggtagcggcacagatcaacggccaagtcgcgccaggcggcagttccggagcggcgatggatgccatcgaacgcgtcgcggccgaggcgttgccggccggctatggctacgagtggtccggcctgtccttccaggagcggcgcagcgccggacaggagagcgtcattttcggactggccttcctgttcgcctatctgttcctggtggcgcagtacgaaagctggatgctgccgatcgccgtaattctgtcccttggagccgccctgttcggtgccaccggggcgctcgtgcttttcggactgcaaaacagcctttatgtgcagatcgccatcgtgctgctcatcgggctggcgtcgaagaacgccatcctgatcgtcgaattcgccaaggaacgccgcgaagaggggcaatcgatcgccgaagcggcaagactcggtgccgagcagcgcttccgcgccgtgatgatgacggctctctccttcattctgggcatcatcccactggcggtgtccaccggcgccggcgccggcgcgcgccaggctgtgggtgtcacaatctttggcggcatgctggccgcaacgacgatcggcctattcatcatcccggccttattcgcggcgatccagcatattgcggaatgggcaactgtccggccgatggcggaatcgaacaccgatgaggtagtcccgcaatcgaggggcaaggcatga

SEQ ID NO: 74197 - protein, 1055 aa, Mesorhizobium loti MAFF303099
MISDLFITRTRLAIVLSIVISIAGAIAIFSLPVQQYPEITPPTVSVTAFYPGASAEVIADVVGGPLETAINGVPNMMYMSSTSSNAGQYSLSVTFEVGTNPDIAQVNVQNRAQLAISQLPAAVTQQGVSVRSRSPDFVLGIAFYSPDSKLDVLQITNFTSTTIADALSRVSGVGEASVVGASEYSMRIWLNPARMDALGITADDVAAAIQRQNIQASLGQAGAPPAREGTELQYTLVARGRLLSTDEFGDIVIRTGEAGAIVRLHDIARIELGARSYSSSASFAGHDTAMLQINQAPGANAIQTANAVRAELQRLSPTFPPGLQYQVVYDATRFVRTSLSLIVRILGEAFLIVLVVTYLFLQDWRATLVSALAMPVAMLGAIAVLLAFGYSINSISLLALVLAIGLVADDAILVVENVKHVMEDDPTVETVAAARKAMGQITGPIISTTLVLLAVVIPTAFLSGISGQLYRQFAVTLSAALVISSVVGLTLSPALAAILLRRGQRGYRRGPLGWFARFMNATRVGYGRLVGFLVRLWIIPLAALAACFLGAYLLFSGLPSTFLPDEDQGALFVDIQLPNAASLDRTRAIVGEVQKTLSATKGVENVISVAGFSIVQGTQSPNGAMVVAALDPWDQRNTPDLRLDAILARLRAQFSTIPGANVAVFSPPAISGIGAVGGLDLRLQALQGQPPEEIAAVVRAFVTAINQAPEIGGVATTFSADVPQIYVDVDRTRAEALGVSVSDIYSTIGASFGSRYVNDFTLHGRVFQVNLQADAEHRGDAEDILNLHVRSRTGAMVPLRAVVSTSTVLAPFVISRYNLSVAAQINGQVAPGGSSGAAMDAIERVAAEALPAGYGYEWSGLSFQERRSAGQESVIFGLAFLFAYLFLVAQYESWMLPIAVILSLGAALFGATGALVLFGLQNSLYVQIAIVLLIGLASKNAILIVEFAKERREEGQSIAEAARLGAEQRFRAVMMTALSFILGIIPLAVSTGAGAGARQAVGVTIFGGMLAATTIGLFIIPALFAAIQHIAEWATVRPMAESNTDEVVPQSRGKA

SEQ ID NO: 74198 - DNA, 3186 bp, Mesorhizobium loti MAFF303099
  CDS (1)..(3186): transl_table=11
atgtgtgtcgtggtaaacttcttcattcaccgtccgatcttcgcctcggcgatcgccatcatcatggtgctcgccgggacgatttgttatttcctgctgccggtctcgcagtttcccgacatcacgccgccccaggtcgtggtcagcgcccattatcccggcgccagcgcgcaagtcgtggccgacacggtgacgacgccgctggagcagcagatcaacggcgtgcagggcatgacctacatgtcgtcgacgagctccaatgacggctcctcgaccatcaccatcaccttcgatgtcggctactccctgagcaccgccgccgtcgacgtccagaaccgcgtctcgcaggcggcctcgtcgctgccggcgatcgtcaaccagggcggcgtgacgatcaagaagcagaacccgaacttcgtgctcatcgtcaacctcacctcgcccgacaagtcggtcgatccggtggcgctgtcgaacctcgcctacctgcaggtcgtcgatccgctgaagcggctgcaaggcgtcggcgacgtgcagatcttcggcgagcggcgctattcgatgcgcatctggctcgatccggacaagcttgccaatctcggcatcaccgccgtcgacgtgcagaatgccatcgccgagcagaatgtccaggtggcggccggcaagatcggccagtcgccggcgcccgccggcaccgccttcgagatgcaggtcaacgccgtcggccgcctgagcgacccgaaggagttcggcgacatcgtggtgcgcgccaacaccgacacgggctcgctggtgcggctgcgcgacgttgcgcgtatcgagctcggcgcgctgcaatattcgtcgtcggccttcttcggcaaggacccgaccgtcgttctcgcggtctaccagatgcccggttccaacgcgctcgaccttcagcagcgcgtcaaggacaagatgcaggagttgtcggcgcggttccccaagggcgtatcctatgccatgcactacgacaccacgcgcttcgtctcggcatcgatgcatgatgtgctgatcacgctcggcgaagcgctggttctggtcgtcgccgtggtgttcatcttcctgcagagctggcgcacgaccatcatcccgaccatcgccattccggtgtcgctggtggcgacgctggtcgtcatggagatgctgggcttctcgctcaacatgctctccctgctcggcatggtgctggcgatcggccttgtcgtcgacgacgccatcgtggtggtcgagaatgtcgaacgacaattagaggccgggttgaagccactcgcggcgaccaaggccgccatggccgaagtcaccggtccgatcatcgccaccaccgcggtgctgatggccgtgttcgtgccggtcgccttcattccgggcgtctcggggcggctctacaaccagttcgcgctgacggtggcgatttcggtcggcatctcggccttcaattcgctgacgctgagccctgcgctcagtgccgctttcctgcgtcatcggcatgggccgcagttcttcctgttccgttggttcaacaccggcttcgacaagatatcccacgcctacgctcatggtgtgcgcttcctcattcgcctgcgctggatcatgctcggccttttcgcggccgggttggtcgccacctatttcgtctggcagaagctgccctcgaccttccttccggtcgaggaccagggctatttcttcgtcgtcatccagttgcccgacggcgcctcgctcgagcgcaccgacgcggtggcccagaaggcgcgcgatatcctgcaggcgacgccgggcgtcgacattgtcggctcgatcagcggcctgaacttcctgaccagtgcggcgcagtcgaactcggcggtcgagttcgccatcctgaagccctgggaagaacgtggccccgaccagagcgcgtcgaaactcgtcgccgacgtgcgcggcaagctgatgcagattccggaagctttcgcgctctccttcgatccgccttcgatcccgggtatcggcacgaccggcggcttcgaattcgtcgtcgaggacctcaccggccgcggcagcacggccctcaatgacgcgacgcaagccgtgatcgccgaggcgcgcaagcagccggaaatcaatccgcagcagctgttctcgccgttctcgacctcgacgccgcagttcaactacgacctcgaccgcagcaaggccaagcttctcggcctcaacctgcccgacgtcttcaacacactgcagatctatctcggctcgctctatgtgaacgacttcaacctgttcggccgcaccttccgggtgaccatccaggccgacaaggatgcacgtgcgggcgccgccgacatttccaggctctatgtgcgcaacgcgtcgggcggcatggtgccgctctcgacgctgggcaagctcgtgccgttcgtcgggccggaaaccgtgccgcactacaacaacaacgcctcggcctcgatcaatggcggcgccgcaccgggcttctcttcgggccaggcggtcgccgccatggaacgggcggcggccaccgcgctccccagggatttcggtttcgaatggaccggcatcaccttccaggagctcaaggcaggatcgatcgcgtccgtcgtcttcggcctcgccatcgtcttcgtcttcctgatcctggcggcgcagtatgagagctgggcgatgccgttcatggtgctgctggcggtgccgctcgctctgtttggcgcgttcgcggccctgtcggtgcgcggcatgcagatcgacgtctactcgcagatcggcttcgtcatgctgatcggcctggcagcgaagaacgcgatcctgatcgtcgagttcgccaggcggcggcgcgaggaaggcttgagcattgtcgaggcggccatggaagccgcgcgcctcaggctgcggccgatcctgatgacggccttcgccttcatcctcggcgtgctgccgctgatgttcgccaccggcgccggtgccgcaagccgccagtcgatcggcaccacggtgtttggcggcatggtcgccgcgaccattctgtcgctggtgttcgtgccggtcttctacgcggtcatcgaacagctgcgggagcgccgcggaagcggcgaacccgcctccaagcatactgaaccaactgccgaacccgccttccctcccctggcggaagcggccgaataa

SEQ ID NO: 74199 - protein, 1061 aa, Mesorhizobium loti MAFF303099
MCVVVNFFIHRPIFASAIAIIMVLAGTICYFLLPVSQFPDITPPQVVVSAHYPGASAQVVADTVTTPLEQQINGVQGMTYMSSTSSNDGSSTITITFDVGYSLSTAAVDVQNRVSQAASSLPAIVNQGGVTIKKQNPNFVLIVNLTSPDKSVDPVALSNLAYLQVVDPLKRLQGVGDVQIFGERRYSMRIWLDPDKLANLGITAVDVQNAIAEQNVQVAAGKIGQSPAPAGTAFEMQVNAVGRLSDPKEFGDIVVRANTDTGSLVRLRDVARIELGALQYSSSAFFGKDPTVVLAVYQMPGSNALDLQQRVKDKMQELSARFPKGVSYAMHYDTTRFVSASMHDVLITLGEALVLVVAVVFIFLQSWRTTIIPTIAIPVSLVATLVVMEMLGFSLNMLSLLGMVLAIGLVVDDAIVVVENVERQLEAGLKPLAATKAAMAEVTGPIIATTAVLMAVFVPVAFIPGVSGRLYNQFALTVAISVGISAFNSLTLSPALSAAFLRHRHGPQFFLFRWFNTGFDKISHAYAHGVRFLIRLRWIMLGLFAAGLVATYFVWQKLPSTFLPVEDQGYFFVVIQLPDGASLERTDAVAQKARDILQATPGVDIVGSISGLNFLTSAAQSNSAVEFAILKPWEERGPDQSASKLVADVRGKLMQIPEAFALSFDPPSIPGIGTTGGFEFVVEDLTGRGSTALNDATQAVIAEARKQPEINPQQLFSPFSTSTPQFNYDLDRSKAKLLGLNLPDVFNTLQIYLGSLYVNDFNLFGRTFRVTIQADKDARAGAADISRLYVRNASGGMVPLSTLGKLVPFVGPETVPHYNNNASASINGGAAPGFSSGQAVAAMERAAATALPRDFGFEWTGITFQELKAGSIASVVFGLAIVFVFLILAAQYESWAMPFMVLLAVPLALFGAFAALSVRGMQIDVYSQIGFVMLIGLAAKNAILIVEFARRRREEGLSIVEAAMEAARLRLRPILMTAFAFILGVLPLMFATGAGAASRQSIGTTVFGGMVAATILSLVFVPVFYAVIEQLRERRGSGEPASKHTEPTAEPAFPPLAEAAE

SEQ ID NO: 74200 - DNA, 3087 bp, Helicobacter pylori 26695
  CDS (1)..(3087): transl_table=11
atgtataaaacagcgattaatcgtcctattacgaccttaatgtttgctttggcgattgtcttttttgggactatggggtttaaaaaattgagcgtggcgcttttccctaaaattgatttgcctacggtggtggttactacgacttatcctggggctagcgctgaaatcatagagagtaaggtaaccgataagattgaagaagcggtgatggggattgatgggatcaaaaaggttacttccacgagttctaaaaatgtgagtatcgtcgtcattgaatttgagttagaaaaacctaatgaagaagccttaaacgatgtggtgaataaaatttcttcggtgcgttttgatgactctaacattaaaaaaccctctatcaataaatttgataccgacagccaagccattatttcattgtttgtgagcagttcaagcgtgccggctacaacccttaatgactacgctaaaaacaccatcaaacccatgctccaaaaaatcaatggggtagggggcgtgcagctcaacggctttagggagcgccagattaggatttatgcaaatcccactttgatgaataaatacaacctgacttatgcggatcttttcagcacgcttaaagcggagaatgtggaaattgatggggggcgcattgtcaatagccaaagggaattttctattttaatcaatgcgaatagttatagcgttgcggatgtggaaaagattcaagtgggtaatcatgtgcgtcttggcgatattgcaaaaattgaaatcggtttggaagaagacaacacttttgcgagctttaaagacaaacccggtgtgattttagaaatccaaaagattgccggagcgaatgaaattgaaatcgtagatagggtgtatgaagctttaaagcgcattcaagccattagccctaactatgaaatcagaccctttttagacaccacgggctatatccgcacctctattgaagacgtgaaatttgatctagttttaggggcgattttagcggttttagtggtgtttgcgttcttgcgtaacggcacgatcaccctcgtttcagcgatctctatccctatttctatcatggggacttttgcgctcatccaatggatgggcttttcattaaacatgctcaccatggtggctttaacgttggcgatagggattatcattgatgatgcgatcgtggtgattgaaaacatccataaaaagctagaaatgggcatgagtaaacgaaaagcgagctatgagggggtgagagaaattggctttgctctagtggcgatttcagcgatgctgctctctgtttttgtgcctatagggaacatgaaaggcattattgggcgtttttttcaaagttttgggatcacggtggctttagcgatcgctctatcgtatgtggtggtcgttacgattatccccatggtaagctcagtcgtggtcaatcccaggcattctcgtttttatgtgtggagtgagcctttttttaaggctttagagtctcgttataccaagttgctccaatgggtattaaaccacaagatcattatctctatagcggtggttttggtgtttgtgggatcgctttttgtggcttctaagattggtatggagttcatgctgaaagaagatagggggaggtttttggtgtggcttaaggctaaaccgggcgtgagcatagattacatgacacaaaagagtaagatctttcaaaaagcgattgaaaaacatgctgaagtggaattcaccaccttgcaagtgggttatggcaccacacaaaacccttttaaggctaagatttttgtgcaactcaagcctttaaaagagcgtaaaaaagagcatcaattggggcaatttgagttgatgagcgttttaaggaaagagttgagaagcttgcctgaagctaaaggtttagatactattaatctttctgaagttactcttatagggggcggtggggatagttcgcccttccaaacctttgtgttttcccattctcaagaagcggtggataaaagcgtggagaatttgaaaaaattcttattagaaagccctgaattaaaaggcaaggttgaaagctatcatacaagcacgagcgaatcgcaaccgcaattgcaactcaaaatcttaagacaaaacgctaacaaatacggcgtgagcgctcaaaccattggatcagtggtgagctctgctttttctgggacttctcaagcgagcgtgttcaaagaagatggcaaagaatacgacatgatcattagagtgcctgatgacaagcgcgtttctgtagaagacatcaaacgcttgcaagtgcgtaacaaatacgataaattgatgtttttagacgctttagtggaaatcacagaaactaaaagcccgtccagtatttctcgctataaccgccaacgcagcgttacggtgcttgctgagcctaataggaatgcgggcgtttctttaggcgagattttaacgcaagtgagcaaaaacactaaagaatggttggttgaaggggcgaattacagatttaccggagaagcggataacgccaaagagagcaacggggagtttttagtcgctttagcgacagcgtttgtgctgatttatatgattttagcggcgttgtatgagtccattttagagccttttatcatcatggttaccatgcctttaagtttttcaggggcgttttttgctctaggtttagtccatcagcctttgagcatgttctctatgataggcttgattttgctcattggtatggtgggtaaaaacgccacgcttttaattgatgtggcgaatgaagagcgtaaaaaaggtttgaatatccaagaggccattttatttgccggcaaaacccgtctaagaccgattttaatgacgaccattgcgatggtttgcgggatgctgcctttagcgttggcgagtggggatggagcggcgatgaaatcccctatagggattgcgatgagtgggggcttgatgatttctatggtgttaagcttactcattgtgccggtgttttatcgtttgctcgctcccatagacgacaaaatcaagcggttttatcaaaaccaaaaaactttagaatga

SEQ ID NO: 74201 - protein, 1028 aa, Helicobacter pylori 26695
MYKTAINRPITTLMFALAIVFFGTMGFKKLSVALFPKIDLPTVVVTTTYPGASAEIIESKVTDKIEEAVMGIDGIKKVTSTSSKNVSIVVIEFELEKPNEEALNDVVNKISSVRFDDSNIKKPSINKFDTDSQAIISLFVSSSSVPATTLNDYAKNTIKPMLQKINGVGGVQLNGFRERQIRIYANPTLMNKYNLTYADLFSTLKAENVEIDGGRIVNSQREFSILINANSYSVADVEKIQVGNHVRLGDIAKIEIGLEEDNTFASFKDKPGVILEIQKIAGANEIEIVDRVYEALKRIQAISPNYEIRPFLDTTGYIRTSIEDVKFDLVLGAILAVLVVFAFLRNGTITLVSAISIPISIMGTFALIQWMGFSLNMLTMVALTLAIGIIIDDAIVVIENIHKKLEMGMSKRKASYEGVREIGFALVAISAMLLSVFVPIGNMKGIIGRFFQSFGITVALAIALSYVVVVTIIPMVSSVVVNPRHSRFYVWSEPFFKALESRYTKLLQWVLNHKIIISIAVVLVFVGSLFVASKIGMEFMLKEDRGRFLVWLKAKPGVSIDYMTQKSKIFQKAIEKHAEVEFTTLQVGYGTTQNPFKAKIFVQLKPLKERKKEHQLGQFELMSVLRKELRSLPEAKGLDTINLSEVTLIGGGGDSSPFQTFVFSHSQEAVDKSVENLKKFLLESPELKGKVESYHTSTSESQPQLQLKILRQNANKYGVSAQTIGSVVSSAFSGTSQASVFKEDGKEYDMIIRVPDDKRVSVEDIKRLQVRNKYDKLMFLDALVEITETKSPSSISRYNRQRSVTVLAEPNRNAGVSLGEILTQVSKNTKEWLVEGANYRFTGEADNAKESNGEFLVALATAFVLIYMILAALYESILEPFIIMVTMPLSFSGAFFALGLVHQPLSMFSMIGLILLIGMVGKNATLLIDVANEERKKGLNIQEAILFAGKTRLRPILMTTIAMVCGMLPLALASGDGAAMKSPIGIAMSGGLMISMVLSLLIVPVFYRLLAPIDDKIKRFYQNQKTLE

SEQ ID NO: 74202 - DNA, 3003 bp, Aquifex aeolicus VF5
  CDS (1)..(3003): transl_table=11
atgcagaaattcttcattgaaagacctgttaccgcttttatgcttatgctttccttcgtctttttggggctttattccctcaagctcgtgcctatagacaggcttcccgatgttgagtttcccgtagtcaggattagtgcggattatccgggtgcggacccttacgtggtagacacgaacgtaacgaggataatagaagaggcggtatcaacggtaagtggaatagagagcataatctcaaggagttatccaggatttgccagtgtcgtggttacctttacccttgacaaggacatagacgtggcaactcaggaagtgagcaacgctatccaaagggctatgaggaggtttcccaaaggcgttgagccacctaccgttgtaaaggtggacacttctgttgctcccataatggttttactcctttactcggacacggcggattaccaaagactcacctactacgcggacaaggtaataaagagagaacttgaaaaactctacggagtgggttcggtaagtctcggaggtttcagggataacgtcctctgggttcggttgaaggtatcggagctttacggctacgagctcactcctctggatgtccttagggaaattgacaaaaaccatcaggatattcccgcgggaaacgtttacggaaagaggagggagtatatactgagactctacggaaagtttaaaacgcccgaagaactctccaacctctacatcaaggaaaacctgagattgggggacgtggcgagggtatacttcggtgaggacgaggagaggagtcttgcgaggtttaacggaaatagggcggtggcgcttctggtgttcaaacaggctaaggtaaacacggtaagggtaattgatgagataaagtccagaatggagtttttcagggaactccttcctcctgatataaaacttgattacacctttgatgcgagcgtttacgtaaaggagagcataagggcagcctttgaggagataattatcggggttttcctcaccgcgtttaccgtttaccttttccttggaaaccttcgccttacactcgttcccgtcttcgcaattcccgtaacgattcttggaaccattttctttctctatcagctcggctactctctgaacacgataactctccttgcccttgcggtagcggtgggtatagtcatagacgatgccatagtcgttatggaaagcatacacagaaggcgggaagagggtcttcctccctttgaggcgggcgttaagggaacgagagtggttatgtttgcactccttgcctcaacttccgtccttatcgtggtattcctgcctgttgtcttcttgaaaggtgttctcggaacctttttaaagaatttcgccctgacgcttataatagctatcggtctctcttacctggttgcgattaccttcacaccctccgccacggtgaggctcattacccaaagaccgagggagaacttctttatgaaactctacaaaaggtttgagggatcctttgacaaagctctcaggttttcccttgaccacaagtttatagtccttctcctttccttcttctttgttgggctgagcgtttacctatttcctaaggtaaagaaggagttcgttccccacgttgacgagggaagatttatggtgaggatgaggatgcccgtggggacttcctttgaacgcgtaaaagaaaaagcgaaggaagtggagaggattctccttaaaaacccgcatatcgcaaaggtgggaatggtggtcggagaaggagtgggaggtgcgggtgttcacagcggactcttcttcgtttacctcaaagaacgttctcaaagacctcaccagatggtcgttatgagtgaagtgagaagggagctttccgaactaaagaacgtaaaagtcagcgttgaacctccccatggtataggtgcgagtgcgggaagaactacggaccttcaatatattgtaaggggtgagaggatcgaagttctgaaaaagatagcgaaaagcatggaagagcacttttcaaacgttgaaggtttcagggacgtggacactagccttgagctcagcgccccctatgtaaagataagtgtaaagagggaaaagctctcacacctgggtgtttcggtggaagaccttggacttactctctcccttctctttggaaagtacagggtgggaacgtatgagctcggctcagagagttatgacttctatataaaagccgaagaagacttcgtaaaggaaatacataacttaaacagagtttacatcagggcaagaaacggagaacttattcccataacggaactaatagacttctcaattgaagcaggacctttcagtctaaccaggtacaacaggcagtactccttcgtgttttacgcaaatctggaggggattgaccttgcgaccgcgaggtctcttgtggaagactggctaaagaaaaacctgccctttggctacacttacgacaccgctggaagggtaaaggagttcaagaaagccttttcgggctttgtgctctctttggctatgtccttaataggcgtttatatgatactggcctccctctttgagagtctaaagcacccctttaccgttcttttaatggttcctttaagcgccctcggagtttttgggtttatgtacttgacggacacctccctgaacgtctcttcttacttcgggataatactcctcgtgggaattatagtgagggacgcggttctctttatagagaggataatacagctaagaaaagagggctacgcggtaagggaggctattcttgaagctaggcgtgagagactccgtcctatactcatgacaacgataaccgtggtttccgcactccttcccgtcgctctcgggcttaccgcgggctccgaacagagaaaaccccttgcgatagcggtaataggcggtatagcctcgggacttcctctgagtttattcttactccccgttctttacgagctaatggagtggaaaaggaaatga

SEQ ID NO: 74203 - protein, 1000 aa, Aquifex aeolicus VF5
MQKFFIERPVTAFMLMLSFVFLGLYSLKLVPIDRLPDVEFPVVRISADYPGADPYVVDTNVTRIIEEAVSTVSGIESIISRSYPGFASVVVTFTLDKDIDVATQEVSNAIQRAMRRFPKGVEPPTVVKVDTSVAPIMVLLLYSDTADYQRLTYYADKVIKRELEKLYGVGSVSLGGFRDNVLWVRLKVSELYGYELTPLDVLREIDKNHQDIPAGNVYGKRREYILRLYGKFKTPEELSNLYIKENLRLGDVARVYFGEDEERSLARFNGNRAVALLVFKQAKVNTVRVIDEIKSRMEFFRELLPPDIKLDYTFDASVYVKESIRAAFEEIIIGVFLTAFTVYLFLGNLRLTLVPVFAIPVTILGTIFFLYQLGYSLNTITLLALAVAVGIVIDDAIVVMESIHRRREEGLPPFEAGVKGTRVVMFALLASTSVLIVVFLPVVFLKGVLGTFLKNFALTLIIAIGLSYLVAITFTPSATVRLITQRPRENFFMKLYKRFEGSFDKALRFSLDHKFIVLLLSFFFVGLSVYLFPKVKKEFVPHVDEGRFMVRMRMPVGTSFERVKEKAKEVERILLKNPHIAKVGMVVGEGVGGAGVHSGLFFVYLKERSQRPHQMVVMSEVRRELSELKNVKVSVEPPHGIGASAGRTTDLQYIVRGERIEVLKKIAKSMEEHFSNVEGFRDVDTSLELSAPYVKISVKREKLSHLGVSVEDLGLTLSLLFGKYRVGTYELGSESYDFYIKAEEDFVKEIHNLNRVYIRARNGELIPITELIDFSIEAGPFSLTRYNRQYSFVFYANLEGIDLATARSLVEDWLKKNLPFGYTYDTAGRVKEFKKAFSGFVLSLAMSLIGVYMILASLFESLKHPFTVLLMVPLSALGVFGFMYLTDTSLNVSSYFGIILLVGIIVRDAVLFIERIIQLRKEGYAVREAILEARRERLRPILMTTITVVSALLPVALGLTAGSEQRKPLAIAVIGGIASGLPLSLFLLPVLYELMEWKRK

SEQ ID NO: 74204 - DNA, 3027 bp, Rickettsia prowazekii str. Madrid E
  CDS (1)..(3027): transl_table=11
atgttattgtctacaatttgtattaaacgtccaatatttgctatagttttgagtctaatgatcgtagctctcggaggaattttttttaccaagctacaaattagaggcgctccagatatttcagtgcctattataaatgttgaagcgcattatgcaggtgcagatgcattatatatggaacaagaaatcacaacacgtatagaaaaagttttaaagactgttaaaaatttagattatataacgtctcaaagttctaccggctcaagtagtattactttatcatttcgattatctacagatattgaattagcattaaacgatgttcgttctaaaatatcagatattagttatatgtttccacaagatatgaaagccccatcagttacgaaacttgatactgataatttcccgagcctcttcataagtattgaaagtgatcaatatagcgatttagaattaacacagatagtctcagataatatacaagcacaattagataaacttgaaagtgtaggtaaatcacaaatttacggcggtagggaatatataatgagaatagaaccagatttcaaaaaattatatcaatataaaatttctttattggagattgaagccgcaataaaagagcaaaataaagattatccagccggaatgattaaaacaaaaagtaataattttatagtaactcttacaggctctttatccgcaccggaagaattcggtaatattattctaaaagtacaaaacggatgtataataaaattacgagatataacaaaaatatctttaacttctcctgatgaggatataattttcagatataatggcaaaaactctattgctcttggtctcataaaagaatcaaaagctaatataatagatttatcaaatgaagtaactaaagaattagaaagaattaaagcatcaattccaaaaggaataagcattagtatagcatacgatggggcaaaacctttaaaagcatcaatttatgcagtatttaaaacaatgtttgaagcattaatattagtagttttagtaacttatttgtttcttgcttctgctaaaattagcttaattccgtttgtaacgattcctgtatcgttgatcggtacttttagcataatgtatgcttttggattttctattaatgtatttacactccttgctatgatacttgctataggtttagttgtcgatgatgcaatagtgatgcttgaaaacatttttagatataatgaaatggggtataaaccaatggaagcggctatgcttgcttctaaagaaattggctttgcaataatcactatgactattacacttgctgccgtgtttgtaccaatcggttttattgaaggctttatcgggaaattatttattgaatttgcttggactttagcattttgcgttttgttctcaggatttgttgctgtcactttaactcctatgatgtcaagtcatatggtaacaaaacataacacgaacttagcaaaattcttagtaagatttcatgatatgctacaattcgttcaaaatagatatatttattatctaaagttagctctcgataataaaaaaaaattcgtcatcattattttatcatcatttatagtacttattattagttttaaattaactaaaaaaactttcgtaccacaagaagatgacggatttttacaagtttttcttaaagggcctgaaggtgctagtttagaatcttctattaaagtagtaaaagaagcagaacaaatccttgctaattataaagatatattcggttatcttatggtaataggtgtaggaggtagtgaaaatgtttttgggtttattccattaaaagactggagcgcacgttctcgctcacaaaaaactattaagaatatgttaaataaacagttttctaaaatacctggcatgtcggttttcgctatggagccacgttcaatgattagcgtgaatgccactagtcctatagaatttactattcaaacaaaccttgaatataaggatttagataaaatatcacaacaatttattgatataatgagagcaaatcccattttcttaaacgtcaatagaaatttacaatcggcaatgcctactataaatatagaagtcaaccgtgataaggcttatttatacggaatggatttagcaaatataggtaaaacattacaatatttaattgcaggtcaacaaattggtgcttttagaatggggaataatttatataatgtgatattacaatttaatcaaaaagatcgacaagatattagcgatttgagtaaaattttaattagaacaaaaaataataatatgttaccgcttgaatcaatagctaatattagggaaaaaatatcactaaaatcatattatcattataataattcaaaatctgttactatttcttccgatcttgctcctgacgtcaaaattaatgatgcaattaacataatcaataaaatagccgcacagttacttgatcctaataatactataattgaatatataggagaaattaaacaaatgaaagaggtagacaataatatacttataacatttgtattttctcttgtatttatctatttggtacttgcagctcaatttgaaagctttactgaccctttattaatattactcgctgtacctttctcaataactggcggggggctgacactttggcttgccggtaatagtcttaatatgtatagtaatattggacttattactttaattggattagttactaagaatgctattatgatagtagaatttgctaatcagctaagagcaaaaggtttaaatgttcgagaagcgataatagaatcttcaaaactgcgcttacgtccgattcttatgactaccgttgctgctatcgttggagcattacctttagtttttgcagatggtgccggtgctgcttctcgtaattctataggttttgtaatagttggtggattaagtatcggtactatatttacaatatttgctatacctgtaatataccaaacttttaagaaggattaa

SEQ ID NO: 74205 - protein, 1008 aa, Rickettsia prowazekii str. Madrid E
MLLSTICIKRPIFAIVLSLMIVALGGIFFTKLQIRGAPDISVPIINVEAHYAGADALYMEQEITTRIEKVLKTVKNLDYITSQSSTGSSSITLSFRLSTDIELALNDVRSKISDISYMFPQDMKAPSVTKLDTDNFPSLFISIESDQYSDLELTQIVSDNIQAQLDKLESVGKSQIYGGREYIMRIEPDFKKLYQYKISLLEIEAAIKEQNKDYPAGMIKTKSNNFIVTLTGSLSAPEEFGNIILKVQNGCIIKLRDITKISLTSPDEDIIFRYNGKNSIALGLIKESKANIIDLSNEVTKELERIKASIPKGISISIAYDGAKPLKASIYAVFKTMFEALILVVLVTYLFLASAKISLIPFVTIPVSLIGTFSIMYAFGFSINVFTLLAMILAIGLVVDDAIVMLENIFRYNEMGYKPMEAAMLASKEIGFAIITMTITLAAVFVPIGFIEGFIGKLFIEFAWTLAFCVLFSGFVAVTLTPMMSSHMVTKHNTNLAKFLVRFHDMLQFVQNRYIYYLKLALDNKKKFVIIILSSFIVLIISFKLTKKTFVPQEDDGFLQVFLKGPEGASLESSIKVVKEAEQILANYKDIFGYLMVIGVGGSENVFGFIPLKDWSARSRSQKTIKNMLNKQFSKIPGMSVFAMEPRSMISVNATSPIEFTIQTNLEYKDLDKISQQFIDIMRANPIFLNVNRNLQSAMPTINIEVNRDKAYLYGMDLANIGKTLQYLIAGQQIGAFRMGNNLYNVILQFNQKDRQDISDLSKILIRTKNNNMLPLESIANIREKISLKSYYHYNNSKSVTISSDLAPDVKINDAINIINKIAAQLLDPNNTIIEYIGEIKQMKEVDNNILITFVFSLVFIYLVLAAQFESFTDPLLILLAVPFSITGGGLTLWLAGNSLNMYSNIGLITLIGLVTKNAIMIVEFANQLRAKGLNVREAIIESSKLRLRPILMTTVAAIVGALPLVFADGAGAASRNSIGFVIVGGLSIGTIFTIFAIPVIYQTFKKD

SEQ ID NO: 74206 - DNA, 3087 bp, Helicobacter pylori J99
  CDS (1)..(3087): transl_table=11
atgtataaaacagcgattaatcgtcctattacgaccttgatgtttgctttggcgattgtcttttttggggtgatgggttttaaaaaattgagcgtggcgcttttccctaaaattgatttgcctacagtggtggttactacgacttatcctggggctagcgctgaaatcatagagagtaaggtaaccgataagattgaagaagcggtgatggggattgatgggatcaaaaaggttacttccacgagttctaaaaatgtgagcattgttgtcattgaatttgagttagaaaaacctaatgaagaagccttaaacgatgtggtgaataaaatttcttcggtgcgttttgatgactctaacattaaaaaaccctctatcaataaatttgataccgacagccaagccattatttcattgtttgtgagcagttcaagcgtgccggctacaacccttaatgactatgctaaaaacaccattaaacccatgctccaaaaaatcaatggggtggggggcgtgcagctcaacggctttagggagcgccagattaggatttatgcggatcccactttgatgaataaatacaacctgacttatgcggatcttttcagcacgcttaaagcggagaatgtggaaattgatggggggcgcattgtcaatagccaaagggaattgtctattttgattaatgcgaatagttatagcgttgcggatgtagaaaagatccaagtgggtaatcatgtgcgtcttggcgatattgcaaaaattgaaatcggtttggaagaagacaacacttttgcgagctttaaagacaaacccggtgtgattttagaaatccaaaagattgccggagcgaatgaaattgaaatcgtggatagggtgtatgaagcgttaaaacacattcaagccattagccctagctatgaaatcagaccctttttagacaccacgagctatatccgcacctctattgaagacgtgaaatttgacttgattttaggggcgattttagcggttttagtggtgtttgcgttcttgcgtagtggtacgatcaccctcgtttcagcgatctctatccctatttctatcatggggacttttgcccttattcaatggatgggcttttcattgaacatgctcaccatggtggctttaacgctagcgatagggattatcattgatgatgcgatcgtggtgattgaaaacatccataaaaagctagaaatgggcatgagtaaacgcaaagcgagttatgagggggtgaaggagattggctttgctctagtggcgatttcggcgatgctgctctctgtgtttgtgcctatagggaacatgaaaggcattatcgggcgctttttccaaagctttgggatcacggtggctttagcgatcgctctatcgtatgtggtggtcgttacgattatccctatggtaagctcagtggtggtcaatcccaggcattctcgtttttacatgtggagtgagcctttttttaaggctttagagtctcgttataccaaattgctccaatgggttttaaaccacaagctcattatctttatagcggtggttttggtgtttgtgggttcgctttttgtggcttctaaattgggtatggagttcatgctgaaagaagatagggggaggtttttagtgtggcttaaggctaaaccgggcgtgagcatagattacatgacgcaaaagagtaagatctttcaaaaagcgattgaaaaacatgatgaagtggaatttaccactctgcaagtgggttatggcaccacacaaaacccttttaaggctaagatttttgtgcaactcaagcctttaaaagagcgcaaaaaagagcatgaattggggcaatttgagttgatgagcgctttaaaaaaggaattaaaaagcatgcctgaagctaaagatttggacagcattaatctttctgaagtcgctcttatagggggcggtggggatagttcgccctttcaaaccttcgtattctcccattctcaagaagcggtggataaaagcgtggagaatttgagaaaattcttattagaaagccctgaattaaagggcaaggttgaaagctatcatacaagcacgagcgaatcgcaaccgcaattgcaactgaaaatcttaaggcaaaacgccaacaaatacggcgtgagcgctcaaaccattggctcagtggtgagctctgctttctctgggacttctcaagcgagcgtgttcaaagaagatggtaaagaatacgacatgatcattagagtgcctgatgacaagcgcgtttctgtagaagacatcaaacgcttgcaagtgcgtaacaaatacgataaattgatgtttttagacgctttagtggaaatcacagaaactaaaagcccgtctagtatttctcgctataaccgccaacgcagcgttacggtgcttgctgagcctaataggaatgcgggcgtttctttgggcgagattttaacgcaagtgagtaaaaacactaaagaatggctggttgaaggggcgaattacagattcaccggagaagcggataacgccaaagagagcaatggggagtttttagtcgctttagcgacagcgtttgtgttgatctatatgattttagcggcgttgtatgagtccattttagagccttttatcatcatggttaccatgcctttaagcttttcaggggcgttttttgctctaggtttggtccatcagcctttgagcatgttctctatgataggcttgattttgctcattggtatggtgggtaaaaacgccacgcttttaattgatgtggcgaatgaagagcgtaaaaaaggtttgaatatccaagaagccattttatttgccggcaaaacccgtctaagaccgattttaatgacgaccattgcgatggtttgtggcatgctgcctttagcgttggcgagtggggatggaacggcgatgaaatcccctatagggattgcgatgagtgggggcttgatgatttctatggtgttaagcctactgattgtgccggtgttttatcgtttgctcgctcccatagacgacaaaatcaagcggttttatcaaaaccaaaaagctttagaatga

SEQ ID NO: 74207 - protein, 1028 aa, Helicobacter pylori J99
MYKTAINRPITTLMFALAIVFFGVMGFKKLSVALFPKIDLPTVVVTTTYPGASAEIIESKVTDKIEEAVMGIDGIKKVTSTSSKNVSIVVIEFELEKPNEEALNDVVNKISSVRFDDSNIKKPSINKFDTDSQAIISLFVSSSSVPATTLNDYAKNTIKPMLQKINGVGGVQLNGFRERQIRIYADPTLMNKYNLTYADLFSTLKAENVEIDGGRIVNSQRELSILINANSYSVADVEKIQVGNHVRLGDIAKIEIGLEEDNTFASFKDKPGVILEIQKIAGANEIEIVDRVYEALKHIQAISPSYEIRPFLDTTSYIRTSIEDVKFDLILGAILAVLVVFAFLRSGTITLVSAISIPISIMGTFALIQWMGFSLNMLTMVALTLAIGIIIDDAIVVIENIHKKLEMGMSKRKASYEGVKEIGFALVAISAMLLSVFVPIGNMKGIIGRFFQSFGITVALAIALSYVVVVTIIPMVSSVVVNPRHSRFYMWSEPFFKALESRYTKLLQWVLNHKLIIFIAVVLVFVGSLFVASKLGMEFMLKEDRGRFLVWLKAKPGVSIDYMTQKSKIFQKAIEKHDEVEFTTLQVGYGTTQNPFKAKIFVQLKPLKERKKEHELGQFELMSALKKELKSMPEAKDLDSINLSEVALIGGGGDSSPFQTFVFSHSQEAVDKSVENLRKFLLESPELKGKVESYHTSTSESQPQLQLKILRQNANKYGVSAQTIGSVVSSAFSGTSQASVFKEDGKEYDMIIRVPDDKRVSVEDIKRLQVRNKYDKLMFLDALVEITETKSPSSISRYNRQRSVTVLAEPNRNAGVSLGEILTQVSKNTKEWLVEGANYRFTGEADNAKESNGEFLVALATAFVLIYMILAALYESILEPFIIMVTMPLSFSGAFFALGLVHQPLSMFSMIGLILLIGMVGKNATLLIDVANEERKKGLNIQEAILFAGKTRLRPILMTTIAMVCGMLPLALASGDGTAMKSPIGIAMSGGLMISMVLSLLIVPVFYRLLAPIDDKIKRFYQNQKALE

SEQ ID NO: 74208 - DNA, 3099 bp, Pasteurella multocida subsp. multocida str. Pm70
  CDS (1)..(3099): transl_table=11
atgcgatttaccgatatttttattcgacgccctgttttagcggtttctattagcttgctgattattattttaggattacaagcgattgcgaagttagctgtgcgcgaatatcccaaaatgactacaacggtgattaatgtttctacggtatacccgggggcagatgcaagtcttatccaagcgtttattacttcaaaactagaagaagctgttgcacaagccgataacattgattacttatcttcaaaaagtagcccaaataactcgttaattacaattaaaatgaagctaaataccgaaccgaacggggctttagcagacgtgttagcgaaagtgaactctgtacgttcgcaattaccacgggggattgatgatccggtcattacgtcttcgacggggggaacggggatgatgtacatccagtttagctccactaaactggatgctagtcaggtaacagactacattgaacgtgtgattaaacctcaattctttacggttgaaggggtggcggaagtacaaatctttggtgcatcggattatgcgctacggatttggttagatcctgccaaaatggccgcacagaatttatccgcgatggcggtcagaaatgcgttatcttcgaataatgtgcaaacggcggcggggaatgacaatggtttttatgtcacctataaaaataaagtggagacaaccaccaaatcagtggaagagctggggaatctgattatttcctcacaaggcgataagttagtgcgtttacgtgatatcgctgacgtagaattaaataaatcgagtgatagctcaagagcggttgctaatggttttgaatctgtggtgttagcgatcaatccaacttcttcagccaacccacttgttgtggcagaaaatgtgcgtccattgtatgagcaaattaagcaaaatttgccagatagcatgcaggcagaaattctttatgacaccacgatagcaattaatagctcaattgatgaagtaatcaaaaccattttagaggcgacaatcattgttttagtggtgatcacattatttattggttcattgcgtgcaattctcattccggtgattacgattccgatttctttgatcggcgtaatcatgctgttacaggcgtttgatttctccattaatttaatgactttacttgccttaattttggcgatcggactcgttgtggatgacgccatcgtggtgcttgagaacgtggatcgtcacattaaattaggcgaaacacctttccgtgctgccattattggtacacgtgaaatcgccgtgcccgtgatttcgatgaccattgccctcatggcagtttactcgccaatggcattaatggatggcattacgggttctttgtttaaagagttcgctttaaccttggctggtgcggtatttatttctgggatcgtggcgttaaccctttcaccgatgatgagcagtaagttgcttaaaccgcatactgacccaagtaagttggaacaatgcatcgaaaaaatgctcaccaccattaatcatggctataactatgctttaaatctggtgatggcaagccgtcgttgtatgttagcttttgcggcggttatttttgctacgctgcctttcttgtttaatgggttagcgagtgagttaaccccagcagaagataaaggggcgttcatggtgattggtcgtgcaccgtccaatgtcaatgtggattatgtacaagaagcaatgcatgagtatgaacagattttgaaagacacaccggaagtggatttttccatggtgatttcaggggcaatgggaagtaaccaatcctttagtgtggtgacattaaaagattggaaagaacgtacccgtagccaagcggaaatcttagcggagttaaataaaaaatcggcgcatattccagaagtggcgttgacgggatttaacttcccagaaatcaacacgggagagcaaggtccaccaattggttttgtgatcagtactgcgagtggctatgaagatttagccaatgtagcagaaaacttcctacaagaaatgaaaaaatccggtcactttgtttataccgcgttggatttaaaatttgatacggcgcagatgcggattaaagtcgataaagaaaaagcaggtacctatggtgtcacaatgcaacaaatcagtgccacattagggagtttcttgtctgccgccacgattgaacgagttgatattgatggacgtgcttatcgaatcatcatgcaagttaaacggggtgaacgtttgtcaccagaaagtttaaacaactattatgtgacggcaagtaacgggaaatcagtaccattaagcagtttcttaaccatgacgttagaatcacagccaacttctttacctcgttttagccagcttaattcagcggtcattagtgcagttcctctcccaaccaaaagtacaggtgaggcgattgcatggttaaaaatggcagcaaaagagtatttaccgcaaggctataattatgactttactggtgaagcgcgtcagttagtccaagaaggcaatgcattagccgttactttcgtacttgctgtggtgattatcttcttggtcttagcgattcaatttgagtcaattcgtgatccgttagtcattatgatttcggtgccacttgccgtgagtggggcgctattaatgctgaatttcttaggcttcttccgtattccaggaaccagtcttaatatttactcacaggttggtttaatcacgctagtagggttaattactaagcacgggattttgatgtgtgaagtggcaaaagaagagcaattacagcatggtaaaaatcgtattgaagcgattactgaagcagcgaaagtgcgtttacgcccgattcttatgacgaccgctgcaatgattgcaggtcttatcccgctcttgtatgcttcgggcgcaggtgcggtgtcgcgctttagtattgggattgtgattgtatcaggtttagcgattgggacattatttaccctgtttgtgttacctgtgatttatagctatattgcaacggaacataaaccactaccggaatttgatgaaagcataaaaccgttaacggataatagcgcacattaa

SEQ ID NO: 74209 - protein, 1032 aa, Pasteurella multocida subsp. multocida str. Pm70
MRFTDIFIRRPVLAVSISLLIIILGLQAIAKLAVREYPKMTTTVINVSTVYPGADASLIQAFITSKLEEAVAQADNIDYLSSKSSPNNSLITIKMKLNTEPNGALADVLAKVNSVRSQLPRGIDDPVITSSTGGTGMMYIQFSSTKLDASQVTDYIERVIKPQFFTVEGVAEVQIFGASDYALRIWLDPAKMAAQNLSAMAVRNALSSNNVQTAAGNDNGFYVTYKNKVETTTKSVEELGNLIISSQGDKLVRLRDIADVELNKSSDSSRAVANGFESVVLAINPTSSANPLVVAENVRPLYEQIKQNLPDSMQAEILYDTTIAINSSIDEVIKTILEATIIVLVVITLFIGSLRAILIPVITIPISLIGVIMLLQAFDFSINLMTLLALILAIGLVVDDAIVVLENVDRHIKLGETPFRAAIIGTREIAVPVISMTIALMAVYSPMALMDGITGSLFKEFALTLAGAVFISGIVALTLSPMMSSKLLKPHTDPSKLEQCIEKMLTTINHGYNYALNLVMASRRCMLAFAAVIFATLPFLFNGLASELTPAEDKGAFMVIGRAPSNVNVDYVQEAMHEYEQILKDTPEVDFSMVISGAMGSNQSFSVVTLKDWKERTRSQAEILAELNKKSAHIPEVALTGFNFPEINTGEQGPPIGFVISTASGYEDLANVAENFLQEMKKSGHFVYTALDLKFDTAQMRIKVDKEKAGTYGVTMQQISATLGSFLSAATIERVDIDGRAYRIIMQVKRGERLSPESLNNYYVTASNGKSVPLSSFLTMTLESQPTSLPRFSQLNSAVISAVPLPTKSTGEAIAWLKMAAKEYLPQGYNYDFTGEARQLVQEGNALAVTFVLAVVIIFLVLAIQFESIRDPLVIMISVPLAVSGALLMLNFLGFFRIPGTSLNIYSQVGLITLVGLITKHGILMCEVAKEEQLQHGKNRIEAITEAAKVRLRPILMTTAAMIAGLIPLLYASGAGAVSRFSIGIVIVSGLAIGTLFTLFVLPVIYSYIATEHKPLPEFDESIKPLTDNSAH

SEQ ID NO: 74210 - DNA, 3189 bp, Pseudomonas aeruginosa PAO1
  CDS (1)..(3189): transl_table=11
atgaatttctcccaattcttcatccagcggccgatcttcgccgcggtgctgtcgctgctgatcctgattggcggcgccatctccctgttccagctacccatcagcgaatacccggaagtggtgccgccgaccgtcgtggtccgcgccaacttccccggcgccaacccgaaagtcatcggcgagaccgtcgcctctccccttgaacaggcgatcaccggggtggagaacatgctctacatgtcctcccagtcgacctccgacggcaagctgaccctgaccatcaccttcgccctcggcaccgacctggacaacgcccaggtgcaggtgcagaaccgcgtcacccggaccgagccgaagctcccggaagaagtgacccggctcggcatcaccgtcgacaaggcctcgcccgacctgaccatggtcgtgcacctgacctcgccggataaccgctacgacatgctctacctgtcgaactacgcggtgctcaacgtgaaggacgaactggcccgcctcgacggcgtcggcgacgtccagttgttcggcctcggcgactattcgctgcgcgtctggctggacccgaacaaggtcgcctcgcgcaacctcaccgccaccgacgtggtcaacgccatccgcgagcagaaccgccaggtcgccgccggcaccctgggcgcgccgccggcgccgagcgataccagcttccagttgtcgatcaacacccagggtcgcctggtcaccgaggaagagttcgagaacatcatcatccgcgccggcgccaacggcgagatcacccgtctgcgcgacatcgcccgggtcgagctgggctccaaccagtacgccctgcgttcgctgctgaacaacaagccggcggtggcgatcccgatcttccagcgtcccggctcgaacgccatcgagatctccaacctggtgcgggagaagatggccgagctgaagcacagcttcccgcaaggcatggactactccatcgtctacgacccgaccatcttcgtccgcggctccatcgaggcggtggtgcacaccctgttcgaagccctggtgctggtggtgctggtggtgatcctgttcctgcagacctggcgcgcctcgatcatcccgctggccgcggtgccggtgtcgctgatcggcaccttcgcggtgatgcacatgctcggcttctcgctcaacgcgctgtcgctgttcggcctggtgctggccatcggcatcgtggtggacgacgccatcgtggtggtggagaacgtcgagcgcaacatcggcctcggcctcaagccggtggaagccaccaagcgtgccatgcgcgaggtgaccgggccgatcatcgccacggcgctggtgctctgcgcggtgttcatcccgaccgcgttcatctccggcctcaccgggcagttctaccgccagttcgccctgaccatcgcgatctccacggtgatctcggcgttcaactcgctgaccctgtcgccagcgctggcggcggtcctgctcaagggccaccacgagccgaaggaccgcttctcggtgttcctcgacaagctcctcggcagttggctgttccgtccgttcaaccgtttcttcgaccgcgccagccatggctacgtcggcacggtgaaccgggtcctgcgcggcagctcgatcgccctgctggtctacggcggactgatggtgctgacctacttcggcttctccagcacgccgaccggtttcgtcccgcagcaggacaagcagtacctggtggccttcgcccagttgcccgacgcggccagcctggaccgtaccgaggcggtgatcaagcagatgtccgagatcgccctggcgcagcccggcgtggcggactcggtggccttccccggcctgtcgatcaacggcttcaccaacagcccgaacagcggcatcgtgttcaccccgctgaagccgttcgacgagcgcaaggacccgagccagtcggccggggccatcgccgccgcgctgaacgccaagtacgccgacattcaggacgcctacatcgcgatcttcccgccgccgccggtacaggggctggggaccatcggcggcttccgcctgcagatcgaggaccgtggcaaccagggctacgaggagctgttcaagcagacccagaacatcatcaccaaggcccgtgcgctgcctgagctggaacccagctcggtgttctccagctaccaggtcaacgtgccgcagatcgacgccgacatcgaccgcgagaaggccaagacccacggcgtggcgatcagcgacatcttcgacaccctgcaggtctacctcggctcgctgtacgcgaacgacttcaaccgcttcggccgtacctatcaggtcaacgtccaggccgagcagcagttccgcctcgaacccgagcagatcggccagctgaaggtgcgcaacaacctcggcgagatggtcccgctggcgtccttcatcaaggtcagcgacacctccggtccggaccgtgtgatgcactacaacggcttcatcaccgccgaactcaacggcgccccggccgcgggctacagctccggccaggcgcaggcggcgatcgagaagctgctgaaggaggaactgcccaacggcatgacctacgagtggaccgagctgacctaccagcagatcctcgccggcaataccgcgctgttcgtcttcccgctctgcgtgctgctggccttcctcgtgctggccgcccagtacgagagctggagcctaccgctggcggtgatcctgatcgtgccgatgaccctgctgtcggcgatcaccggggtgatcctggccggcagcgacaacaacatctttacccagatcggcctgatcgttctggtggggctggcgtgcaagaacgcgatcctgatcgtcgagttcgccaaggacaagcaggaggaaggcatggaccgcgtcgccgcggtgctggaagcctgccgcctgcgcctgcggccgatcctgatgacgtccatcgccttcatcatgggtgtggtgccgctggtgatctccaccggcgccggcgccgagatgcgccatgcgatgggcgtggcggtgttctccgggatgatcggggtgaccttcttcggcctgctgctgacgccggtgttctacgtcctcatccgccgcttcgtggagaaccgcgaagcgcgccgcgccgccaacgacaaaggcctgccagaggtgcatgcatga

SEQ ID NO: 74211 - protein, 1062 aa, Pseudomonas aeruginosa PAO1
MNFSQFFIQRPIFAAVLSLLILIGGAISLFQLPISEYPEVVPPTVVVRANFPGANPKVIGETVASPLEQAITGVENMLYMSSQSTSDGKLTLTITFALGTDLDNAQVQVQNRVTRTEPKLPEEVTRLGITVDKASPDLTMVVHLTSPDNRYDMLYLSNYAVLNVKDELARLDGVGDVQLFGLGDYSLRVWLDPNKVASRNLTATDVVNAIREQNRQVAAGTLGAPPAPSDTSFQLSINTQGRLVTEEEFENIIIRAGANGEITRLRDIARVELGSNQYALRSLLNNKPAVAIPIFQRPGSNAIEISNLVREKMAELKHSFPQGMDYSIVYDPTIFVRGSIEAVVHTLFEALVLVVLVVILFLQTWRASIIPLAAVPVSLIGTFAVMHMLGFSLNALSLFGLVLAIGIVVDDAIVVVENVERNIGLGLKPVEATKRAMREVTGPIIATALVLCAVFIPTAFISGLTGQFYRQFALTIAISTVISAFNSLTLSPALAAVLLKGHHEPKDRFSVFLDKLLGSWLFRPFNRFFDRASHGYVGTVNRVLRGSSIALLVYGGLMVLTYFGFSSTPTGFVPQQDKQYLVAFAQLPDAASLDRTEAVIKQMSEIALAQPGVADSVAFPGLSINGFTNSPNSGIVFTPLKPFDERKDPSQSAGAIAAALNAKYADIQDAYIAIFPPPPVQGLGTIGGFRLQIEDRGNQGYEELFKQTQNIITKARALPELEPSSVFSSYQVNVPQIDADIDREKAKTHGVAISDIFDTLQVYLGSLYANDFNRFGRTYQVNVQAEQQFRLEPEQIGQLKVRNNLGEMVPLASFIKVSDTSGPDRVMHYNGFITAELNGAPAAGYSSGQAQAAIEKLLKEELPNGMTYEWTELTYQQILAGNTALFVFPLCVLLAFLVLAAQYESWSLPLAVILIVPMTLLSAITGVILAGSDNNIFTQIGLIVLVGLACKNAILIVEFAKDKQEEGMDRVAAVLEACRLRLRPILMTSIAFIMGVVPLVISTGAGAEMRHAMGVAVFSGMIGVTFFGLLLTPVFYVLIRRFVENREARRAANDKGLPEVHA

SEQ ID NO: 74212 - DNA, 3123 bp, Campylobacter jejuni subsp. jejuni NCTC 11168
  CDS (1)..(3123): transl_table=11
atgttttctaaattttttatcgaaagacctgtttttgcttcagttgttgcaattatcatttctttagctggagctataggtcttacaaatttacctatagaacaatatccttctttaacccctcctacagttaaagtaagtgcaacttacacaggagctgatgcacaaaccattgcttcaacagttgcaagtcctatcgaagatgcaatcaatggcgcagataatatgatttacatggattcaacttcaagttcttcaggaactatgagtttgactgtttattttgatatcggtacagatcctgatcaagccaccatagatgttaataatagaatttcagccgcaactgcaaaaatgccagatgcagttaaaaaacttggagtaacagttagaaaaacttcctcaacaacacttgctgcaatttctatgtattcaagtgatggctcaatgagtgcagtagatgtatataactatatcactttaaatgttttagatgagttaaaaagggttccaggagttggagatgcaaacgctataggaaatcgtaattattctttaagaatttggctcaagcctgatttattaaataaatttggaatcacagctactgatgtaatttctgcggttaatgaccaaaatgcccaatacgcaactggtaaaattggcgaagaacctgtaacccaaaaatccccttatgtttattcaatcactatgcaaggaagactacaaaatcctagtgaatttgaaaacattattttaagaacaaataatgatggatcatttttaagacttaaagatgtagctgatgtggaaataggatcacaacaatacagctcacaaggacgattaaatggcaatgatgcagttccaattatgatcaatcttcaatcaggggcaaacgcattgcatacagcagaacttgttcaagctaaaatgcaagaactttcaaaaaattttccaaaaggtttaacatataaaattccttacgatacaacaaaatttgtaatagaatcaatcaaagaagttgttaaaacttttgttgaagctctaattttagttatcattgttatgtatatgttcttaaagaatttccgtgcaacacttattcctatgatagctgtacctgtttcattgttaggaacttttgctggactttatgttttaggttttagtattaacttgcttacgctttttgctttaattttagccatagggatcgttgtagatgatgcgattatagttgtagaaaatattgataggattttacatgaaaatgagcaaataagcgtaaaagatgctgctatccaagcgatgcaagaagttagctctccggttatttcaattgttcttgtgctttgtgctgtttttgtaccagtttcttttatatcaggttttgttggagaaattcaaagacaatttgctcttaccttagctatatctgtaaccatatcaggttttgttgctcttaccttaacaccttctttatgtgcactctttttgcgacgtaatgaaggagagccatttaaatttgtaaagaaatttaatgatttttttgattggagtacctctgtatttagcgcaggagtagcatatattctaaaaagaaccattcgttttgttttaattttttgtattatgcttggggcaattttttatctctataaagctgtaccaagctctttagttcctgaagaagatcaaggtttgatgattggcattatcaaccttccttcggcttcagcactccatagaacaatctcagaagttgatcacataagccaagaagttttaaaaactaatggagttaaagatgcaatggctatgataggatttgatctttttacaagttcactcaaagaaaatgccgctgcaatgtttataggcttgaaagattggaaagatagaaatgtgagtgctgatgaaatcgccatggagcttaataaaaaatttgcttttgatcgcaatgcttcaagtatatttataggcctacctcctatacctggattaagtatcacaggcggttttgaaatgtatgttcaaaacaaaagcggaaaaagctatgatgaaatacaaaaagatgtaaataaacttgttgctgtggccaaccaaagaaaagagctatcaagagtaagaacaacccttgatacaactttccctcaatacaagcttataattgatagagataaattaaaacactacaatcttaacatgcaagatgtttttaacacgatgaatgcaactataggcacttattatgttaatgatttttctatgctaggtaaaaacttccaagtaaatatccgcgcaaaaggtgattttagaaatacacaagatgcattaaaaaatatttttgtaagatcaaatgatggaaaaatgataccacttgattctttcttaactttacaaagaagttcagggcctgatgatgtaaaacgattcaaccttttcccagcggcacaagttcaaggtcaacccgcaccaggttatacttcaggtcaagctatagaagcgattgctcaagtagcaaaagaaactttaggggatgattattccatagcttggagtggatcagcttatcaagaagtttctagtaaaggaacagcaagttatgcttttgctttaggtatgatatttgtctttttaattctagctgcccaatatgaaagatggcttatacctttagcagttgtaacagctgtaccttttgcggtatttggatcatttttattggtatatttaaggggatttagcaatgacatatattttcaaacaggacttttgctcttgattggactttcagctaaaaatgctatcttaatcgtagaatttgcaatggaagagcgctttaaaaaaggcaaaggagtttttgaagcagctgttgcagcagcaaaacttcgttttcgtcctatcataatgacttctttggcatttacttttggggtcttgccaatgattttcgcaacaggagcaggaagtgcttcaagacactctttaggaacagggcttattggtggaatgatcgcagcatcaactttagcgatattctttgtgcctttatttttctatcttttagaaaattttaatgaatggctagataaaaaaagaggtaaggttcatgaataa

SEQ ID NO: 74213 - protein, 1040 aa, Campylobacter jejuni subsp. jejuni NCTC 11168
MFSKFFIERPVFASVVAIIISLAGAIGLTNLPIEQYPSLTPPTVKVSATYTGADAQTIASTVASPIEDAINGADNMIYMDSTSSSSGTMSLTVYFDIGTDPDQATIDVNNRISAATAKMPDAVKKLGVTVRKTSSTTLAAISMYSSDGSMSAVDVYNYITLNVLDELKRVPGVGDANAIGNRNYSLRIWLKPDLLNKFGITATDVISAVNDQNAQYATGKIGEEPVTQKSPYVYSITMQGRLQNPSEFENIILRTNNDGSFLRLKDVADVEIGSQQYSSQGRLNGNDAVPIMINLQSGANALHTAELVQAKMQELSKNFPKGLTYKIPYDTTKFVIESIKEVVKTFVEALILVIIVMYMFLKNFRATLIPMIAVPVSLLGTFAGLYVLGFSINLLTLFALILAIGIVVDDAIIVVENIDRILHENEQISVKDAAIQAMQEVSSPVISIVLVLCAVFVPVSFISGFVGEIQRQFALTLAISVTISGFVALTLTPSLCALFLRRNEGEPFKFVKKFNDFFDWSTSVFSAGVAYILKRTIRFVLIFCIMLGAIFYLYKAVPSSLVPEEDQGLMIGIINLPSASALHRTISEVDHISQEVLKTNGVKDAMAMIGFDLFTSSLKENAAAMFIGLKDWKDRNVSADEIAMELNKKFAFDRNASSIFIGLPPIPGLSITGGFEMYVQNKSGKSYDEIQKDVNKLVAVANQRKELSRVRTTLDTTFPQYKLIIDRDKLKHYNLNMQDVFNTMNATIGTYYVNDFSMLGKNFQVNIRAKGDFRNTQDALKNIFVRSNDGKMIPLDSFLTLQRSSGPDDVKRFNLFPAAQVQGQPAPGYTSGQAIEAIAQVAKETLGDDYSIAWSGSAYQEVSSKGTASYAFALGMIFVFLILAAQYERWLIPLAVVTAVPFAVFGSFLLVYLRGFSNDIYFQTGLLLLIGLSAKNAILIVEFAMEERFKKGKGVFEAAVAAAKLRFRPIIMTSLAFTFGVLPMIFATGAGSASRHSLGTGLIGGMIAASTLAIFFVPLFFYLLENFNEWLDKKRGKVHE

SEQ ID NO: 74214 - DNA, 3204 bp, Neisseria meningitidis Z2491
  CDS (1)..(3204): transl_table=11
atggctaaattttttatcgaccgccctatttttgcgtgggttatttcgattttcattattgcggcgggtattttcggcatcaaaagcctgcctgtttcgcaatatccgtccgtcgccgccccgaccattactttgcacgccacttatccgggtgcgtccgcgcaggtaatggaagacagcgtgctttccgtgatcgagcggaatatgaacggcgtggaaggtttggattatatgtccacttccgccgattcgagcggcagcggcagcgtgagcctgacctttacgcccgataccgacgagaatctggcgcaggtggaagtgcagaacaagctttccgaagtattgagcacgctgccggcaaccgtccagcaatacggcgtaaccgtatccaaggcgcgttccaatttcctgatgattgtgatgctttcgtcggatgtgcagtcaaccgaagagatgaacgactacgcgcagcgtaatatcgttcccgagttgcagcgtatcgaaggcgtggggcaggtacgcctgttcggcgcgcaacgcgcgatgcggatttgggttgatcctaagaaactgcaaaactacaatttgtcgtttgccgatgttggcagcgcgctgtccgcccagaacgtccagatttcagcgggttctatcggttcgcttcccgccgttcgcggacagacggttacggctaccgtaacggcgcaagggcagttgggtacggccgaagaattcggcaacgtcattctccgcgccaataccgacggttctaatgtttacctgaaggatgtggcaagggtcggactgggtatggaagactattcttcctcaacccgtctgaacggtgtaaataccaccggtatggcggtgatgctgtccaacagcggcaatgcgatggcgacggcaaaggcggttaaagaacgcatggcgacgttggaaaaatactttcctcagggtatgagctggaaaaccccttacgatacttccaaattcgtcgaaatttcgattgaaaaagtgattcacactttaatcgaagcgatggtgttggtgtttgtcgtaatgtatctcttcctgcaaaacatccgttatacgctgattccgaccatcgtcgtaccgatttcgctgttgggcggtttcgccttcatctcttatatgggcatgtcgattaacgtactgaccatgtttgcgatggttttggtcatcggcatcgtggtcgatgacgcgattgtggtggttgaaaacgtcgagcgcattatggcggatgaaggcttgccgcccaaagaagcgaccaaaaaagcgatgggtcagatttcgggtgcggtcatcggtattaccgccgttctgatttccgtgttcgtaccgttggcgatgttcagcggggcgacgggcaatatttacaaacagtttgccctgacgatggcgtcatcaatcgcattctccgccttccttgcgctgacccttacccctgctttgtgtgccacaatgttgaagacaatcccgaaagggcatcacgaagagaaaaaaggtttcttcggctggtttaacaagaaattcaatagttggacgcacggttacgaaggccgggttgccaaagtgctgcgtaagactttccgcatgatggttgtctatatcggcttggcggttgtgggcgtgttcctgtttatgcgcctgccgacttcattcctgccgaccgaagaccaaggcttcgtcatggtcagcgtgcaactgcctgcaggagcgacccaagagcgcaccaatgcgactttggcgcaagttacccaactggcgaaaagcattcctgaaatagaaaacatcattaccgtttccggcttcagcttttcgggcagcggtcagaatatggcgatgggttttgccatattgaaagattggaacgagcgtaccgcgcccggcagcgatgccgttgcgattgccggcaagctgacgggtatgatgatggggacgcttaaagacggttttggcatcgccgtcgtcccgcctccgattctggagttgggcaatggttcgggcctgagcatcaacctgcaagaccgcaataataccggccataccgcattgctggcgaagcgcaacgagttgattcagaaaatgcgtgccagcggtttgtttgaccccagcaccgtccgtgctggcggtttggaagactcgccgcagttgaaaatcgacatcaaccgtgccgccgcggcggcgcaaggcatttcgtttgccgacatccgcaccgcattggcaagcgcgctgagttcgtcttatgtcagcgacttcccgaaccaaggccgtctgcaacgcgtgatggtgcaggccgacgaggatgcccgtatgcagcctgccgatattttgaacctgaccgtgccgaacaaatccggcgtcgccgtaccgctttccaccattgctactgtttcttgggaaaacggtacggaacagagcgtacgcttcaacggttatccttcgatgaagctgtccgcttcgcctgcaaccggcgtttccaccgggcaggctatggcggcggttcaaaaaatggttgacgaattgggcggcggttacagcctggagtggggcggacagtcgcgcgaagaggcaaaaggcggctcgcaaaccctgattttgtacggtttggcggttgcagccgtatttttggtacttgccgcgctttatgaaagctggtcgattccgctggcggtcatccttgtgattccgttgggtttgatcggtgcggctgcgggcgtaaccgggcgcaacctgtttgaaggactgttgggcagcgttccctcgttcgccaacgacatctactttcaagtcggtttcgttaccgtgatgggtttgagtgcgaaaaacgcgattttgattatcgagtttgccaaagaccttcaagcgcaagggaaaagcgcggttgaagccgctttggaagcagcccgcctgcgtttccgtccgattatcatgacctcgttcgcctttattttgggcgtggttcccctgtatattgccggcggtgcaagttctgccagccagcgcgccattggtacaaccgtattctgggggatgctcatcggcacgctcttgtccgtgttccttgttccgcttttctatgtggtggtgcgcaaattcttcaaagaaaccgcgcacgaacacgaaatggcagtaaaacacgccgccgaagcgggcattaccggttcggacgacagccaacattaa

SEQ ID NO: 74215 - protein, 1067 aa, Neisseria meningitidis Z2491
MAKFFIDRPIFAWVISIFIIAAGIFGIKSLPVSQYPSVAAPTITLHATYPGASAQVMEDSVLSVIERNMNGVEGLDYMSTSADSSGSGSVSLTFTPDTDENLAQVEVQNKLSEVLSTLPATVQQYGVTVSKARSNFLMIVMLSSDVQSTEEMNDYAQRNIVPELQRIEGVGQVRLFGAQRAMRIWVDPKKLQNYNLSFADVGSALSAQNVQISAGSIGSLPAVRGQTVTATVTAQGQLGTAEEFGNVILRANTDGSNVYLKDVARVGLGMEDYSSSTRLNGVNTTGMAVMLSNSGNAMATAKAVKERMATLEKYFPQGMSWKTPYDTSKFVEISIEKVIHTLIEAMVLVFVVMYLFLQNIRYTLIPTIVVPISLLGGFAFISYMGMSINVLTMFAMVLVIGIVVDDAIVVVENVERIMADEGLPPKEATKKAMGQISGAVIGITAVLISVFVPLAMFSGATGNIYKQFALTMASSIAFSAFLALTLTPALCATMLKTIPKGHHEEKKGFFGWFNKKFNSWTHGYEGRVAKVLRKTFRMMVVYIGLAVVGVFLFMRLPTSFLPTEDQGFVMVSVQLPAGATQERTNATLAQVTQLAKSIPEIENIITVSGFSFSGSGQNMAMGFAILKDWNERTAPGSDAVAIAGKLTGMMMGTLKDGFGIAVVPPPILELGNGSGLSINLQDRNNTGHTALLAKRNELIQKMRASGLFDPSTVRAGGLEDSPQLKIDINRAAAAAQGISFADIRTALASALSSSYVSDFPNQGRLQRVMVQADEDARMQPADILNLTVPNKSGVAVPLSTIATVSWENGTEQSVRFNGYPSMKLSASPATGVSTGQAMAAVQKMVDELGGGYSLEWGGQSREEAKGGSQTLILYGLAVAAVFLVLAALYESWSIPLAVILVIPLGLIGAAAGVTGRNLFEGLLGSVPSFANDIYFQVGFVTVMGLSAKNAILIIEFAKDLQAQGKSAVEAALEAARLRFRPIIMTSFAFILGVVPLYIAGGASSASQRAIGTTVFWGMLIGTLLSVFLVPLFYVVVRKFFKETAHEHEMAVKHAAEAGITGSDDSQH

SEQ ID NO: 74216 - DNA, 3168 bp, Xylella fastidiosa 9a5c
  CDS (1)..(3168): transl_table=11
atgccaaaattttttattgagcacccaatctttgcctgggtggtggcgatcctgatctcacttgcgggtgtgatctcgatcttcaaccttggcgtcgaatcttacccgagcatcgctccaccccaggtgaccatcactgcccattatcctggtgcaagtgcagacacacttgaaaagtcagtcactcaagtgatcgaacagcaactgaccggcattgatcacctgctgtacttcagttccagctcagactccaatgggcaagccacaatcaccctcacttttgaaagcggcaccaacccggatattgcccaagtacaggtccaaaataaggtatcgctagccactccccgccttcccagtgaggtgacccagcaaggtgtggtggtggctaaagctaacgctggcttcctgatggtggtcgcactacgctcagataaccctgcattcgaccgagacgcattgaacgactttgtcggcacacacgtgcttgagcaaatctcgcgagtgcctggtgtcggcagcaccaatcagttcggtgcacagtacgcaatgaatatctggctaaatccagaaaagctgcagggctaccacctgtcggcaagccaggtgtacaacgcaatcagtacccagaatgtgcaatttgctgccggttcaatcggcgctgatccggcaccggccaatcagagcttcaccacaacggtcaccacaaaaggccgcttcactacgcctgagcaattcgaaaatatcatcctacgtactaatagcgacggcagcacagtgcagctgaaagacgtagcgcgcgtcaagataggcgcagagagttatggcattgactctcagtacaacggtaaacccgctggtgcctttggtgtacaactgctgcctggtgccaacgcgttacaggttgttgaaagcatacataccaaaatggacgagctgcaaagcacgtttccgcaaggcgtcacttggttcactccttatgaaagcaccacttttatcaagatatcgatcaaggaagtggtgaaaacgctggccgaagcgattgtcttggtcttccttgtgatgctgatctttctgcagaacttccgtgcaacgatcatcccgaccctggtgattccggtcgccttactcggtacctttgcaggcatgttagcgattggattcactatcaaccaactcaccttatttgcaatggtgctagctatcggcatcgtggtcgatgatgcgatcgtggtaatcgagaatgtcgagcgcatcatgaccgaagaacatttggaacctaaagccgctacgcagaaggcaatgacacaaatcaccggagcggtgatagccatcagcattgtgttgacagcagtatttatcccttctgcgatgcaaccgggggccgctggagcgatttacaaacaatttgcactgacaattgcgatgtcaatgggtttttcagcattcttggcgctcaccttcacgcccgcactatgcgcgagtttcctgaaatctagccacggacaaaataaaaattggatcttccgtacctttgagaagtactacgagaaactctcgcaccgctatgtccgtctcatcagcaacacactcaagcgtactccacgctggacagcattttttgcggtactcgtcgtcctctgtggctttttatttacacggatgccttcaagcttcctgcctgaggaggaccaaggtttcgcgctagcgattgtgcagcttccaccaggagccacaaaaacgcgtacgaacgaagtattcgctcagatgcgcgctgtattggagaaaatgccgtccatcgaagggctcatgcagatcagtggcttcagtttcgttggctcaggtgaaaacgttggaatgggcttcatccgattaaaaccctggcaggaacgtcaggagaccgccgatcaactgattcagcaactgaatggtatgttctacggcatcaagggggcgcaaatctttgtggtcaaccttcccaccgtacaggggcttggccagtttggtggcttcgatatgtggctgcaagaccgcaacggccttggccacgaagcattgactcaagcacgtaatgtggtgctcggcaaagcggcacaacgccaggatgtgatggttggtgtgcgtccgaatgggctggaaaactctcctcagctgcaattgactgttgatcgtgtgcaaggagaatcgatgggtctgtcaaccagcgatatctacaaagcaatccaactgatgctggctccgacctacgtaaacgactatttctctgaaggccgtattaaacgcgtcaacatgcgtgccgatgacatgtaccgcaccagtcctgattcactacgcaatttctacacacccagcagttctgctaccgatgccaatggccaaccattgatgattccgctcagcaacatcgtaaaggccgattgggtatacgcagcaccatcgctcaatcgttataacggttattcggcaatcaatattgttggaaacacagcccctggtacatcatccggacaggcaatgaaggtgttggcaggtatcgttaacgacgatctgccacatgggtttggcattgtttggagcgggatgtcctaccaagagatcctcgctggcaacgcagcaacgttactactggtgttgtctgtcgtcgtggtgttcctatgtttatcagcactttatgaaagttggtcaatcccggtggctgtactgctgatcgtgcccatcggtgtactcggtaccatcgtgttctccatgcttcgcggcttaccgaacgacctgtacttcaaaatcggcatgatcacggtcatcggcttggcagcaaaaaatgcaatcctgattgtggaattcgcagttgcacaacgcgcccttggcaagacattgcgtgaagcgaccattgatgcagcacgtttacgcttccgcccaatcctgatgacatctttagcattcatcctgggtgtgctgccgctagcaatctcaacgggtgctggcgccaacgcccgacatgccattgggactggggtgatcggcggcatgacgttcgcaaccatcctcggggtgatcttcatcccactgctctttgtcgtggtgcgacgcaccatcggcgataggcttgatgaacaatccaaggaataccttaaagcgcaatcaagcagcggccaccttcagaatcgctga

SEQ ID NO: 74217 - protein, 1055 aa, Xylella fastidiosa 9a5c
MPKFFIEHPIFAWVVAILISLAGVISIFNLGVESYPSIAPPQVTITAHYPGASADTLEKSVTQVIEQQLTGIDHLLYFSSSSDSNGQATITLTFESGTNPDIAQVQVQNKVSLATPRLPSEVTQQGVVVAKANAGFLMVVALRSDNPAFDRDALNDFVGTHVLEQISRVPGVGSTNQFGAQYAMNIWLNPEKLQGYHLSASQVYNAISTQNVQFAAGSIGADPAPANQSFTTTVTTKGRFTTPEQFENIILRTNSDGSTVQLKDVARVKIGAESYGIDSQYNGKPAGAFGVQLLPGANALQVVESIHTKMDELQSTFPQGVTWFTPYESTTFIKISIKEVVKTLAEAIVLVFLVMLIFLQNFRATIIPTLVIPVALLGTFAGMLAIGFTINQLTLFAMVLAIGIVVDDAIVVIENVERIMTEEHLEPKAATQKAMTQITGAVIAISIVLTAVFIPSAMQPGAAGAIYKQFALTIAMSMGFSAFLALTFTPALCASFLKSSHGQNKNWIFRTFEKYYEKLSHRYVRLISNTLKRTPRWTAFFAVLVVLCGFLFTRMPSSFLPEEDQGFALAIVQLPPGATKTRTNEVFAQMRAVLEKMPSIEGLMQISGFSFVGSGENVGMGFIRLKPWQERQETADQLIQQLNGMFYGIKGAQIFVVNLPTVQGLGQFGGFDMWLQDRNGLGHEALTQARNVVLGKAAQRQDVMVGVRPNGLENSPQLQLTVDRVQGESMGLSTSDIYKAIQLMLAPTYVNDYFSEGRIKRVNMRADDMYRTSPDSLRNFYTPSSSATDANGQPLMIPLSNIVKADWVYAAPSLNRYNGYSAINIVGNTAPGTSSGQAMKVLAGIVNDDLPHGFGIVWSGMSYQEILAGNAATLLLVLSVVVVFLCLSALYESWSIPVAVLLIVPIGVLGTIVFSMLRGLPNDLYFKIGMITVIGLAAKNAILIVEFAVAQRALGKTLREATIDAARLRFRPILMTSLAFILGVLPLAISTGAGANARHAIGTGVIGGMTFATILGVIFIPLLFVVVRRTIGDRLDEQSKEYLKAQSSSGHLQNR

SEQ ID NO: 74218 - DNA, 3147 bp, Sinorhizobium meliloti 1021
  CDS (1)..(3147): transl_table=11
atgcccagttttttcatagacaggccgatctttgcctgggtggtggcgatcttcatcatgatcgccggcatcatcgctatcccgctcctgccggtttcgcagtatccggatgtcgcaccgccgcagatatcgatcaataccaactatcccggcgcctcgtcgcaggacacctatcagagcgtcacgcggctgatcgaggatgagttgaacggcgtcgaggggctgctttacttcgaatcgtcgaccagctcctccggctcggtctcgatcgacgccaccttccagccgggcaccgatccgagccaggcctcggtcgacatccagaaccgggtgcagcgcgtcgaaccgcgcctgcccgatcccgtcaggcagcaaggcgtacaggtggacgaggccggcgccggcttcctgctgatcatctcgctgacctcgaccgacggttcgatggacgcgatcgggcttggcgattatctcagccgcaacgtgctcagcgaaatccagcgcgtgcccggcgtcggacgcgcccagctcttcgcgaccgagcgctcgatgcgcgtctggctcgatcccgacaagatgctcggcctcaacctgacggcggccgacgtcacggcggcgatccaggctcagaacgcgcagatcgcctccggctcgatcggcgcccagccgaatccgatcacgcagcaagtcaccgctccggtcgtcatcaagggtcagctttcgagcccggaggaattcggtgccatcgtgctcagggcgaatgccgacggctctgccgtgcggctgcgcgacgtcgcgcgcctcgagatcggcggcgaaagctacaccttctccacccgcctcaacggcagcccctcggcggccatcgccgtgcagctctctccgagcggcaacgcgatgtcgacctcggcagcgatcaaggcccgcatggacgagctcgcggagttcttcccggaggggctcgaatattcgatcccctacgacacctcgcccttcgtcgcggtgtcgatcgagaaggtgctgcacaccctcgtcgaggccgtcggcctcgtcttcctggtgatgttcctgttcctgcagaacgtccgctatacgatcattcccaccatcgtcgtgccggtcgccctgctcggcacctgcgcggtcatgctggcgatgggcttctcgatcaacgtgctcacgatgttcggcatggtgctggcgatcggcatcctcgtcgacgatgcgatcatcgtcgtcgagaacgtcgagcgcatcatgtcggaagagggcctgacgccgaaggatgccacccgcaaggcgatgaagcagatcaccggtgcggtgatcggcatcacgctggtgctggcttctgtgttcatcccgatggccttcttcccgggcgccgtcggcgtgatctatcgccagttcagcctgaccatggtcgtttcgatcctgttctcggcgctgcttgcgctctcgctgacgccggcactctgcgcgagcttcctcaaacaggttccgaagggtcaccatcacgccaagcgcggcttcttcggctggttcaatcgcggtttcgaccggacgtcgcacggctacacgcgcgccgtcggaggcatcgtcaggcggaccggccgcttcatggtcatctatctggcgctgcttgccggtctcggctgggcctttctccagcttccttcgtcctttctgccggacgaggaccagggcttcgtcatcgtcatgatgcaattgccttcggaagcgactgcaaaccgcaccacggaggtgatcgagcagaccgagaccatcttcggccaagaaaaggcggtcgacacgatcgtcgcgatcaatggcttctccttcttcggaagcgggcagaatgcggggctcgccttcgtgacgctcaaggactggagcgagcgcgatgcagacaactccgcccagtcgatcgccggtcgcgccaccatggccatgagccagatcaaggacgcgatcagcttcgcgctgtcgcctccggcgatccagggcctcggaacgacgggcggattctccttccgcctccaggaccgtgcgggtctcggccaggcggcactcgccgaagcgcgcgaccagcttctcgacctcgcttcccagagcaaggtcctgaccggggtccgcttcgagggcatgcccgacgcggcgcaggtcagcgtcaatatcgaccgcgagaaggccaataccttcggcgtgacctttgccgacatcaactcgaccatctcgaccaatctcggttcgtcctatgtcaacgacttcccgaatgccggccgcatgcagcgcgtgacggtgcaggcggacgagacgaagcgcatgcagaccgctgacctcctgaacctgaacgtccgcaactccaacggcggcatggttccgctctcggccttcgcggacgtggaatgggtcaaggcgccgacgcagacagtgggctacaacggttacccggcggtccgcatcagcggcgaggccgctcccggctactcctccggcgatgcgatcgccgagatggagcgtctggtggctgagcttcccgcgggcttcggctatgagtggacgggacagtcgctgcaggaaatccagtcgggctcgcaggcgccgctcctgatagcactctcctgcctgctcgtcttcctctgcctggcggcactctatgagagctggtccattccggtctcggtcatcatggtcgtgccgctcggcgtcatcggcgccgtgctcgccgtgacgatgcgcgacatgccgaacgacgtctacttcaaggtcggcctgatcgcgatcatcgggctttcggcgaagaacgcgatcctcatcatcgagttcgccaaggaactccgcgaacagggcaaatcgctcatcgactcgacgctggaggctgcgcatctgcgcttccggccgatcctgatgacctcgctcgccttcaccctcggcgttctgccgctggcgatcgcgacgggcgcaagttccggcagccagcgcgccatcggcacgggcgtcatgggcggcatgatctcggcgacggtgctggcgatcttcttcgtcccggtcttcttcgtgttcgtgatgaagatcttcgaacgcggaagagcggcgccggaggcggctaagcccgcatccgaaaccaccagcccggccgagtaa

SEQ ID NO: 74219 - protein, 1048 aa, Sinorhizobium meliloti 1021
MPSFFIDRPIFAWVVAIFIMIAGIIAIPLLPVSQYPDVAPPQISINTNYPGASSQDTYQSVTRLIEDELNGVEGLLYFESSTSSSGSVSIDATFQPGTDPSQASVDIQNRVQRVEPRLPDPVRQQGVQVDEAGAGFLLIISLTSTDGSMDAIGLGDYLSRNVLSEIQRVPGVGRAQLFATERSMRVWLDPDKMLGLNLTAADVTAAIQAQNAQIASGSIGAQPNPITQQVTAPVVIKGQLSSPEEFGAIVLRANADGSAVRLRDVARLEIGGESYTFSTRLNGSPSAAIAVQLSPSGNAMSTSAAIKARMDELAEFFPEGLEYSIPYDTSPFVAVSIEKVLHTLVEAVGLVFLVMFLFLQNVRYTIIPTIVVPVALLGTCAVMLAMGFSINVLTMFGMVLAIGILVDDAIIVVENVERIMSEEGLTPKDATRKAMKQITGAVIGITLVLASVFIPMAFFPGAVGVIYRQFSLTMVVSILFSALLALSLTPALCASFLKQVPKGHHHAKRGFFGWFNRGFDRTSHGYTRAVGGIVRRTGRFMVIYLALLAGLGWAFLQLPSSFLPDEDQGFVIVMMQLPSEATANRTTEVIEQTETIFGQEKAVDTIVAINGFSFFGSGQNAGLAFVTLKDWSERDADNSAQSIAGRATMAMSQIKDAISFALSPPAIQGLGTTGGFSFRLQDRAGLGQAALAEARDQLLDLASQSKVLTGVRFEGMPDAAQVSVNIDREKANTFGVTFADINSTISTNLGSSYVNDFPNAGRMQRVTVQADETKRMQTADLLNLNVRNSNGGMVPLSAFADVEWVKAPTQTVGYNGYPAVRISGEAAPGYSSGDAIAEMERLVAELPAGFGYEWTGQSLQEIQSGSQAPLLIALSCLLVFLCLAALYESWSIPVSVIMVVPLGVIGAVLAVTMRDMPNDVYFKVGLIAIIGLSAKNAILIIEFAKELREQGKSLIDSTLEAAHLRFRPILMTSLAFTLGVLPLAIATGASSGSQRAIGTGVMGGMISATVLAIFFVPVFFVFVMKIFERGRAAPEAAKPASETTSPAE

SEQ ID NO: 74220 - DNA, 3135 bp, Sinorhizobium meliloti 1021
  CDS (1)..(3135): transl_table=11
atgaatatcggtatgggaggccatcaaccgggtggagggcagggcggaaagacgggtttcaccgcgcttttcatccgccggccgatcttcgccctggtcgtcaacacattgatcgtcgtggctggtcttgccgcctggaatggcgtcgagatccgcgaactgccgcaggtcgaccagccggtggtctcggtcacgaccgagttcgacggcgcctcgccggagacgatcgaccgtgaagtgacctcggtcatcgaaggtgccgtctcgcgcgtgcagggcatcaagggcatttcgtcgtcctcttcgttcgggcgcagccgggtcacgctcgaattctccgacacgaccgatatcggccaggcagccaacgacgttcgcgatgcgctcggccggatcaccggccaattgcctgatgatgccgacgagccgcgcatcgtgaaggcggattccgacagccagccgatcatgcgcctggcattgacctccgacacgatgagcatggacgacatgacgctgctcgtcgagaacgagatcagcgaccgactggcggcggtcgaaggcgttgccgacgtcaccgtctacggcgaccaggagaagattttccgtatcgacctcaaccaggcgaagctcgccggacgcggcgtcaccgtggccaatcttcgcgaggcgctttccgacgcctcctacgatgtgcctgcaggctcgctgacgagcgcaagtcaggacatttccgttcgggcgacggccgatcttcagacgcccgagcaattcgaaaacctcatgctcggcaacaatgtccggcttcgcgacgtggcgaccgtgaccctcggcccggatacgggcacctcggcgctgcgctccaacggccgcgagggtatcggcctcggcatcatccgtcaggcccagtcgaacacggtcgatatttccgaaggcgtgcgcagcgttgtggacgcgatctcctcggatatcctcccgacgggaaccgagctcaagatcaccagcgacgacgcggtgttcatcaacggcgccatccacgaggtggagatcgcactcttcgtcgccgttttcatcgtcaccctcgtcatctatctgttcctgctcgactggcgcgcgacgctcatcccgaccatcaccatgccgatcgcgctgatcggaacggtggccgcgatctatcttgcgggcttctcgatcaacatcctgacgcttctggcgatcgtgcttgcgaccgggctcgtcgtcgatgacgcgatcgtggtgctcgaaaatatcgtgcggcgccgggcggagggcctcggtccgcgcgccgccgccgtgcacggtacgctcgaggtcttcttcgccgtgctcgcaaccacggccacgctggcggccgtgttcgttcctctctccttcctgccggggcagaccgggggcctcttccgtgaattcggcttcgtgctcgccttctcgatcctcctgtcgtccttcgtctcgctgacgctctgtccgatgctcgcctcgcgcatgctgacgaaagagccgcatgagcatgacggggtgatgcagcgcttcggacggcgcgcttccgccttctaccgcgtgacgcttcgcgcctgcctcaatgcgccgctcatcgtcttcgcggtggccgctttctttaccgccgccggcgctctgggcttcctgacgctcaagtcggagctgacgccgaacgaggaccgttcgcaggtcatgctgcggatcaacgcgccgcagggcgtctcgctggaatacacgcaggcacagctacgccgcatcgaagagggcctgcagccgctgctcaaatccggcgagatcagcaatgtgttctcgatttccggccagggcggctcggccaatagcggcttcatggtcctgacgcttgccccgtgggaagagcgcgagcgtacgcagggccagatcgtcgccgacatcaacagggcgacctcgaagatcccgtcggttcgcgccttcaccatccaggcgaacagcctcggtatccggggtgccggcagcggccttcaggtcgcgcttgtcggcaacgattacacgaagctgggcgacgcggcggcgaagctcgtcagggcaatggaggataccggccgtttcgagaatgtgaggctcaactacgaggccaatcaggcgcaattgtcggtgacgatcgaccgcgagcgcgcctccgacctcggcgtggacataggtggcctctcctgggcgctgcaggcgatgctcgacggcagcagcgtcgtcgacatcttcgtggaaggagaagcctatccggtcaagctgctctcttccaccgagccgctcaacgacccgacggacctgcagaacatcttcgtcaaggccggcgacggccgcatcgtgccgatgtcgtcgatcgcaacggtcgaggagaaggcagtggcgccgcagctttcccgcgaatcgcaactgcgcgccgtttcgctctcggcggggctgaaatccgatctcgcactcggcgaggcgctgtcgatggtcgaagagatggccgaaccccttctgccgccgggatcgcgggtcatgccgcttgccgaggccgcgacactggacgagaacgccaacggcctgttcgttaccttcggcttcgcgctcgtcatcatcttcctggtgcttgcggcgcaattcgaaagcttcgtgagcggcctcatcatcatgtcgaccgtgccgctcggtctcgcctgcgccgtcttcgcaatgatcgtgaccggcaacacgctgaacatctacagtcagatcgggctcgtcatgcttgtcggcatcatggccaagaacggcatcctgatcgtagagttcgccaaccagctccgcgaccgggggcaggacgtccgcagtgccatcgagaatgccgccaatatccgtcttagaccggtgatgatgacgatgatcgcgaccgtcgtgggcgcggtaccgctggtgctggcaagcggtgccggcgccgaagcgcgcatcgcgctcggctgggtcctcgtcggcgggttgggcctggcggtggtcgtgacgctctacctgacgccggtcgcctatctggtcattgcccgctttaccaagccgcatgccgacgaggagcggaagctgcaggaggagatgaacgcggccgaggtgctcaagatctga

SEQ ID NO: 74221 - protein, 1044 aa, Sinorhizobium meliloti 1021
MNIGMGGHQPGGGQGGKTGFTALFIRRPIFALVVNTLIVVAGLAAWNGVEIRELPQVDQPVVSVTTEFDGASPETIDREVTSVIEGAVSRVQGIKGISSSSSFGRSRVTLEFSDTTDIGQAANDVRDALGRITGQLPDDADEPRIVKADSDSQPIMRLALTSDTMSMDDMTLLVENEISDRLAAVEGVADVTVYGDQEKIFRIDLNQAKLAGRGVTVANLREALSDASYDVPAGSLTSASQDISVRATADLQTPEQFENLMLGNNVRLRDVATVTLGPDTGTSALRSNGREGIGLGIIRQAQSNTVDISEGVRSVVDAISSDILPTGTELKITSDDAVFINGAIHEVEIALFVAVFIVTLVIYLFLLDWRATLIPTITMPIALIGTVAAIYLAGFSINILTLLAIVLATGLVVDDAIVVLENIVRRRAEGLGPRAAAVHGTLEVFFAVLATTATLAAVFVPLSFLPGQTGGLFREFGFVLAFSILLSSFVSLTLCPMLASRMLTKEPHEHDGVMQRFGRRASAFYRVTLRACLNAPLIVFAVAAFFTAAGALGFLTLKSELTPNEDRSQVMLRINAPQGVSLEYTQAQLRRIEEGLQPLLKSGEISNVFSISGQGGSANSGFMVLTLAPWEERERTQGQIVADINRATSKIPSVRAFTIQANSLGIRGAGSGLQVALVGNDYTKLGDAAAKLVRAMEDTGRFENVRLNYEANQAQLSVTIDRERASDLGVDIGGLSWALQAMLDGSSVVDIFVEGEAYPVKLLSSTEPLNDPTDLQNIFVKAGDGRIVPMSSIATVEEKAVAPQLSRESQLRAVSLSAGLKSDLALGEALSMVEEMAEPLLPPGSRVMPLAEAATLDENANGLFVTFGFALVIIFLVLAAQFESFVSGLIIMSTVPLGLACAVFAMIVTGNTLNIYSQIGLVMLVGIMAKNGILIVEFANQLRDRGQDVRSAIENAANIRLRPVMMTMIATVVGAVPLVLASGAGAEARIALGWVLVGGLGLAVVVTLYLTPVAYLVIARFTKPHADEERKLQEEMNAAEVLKI

SEQ ID NO: 74222 - DNA, 3156 bp, Caulobacter crescentus CB15
  CDS (1)..(3156): transl_table=11
atgctctcgcgtttcttcatcgaccggcccatcttcgcatgggtcatcgccatcgtgatcatgctggccggggcgctcgccatccggaccctgccgatcgcgcaatatcctgaaatcgccctgccgcaggtgtcgatctcggccaactatcccggcgcctcggccaagaccgtcgaggacagcgtcacccaggtcatcgaacagaagatgaagggcctggacggtctggactacatgtcctcgaccagcgacggctcgggctcggccacggtgaccctgaccttcaaggccggcaccgacatcgacatcgcccaggtccaggtccagaacaagctgcagaccgccaccgccctcttgccgcaggaagtgcagcagcaaggcctgacggtcgccaagtcggcgcgcaacttcatgatggtcatcggcctctattccgaggatccgaagaccaccggcgcggatctggccgactacatggcctcgaacctgcaggacccgctgagccgcgtcgacggcgtcggcgacatccagctgttcggctcgcaatatgcgatgcgcatctggctggacccgcagaagctggccagcttcagcctgacgccggccgacgtcgccgccgcgatccgcgcccagaacgcccaggtctcggccggccagatcggcggcacgccgaacctgccgggcacgggcctgaacgccacgatcacggcgcagtcgcgcctgcagacccccgagcagttccgccagatcatcgtcaagaacaccagcggcggcgccaccgtgcgcctgagcgacgtggcccgtgtcgaactgggcgcggaaagctacgcctcgatcgccaagttcaacggctatcaggcggccggcatggccatcaagctggcccccggcgccaacgcgctggataccgccgccgccgtgaacgccaggatggcccagctcgagaagaacttcccagccaactacaagtacgtcattccctatgactcgacgccgttcgtgaagctgtcgatcgaggaagtggtcaagacgctggtcgaggccatcatcctggtgttcatcgtcatgttcctgttcctgcagaactggcgcgcgaccctgatcccgaccatcgccgtgccggtcgtccttctgggcaccttcggcgtgctggccgccttcggctactcgatcaacacgctcaccatgttcggcctggtgctggccatcggccttctggtcgacgacgccatcgtcgtggtcgagaacgtcgagcgcgtgatgagcgaggaaggcctctcgcccaaggaagccacccgcaagtcgatgaacgagatcaccggcgccctgatcggcatcgccctcgttctggcggcggtgttcgtgccgatggccttcttcggcggctcgcagggcgtgatctaccgccagttctcgatcaccatcgtctcggccatggccctgtcggtggtcgtcgccctggtgctgacgcccgccctcaccgccacgatgctgaagccggtcaaggccggtcaccacgaggagaagaccggcttcttcggctggttcaaccgcagcttcaacgacatgtcgtcgcgctatcagggctcggttcgcaagatcctgggcaagcgcggccgctggatggccatctacgccgcgatcatcgtggccatgggcctgctgttcgtccgcctgcccagcgccttcctgcccgaagaagaccaggggaccatgttcaccctggtgcagctgcccgccggcgcgaccgaggagaagaccctggccgtgctggaccaggtgcgcgaccacttcctggtcggcgagaaggaggccgtccagtcggtgttcaccgtctcgggcttcagcttcgccggcgccggccagaacgcgggtctcgccttcgtgcgcctgaaggacttcgagcaccgcaagtcggccaacctgaaggcccaggccgtggccggtcgcgccatgggcgccttcagccagttccgtgacgccatggtgttcgccatcgttccgccggccgtgcaggagctgggcaactcgtccggcttcgacttccagctgcaggacgtcggcggcgtcggccacgaggccctgatgaacgcccgcaacatgatgctgggcatggcctcgcaggatcccagcctggtgggcgtgcgccccaacggccaggacgacaccccgcagctgaagatcgaggtcgaccaggccaaggccggcgcgctgggcctgaccaccgccgacatcaacagcgccctcagcgccgcctggggcgggtcgtacgtcaacgacttcatcgaccgcggccgcgtgaagaaggtctacatgcaggccgacgccccgttccgcatgacgcccgaggacctgaaccgctggtacgtgcgcaacaaccaaggccagatggtcgccttcccggccttcgccacggcgtcgtggacctacggctcgccgcgcctggagcgctacaacggcctgtcgtcggtcaacatccagggcgccccggccccgggcaagagctcgggcgacgcgatcgcggcgatggagaagatcgcggccaagctgccgcccggcgtcggctatgagtggaccggcctgtcggcccaggaactggaggccggcaatcaggcccccgccctgtacgccatctcgatcctggtggtgttcctgctgctggccgcgctttacgagagctggtcgatcccgctggcggtgatcatggtcatcccgctgggcgtcatcggcgccctgctggcgaccttcgcccgtggcctcagcaacgacatctacttccaggtgggcctgctgacgaccatgggcctggcggccaagaacgccatcctgatcgtcgagttcgccaaggacctctacgagaagggcatgggcctgatcgaggccacgctggaggcggttcgcctgcgcctgcgcccgatcatcatgacctcgctggccttcgtcttcggcgtgctgccgctggcgatctccaacggggctggatcgggggcccagcacgcgatcggcaccggcgtcatcggcggcatgatctcggccaccctgctcgccatcttcttcgtcccgctgttcttcgtggtggtcgagaagatcttcaaacccaagcacaacggtcacgacgccgcccaaggccaagtgtcgtcgacggaggctcactga

SEQ ID NO: 74223 - protein, 1051 aa, Caulobacter crescentus CB15
MLSRFFIDRPIFAWVIAIVIMLAGALAIRTLPIAQYPEIALPQVSISANYPGASAKTVEDSVTQVIEQKMKGLDGLDYMSSTSDGSGSATVTLTFKAGTDIDIAQVQVQNKLQTATALLPQEVQQQGLTVAKSARNFMMVIGLYSEDPKTTGADLADYMASNLQDPLSRVDGVGDIQLFGSQYAMRIWLDPQKLASFSLTPADVAAAIRAQNAQVSAGQIGGTPNLPGTGLNATITAQSRLQTPEQFRQIIVKNTSGGATVRLSDVARVELGAESYASIAKFNGYQAAGMAIKLAPGANALDTAAAVNARMAQLEKNFPANYKYVIPYDSTPFVKLSIEEVVKTLVEAIILVFIVMFLFLQNWRATLIPTIAVPVVLLGTFGVLAAFGYSINTLTMFGLVLAIGLLVDDAIVVVENVERVMSEEGLSPKEATRKSMNEITGALIGIALVLAAVFVPMAFFGGSQGVIYRQFSITIVSAMALSVVVALVLTPALTATMLKPVKAGHHEEKTGFFGWFNRSFNDMSSRYQGSVRKILGKRGRWMAIYAAIIVAMGLLFVRLPSAFLPEEDQGTMFTLVQLPAGATEEKTLAVLDQVRDHFLVGEKEAVQSVFTVSGFSFAGAGQNAGLAFVRLKDFEHRKSANLKAQAVAGRAMGAFSQFRDAMVFAIVPPAVQELGNSSGFDFQLQDVGGVGHEALMNARNMMLGMASQDPSLVGVRPNGQDDTPQLKIEVDQAKAGALGLTTADINSALSAAWGGSYVNDFIDRGRVKKVYMQADAPFRMTPEDLNRWYVRNNQGQMVAFPAFATASWTYGSPRLERYNGLSSVNIQGAPAPGKSSGDAIAAMEKIAAKLPPGVGYEWTGLSAQELEAGNQAPALYAISILVVFLLLAALYESWSIPLAVIMVIPLGVIGALLATFARGLSNDIYFQVGLLTTMGLAAKNAILIVEFAKDLYEKGMGLIEATLEAVRLRLRPIIMTSLAFVFGVLPLAISNGAGSGAQHAIGTGVIGGMISATLLAIFFVPLFFVVVEKIFKPKHNGHDAAQGQVSSTEAH

SEQ ID NO: 74224 - DNA, 3144 bp, Caulobacter crescentus CB15
  CDS (1)..(3144): transl_table=11
atgctgtccgacctttccgtccgtcgccctgtattcgccgccgtcgcggcgatcatcctctgtgtcattggtctggcggcctacacctcgctgccgatccgtgagttgccgagcgtcgatccgccggtggtctcggtctcgaccagctatcgcggcgcctcggctgaagtcatcgaagagcgcatcacccaggtgatcgagcgccaggtcgccggcatccagggcatcgaccgggtcaacagctcttcgcgcgacggccgctcgaacatcagcatcacgttcaacctggaccgcgatctggacgcggcggccaatgacgtgcgcgacgccgtcagccgtgtaaccagcaacctgcccgatcaggccgacccgccgcagatcgccaaggccaacgccgacgctgcgccgatcatcatcctgaacctgacctcgacgacgctgaacccgctgcagttggccgactacgccgaccgctatctggtcgagcggatgtcgacggtcgacggcgtggcccaggccaacctgttcggcgccaagatctacgcgatgcggatctggctggacgccaacgagatggccgcgcgcggcgtcacggtggacgatgtcgagagcgcgctcaacgcccagaacctggagttgcccgccggctcgttggaaagcgcggccaaggacttcaccatccgcgtggcgcgcagctacgccacgcctgaagagtttgcgcgcctgccgctacgggccgccaacagctcgggctacgttctgcgtctgggcgacgtggcccggatcgaggaggggcccgatgaacgtcgtcgcctcttccgcggtaacggcatcgatcaggtcggcatcggcctgacccgccagtcgcaggccaatgacgtggccatctccaaggccgtccgcgccgaggttgaggcgatcaaccagaccctgccgcccggcaccaagatggtgatcgccgtcgacaactcggtgttcaccgctgaggccattcacgaggtctggatcaccatgggcctggcgatcggtctggtggtcatggtcaacctgctgttcctgggcagctggcgatcggccctgatcccttcgatcgtcgcgccgatctgcatcctgtcgaccttcatcatcctggcgccgctgggcttctcgctgaacctgctgaccctgctggcgctggtgctggcggtgggtctggtggtcgacgacgccattgtggtggtcgagaacatccagcgccgcgtcgacgatggcgagccgccgctggtcgccgccgagcgcggcacgcgtcaggtgttcttcgccgtcgtggccaccaccgtcgtgctggtgtcggtcttcgcgccgctgatgttcctgcccggttacatcggacgcctgttcgtcgagctggccgtggccatcgccgccgccgtcgccttctcggccctgctggcgctgtcgctgtcgccgatgatggcctcgaagctgctgcggcccgcccatggcgaaggctggctggcgcgacgcgtcaacaagaccatgggcgccttgagcgcgtcctatcgcgcctcgctggagcagatcctcggcggatggtcggcggccgcttccggcgtgctggtggtcttgctggcgggtttcgccgcggtgctgttcgtcagcctgcccaaggaactggtgccggccgaagaccggggccgggtggatgtctcgatctctgcggcggaaggcgcgggctatgactacacgtcggccatcgcgctgaagatcgaaaaggtgctcgacaagtaccgtgaggccggggtttccgagcgcaccatcatgaccatcccgcgctttggcggaaattcgttcaacagcgccaacggcgtcgttgcgctgaagccctggggcgagcgcgacaagaccgccgacgaggtcgcggccgagctgaacaaggagctttccaggttcaccagcgttcgcgccgtggccagcgtgcgtggtcccttccagcggggcggcggcgggggcggcggaggcggcaccaatgtcgacttcatcgcggtcggtaacgactatgtccagctggccaactggctgaagccgatcctggccgaggcgcaggacaatccgggcctggcgcgtccgcgtctggactatgagccgaccgcgccgcgcctgttggtgcagatcgatctcgacaaggccgcgacgctcggggtctcggcccagtcggtcggccgcgcgctggaaaccatgttcggctcgcgccgggcgacgacctacatcaagagcggccaggagtacgatgtcatcctgcagaccaacctggatcagcgtcggagcatcgaggatctgaaccgcctgaacgtgcgcaccaacacgggcgcgatcgtgccgctgtccaccgtggtgaccacggaactgcggggcgacacgccggatcgtccgcgtgtcgaccggctgcgctcggtgaccctgaccgcccagctgaaccccggctacacggtcgaggacgccgtcgcgttcttcaaggatcaggcggcccagcatcccgcgccgggcgtcagcgtcaagtggggcggccaggccaaggactatctggaaggctccggcggcatcgcgatcgccttcggcctcgcgctcctgctggtgttcctggtgctggccgctcagttcgagagctggatccacccggcggtcatcatgctgaccgtacccctagcggcgctgggcgggctgttcggcctgctgatgacgggctcgaccatcaacacctacagccagatcggcctgatcattctgatcggcatcgccaccaagaacggcatcctgatcgtcgagttcgccaaccagttgcgcgacgagggtttgagcgtgcgtgaggcggtgatcgaggcggcggccctgcgtctgcgtccgatcatcatgacctcggtctcggccgcgatgggcgccttgccgctgatgctgtgggcgggcgcaggcgcgggcagccgccagacgatcggggcggtgatcttcaccggcgcgatcttcgccaccctgctgacgctgttcatcgttccggtcttctacgacctcctggcgcgcttcacgaagtcgccggagtggacggcgcgccagatcgaagcgtatgaagcccaggaaaagtcgggtgaggggcaaacctcacccgcataa

SEQ ID NO: 74225 - protein, 1047 aa, Caulobacter crescentus CB15
MLSDLSVRRPVFAAVAAIILCVIGLAAYTSLPIRELPSVDPPVVSVSTSYRGASAEVIEERITQVIERQVAGIQGIDRVNSSSRDGRSNISITFNLDRDLDAAANDVRDAVSRVTSNLPDQADPPQIAKANADAAPIIILNLTSTTLNPLQLADYADRYLVERMSTVDGVAQANLFGAKIYAMRIWLDANEMAARGVTVDDVESALNAQNLELPAGSLESAAKDFTIRVARSYATPEEFARLPLRAANSSGYVLRLGDVARIEEGPDERRRLFRGNGIDQVGIGLTRQSQANDVAISKAVRAEVEAINQTLPPGTKMVIAVDNSVFTAEAIHEVWITMGLAIGLVVMVNLLFLGSWRSALIPSIVAPICILSTFIILAPLGFSLNLLTLLALVLAVGLVVDDAIVVVENIQRRVDDGEPPLVAAERGTRQVFFAVVATTVVLVSVFAPLMFLPGYIGRLFVELAVAIAAAVAFSALLALSLSPMMASKLLRPAHGEGWLARRVNKTMGALSASYRASLEQILGGWSAAASGVLVVLLAGFAAVLFVSLPKELVPAEDRGRVDVSISAAEGAGYDYTSAIALKIEKVLDKYREAGVSERTIMTIPRFGGNSFNSANGVVALKPWGERDKTADEVAAELNKELSRFTSVRAVASVRGPFQRGGGGGGGGGTNVDFIAVGNDYVQLANWLKPILAEAQDNPGLARPRLDYEPTAPRLLVQIDLDKAATLGVSAQSVGRALETMFGSRRATTYIKSGQEYDVILQTNLDQRRSIEDLNRLNVRTNTGAIVPLSTVVTTELRGDTPDRPRVDRLRSVTLTAQLNPGYTVEDAVAFFKDQAAQHPAPGVSVKWGGQAKDYLEGSGGIAIAFGLALLLVFLVLAAQFESWIHPAVIMLTVPLAALGGLFGLLMTGSTINTYSQIGLIILIGIATKNGILIVEFANQLRDEGLSVREAVIEAAALRLRPIIMTSVSAAMGALPLMLWAGAGAGSRQTIGAVIFTGAIFATLLTLFIVPVFYDLLARFTKSPEWTARQIEAYEAQEKSGEGQTSPA

SEQ ID NO: 74226 - DNA, 3135 bp, Sinorhizobium meliloti 1021
  CDS (1)..(3135): transl_table=11
atgaacctgtcggcgcactttatcgatcgcccgcgacttgccaccgtcatcgcggtcgtgatggcgatcgccggtgcgctcgcactcttccagattccgatcgctcagtttccacagatcacgccgcccgaggtgcaggtcaccgccagttatccaggggccaatgcgagcgtcttggaggagagcgtcggagccccgatcgaggaccaggttaacggggtcgaggacatgctttacatgtcgtcctcaagcaccaacaacgggacctactcgctgactgtgaccttcgccgtgggtaccgatccggcactggcgcaagtgaacgtgcagaaccgtgtcgcgctcgcgacaccccggcttcccgcttccgtgacccagacgggggtctccgtaagagcgcgctcgtccagcatgttgatgggtgttgcgatctattcccccgagggaacgcgcgacgagatattcatcagcaactatgccgccaacaatatccgtgatgcgatcgcccgcgtggccggcgtcggggaggccggtatctttggtccgtcatacagcatgcgtatctggatgaacccagaccggatgcaggccctaggcctcaccgccacggatctgacgagcgccatccaggcccagaatgcgcaggcctctgccggccaattggggtctccgcctgcaacatcgggccaacagttgcagctcacaatcatggcccaggggcgtctcgcgaccgaggaggacttctcgaatatcatcgttcgcaccaatacggaaggtgccttagtccgcctccgcgatgtcgcgcgcgtggaactcggcgcgcaatcctacgacacggcgtcgactttcaacggtcaaccgagcgcgacggtcgtggtttaccagagcgccgaggccaatgcgcttgccgtgtcgcgggcagtgctctccgagctcgatcggctttcgcggcagtttcccgaggacgtggcctatgcgatcgtcttcgacacaactgccttcatcaccgaaacgatcaaggagatcgccatcacgcttgcgatcacctttgcgctggtggtcgccgtcacctacttcttcttgcaagactggcgggcgacggtcataccgacactgacgatcccggtatccctgattggcgggtttgccgtcctttatctgctagactactcggccaatacaattacgctcttcgccgtcatcctcgccatcagcctggtcgtcgacgacgcgatcatcgtcgtcgagaacgtaaagcgcttgatggccgaagagcgactgaatgtgcacgacgcgacccgccgtacgatgagccaagtcacgggcccgatcgtggcgaccactctggtccttgcagcccttttcgtgccgatcgcattcgtggccggaattaccgggcagctctaccgtcaattctccgtgacgatcctgatcacgattaccttctcgaccatcaatgcactaacgctcagcccggccttgtgtgtcctcatgctcaggtcaccgcgcgagcagcggtcaggaatttttgggacattcaaccgaggcctcgacttctcgcgcaactggtacgtcgcgatgctcgaccgcatgtcccggcggctctggattgcttcggtaattcttctggcgatccttggcggggtctatggattgttccgcgcgcttccgaccggattcgtgccgagcgaggatcagggatacctttttatcaatgtgcaattgcccaatgccgcttcgctcgagcggacacagcaggcgctggataccgtttcgaggatcttgcaacggacaccaggggttgcgaattctgtcggcattgccggcaatagcatggtgggcggcggcggctcgaacgccggaatggtgattacagcgctgaaaccctggggcgaacgcaggagcgctgaggaaagcatcgacgcgatcatgaatcgtctccgcgccgattttggccggatacccaccgcctccgtcgtgccgttcaacccaccggccataccgggtcttggtacgaccggcggcttcgacctcaggcttcaggcgcgcagcggccagagccagcaggaaattgccgaagtcatgcgcggcctgatcgtcaaggctaaccagacaccaggacttgccagcgtcttcagcaccttctcggccgacgtcccacaggtctttctcaatgtcgaccgccgccgggccgagctcttcggggtttcaaccgcgacgatcttcaacgccatgcaatcccacctcggctcgtcctatgtcgatgatttcaacatcttctcgcgcgtgtaccaggtgcggatccaggatgagccacagttccgcagccgcatcgaggacattcagcgcctgcgggtgcgcagccggaacggagagctcgtgccgctccaatcactgctttccatctccaccagttacgggccgactgcgatcaatcgctacaacctgttcccttcggcctcgatcaacggccaggccgcgacgggaacgagtaccggccaggccctcgccaccatggcgtcgctcgcggagcaaaatctccccgaaggcttcggattcgagtggacgggactggcgctgcaggaagagcaggccggaaaccagaccgccctcattctcctcatgggcctcatcttcacctatctctttctcgtcgggcaatacgaaagctggagtgttccactcgctgtgatgctgtcggtcgctgtcgccgtgctcggcgctctcgtgggtctgatgctcgcctcgatcgacatcaacatatacgcccaaatcggtctggttctactgatcggactcgccgcgaagaacgcgatcctcatcgtcgagttcgccaaggaacggcgcgataaagggatggcgacacctgaagccgcagcggcggggacagcccaacgttttcgccccgtactcatgaccgcaatggcatccatcctcggcgtcatccccctcgtgatcgccaccggggcaggggccggcagccgccgcgccattggcatgaccgtgttcggcggactgctcgtcggtaccgtcgtcgggcttcttttgatccccgtgttctatgtgctggttcagaccgtacgggagcaggccaaggaacgatttttccgcacccgcgcaggacgcaaggcgtaa

SEQ ID NO: 74227 - protein, 1044 aa, Sinorhizobium meliloti 1021
MNLSAHFIDRPRLATVIAVVMAIAGALALFQIPIAQFPQITPPEVQVTASYPGANASVLEESVGAPIEDQVNGVEDMLYMSSSSTNNGTYSLTVTFAVGTDPALAQVNVQNRVALATPRLPASVTQTGVSVRARSSSMLMGVAIYSPEGTRDEIFISNYAANNIRDAIARVAGVGEAGIFGPSYSMRIWMNPDRMQALGLTATDLTSAIQAQNAQASAGQLGSPPATSGQQLQLTIMAQGRLATEEDFSNIIVRTNTEGALVRLRDVARVELGAQSYDTASTFNGQPSATVVVYQSAEANALAVSRAVLSELDRLSRQFPEDVAYAIVFDTTAFITETIKEIAITLAITFALVVAVTYFFLQDWRATVIPTLTIPVSLIGGFAVLYLLDYSANTITLFAVILAISLVVDDAIIVVENVKRLMAEERLNVHDATRRTMSQVTGPIVATTLVLAALFVPIAFVAGITGQLYRQFSVTILITITFSTINALTLSPALCVLMLRSPREQRSGIFGTFNRGLDFSRNWYVAMLDRMSRRLWIASVILLAILGGVYGLFRALPTGFVPSEDQGYLFINVQLPNAASLERTQQALDTVSRILQRTPGVANSVGIAGNSMVGGGGSNAGMVITALKPWGERRSAEESIDAIMNRLRADFGRIPTASVVPFNPPAIPGLGTTGGFDLRLQARSGQSQQEIAEVMRGLIVKANQTPGLASVFSTFSADVPQVFLNVDRRRAELFGVSTATIFNAMQSHLGSSYVDDFNIFSRVYQVRIQDEPQFRSRIEDIQRLRVRSRNGELVPLQSLLSISTSYGPTAINRYNLFPSASINGQAATGTSTGQALATMASLAEQNLPEGFGFEWTGLALQEEQAGNQTALILLMGLIFTYLFLVGQYESWSVPLAVMLSVAVAVLGALVGLMLASIDINIYAQIGLVLLIGLAAKNAILIVEFAKERRDKGMATPEAAAAGTAQRFRPVLMTAMASILGVIPLVIATGAGAGSRRAIGMTVFGGLLVGTVVGLLLIPVFYVLVQTVREQAKERFFRTRAGRKA

SEQ ID NO: 74228 - DNA, 3186 bp, Synechocystis sp. PCC 6803
  CDS (1)..(3186): transl_table=11
atgttcgttgattttttcattaagcgccctgttttctccagcgtttgcgccatcatcattttgctggtggggacgattagcatttttagcttaccgatcgcccaatttccggaagtagccccaaccaccattcaggttagttccaactacagcggggccaatgcggaagtggtggaaagggccgtcaccgacattttggagcggcagatcaacggggtgcaggggatgaggtacatttcctctaccagcagtaacgatggcaccagtagcatcaccgtcacctttgaccggagccagaataaggacattgccgccgtcgatgtgcaaaaccgcgtggctctggcagaaccgcaactgccggaagcagtgagaagaacggggatcagggttaataaagaatccaacgccctactgttgggcatcggcatcactagccccgatggcgagtacgacaacgtttttttgagcaactacgccgatcgctatctggtggatcccatccgtcggctggaaggagtgggggatgtacggatttttggggaaaggctctatgccatgcgcctctgggtagatccaatgaaattagcggcccagcagttgaccatggcggacctgagtcgagctttgcaggaacagaatttacaggtgggggctggacagattggagcagaaccagcacccccaggtcaagaatatcaattggacttgctcgccagtagtcaattagtagaagtaaaagattttgaggacttaattgttaaatccggggccagcggctctgtggttagattcaaagatatcggtcgggtggaattgggggcccaaaactacaatagttttttacgctttcggggcgacgaagcggtggggctaggtatttaccaattgctggatagtaatgcgttggaagtagcccgtttggtgaaagacgaaatggcccgtttggctcaaaactttcccgaaggtattgaatacagcgttgcctttgataccacggaatttgtgcaggagtccctctcggaggtggtggaaaccctgctcattgccgtcgttctggtaatcctggtaattttggtctttctgcaagactggcgatcggccttaattcccgctttaaccattcccctggctttaattggtacttttgcctttgtcaaagtctttaacttttccattaacagtttgaccctgttcggtttaactctggcaacagggttggtggtggacgatgccatcattgtggtggagcaaattagccgttttatcaaagttaaacacgaagatccccaagaagcggcccaggaggccatgggggaactgacgggggcggtcattgccacttctttggtattgatggcagtgtttattccagtggccttttttcctggaacgacgggggctttatatcaacaatttgcccttaccattgctttttccattcttctatctactttcctggccttgacgctgaccccttccctctgcgccctgttactgcgggaaggccaagaaccaccggcctttattgccggatttttcaactggtttaaccgggtactagacattatcaaaaacggttatggcaatgtgttgggcaaattagtcaatctgcgggcatgggtaattggcgtatttgttctgttacttggggccaccgcttggttgtacgtcactgtgcccactgcctttttaccggaggaagaccagggttatttcatcaccattatccaagctccccagggggtttccctgcaatacaccagtagggtaatggcccaggtggaaaaggaattgctagcggtgccagaagtgacggcgacctttgcagtgggaggatttagttttagtggtaatagccccaaccaagggattatttttacccggctcaaaccttggggggaacggactgctcctaatcaatcggtgcaggccatcatcggtcagatgtttggtaaattttcccaaattcccgaagccaatatcattcccattaacccacctcctataaggggtttggggcaatttggtgggtttgatttccagttacaggatttacgggtgaatagtgaactggacaccatggtgggcacgatgggggaaatcctgggggcggccaaccaaaatccggctttaaccagggtatttagtactttccaagctaataatccccagttaattgtcaatgtcaaccgcaacaaggctaaaagcttgggggtgccggtggaccaaattttccaaaccatggaaacggcgttgggttcgagctatgtgaacgactttgttctgcagggccgcacctatcgggtttacctccaggccgatgagcagttccgcagtagcccggaggatattaatagcctttatgttcgcagtgagtccggcaccatgattcccatggctaatttggtcactgtgacccagggggtgggggcaccaattattacccattacaatctcttccgctcgatcgccattacggggtcagctaactttggggtgagtacggggcaagccatgaatgccatggcggcgatcgcccgacaggtcatgccaccggggtttgatttccaatggtcgggtatttctttggaggaaatgggttcccagggccaggctcccctaatttttggcttaggtttgctgtttgtatttttggtactggcggctcagtatgaaaactacattgacccggtgattattctgctcagcgtccccctggctattttgggagctttaacggcccaaagtttacggggtttccccaatgacgtgtactgccaaattggtttggtgatgttgattggtctttccagtaaaaacgccattttaattgtggagtttgctaaccagttacgggcggagggttatcccattgctaaagctgccctggaagcatcaaaggatcgtctccgccccattttaatgaccgccctttccactctatttggtatttttcccttggcgatcgccactggtgcgggggccggtagtcggcaagcattgggtacagcggtatttggcgggatgttggtggccactttcctcagcctatttgtagtgccagttttatacattgtggtcaaaactatcagtggaaggcttttggcacccaaatccaccaaccccgagcctagccccgaaatcgaatcccacaccccagccccagcgtcccaaaggaatagctag

SEQ ID NO: 74229 - protein, 1061 aa, Synechocystis sp. PCC 6803
MFVDFFIKRPVFSSVCAIIILLVGTISIFSLPIAQFPEVAPTTIQVSSNYSGANAEVVERAVTDILERQINGVQGMRYISSTSSNDGTSSITVTFDRSQNKDIAAVDVQNRVALAEPQLPEAVRRTGIRVNKESNALLLGIGITSPDGEYDNVFLSNYADRYLVDPIRRLEGVGDVRIFGERLYAMRLWVDPMKLAAQQLTMADLSRALQEQNLQVGAGQIGAEPAPPGQEYQLDLLASSQLVEVKDFEDLIVKSGASGSVVRFKDIGRVELGAQNYNSFLRFRGDEAVGLGIYQLLDSNALEVARLVKDEMARLAQNFPEGIEYSVAFDTTEFVQESLSEVVETLLIAVVLVILVILVFLQDWRSALIPALTIPLALIGTFAFVKVFNFSINSLTLFGLTLATGLVVDDAIIVVEQISRFIKVKHEDPQEAAQEAMGELTGAVIATSLVLMAVFIPVAFFPGTTGALYQQFALTIAFSILLSTFLALTLTPSLCALLLREGQEPPAFIAGFFNWFNRVLDIIKNGYGNVLGKLVNLRAWVIGVFVLLLGATAWLYVTVPTAFLPEEDQGYFITIIQAPQGVSLQYTSRVMAQVEKELLAVPEVTATFAVGGFSFSGNSPNQGIIFTRLKPWGERTAPNQSVQAIIGQMFGKFSQIPEANIIPINPPPIRGLGQFGGFDFQLQDLRVNSELDTMVGTMGEILGAANQNPALTRVFSTFQANNPQLIVNVNRNKAKSLGVPVDQIFQTMETALGSSYVNDFVLQGRTYRVYLQADEQFRSSPEDINSLYVRSESGTMIPMANLVTVTQGVGAPIITHYNLFRSIAITGSANFGVSTGQAMNAMAAIARQVMPPGFDFQWSGISLEEMGSQGQAPLIFGLGLLFVFLVLAAQYENYIDPVIILLSVPLAILGALTAQSLRGFPNDVYCQIGLVMLIGLSSKNAILIVEFANQLRAEGYPIAKAALEASKDRLRPILMTALSTLFGIFPLAIATGAGAGSRQALGTAVFGGMLVATFLSLFVVPVLYIVVKTISGRLLAPKSTNPEPSPEIESHTPAPASQRNS

SEQ ID NO: 74230 - DNA, 3252 bp, Synechocystis sp. PCC 6803
  CDS (1)..(3252): transl_table=11
atgttgctgagtatctccaacgttttcatcaaaaaccccgtgctgactacggtgtgcaccatcgtgatcatcctcctcggggcgatcgccttacccctcctgcccctggccaaacttccagacatggcccccaaacaggtgcaggtaaccaccaactatgtgggctccgatgcccaaactgcagtggataatgtcaccactgtgctagagcggcagattaacggtacggagcaagtcatttatatgaactccaccaccgacaacactggcactagcaccatcaacgtctatttcccggtggaaatggaccgcaacattgcccaggtactcgtccaaaataacgtggcgatcgccgcttccagtttgccggaagttgtcaaccgccagggggtaacgacccagacccaatccccctctgtcaccattgcctatggggtttactcagaaaacgatgaccagggcaaaccgatctatgacgacatctttgtcagtaactttgttgaccgggtgttgctggatgaaattaaacggattgacggggtgggttcggccattttaattggggcttctgaatatgccatgcgtttttggctagaccccgatgccttggccgctagggacttaaccgcggccgatgttaccaacgccattcggagccaaaacattcaagtgggggtagggggggttaacctgccgccggtcactgatcaacaacgtttccaaattaatgcccgggccctgagtcgctttaccaccccggaagaagcggaacaaattgtcgtcaaagtgggggatgatggtactctcattcgtattaaagatgtggggagggccaccattggtacccaaaactatattcaaactgccctgttcaataacgccccggcagtggcatttgttatctatcaactgcccggtaccaatgccctagacacggccaacatggtcaaggaaaaaatggcggagttacggcccctatttccccctggtctaaatgcagaggtagctttggataacaccctgtttgtgacggcatctttggaagaagcggccctgaccctaattgaagccattttgctggtaattttagtgatttttatcttcctacaaaattggcgtactaccctaatcccagccctggccattcccgtatctttgattggggccatggcctttgccctagcttttggttttagcttgaaccagttgaccctgtttggggtaattctggccactggtctcgtggtggatgacggtattttggtggtggaggcgatcgaggtaaaactggatcaaggcatgaagccattccaggccgccctagatgccatgggggaactaacgggagccgtaatttccacctctttggtgttgatggctgtgttcatccctgtgacattcttcccaggtactacggggattgtttataagcaatttgctgtaattatggcttcggcggtagcggtatctacttttaatgccatcagtttttcccctagtatgtccgccattttaatgcggcccaaaaaagaggtccatggccccctcgcttggtttttcaatctttttaaccgcacctttgactggttaaaggaacgctacggcaatattatcacggcaattttaaaggtcagactgctggctattcccatttttattggcagtttaatcctcacagtaattgtctataacatcacccccactgggtttattcccgaagaagatcaggggtattttttcatgttgggcaactcccccgccggtgtgtctattgagtacactaaagatgtgatttcccaagcaacggaaattgtctccgctcgcccagaggtggaacatgtgctgggtatggggggctttagctttttaggcaatgacagtagtaaatccctctttttcgtcaagctgaaaaattgggacgaacgccccgggcaaaaggggtctgtgttcggtctgttggcagaaattaaccgagagttagctcaaaaaattcccgatgcccaggtgtttgccgttaatgctcccccggtggacggccttagtagcacagggggtctggatttttacatccaaaaccggggtggtatgcccctggaaaatttcttggactatgtccagcaatatatggaaaagctgcgccaggaaccggctctcaatccccgtacggtttttacccaatttacctttaatgctcccttgttagaaattggggtggatcgggaaaaggccaatgcccaaaatgttgatatttcggaggtgttcaacaccattggtatttacatggggtctagctatatcaaccaatttgtgatggaaagccggctttatcaggtgtatgccatggccgatgggcaattccgttctaatccccgggatattggtcgcctttatgtccgttcccgcactggggctttagttcagctcagcaatttaattgatgttaaacaaaccacctatcccccgattctgaccaatttcaatatttatccggcggtggatgtccaggcttctccggcggcgggctacagtacggggcaagccatggcaaccatggaaaggttgtctaaggagatgttccccgattccattggttatgcctggtatggtacgggctatgaagaattgcaatcggcgggggcggctccgatcatttttggtttagccttcatcatggtgttcctggtactctcagcccagtacgaaagttacgtggatcccgccattatcatgatgactgttcccctagctattctcggggcgatcggggcgattttactgcgggccaactttatggtagccaccaacatggtttggcccacggtaaacaacaatgtttacgcccaggtagccttggttatgttaattggtctagctagtaaaaacgccattttgattgtggaatttggtaatcaggctatggatttgggcatgaaaattccccaggcggcggcttttgcggccaaggaaaggatgcgaccgattctgatgaccgccatttccgggctggtgggtttttggcccttggtaattgcttctggggcgggggcgatgagccgctggtccttgggaacggctatttttggtggttatctaatttccaccattcttagtttgttcctagtgccggtgctctatacccttgtcaaagaggctgaggctcgctttttgaagggggagaaaggggaaggtgattctaatccaccccctccctccggggaagataatggggagcctgttaataaccccagctag

SEQ ID NO: 74231 - protein, 1083 aa, Synechocystis sp. PCC 6803
MLLSISNVFIKNPVLTTVCTIVIILLGAIALPLLPLAKLPDMAPKQVQVTTNYVGSDAQTAVDNVTTVLERQINGTEQVIYMNSTTDNTGTSTINVYFPVEMDRNIAQVLVQNNVAIAASSLPEVVNRQGVTTQTQSPSVTIAYGVYSENDDQGKPIYDDIFVSNFVDRVLLDEIKRIDGVGSAILIGASEYAMRFWLDPDALAARDLTAADVTNAIRSQNIQVGVGGVNLPPVTDQQRFQINARALSRFTTPEEAEQIVVKVGDDGTLIRIKDVGRATIGTQNYIQTALFNNAPAVAFVIYQLPGTNALDTANMVKEKMAELRPLFPPGLNAEVALDNTLFVTASLEEAALTLIEAILLVILVIFIFLQNWRTTLIPALAIPVSLIGAMAFALAFGFSLNQLTLFGVILATGLVVDDGILVVEAIEVKLDQGMKPFQAALDAMGELTGAVISTSLVLMAVFIPVTFFPGTTGIVYKQFAVIMASAVAVSTFNAISFSPSMSAILMRPKKEVHGPLAWFFNLFNRTFDWLKERYGNIITAILKVRLLAIPIFIGSLILTVIVYNITPTGFIPEEDQGYFFMLGNSPAGVSIEYTKDVISQATEIVSARPEVEHVLGMGGFSFLGNDSSKSLFFVKLKNWDERPGQKGSVFGLLAEINRELAQKIPDAQVFAVNAPPVDGLSSTGGLDFYIQNRGGMPLENFLDYVQQYMEKLRQEPALNPRTVFTQFTFNAPLLEIGVDREKANAQNVDISEVFNTIGIYMGSSYINQFVMESRLYQVYAMADGQFRSNPRDIGRLYVRSRTGALVQLSNLIDVKQTTYPPILTNFNIYPAVDVQASPAAGYSTGQAMATMERLSKEMFPDSIGYAWYGTGYEELQSAGAAPIIFGLAFIMVFLVLSAQYESYVDPAIIMMTVPLAILGAIGAILLRANFMVATNMVWPTVNNNVYAQVALVMLIGLASKNAILIVEFGNQAMDLGMKIPQAAAFAAKERMRPILMTAISGLVGFWPLVIASGAGAMSRWSLGTAIFGGYLISTILSLFLVPVLYTLVKEAEARFLKGEKGEGDSNPPPPSGEDNGEPVNNPS

SEQ ID NO: 74232 - DNA, 3168 bp, Salmonella typhimurium LT2
  CDS (1)..(3168): transl_table=11
atgaaattcacccactttttcattgcacgccccatcttcgccatcgtcctgtcgctgttaatgctgctggctggcgctatcgcctttttaaaactgccgctgagtgaatatccggccgttacgccgcccacggtacaggttagcgccagctaccccggcgctaacccgcaagtgattgccgatacggtagccgcgccgctggaacaggtgatcaacggcgttgacggcatgttgtatatgaatacccagatggccattgatggtcgcatggttatctctatcgccttcgaacagggaaccgatcctgatatggcgcaaattcaggtgcaaaaccgggtatcccgcgcgctgcctcgcctgcccgaagaagtccagcgaattggcgttgtaacggagaaaacgtcccccgatatgttgatggtggttcatcttgtctcgccgcaaaaacgctatgactcgctttacctgtctaacttcgccatccggcaggttcgcgacgaactggcccgtttacccggcgtcggcgatgttctcgtctggggcgcgggcgagtacgccatgcgcgtctggctggacccggcgaaaatcgccaaccgcggtcttaccgccagtgatatcgttacggcgttgcgggaacaaaacgtacaggtcgccgccggttccgtcgggcaacagccggaggcctccgccgcttttcagatgacggtaaacacgctgggccgcctgaccagcgaagaacagttcggcgagattgtggtaaaaatcggcgctgacggcgaggtgacgcgtctgcgtgatgtcgcccgcgtcacgctgggcgcagatgcctatacgctgcgcagtttactgaatggcgaagcggcgccagcgttacagattattcaaagtccgggcgccaatgcgattgacgtttctaacgcgattcgcggcaaaatggatgagttgcagcaaaacttcccgcaggatatcgaataccggattgcctatgatcctacggtcttcgtgcgcgcatcgctacaatcggtggcgattacgttgctggaagccctcgtgctggtcgtccttgtcgtggtgatgttcctgcaaacctggcgggcgtccattattcctctggtggcggttcccgtttcgctggtcggcacctttgccttgatgcacctgtttggcttttcgctgaatacgctttcgctgtttggtttggtcctgtcgataggtatcgttgtcgatgacgccatcgttgtggtcgaaaacgtggaacggcatatctcgcagggcaaaagtcccggagaggcggcaaagaaggcgatggatgaagtcactggtcccattctttctattacctcggtgctaacggcggtctttatcccttccgcattcctggcgggcctgcagggtgagttttatcgtcagttcgcgttgaccatcgctatttcgaccatcctttcggccattaactcgctgacgctctcccctgcgctggctgccattttgctaagaccgcaccacgatactgcgaaggctgactggctaacgcggttgatgggcacggtcactggcggttttttccatcgctttaaccgtttcttcgacagcgcgtcgaaccgctatgttagcgccgtccgtcgggccgtgcgcggcagcgtcattgtgatggtgctctatgctggctttgtggggctgacctggcttggcttccatcaggtgccgaacgggtttgtgcctgcgcaggataaatactatctcgtcggcatcgcccagctcccaagcggcgcatcgttggatcgcacagaggcggtcgtgaaacagatgtccgctatcgcgctggcggaacccggcgttgaaagcgtcgtcgtcttccccggtctgtcggttaacggcccggtaaatgtgccaaattcggcgctgatgttcgccatgctgaaaccctttgacgagcgtgaagatccttcgctttccgctaacgctatcgccggaaagctaatgcacaaatttagccacattcccgacggatttattggcatcttcccgccaccgccggttccagggcttggcgcgacgggcggctttaaattgcagattgaagatcgtgcggaactgggatttgaagcgatgacaaaggtgcaaagcgagattatgtctaaggcgatgcagacgcccgaactggccaatatgctggccagtttccagacaaacgccccgcaattacaggtggatatcgaccgggtaaaggcgaaatcaatgggggtatcgctcaccgacatctttgaaacgttgcaaattaacctcggctcgctttacgtcaacgatttcaaccgatttggccgtgcctggcgggtgatggcgcaggccgatgcgccattccgtatgcagcaagaggatatcggcctgcttaaagtccgcaatgcgaagggcgagatgatcccgcttagcgctttcgtcacgattatgcgccagtcggggccggacagaatcatccattacaacggcttcccctcggtagatattagcggtggaccggctccgggcttctcctccggacaggcgacggacgcgattgaaaagatcgtgcgtgaaacgttaccggaagggatggtcttcgaatggaccgatctggtttatcaggaaaaacaggccggcaactctgcgcttgctatctttgcgctggcggtgctgctggccttcctgatcctggcggcgcagtacaacagttggtcgctgcccttcgccgtcctgcttattgcgcctatgtcattactctcagccattgtcggcgtgtgggtatctggcggagataacaatatctttacgcagattggtttcgtggtgctggtcggcctggcggccaagaacgccattttgattgtcgagtttgcccgcgccaaagaacacgacggcgcagacccgctgaccgccgtactggaagcgtcccgcctgcgtctgcgtcctatcctgatgacctcattcgcctttatcgcaggtgtagtaccactggtactcgcgacgggtgccggcgcggaaatgcgacatgcgatgggcatcgccgtgtttgccggcatgttgggcgtcacgctcttcggcctgttattgacgcctgtattttacgtggtggttcgcaggatggcattaaagcgtgagaaccgcgttgattcgcatgatcagcaagcataa

SEQ ID NO: 74233 - protein, 1055 aa, Salmonella typhimurium LT2
MKFTHFFIARPIFAIVLSLLMLLAGAIAFLKLPLSEYPAVTPPTVQVSASYPGANPQVIADTVAAPLEQVINGVDGMLYMNTQMAIDGRMVISIAFEQGTDPDMAQIQVQNRVSRALPRLPEEVQRIGVVTEKTSPDMLMVVHLVSPQKRYDSLYLSNFAIRQVRDELARLPGVGDVLVWGAGEYAMRVWLDPAKIANRGLTASDIVTALREQNVQVAAGSVGQQPEASAAFQMTVNTLGRLTSEEQFGEIVVKIGADGEVTRLRDVARVTLGADAYTLRSLLNGEAAPALQIIQSPGANAIDVSNAIRGKMDELQQNFPQDIEYRIAYDPTVFVRASLQSVAITLLEALVLVVLVVVMFLQTWRASIIPLVAVPVSLVGTFALMHLFGFSLNTLSLFGLVLSIGIVVDDAIVVVENVERHISQGKSPGEAAKKAMDEVTGPILSITSVLTAVFIPSAFLAGLQGEFYRQFALTIAISTILSAINSLTLSPALAAILLRPHHDTAKADWLTRLMGTVTGGFFHRFNRFFDSASNRYVSAVRRAVRGSVIVMVLYAGFVGLTWLGFHQVPNGFVPAQDKYYLVGIAQLPSGASLDRTEAVVKQMSAIALAEPGVESVVVFPGLSVNGPVNVPNSALMFAMLKPFDEREDPSLSANAIAGKLMHKFSHIPDGFIGIFPPPPVPGLGATGGFKLQIEDRAELGFEAMTKVQSEIMSKAMQTPELANMLASFQTNAPQLQVDIDRVKAKSMGVSLTDIFETLQINLGSLYVNDFNRFGRAWRVMAQADAPFRMQQEDIGLLKVRNAKGEMIPLSAFVTIMRQSGPDRIIHYNGFPSVDISGGPAPGFSSGQATDAIEKIVRETLPEGMVFEWTDLVYQEKQAGNSALAIFALAVLLAFLILAAQYNSWSLPFAVLLIAPMSLLSAIVGVWVSGGDNNIFTQIGFVVLVGLAAKNAILIVEFARAKEHDGADPLTAVLEASRLRLRPILMTSFAFIAGVVPLVLATGAGAEMRHAMGIAVFAGMLGVTLFGLLLTPVFYVVVRRMALKRENRVDSHDQQA

SEQ ID NO: 74234 - DNA, 3150 bp, Salmonella typhimurium LT2
  CDS (1)..(3150): transl_table=11
atgcctaatttctttatcgatcgccctatatttgcgtgggtgatcgccatcatcatcatgttggcaggggggctcgcgatcctcaaattgccggtagcgcaatatccgacgattgcgccaccagcagtgacgatctccgcaacctaccctggcgctgatgcgaaaacggtacaggataccgtcacgcaggttatcgaacagaatatgaacggtatcgataacctgatgtatatgtcctccaacagtgactccacggggaccgtgcagatcacgctgacctttgaatccggcaccgatgcggatatcgcgcaggttcaggttcagaacaagttgcaactggcaatgccgttacttccccaggaagtacagcaacagggcgtgagcgttgagaagtcctcaagtagcttcctgatggtagtgggcgtcattaacaccgacggcaccatgacccaggaggatatttcggattacgttgccgccaatatgaaagatccgatcagccgtacctctggggtgggcgacgtccagctgtttggttcgcaatatgcgatgcgtatctggatgaatccgacagagctgaccaaataccaactgacgccggtcgacgtgattaacgcgatcaaagcgcagaacgcccaggtcgcggcaggtcagctcggtggtacgccgccggttaaaggccagcagcttaacgcatcgattattgcccaaacgcgtctgacctcaacggatgagtttggcaaaatcctgctgaaagtgaatcaggatggctcccaggttcgtctgcgggatgtagcgaaaattgagcttggcggcgagaactacgacgtcattgcgaaatttaacggtcagccagcgtcaggtcttggcatcaaactggctaccggcgccaacgcgctggataccgctaccgctattcgtgccgaactgaaaaaaatggaaccgttcttcccgccagggatgaaaatcgtctacccgtatgacaccacgccgttcgtgaagatctctattcatgaagtggtaaaaacgctggtcgaagcgattatcctcgtgttcctggtgatgtacctgttcctgcagaacttccgcgcgacgttgattccgactattgcggttccggtggtgttgttgggaacctttgccgtgcttgcggcattcggtttctcgataaacacgctgacgatgttcgggatggtgctcgccatcggcttgctggtggatgacgccatcgtggtggtcgagaacgtcgaacgtgttatgacggaagaaggccttccgccgaaggaagcgacgcgcaaatccatgggccagattcagggcgcattggtgggtatcgcgatggtactgtcggcggtatttattccgatggccttctttggcggctcaaccggggcaatttatcgtcagttctctatcaccatcgtatcggcgatggcgctgtcggtgctggtcgcgctgatcctgacgcctgcgctgtgcgcgacgatgctcaaacccgtcgccaaaggcgatcatggcgaagggaaaaaaggctttttcggctggtttaaccgcctgtttgataagagcacgcatcactacaccgatagcgtaggcaatattctgcgcagcaccgggcgttatctgctgctctatctcattatcgtcgtcggtatggcttatctgttcgttcgtctgccaagctctttcttgccggatgaagaccagggcgtattcctgacaatggtccagctccccgcgggcgcaacgcaagagcgcacgcaaaaagtgctggatgaggtcacggattactatctgaacaaagagaaagccaacgttgaatcggtattcgccgtcaacggcttcggttttgcagggcgcggtcagaataccggtattgcattcgtgtcgttgaaagactgggccgatcgtccaggcgaaaaaaacaaggttgaagcgattacccagcgggcaaccgcagcgttttcacaaattaaagatgcgatggtcttcgcctttaacctgccggcgatcgttgagctgggcaccgcaaccggctttgacttcgagttgattgaccaggcgggacttggtcatgaaaaactcacccaggcacgtaatcagttgttcggcgaggtggcgaaatatcctgatctgctggtcggcgttcgacctaacggtctggaagatacgccgcagtttaaaatcgatatcgaccaggaaaaagctcaggcgctgggcgtatctattagcgacattaataccacgctgggcgcagcatggggcggcagctatgtaaacgactttatcgatcgcggtcgtgtgaagaaagtttacgtgatgtccgaagcgaaataccgcatgttgccggatgatattaacgactggtacgttcgtggtagcgatggtcagatggtgccattctccgcattctcctcttcccgctgggaatatggttcgccgcgtctggaacgctataacggtctgccttcgatggaaattctggggcaggcggcgccaggcaagagtaccggtgaagcgatggcgatgatggaagaactggccagcaagctgccgtcaggcattgggtatgactggaccgggatgtcctaccaggagcggttgtccggcaaccaggcccctgccctgtatgctatatcgctgatcgtcgtcttcctgtgtctggcggcattgtatgagagctggtctatcccgttctccgtaatgctggttgttccgcttggggttatcggcgcgctgctggctgcgaccttccgcggactgactaacgacgtttacttccaggtgggcctgctcacaaccattgggttgtcggcgaagaacgcgatacttatcgtcgaattcgccaaagacttaatggataaagaagggaaaggtctggtagaagcgacgctggaggccgtccggatgcgtttgcgcccgattctgatgacctcgttagcgttcatgctgggggttatgccgctggttatcagttccggcgcgggttccggcgcgcagaatgcggtaggtactggcgtactgggcgggatggtaacggcaaccgtactggctattttcttcgtaccggtcttcttcgtggtggtacgccgccgctttagccgtaaaagcgaagatattgagcatagtcattcgacagaacatcgctga

SEQ ID NO: 74235 - protein, 1049 aa, Salmonella typhimurium LT2
MPNFFIDRPIFAWVIAIIIMLAGGLAILKLPVAQYPTIAPPAVTISATYPGADAKTVQDTVTQVIEQNMNGIDNLMYMSSNSDSTGTVQITLTFESGTDADIAQVQVQNKLQLAMPLLPQEVQQQGVSVEKSSSSFLMVVGVINTDGTMTQEDISDYVAANMKDPISRTSGVGDVQLFGSQYAMRIWMNPTELTKYQLTPVDVINAIKAQNAQVAAGQLGGTPPVKGQQLNASIIAQTRLTSTDEFGKILLKVNQDGSQVRLRDVAKIELGGENYDVIAKFNGQPASGLGIKLATGANALDTATAIRAELKKMEPFFPPGMKIVYPYDTTPFVKISIHEVVKTLVEAIILVFLVMYLFLQNFRATLIPTIAVPVVLLGTFAVLAAFGFSINTLTMFGMVLAIGLLVDDAIVVVENVERVMTEEGLPPKEATRKSMGQIQGALVGIAMVLSAVFIPMAFFGGSTGAIYRQFSITIVSAMALSVLVALILTPALCATMLKPVAKGDHGEGKKGFFGWFNRLFDKSTHHYTDSVGNILRSTGRYLLLYLIIVVGMAYLFVRLPSSFLPDEDQGVFLTMVQLPAGATQERTQKVLDEVTDYYLNKEKANVESVFAVNGFGFAGRGQNTGIAFVSLKDWADRPGEKNKVEAITQRATAAFSQIKDAMVFAFNLPAIVELGTATGFDFELIDQAGLGHEKLTQARNQLFGEVAKYPDLLVGVRPNGLEDTPQFKIDIDQEKAQALGVSISDINTTLGAAWGGSYVNDFIDRGRVKKVYVMSEAKYRMLPDDINDWYVRGSDGQMVPFSAFSSSRWEYGSPRLERYNGLPSMEILGQAAPGKSTGEAMAMMEELASKLPSGIGYDWTGMSYQERLSGNQAPALYAISLIVVFLCLAALYESWSIPFSVMLVVPLGVIGALLAATFRGLTNDVYFQVGLLTTIGLSAKNAILIVEFAKDLMDKEGKGLVEATLEAVRMRLRPILMTSLAFMLGVMPLVISSGAGSGAQNAVGTGVLGGMVTATVLAIFFVPVFFVVVRRRFSRKSEDIEHSHSTEHR

SEQ ID NO: 74236 - DNA, 3114 bp, Salmonella typhimurium LT2
  CDS (1)..(3114): transl_table=11
atggcaaacttttttattagacgtcctattttcgcctgggttctggccattatcctgatgatggctggcgcactggcaataatgcaacttcccgttgcgcagtatccaaccattgcgccgccagcggtttctatttctgcaacctatcctggcgcggatgcgcagacggtacaggatacggttactcaggttatcgaacaaaatatgaacggtatcgataacctgatgtatatgtcctctaccagcgactctgctggtagcgtgaccatcaccctgaccttccagtccggaaccgatccggatatcgcgcaggttcaggtgcaaaataaattgcagctcgccacgcctttactgccgcaagaagtccagcagcaggggattagcgttgaaaaatccagcagcagctttttgatggtcgccgggttcgtctcagataatccgaacactacccaggacgacatctctgactatgtcgcctctaacattaaggattctatcagccgtctgaatggtgtgggcgacgttcagctatttggcgcacagtacgccatgcgtatctggctggatgcgaatctgctaaataaataccagctcacgccagttgacgtcatcaaccagttaaaagtacagaacgaccagattgcggcaggccaactgggcggcacgccagcattaccgggccagcagcttaacgcctcaatcatcgcccaaacgcgtctgaaagatccggaagagttcggcaaagttacgttgcgcgtcaataccgacggctctgtcgtccatctcaaagatgtcgcgcgtattgagcttggcggtgaaaactataacgttgtagcgcgcattaacggtaaaccggcctccggtctcggtattaaactggcgaccggcgctaacgcgctggataccgcaaccgcaatcaaagtgaaactggcggagctgcagcctttcttccctcagggaatgaaggtggtttatccttatgacacaacgcccttcgtaaaaatatctatccacgaagtggtaaaaacgctgtttgaagcgattattctggtgttcctggtaatgtatctgttcttacagaatatccgggcaaccctgattcctaccatcgctgttcctgtcgtgttgctaggcacttttgcggtactcgccgcctttggctattccatcaataccctgacgatgtttggtatggtactggcgatagggctgttggttgacgatgcgatagtggtcgtagaaaacgttgaacgtgtaatgatggaggataacctttctccccgagaggcgacggaaaaatccatgtcgcagattcagggagcgctggttggtatcgcgatggtactgtctgcggtatttatcccgatggccttttttggcggctcgaccggggcaatttatcgccagttctctattactattgtttcagcaatggcgctatccgttctggttgcgttgattctgacgccagcactgtgcgctacgctgcttaaacccgtatctgctgaacatcacgagaaaaaaagcggcttctttggctggttcaataccaggtttgaccacagcgttaaccactatactaacagcgtaagcggcatcgtgcgtaatacgggtcgctatctcattatctatctacttattgtagtcggaatggcggttctgtttttacgcctcccgacctccttcctgccggaagaagatcagggagtattcctgaccatgattcagctcccctctggcgctacgcaagaacgtacgcagaaagtgctggatcaagtcactcattactacctgaataatgaaaaagcgaacgtcgaaagcgtgtttaccgtaaacggctttagctttagcggtcagggacaaaactcagggatggcatttgtcagccttaaaccctgggaagagcgtaacggtgaagaaaatagcgtcgaagccgttatcgccagagcgacacgcgcctttagccagattcgcgacgggttggtgttccccttcaacatgccggcaattgtcgagttaggtaccgcaacaggtttcgacttcgaactgattgatcagggaggactcggtcacgatgcgttaacaaaagcgcgtaatcaactcctgggtatggtcgcgaagcatcctgatctattagtgcgcgtacgcccgaacgggctggaagacacgccacagttcaagctggatgtcgatcaagaaaaagcgcaggcgctcggcgtttcgctgtctgatatcaacgaaaccatctccgcggcgttgggcggctattacgttaacgactttatcgatcgcggacgagtgaaaaaagtatacgttcaggctgacgctcagttccgtatgctgccgggagatatcaacaatctttatgttcgcagcgctaatggcgagatggtgcccttctctacctttagctcagcacggtggatttatggttcgccacgcctggaacgctataacgggatgccgtcaatggaactgctcggcgaagcagcacccggacgaagcaccggtgaagccatgtcgttaatggaaaacctggcttcacagctaccaaacggtattggctatgactggacaggtatgtcgtatcaggaacggttgtcaggtaaccaggcgccggcgctgtacgcaatctcactcattgtcgttttcctctgccttgccgctctgtatgaaagctggtcaattccgttctcggtaatgctggtcgtaccgctcggcgtggttggcgctctgcttgcagcgtcattgcgcggtctgaacaatgacgtttacttccaggttggcttgttaaccactattggcctttctgctaaaaacgccatcctgattgtcgagttcgccaaagatctcatggaaaaagaaggacgtggattgattgaagcgacgctggaagcatcccgtatgcgtttacgtcctattctaatgacctcgctggcctttattctcggggtaatgccgttagttatcagtcgtggcgcaggtagtggtgcacagaacgcagtaggcacaggggttatggggggaatgttaaccgcaaccttattagctatcttcttcgtgccggtattcttcgttgttgtaaaacgccgatttaatcgccatcatgattaa

SEQ ID NO: 74237 - protein, 1037 aa, Salmonella typhimurium LT2
MANFFIRRPIFAWVLAIILMMAGALAIMQLPVAQYPTIAPPAVSISATYPGADAQTVQDTVTQVIEQNMNGIDNLMYMSSTSDSAGSVTITLTFQSGTDPDIAQVQVQNKLQLATPLLPQEVQQQGISVEKSSSSFLMVAGFVSDNPNTTQDDISDYVASNIKDSISRLNGVGDVQLFGAQYAMRIWLDANLLNKYQLTPVDVINQLKVQNDQIAAGQLGGTPALPGQQLNASIIAQTRLKDPEEFGKVTLRVNTDGSVVHLKDVARIELGGENYNVVARINGKPASGLGIKLATGANALDTATAIKVKLAELQPFFPQGMKVVYPYDTTPFVKISIHEVVKTLFEAIILVFLVMYLFLQNIRATLIPTIAVPVVLLGTFAVLAAFGYSINTLTMFGMVLAIGLLVDDAIVVVENVERVMMEDNLSPREATEKSMSQIQGALVGIAMVLSAVFIPMAFFGGSTGAIYRQFSITIVSAMALSVLVALILTPALCATLLKPVSAEHHEKKSGFFGWFNTRFDHSVNHYTNSVSGIVRNTGRYLIIYLLIVVGMAVLFLRLPTSFLPEEDQGVFLTMIQLPSGATQERTQKVLDQVTHYYLNNEKANVESVFTVNGFSFSGQGQNSGMAFVSLKPWEERNGEENSVEAVIARATRAFSQIRDGLVFPFNMPAIVELGTATGFDFELIDQGGLGHDALTKARNQLLGMVAKHPDLLVRVRPNGLEDTPQFKLDVDQEKAQALGVSLSDINETISAALGGYYVNDFIDRGRVKKVYVQADAQFRMLPGDINNLYVRSANGEMVPFSTFSSARWIYGSPRLERYNGMPSMELLGEAAPGRSTGEAMSLMENLASQLPNGIGYDWTGMSYQERLSGNQAPALYAISLIVVFLCLAALYESWSIPFSVMLVVPLGVVGALLAASLRGLNNDVYFQVGLLTTIGLSAKNAILIVEFAKDLMEKEGRGLIEATLEASRMRLRPILMTSLAFILGVMPLVISRGAGSGAQNAVGTGVMGGMLTATLLAIFFVPVFFVVVKRRFNRHHD

SEQ ID NO: 74238 - DNA, 3162 bp, Ralstonia solanacearum GMI1000
  CDS (1)..(3162): transl_table=11
atggcacgctatttcatcgaccgccccatctttgcgtgggtcctggccatcatcgtgatgctggccggggcgctgtccatcgccacgctgccgatcgcgcagtacccgagcatcgcgccgccggccgtcgccatcaccgccacctaccccggcgcatcggccaagacgctggaagacaccgtcacccagatcatcgagcagaagatgaaggggctggaccacctgagctacatggcctcgaccagcgagtcctcgggcacggtcaccatcaccctgaccttcgacaacggcaccgaccccgataccgcccaggtgcaggtgcagaacaagctcgcgctggccacgccgctgctgccgcaggaggtgcagcagcaaggcgtgcaggtcaccaagtccgccaccaacttcctgaacgtgctggcgttcacgtcggaagacggcagcatgaacggctccgacctctccgattacgtggccgccaacgtgcaggacgccctcagccgggtggaaggcgtgggcgacaccacgctgttcggctcgcagtacgccatgcgcatctggctggacccgcacaagctgtccaacttcagcctgacgccgctggacgtgaagaccgccatccaggcgcagaacgcccaggtctcggccggccagctcggcggcatgccggcggcggacaaccagcagatcaacgccaccatcacctcgcagacgcgcctgaagaccgccgaggcgttcggcaacatcctgctgcgcacgcaggccgacggcgcccaggtgcgcctgcgcgacgtggcccgcatcgagctgggcagcgagagctacagcaccgtgggccgctacaacggcaagcccgccgccggcctggccatcaagctggccaccggcgccaacgcgctcgataccgtcaaggccatcgatgcccgcgtggccgagctggagcccttcttcccgcccggcatgaaggtgcagaagccctacgacaccacgcccttcgtgcgcatctcgatcgaggaggtggtgcgcacgctggtcgaggcgatcgcgctggtgttcctggtgatgtacctgttcctgcagaacttccgcgccacgctcattccgaccatcgccgtgcccgtggtgctgctgggcacgttcggcgtgctggccgcgtgcggcttcaccatcaacacgctgaccatgttcgccatggtgctggccatcggcctgctggtcgacgacgccatcgtggtggtggagaacgtggaacgggtgatgagcgaagagggcctgccgcccagggaagccacgcgcaaatccatgggccagatcaccggcgcgctgatcggcgtggcgctggtgctggccgccgtgttcgtgccgatggccttcttcaagggctccaccggcgtgatctaccggcagttctcgatcaccatcgtctcggcgatgacgctgtcggtgctggtggcgatggtgctgaccccggcactgtgcgcgacgctgctcaagcccgtcaggaaaggccacgcgcaggccacgaccggcttcttcggctggttcaaccgcaccttcgaccgcggcaaccatcgctaccagggcatcgtgcgccacatgctgggcaagcaacggcgctacatggccatgtacggcgtgctgttcgccatggtggtggtcggcttcatgaagctgccggtcggcttcctgcccgacgaagaccagggcacgctgttcgtgctggcgcagctgccgccgggcgccaccaatgcgcgcaccgaagacgtgctgcgccaggtcgagcaccacttcctggtggaccagaaagaagccgtgagcggcgtgttctcggtggcgggcttcagctttgccggcagcggccagaacatgggctttgccttcgtcaagctgcgcccgtggaacgagcgcaagggcgaggcgctcagcgtcagcggcgtcgtggccagggccttcgggttcttcgccaccatccgcgacgcccgggtcttcgccttcgccccgccggccgtggcggagctgggcaacgccaccggcttcgacctgatgctgcaggaccgcgccaacctcggccacgccgcgctgatgcaggcccgcaaccagctgctgggcacgctctcgcaagacccgcgcctggtggccgtccgccccaacggccaggaagacacgccggagttccagttgcagatcgatgcgcacaaggcggaaacgctgggcctgtcgatctccgacatcaacagcacgctcgccaccgcgtggggcagcagctacgtcaacgacttcatcgaccggggccgcgtcaagaaggtcatgctgcaggccgatgcgcccttccgcatgaacccggaggacatcgacaaatggtatgtgcgcaacagcgccggcaccatggttccgttcaccgcgttcgccagggtggactggtcctcgggctcgccgcggctggagcgctacaacggcgtgccatcgatggagatcctgggcatggccaagcccggcagcgcctccagcggcgaggcgctcgccatcgtcgaggcggccgtgaccaagctgccggccggcatcggctacgcgtggaccgggctgtcgctgcaggagaaggcctccagcgggcagaccaccctgctctacacgctgtcgatcctgatcgtgttcctgtgcctggcggcgctgtacgagagctgggcgatccccttctcggtcatcatggtggtgccgctcggcgtgctgggcgcgctgctcggcgccatcctgacctggaagatgaacgacgtgtatttccaggtgggtctgctgaccaccatcggcctggcatccaagaacgccatcctgatcgtcgaatttgccaaggaactcaatgcgcaggggatgcgcgtggtcgaggcggccatgacggcggcacgcatgcgcctgcggcccatcctgatgacgtcgctggccttcatcctcggcgtcgtgccgatggtcacgggcagcggtgccggcgccggcgcgcagcacgcgctgggcacggcggtcatcgggggcatgctgtccggcaccgttctcgccatcttcttcgtgccgctgttcttcgtgctggtgcgcgggctgttccgggccaggccggccacggccacggccgcggccaccaccgcgcaaccggccgacgccgccgcttcgtaa

SEQ ID NO: 74239 - protein, 1053 aa, Ralstonia solanacearum GMI1000
MARYFIDRPIFAWVLAIIVMLAGALSIATLPIAQYPSIAPPAVAITATYPGASAKTLEDTVTQIIEQKMKGLDHLSYMASTSESSGTVTITLTFDNGTDPDTAQVQVQNKLALATPLLPQEVQQQGVQVTKSATNFLNVLAFTSEDGSMNGSDLSDYVAANVQDALSRVEGVGDTTLFGSQYAMRIWLDPHKLSNFSLTPLDVKTAIQAQNAQVSAGQLGGMPAADNQQINATITSQTRLKTAEAFGNILLRTQADGAQVRLRDVARIELGSESYSTVGRYNGKPAAGLAIKLATGANALDTVKAIDARVAELEPFFPPGMKVQKPYDTTPFVRISIEEVVRTLVEAIALVFLVMYLFLQNFRATLIPTIAVPVVLLGTFGVLAACGFTINTLTMFAMVLAIGLLVDDAIVVVENVERVMSEEGLPPREATRKSMGQITGALIGVALVLAAVFVPMAFFKGSTGVIYRQFSITIVSAMTLSVLVAMVLTPALCATLLKPVRKGHAQATTGFFGWFNRTFDRGNHRYQGIVRHMLGKQRRYMAMYGVLFAMVVVGFMKLPVGFLPDEDQGTLFVLAQLPPGATNARTEDVLRQVEHHFLVDQKEAVSGVFSVAGFSFAGSGQNMGFAFVKLRPWNERKGEALSVSGVVARAFGFFATIRDARVFAFAPPAVAELGNATGFDLMLQDRANLGHAALMQARNQLLGTLSQDPRLVAVRPNGQEDTPEFQLQIDAHKAETLGLSISDINSTLATAWGSSYVNDFIDRGRVKKVMLQADAPFRMNPEDIDKWYVRNSAGTMVPFTAFARVDWSSGSPRLERYNGVPSMEILGMAKPGSASSGEALAIVEAAVTKLPAGIGYAWTGLSLQEKASSGQTTLLYTLSILIVFLCLAALYESWAIPFSVIMVVPLGVLGALLGAILTWKMNDVYFQVGLLTTIGLASKNAILIVEFAKELNAQGMRVVEAAMTAARMRLRPILMTSLAFILGVVPMVTGSGAGAGAQHALGTAVIGGMLSGTVLAIFFVPLFFVLVRGLFRARPATATAAATTAQPADAAAS

SEQ ID NO: 74240 - DNA, 3147 bp, Agrobacterium tumefaciens str. C58
  CDS (1)..(3147): transl_table=11
atgacgcaaccgtcttccggtcaggattccaaactcgcctttaccgcgctcttcgtgcgcaggcctattctggcggcggttctcaacacgctgctggtcgttgccggtcttgcagcgctggttggcgtcgaagtgcgcgaattgcccgatgtcgaccgtccgtcgatcagcgtcaggaccacctatgagggggcggcaccggaaacgattgaccaggaagtaacgcagaccatcgaaggcgccgtggcgcgtgtcagcggcatcaaatccatcgcttcgagctcgcaattcggaaccagccgcgtgacgatggagttcagcgacaatgtcgacatggccgttgccgccaatgacgtgcgcgacgccatcggccgcgtcaccaaccagctgcctgacgatgccgacgaaccccagatcatcaaggcggattccgacagccagccgatcatgcgccttgccgtcacatcctccacgctcagcatggaagatctgaccaagctggtggatgacgagatcatcgaccgcctggccgctgtcgatggtgtggcggatgtcgagctttacggcgatcaggaaaaggtttttcgcgtcgatctcaatcaggctgctcttgccagccgtggtctgaccgtcaccgatgtttccaatgcgcttgccagcgccgcactcgacgtgccggcgggatcgctgaaaagcacgacgcaggacattgtcgtgcgcgccacggccagtctgacgaagccggaggatttttccaaccttctcatcaaggacaatatccgcctgcgggatgtggcgaccgtcatgctcggcgctgacgatcaatccacctcgttgcgctccaatggggtgcagggtgtcggtctcggcgtcatccgtcaggcgcagtccaacacgctcaatatttcaacgggtgtgaaggccgccgtcgatgccatgtccgccaatctgcctgagggcacgcgtattgtcgtcaccagcgatgacgccgtcttcatcgaaggcgcgctgcatgaggtcgaactggcgctggggctctccgcgctcatcgtggtcgttgtgctctatctctttttccgcgactggcgggcgaccctcattccggcgatcaccatgccggtggcgctgatcggcaccatcgtcgccatctatatggtcggcttctcggtcaatatcctgacgctgcttgccatcgttctggcgacgggtctggttgtcgatgacgccatcgtggtgctggaaaacatcgtgcgccgccgggcggaaggcatgggaccgcgcgccgccgccgttctcggcacgcaggaagtgttcttcgccgtcatcgcaacgacggcgacgcttgccgccgtgttcattccgctgtcgttcctgccgggccagcttggcggcctgttccgtgaattcggcttcgtgctcgccttcgccgtcggcctgtcgtcaataacggcgctgacgctgtgcccgatgctggcctcgcgcatgctgaaacaggggctgaaggaaccgacggggccgctcatgtggttcggcaatgtctttgcctccacctacaagacgacgcttgccgcctgcctcaacaatccgctgatcgtcatcgttgttgcgctgatcttctcgggcctgtcctggatcgccttcggcatgatccagaacgagctgacgccgcgcgaggaccgcgcctcggtcatgatgcgggtcaccgcgccgcagggcgtcagccttgaatatacgcgtgaccagttgcaacggatcgaggaaaatctgcagccgctgcgcgatagtggcgaaatccgcaatgtctattccatcaccggcatgaacggttcttccaataccggcttcatggtgctgacgctcgccccttgggcggatcgcgaacgcacccagaaccagatcgcggctgacgtcacctccgctgccaacaaggttccggctttgcgcggtaatgccatgcagccgaacagtctgcgcattcgcggcgccggcaacggcctgcagatggcgatggtcggcagcaactatccggcgctgacagaggcgacgcagaaactgctgctttccatggaggaaggcggcctgttcgatacgccgcgtttggacaacgagccaaatcaggcccagctttccgtctccatcgaccgcgagcgcgcctccgatctcggtatcgacatcaccggcctctcgcgttcgatgcagtcgctgctggaaggtcgctcgatcgttgatgtcttcgtggatggcgatgctatcccggtcaggctcctgtcttctacccggccgatcaacgatccgaccgatctggaaaatgtcttcctgaaaacgggtgacggtaagatcgtgccgatgtcggtcatcgccacgctcaaggaaaatgcggttgcgccgcagttgaaccgcgagcagcagcttccttccgtcggtttcaccgccaacctcaaagacggtgtgtcgctcggtcaggccatggagaaggtgaacgaactggcgcaatccgtgatgccatcaggcgcgcgtctgctgccgctgggtgaagcggcgacgctggaagaaaattcgagcggcatgttgctgaccttcggtttcgccatcgccatcatcttccttgtgctggccgcgcagtttgaaagcgtgctgagttcggtcatcatcatgtcgacggtgccgctcggtctcgcctgcgccgtcatcgcgctgctggtcacgggctcgagcctcaacgtctatagccagatcgggcttgtgctgcttgtcggcgtcatggccaagaatggtattttgattgtcgagttcgccaatcatctgcgcgatcagggtgcgaccgtgcgtgaggcgatcgaaaaggccaccagcatccgcctgcgccctgtcatgatgacgatgatcgccaccattctcggcggcgtgccgctggtgctggcgcagggggcgggtgcggaagcgcgcatcgcactcggctgggtcatcgtcggcggtctcggttttgcgacgctggtgacgctttacatcaccccggtgtcttacctgctgatcgcccgcttcgccaaaccgcaggcagatgaagaaattcgccttcaccgcgaactcgaacttgccgcccgccgcaaagcgctggaggaagacaagccgttgctcgcagcggaatag

SEQ ID NO: 74241 - protein, 1048 aa, Agrobacterium tumefaciens str. C58
MTQPSSGQDSKLAFTALFVRRPILAAVLNTLLVVAGLAALVGVEVRELPDVDRPSISVRTTYEGAAPETIDQEVTQTIEGAVARVSGIKSIASSSQFGTSRVTMEFSDNVDMAVAANDVRDAIGRVTNQLPDDADEPQIIKADSDSQPIMRLAVTSSTLSMEDLTKLVDDEIIDRLAAVDGVADVELYGDQEKVFRVDLNQAALASRGLTVTDVSNALASAALDVPAGSLKSTTQDIVVRATASLTKPEDFSNLLIKDNIRLRDVATVMLGADDQSTSLRSNGVQGVGLGVIRQAQSNTLNISTGVKAAVDAMSANLPEGTRIVVTSDDAVFIEGALHEVELALGLSALIVVVVLYLFFRDWRATLIPAITMPVALIGTIVAIYMVGFSVNILTLLAIVLATGLVVDDAIVVLENIVRRRAEGMGPRAAAVLGTQEVFFAVIATTATLAAVFIPLSFLPGQLGGLFREFGFVLAFAVGLSSITALTLCPMLASRMLKQGLKEPTGPLMWFGNVFASTYKTTLAACLNNPLIVIVVALIFSGLSWIAFGMIQNELTPREDRASVMMRVTAPQGVSLEYTRDQLQRIEENLQPLRDSGEIRNVYSITGMNGSSNTGFMVLTLAPWADRERTQNQIAADVTSAANKVPALRGNAMQPNSLRIRGAGNGLQMAMVGSNYPALTEATQKLLLSMEEGGLFDTPRLDNEPNQAQLSVSIDRERASDLGIDITGLSRSMQSLLEGRSIVDVFVDGDAIPVRLLSSTRPINDPTDLENVFLKTGDGKIVPMSVIATLKENAVAPQLNREQQLPSVGFTANLKDGVSLGQAMEKVNELAQSVMPSGARLLPLGEAATLEENSSGMLLTFGFAIAIIFLVLAAQFESVLSSVIIMSTVPLGLACAVIALLVTGSSLNVYSQIGLVLLVGVMAKNGILIVEFANHLRDQGATVREAIEKATSIRLRPVMMTMIATILGGVPLVLAQGAGAEARIALGWVIVGGLGFATLVTLYITPVSYLLIARFAKPQADEEIRLHRELELAARRKALEEDKPLLAAE

SEQ ID NO: 74242 - DNA, 3090 bp, Agrobacterium tumefaciens str. C58
  CDS (1)..(3090): transl_table=11
atggcccatttcttcatccggcgccccgtttttgcatgggttatcgccatcgtcatcatgctgggcggcgtccttgcgatctggacgctgtcgatttcgcaataccctgatatcgcgccaacgacggtgcgcgtcagcgctacctataatggtgccagtgccgaaaccgtcgaaaaatcggtgacgaccatcatcgaggatggcatgaccggcctcgacgacctcacctatatgacctcgtcatcctcgacaggtagcgccgaagtgacattgaccttcggtaacagcatcctgcctgatatcgcgcaggttcaggtgcagaacaagctgcagctcgtccagtcacaattgcccgataccgtgcagcagcagggtctgcaggtcagccgctcgacatcgagcattctgatggtcggcgcgttgatctccaccgacggcaagcgcaactcggccgatctcggcgacgtgttctcctcgcgtgtcgaagaccagatcaagcgtctcgaaggcgtgggcagcatcaacgtctttggttccgaatatgcgatgcgcatctggctggatccgttcaagctcaacaaataccagctgaccacggccgacgttaccggcgccattcaaagccagaacacccaggtttcggtcggctcgctcggcgccgtaccggccgtcaagggccagcagctcaacgtgacggtaacggcgcagagccagctcaccactgtcgcagatttcgagaaggtcatcctcaaagtcgaaaaggacggcgcaacggtccgcctcagcgacgttgcccgcatcgagatcggccaggaaacctatggcggcgattcccgctccaacggccgcccttcggccggtttcgcggtcaacctcgccaccggtgcgaacgcgctcgacacggcagcgcgcgtgaaagcggctctgaccaatgtcgaaggctcgctgccggaaggcgtttcgatcgaatatccctacgacacgacgcccttcgtaaagctgtcgatcgagaaagtggtgcatacgctgatcgaggcgatcatcctcgtcttcgtcgtgcttctggtgttcctgcaaaacctcagggccacattcattccgatgatcgccgtgccggtggttctgttgggaacattcggcgtgctggcattgacaggctactcgatcaatacgctaaccatgttcgccatggttcttgcgatcggccttctcgtcgatgacgccatcgtcgtcgttgaaaacgtcgagcgcatcatgtcggaagagggcctgtcaccggtcgaggcgaccgaaaaatcgatgggcgagatcaccggtgcgatcatcggcatcgcgctcgtcctgaccgccgtgttcattccgatggctttcttcggtggatcaaccggcatcatctatcgccagttctcgatcaccatcgtgtcggccatgctgctgtccgccgtggtcgccatcgttctgacgccggcgctttgcgccaccatgctaaagccgatcgaccaccataagaaaaagcgtggaccgggcgcatggttcaaccgcggctttggcaaaacgacggacggttatgtgtcgtccatcgggtatctgctcaagcgtccgctgcgcgtgatgatcattttcgcggtcgtcatcggtggctgcgtctggttcttcagcaagctgccgagctcgttcctgccgcaggaagaccagggcgtgcttctgacgatcatccagacgccgaccggctccaacatcgaacgcaccaacgaggtggtcaagcaggtcgaaaactacttccgcgaaaaagaagctgccaatgtcgaatcggttttcggcgtgctgggtttcagcttcagcggttccggccagaacaacgccatcgtcttcaccaaactcaaggatttcgctgaacgaaccgcgcccgatcaacatgccggtgccattgtgcagcgcgccatgggcaccttcttcggtttccgcgatgcgcaggtgttcccgcttctgccaccggccattcagggcatgggcacctcgagcggtttctcgatgtatctcgtggatagcggccgcaacggcaccgatgccctgaccgcctcatcgaaggaactgatcgcgcttgcgacaggcaatccgaagatcagctcgcttcgaagcgacagccaggacaatgaaacccagatgaagatcgttctcgatcaggagaagatgggagccatgggcgtcgatctgtcctccgtgaacctcatgctgtcgacgatctttgccggccgggatgtcaatgacttcaccctgaacggcgaactcaagcccgtctatgtccagggtgacgcgccctatcgcatgcagccggacgacctgaaatattggtatgcccgcaataccaccggcgagatggtgccattctcctccttcagcgaggtgaagtgggtcaacgcgccgccgtctctcgcccgcttcaacggtacaggcgcgatctcgctggaaggtaccgcgggcacgggcgtggcctccggtgaagccatggacgagatggaacgtctgacggcaagcctgccgggcggttacaccgtggcgtggcagggcatttcctatcaggagcgactttccggttcacaggcgccgatgctctacgcgctgtcggttctcatcgtgttcctttgccttgctgccctctatgaaagctggtcgatccccttctcggtcatcctggccgtcccggtgggcgtcctcggtgccttgactgcggcccatttcttcggccagacgaacgacgtctacttcaaggttggcctgctgacgaccatcggccttgctgcgaaaaacgcgatcctcatcgtcgaattcgccaaggagaggcaggagcatgggttaagtctggtggaagcggcgctggaggcagcgaagctgcgcctgcgcccgatcatcatgacgtcgcttgccttcatcctcggcgttgtgcctctcgcaatcgcaaccggagcgggttccgccgcacaaaatgcaatcggtattggggttctgggtggtatgctttctgcaacactgctcggaattttcttcgttccgtcctttttcgtcatcattcgccgcctttcaaggcgttaa

SEQ ID NO: 74243 - protein, 1029 aa, Agrobacterium tumefaciens str. C58
MAHFFIRRPVFAWVIAIVIMLGGVLAIWTLSISQYPDIAPTTVRVSATYNGASAETVEKSVTTIIEDGMTGLDDLTYMTSSSSTGSAEVTLTFGNSILPDIAQVQVQNKLQLVQSQLPDTVQQQGLQVSRSTSSILMVGALISTDGKRNSADLGDVFSSRVEDQIKRLEGVGSINVFGSEYAMRIWLDPFKLNKYQLTTADVTGAIQSQNTQVSVGSLGAVPAVKGQQLNVTVTAQSQLTTVADFEKVILKVEKDGATVRLSDVARIEIGQETYGGDSRSNGRPSAGFAVNLATGANALDTAARVKAALTNVEGSLPEGVSIEYPYDTTPFVKLSIEKVVHTLIEAIILVFVVLLVFLQNLRATFIPMIAVPVVLLGTFGVLALTGYSINTLTMFAMVLAIGLLVDDAIVVVENVERIMSEEGLSPVEATEKSMGEITGAIIGIALVLTAVFIPMAFFGGSTGIIYRQFSITIVSAMLLSAVVAIVLTPALCATMLKPIDHHKKKRGPGAWFNRGFGKTTDGYVSSIGYLLKRPLRVMIIFAVVIGGCVWFFSKLPSSFLPQEDQGVLLTIIQTPTGSNIERTNEVVKQVENYFREKEAANVESVFGVLGFSFSGSGQNNAIVFTKLKDFAERTAPDQHAGAIVQRAMGTFFGFRDAQVFPLLPPAIQGMGTSSGFSMYLVDSGRNGTDALTASSKELIALATGNPKISSLRSDSQDNETQMKIVLDQEKMGAMGVDLSSVNLMLSTIFAGRDVNDFTLNGELKPVYVQGDAPYRMQPDDLKYWYARNTTGEMVPFSSFSEVKWVNAPPSLARFNGTGAISLEGTAGTGVASGEAMDEMERLTASLPGGYTVAWQGISYQERLSGSQAPMLYALSVLIVFLCLAALYESWSIPFSVILAVPVGVLGALTAAHFFGQTNDVYFKVGLLTTIGLAAKNAILIVEFAKERQEHGLSLVEAALEAAKLRLRPIIMTSLAFILGVVPLAIATGAGSAAQNAIGIGVLGGMLSATLLGIFFVPSFFVIIRRLSRR

SEQ ID NO: 74244 - DNA, 3135 bp, Agrobacterium tumefaciens str. C58
  CDS (1)..(3135): transl_table=11
atggcacgttttttcatcgatcggcccatttttgcctgggtcgtcgccatcttcatcatgctggcgggcctgctcgccattcccatgctgccgattgcgcaatatccgaatgtggccccgccacagatttcgatcggcaccaactatccgggcgcctcgccggaagacatctatcagagtgtcacccggcccatcgaggaagagctgaacggcgttcccggtctcatctactttgaatcgacgtcggaatcctccggccgtatttcgatcaacgtgaccttcgagcccggtaccaatatcggcgaagcccaggtcgaagttcaaaaccgcatcgcgcgtgtcgagccccgtctgccccggtctgtgacgcagcagggcctgcgcgtggaacaggccggcacatcgtttctgatgatggtggcgctgacctccgtcgacggcaacaccgatgccatcggtcttggagattatctcagccgtaacgtgctgggtgaattgcgtcgtgtgccgggtgtcggcagcgcacagctgttcgctacccagcgctccatgcgcatctggatggatcccgacaagatgttgggtctcagcctgacctcggacgatgtcatcaacgccattcaggcgcagaactcgcaggttgccgccggccgcatcggcgcatcgccaaaccctgtcggccagcagatttccgcgaccgtcaacgtccagggccagctgacctcgcccgaggaattcggctccatcgtgctgcgcgccaatcccgacggttcatcggtgcggctgcgtgatgtcgcgcgtgtcgaggtgggcggcgagagctacaatttctcgagccgcctcaacggtaaaccgagtgctgccatcggcgtacagctgtcaccaacggcaaatgccatgcagacctccgaaggcgttcgcgcgacgatggaagagttgtcgcgttatttcccgcagggcatcgaatatgagattccctatgataccagtcccttcgtcaagatctcgatcgagaaggtcattcacacgctgatcgaggcaatgatccttgtcttcgtggtgatgttcgtcttcctgcagaacatccgctacacgatcattccgacactggtggtgcccgtggcgctgctgggcacgtgcgccgtcatgtatgtctcggggttctcgatcaacgtgctcaccatgttcgcgatggttctcgccatcggcattctggtggacgacgcgatcgtcgttgtcgagaatgtcgaacgcatcatggctgaggagcatctgtcgccaaaggaggcgacccgcaaggccatgggccagatttcgggtgccatcataggcatcacgctggtgctgaccgcggtgttcgtgccgatggcctttttcccgggcgctgtcggaatcatctaccaacagttcagtctgaccatggtggtttccatcctgttctcgggcttcctcgcgctgtcgctcacgcccgcgctctgcgcctcgttcttgaagccgatcaaggcagggcatcacgagaagaaaggattttttggctggttcaaccgcaattttgataaggcgtcgcacaaatactcctcctcggtgggtggcatcatcaagcgttcaggtcgcttcatgatcatctatgcggctctgcttgccggcctcggctgggcctatatgcagctgccaagctcgttcctgccgaacgaggaccaaggctatctgatcgtcgatattcaggcaccggcggaagccagtaccgagcgcaccctgcaatccatccagcagatcgagaaaatcttcatggaggagccggcggtggagcgcgtcattgcgatctcgggcttctctttctccgggtccggccagaatgccggccttgccttcgcgacgctgaaggactggagcgaacgtggacccgaggactcggctgcggccatctccgcgcggatcaacggcaagctttggggcctgccggatgccatgtcgttcgccttgtcgccgccgcctattcagggtctgggcaactcgagcggtttcaccttccgtcttcaggacaggtcgggtgccggtcagaccgcacttagcgcagcgggcgcccagctcatggccgccgcccgccagagccccgtccttgccggtcttcgcatcgaaggcatgccggatgcggcgcaggtgaacctcatcatcgaccgtgaaaaggccaataccttcggtgtcaccttcagcgacatcaacgccaccatctcggccaatatggggtcgtcctacgtcaacgacttccccaatgccggccgcatgcagcgcgtgacggtgcaggcggagcagggccagcgtatgaagaccgaggatcttttgaacctcaacgtccgcaacgccaatggcggcatggtgcccgtcagctcattcgctacggtggaatgggttcgcggtccctcgcaggtggtcggttataacggctatccggcgatccgtgtcagcggccagtccgcgcccggttactcctccggtgatgcgattgccgaaatggagcgtctggcgcgtgagttacctggtggtttcggtttcgaatggactgggcagtcgctgcaggaaatccagtcgggctcgcaggcgccggcacttatcggcctcagcgtgctgttcgtcttcctgctgctggcggcgctttatgaaagctggtccattccgctctcggtcatgctggtggtgccgctcggcgtcatcggctcggtggcggcggtgatgctgcgcggcatgccgaacgacgtctacttcctcgtcggcctcgtcgccatcatcgggctttcggccaagaacgctatcctgatcatcgaatttgccaaggatctgcgggcggagggcaaatccacctatgatgcgacagtggaggcggcccacctgcgtttccggccgatcctgatgacctcgctcgccttctcgctcggcgtgctgccgatggcaattgcttcaggcgccagtgcggcgagccagaacgccatcggcaccggcgttctcggcggcatgatctcggcgacgatcctcgcgatcttcttcgttcccgtgttcttcgtctttgtcatgaagtttttcggggatcggaagaaggacgacaagattgctgctgacgccgtatcgccggccgaataa

SEQ ID NO: 74245 - protein, 1044 aa, Agrobacterium tumefaciens str. C58
MARFFIDRPIFAWVVAIFIMLAGLLAIPMLPIAQYPNVAPPQISIGTNYPGASPEDIYQSVTRPIEEELNGVPGLIYFESTSESSGRISINVTFEPGTNIGEAQVEVQNRIARVEPRLPRSVTQQGLRVEQAGTSFLMMVALTSVDGNTDAIGLGDYLSRNVLGELRRVPGVGSAQLFATQRSMRIWMDPDKMLGLSLTSDDVINAIQAQNSQVAAGRIGASPNPVGQQISATVNVQGQLTSPEEFGSIVLRANPDGSSVRLRDVARVEVGGESYNFSSRLNGKPSAAIGVQLSPTANAMQTSEGVRATMEELSRYFPQGIEYEIPYDTSPFVKISIEKVIHTLIEAMILVFVVMFVFLQNIRYTIIPTLVVPVALLGTCAVMYVSGFSINVLTMFAMVLAIGILVDDAIVVVENVERIMAEEHLSPKEATRKAMGQISGAIIGITLVLTAVFVPMAFFPGAVGIIYQQFSLTMVVSILFSGFLALSLTPALCASFLKPIKAGHHEKKGFFGWFNRNFDKASHKYSSSVGGIIKRSGRFMIIYAALLAGLGWAYMQLPSSFLPNEDQGYLIVDIQAPAEASTERTLQSIQQIEKIFMEEPAVERVIAISGFSFSGSGQNAGLAFATLKDWSERGPEDSAAAISARINGKLWGLPDAMSFALSPPPIQGLGNSSGFTFRLQDRSGAGQTALSAAGAQLMAAARQSPVLAGLRIEGMPDAAQVNLIIDREKANTFGVTFSDINATISANMGSSYVNDFPNAGRMQRVTVQAEQGQRMKTEDLLNLNVRNANGGMVPVSSFATVEWVRGPSQVVGYNGYPAIRVSGQSAPGYSSGDAIAEMERLARELPGGFGFEWTGQSLQEIQSGSQAPALIGLSVLFVFLLLAALYESWSIPLSVMLVVPLGVIGSVAAVMLRGMPNDVYFLVGLVAIIGLSAKNAILIIEFAKDLRAEGKSTYDATVEAAHLRFRPILMTSLAFSLGVLPMAIASGASAASQNAIGTGVLGGMISATILAIFFVPVFFVFVMKFFGDRKKDDKIAADAVSPAE

SEQ ID NO: 74246 - DNA, 3141 bp, Agrobacterium tumefaciens str. C58
  CDS (1)..(3141): transl_table=11
atgatcccaaatttctgtatcaaccgccccgtcgccaccacacttctcgccatcggccttgtgctcgccgggcttgccggcttccgcctgctgcccgtcgctgccctgccgaaggtggattttccgacgatcaacgtctcctcgtcgctctcgggcgcctcgccgcaaaccatggccacatcggtcaccacaccgctggtcaagcagttcgaaaccattcccggcgtcagcgaaatcagcgccaccaacacgctcggcaacagctcgatcgtgctgcagttcgatctcaaccgcgatatcgacgccgcagcagccgatgttcaggccgccatttcgcgcgcccaacggcaattgccgagcaacatgacgacaaccccaagctatcgcaagaccaatccggccgatgcgccggtgctgctgcttgccgtcaacagcaaggaaatgccgaccagcaaggtggatgagatcgccgaaaacatcatctcgccgcttctctccaccatttcgggcgtcgcacaggtgagcatctatggtgcgcaaacctatgccgtgcgcattggtctcgatccaacgcagcttcaggcaagagggctcggtgttgatacggtcacaacggccatcacccaggcgaacaatcaggtacccgtgggtgccttgcagaccgacaatcagcgcttgaccatcgaggccgatacccagcggaccaatgcggccgccttccgctcgctggtcgtctccacgaataatggcgcgccgattcatctcggcgatatcgccaatgtcactgacagcatcgacaataccaatgccggcagctggttcgatggcgaacaggctattattcttgccgtgcagcggcagccggatgccaataccgtcgaagtggttgatgccatcaaggccaagctgccggcgctgcaacagcaattgccgccatccgtcaatatccacgtcatgaacgatgcttcgaccgccatcaaggatgcgatctctgacgttcagttcaccctgttcctcaccatcgggctggtggttgcggtcatctatcttttcaccgggcacctgacggcaaccatcattccgggccttgccgtgccgctgtcactcatcaccgctttcggcatgatgtatgttctgggctacagcatcgacaatatctcgctgctcgggctgacgctatcggtgggcctggtggtggatgacgccatcgtcatgctggagaacatcctgcggctgcatgaaaaaggcctgcccatgcgtgaggcggccttgcagggggcggcggaagtcagcggcaccatcctgtccatgtccgtctcgctggtggccgtcttcattcccattctgttgatgggcggcgtgatcggcaggctcttcaacgagttcggtatggtcgtcacgctggcgatcatggcctcggcgctggtctcactgacagtaacgccgatgctcgcttcgcgcctgtccggccactcctcgcggccgccggccatcatccgctggttcgatgccggcttcgagcgcacgcttcgcctctacggcaaggccgtcggctggtgcctttcccatcgccgcatcgtgcttgcctcatttctcgcctcggtcgccgcctcggtctacctgttcgaaaccctgccctccagcttcttcccgcaggaagatatcggccgcctttctgtctcgacacaggcgcgtgaggatatttcctacacggcgatgcgggatctccaggcacaggtcgccgatcagatccgcaagaacccggcggtcgtgcatgtcacttccatcgtcggtggcaattcacgcaatccgctgaacaacggttcgatgtttgtggaattgaagccaaaggaagaacgcgcgccgataagccaggtgctgaccgaactgggtcaggccacgtcgaaagtggcgggcattcgcacctatatcaacccgcagcagagcctgcgtttcggcggacgcagttccgccagccaatatcagctcgtcgttcagggcttgaatgccgatacgaccaatgaatggtcgaacaagctgatggaggcgatgcgccgcgaccacacattcaccgccgtcaccaccgacgcccagaacggggcgattgccgcgacgatctccgtcgatccggaaaaagcggccgccttcggcatcaccaatgaccagttacgcaagacactggaaatgtccttcggcggctataccgcggcacaaatccagtcgacgggcgatagctacgacgtcatcgtggaattcgacagctccaaatcctggaatgacgatttcctcagcgatatcaatattctttcggcgaaatcaggagttctggttccactttccaacttcgcctcgctgacccgtacgcaggcgccggttaccatcaaccagacgggccagctcgtctccaccaccatctccttcaacctgccggatggcgtggcgctttccgatgccacaagccggatcgaccagatcaagaccacgatcggcctgccgcaggatgtgttcaccagctatggcggtacggcggcgatcttccagcagagccagggcaataccggcgtcctcattctggcggcagtgctgaccatctatgtggtgctgggcgtgctctatgaaagcttcatccacccgctgaccatcctctccggcctgccggccgcagcctttggcgctcttgtggcgctgaaagtgatgggcatggatttctcgatcatcgcgctcatcggccttttgatgctgatcggtatcgtgaagaaaaacgcgatcatgatgatcgacgtggcggtggagttgatgcgcgaaaaggcggaaccgcccgcaatcgccattcacgaagcctgcgtgcgccggttccggccgatcatgatgaccaccttctgcgcattgctgggcgcactgcccatcgcgctcggctccggcgcaagttcggaactgcgccagccgctcggcatcgccgttgtcggtggtctcatcgtctcgcaactgctgacgctgttcatcacacccgtgatcttcgtggaaatggaccggttcggccacttcctcaccgggctattttcccgcaagaaaaacgttgagccccatgcagaacagcaaaaaccgcgtaggaaggccgaaccggattccgtggcggcctaa

SEQ ID NO: 74247 - protein, 1046 aa, Agrobacterium tumefaciens str. C58
MIPNFCINRPVATTLLAIGLVLAGLAGFRLLPVAALPKVDFPTINVSSSLSGASPQTMATSVTTPLVKQFETIPGVSEISATNTLGNSSIVLQFDLNRDIDAAAADVQAAISRAQRQLPSNMTTTPSYRKTNPADAPVLLLAVNSKEMPTSKVDEIAENIISPLLSTISGVAQVSIYGAQTYAVRIGLDPTQLQARGLGVDTVTTAITQANNQVPVGALQTDNQRLTIEADTQRTNAAAFRSLVVSTNNGAPIHLGDIANVTDSIDNTNAGSWFDGEQAIILAVQRQPDANTVEVVDAIKAKLPALQQQLPPSVNIHVMNDASTAIKDAISDVQFTLFLTIGLVVAVIYLFTGHLTATIIPGLAVPLSLITAFGMMYVLGYSIDNISLLGLTLSVGLVVDDAIVMLENILRLHEKGLPMREAALQGAAEVSGTILSMSVSLVAVFIPILLMGGVIGRLFNEFGMVVTLAIMASALVSLTVTPMLASRLSGHSSRPPAIIRWFDAGFERTLRLYGKAVGWCLSHRRIVLASFLASVAASVYLFETLPSSFFPQEDIGRLSVSTQAREDISYTAMRDLQAQVADQIRKNPAVVHVTSIVGGNSRNPLNNGSMFVELKPKEERAPISQVLTELGQATSKVAGIRTYINPQQSLRFGGRSSASQYQLVVQGLNADTTNEWSNKLMEAMRRDHTFTAVTTDAQNGAIAATISVDPEKAAAFGITNDQLRKTLEMSFGGYTAAQIQSTGDSYDVIVEFDSSKSWNDDFLSDINILSAKSGVLVPLSNFASLTRTQAPVTINQTGQLVSTTISFNLPDGVALSDATSRIDQIKTTIGLPQDVFTSYGGTAAIFQQSQGNTGVLILAAVLTIYVVLGVLYESFIHPLTILSGLPAAAFGALVALKVMGMDFSIIALIGLLMLIGIVKKNAIMMIDVAVELMREKAEPPAIAIHEACVRRFRPIMMTTFCALLGALPIALGSGASSELRQPLGIAVVGGLIVSQLLTLFITPVIFVEMDRFGHFLTGLFSRKKNVEPHAEQQKPRRKAEPDSVAA

SEQ ID NO: 74248 - DNA, 3078 bp, Brucella melitensis 16M
  CDS (1)..(3078): transl_table=11
atgaatatttccgaagtcttcattcgccgtccggttgcgacaatcctgctggtgataggcgggttgattggcgggattgcagcttataaccagcttccggtggcggcactgccggaagcggattttccgaccatcaatgtctccgcccagcttgcaggcgcttcgcccgatacgatggcctcctcggtcgcaacgccccttatcaagcaattcgagaccattgcaggcatcgatacgatcagtgccagatcatcccttggcaatacatcgattacgctgcaattcgacttgaagcgcaatatcgatgcggcggcggctgatgtgcaggcagccatcatgcgtgcgcagcggcggctgccggataatctgacgacgccgccgagttatcgcaagacaaatcccgccgatgcgccggttgtcattctggctttgacaggcgacggcgcccgcctgacccagatggatgacattgcgcagaatgtcatctcgccagccctgtccactatttcgggtgtggcgcaggcgctggtctatggctcaaagacctatgcggttcgcgttgaggtggaccctgacaaactggacagccgcaacctgtcgctatcgggccttggcgagaccattgctgcggcaaataaccagaccccggttggaacgctgcaaaacaggtcacaggcccttacagtcgatgcgcaaacccagcgcacgaatgccggggagttcaggaatctgatcgtcgcgggtagcggcaatcgcattgtccgcctgtccgatgtggcaacggtgctggacagtgtggataatgtcaatcaggatagctggctggatggaaagcagacgattgcactggcggttcagcgccagcccggttcaaatacggtggctgttgtggatgcgatccgcgccaagcttcctgaaatcgaggcagcattgcctgcgcatatgcatatcgccgtcgtcaacgatgcttccgtttccatccgtgcagcggtggcggatgttcaaaggatgcttgccatcaccgtgtgcctcgtggtgctggtgattttcctgtttctggggcagttctgggcaacgatgatcccgggattggcggttccgctttctctggtcgcaacatttgcggcgatgtatgcctgcgggttttccatcgacaatatatcgcttctggcgctgacattggccgtggggctggtggtcgatgatgctatcgtgatgctcgaaaatattgtccgtcatgtggaggaggggcttgcgccatttcaggccgctattgtcggcagccaggaagtgaccacaatcatttccatgtcgctgtcactggtcgccgttttcctgccgatcctgttgatgggcggtattgtcgggcgggttctgaacgaattcggcatggtggtaacgctcgcaatcctgtcctcggccgtcgtctcgctgacggtcacacccatgcttgctgctcgcctgccgcacaaacaggcaaaacccggacgcattgcgcaaatgttcaaccgggtaacggaaagctatgggcgcgctgtcgggtggtgtctgcgccaccggcttctggtgatgctgcttttcgtgctgagttttctggggtctgtatggtcgttcatgacattgccacgcagcttcttcccgcaggaagatacgggcctggtgatgatttcgacgcaagccaggcaagacatttcctatcagggaatgagtgaattgcagaaacaggcagcagccatcgtttccgctaatccagcggttgaacacgttacggcgacgctggggagcggccccggcggggcgacattcaatacaggttcgatgtttgtgcagttgaaaccgcggcaggcgcgcccaccgctcaaccagacactcagcgaactgcgaaagaaacttgccggtcttcccggcttgacggcatatttgaccccggtgcaaagcctgcgctttggcgggcgcagtacgcaaagccagtatcagatcgttttgcaatcgcttgatgccgatgaagcgcgcttctggtcgcaaaagcttgccgaagcgacgaaggctgagccggagactttcgtggatgttgcctccgatttgcagggcaatgcacttcaggcccatatcgctatcgacaacgacaaggcaggcagtctgggtattacatcgcaggcaattcgcaaaacgcttgaagccgcatatggaacactgacggtgtcgcagatacaggccactggcaacagttatgatgtaatcattgaacttgaccagagccagcagtgggatgagaccaggcttggcgcacttcgtgccccgactatgtcgggcgtgcttgttccgctggcaagtttcgcgacgattacccggacaaacgggccggtcacggtcaaccagacaggccagctcgcatccgtcacgctttcctataatctgcctgcgggtgtttcgctcggaacggcaacggatcgcctggaaagcctgcgcaatgaaatcgacatgcctgtttcggttgcaatgcgccccgccggtgcggcacagattttcgctcaatcaaccgggaatatggggcttttgatctttgcggcgattgcaacgatctatatcgttctgggtgtgctttatgaaagttttgcccatccgctgacaatcctgtccggcctgccatcggcggctttcggcgcgctggcaacgctacagcttttcggcttcgatttttcgattatcgccctcataggtctcctcatgctgatcggcatcgtgaagaaaaacgccatcatgatggtggatgtggccctgacattgaaacgggatgaaaaccgcaaaccggatgaagctatccatcttgcggcggttcggcggtttcgcccgatcatgatgacgacattttgcgcattgctggcagcggtccccgttgcgctcggtcatgggcaggggtctgaattgcgccagccgcttggtgtagcagtcgtgggcggcctgattttaagccaggcgctgacgctgtttatcacgcctgtgattttcgttgaaatcgaccggctggcaaatcatcgctggttttcacgcaggaaagtctcccgtgcggatttatag

SEQ ID NO: 74249 - protein, 1025 aa, Brucella melitensis 16M
MNISEVFIRRPVATILLVIGGLIGGIAAYNQLPVAALPEADFPTINVSAQLAGASPDTMASSVATPLIKQFETIAGIDTISARSSLGNTSITLQFDLKRNIDAAAADVQAAIMRAQRRLPDNLTTPPSYRKTNPADAPVVILALTGDGARLTQMDDIAQNVISPALSTISGVAQALVYGSKTYAVRVEVDPDKLDSRNLSLSGLGETIAAANNQTPVGTLQNRSQALTVDAQTQRTNAGEFRNLIVAGSGNRIVRLSDVATVLDSVDNVNQDSWLDGKQTIALAVQRQPGSNTVAVVDAIRAKLPEIEAALPAHMHIAVVNDASVSIRAAVADVQRMLAITVCLVVLVIFLFLGQFWATMIPGLAVPLSLVATFAAMYACGFSIDNISLLALTLAVGLVVDDAIVMLENIVRHVEEGLAPFQAAIVGSQEVTTIISMSLSLVAVFLPILLMGGIVGRVLNEFGMVVTLAILSSAVVSLTVTPMLAARLPHKQAKPGRIAQMFNRVTESYGRAVGWCLRHRLLVMLLFVLSFLGSVWSFMTLPRSFFPQEDTGLVMISTQARQDISYQGMSELQKQAAAIVSANPAVEHVTATLGSGPGGATFNTGSMFVQLKPRQARPPLNQTLSELRKKLAGLPGLTAYLTPVQSLRFGGRSTQSQYQIVLQSLDADEARFWSQKLAEATKAEPETFVDVASDLQGNALQAHIAIDNDKAGSLGITSQAIRKTLEAAYGTLTVSQIQATGNSYDVIIELDQSQQWDETRLGALRAPTMSGVLVPLASFATITRTNGPVTVNQTGQLASVTLSYNLPAGVSLGTATDRLESLRNEIDMPVSVAMRPAGAAQIFAQSTGNMGLLIFAAIATIYIVLGVLYESFAHPLTILSGLPSAAFGALATLQLFGFDFSIIALIGLLMLIGIVKKNAIMMVDVALTLKRDENRKPDEAIHLAAVRRFRPIMMTTFCALLAAVPVALGHGQGSELRQPLGVAVVGGLILSQALTLFITPVIFVEIDRLANHRWFSRRKVSRADL

SEQ ID NO: 74250 - DNA, 3144 bp, uncultured bacterium
  CDS (1)..(3144): transl_table=11
atgtcgctgttttttatcaggcgtcccaactttgcctgggtggtcgcgttgttcatctcgatggccggtttgctggccatgccctttctgcctgtggcgcagtaccccagcgtggctccgccgcagatcaccatctctgcgacctacccgggtgcttcggcgcaggtgctgaccgactcggtgactggtgtcatcgaggaggagctcaacggcgcaaagaacctgctgtacttcgagtccagcagcaacgccaacggcattgctgaaatcaccgtgaccttccagcctggcaccaacccggaactggctcaggttgaggtgcagaaccgcttgaagaaagcggaggcgcgtatgccccaggccgtcctcacacagggcattcagaccgagcaggcttccgccggatttctgctgatctatgccctgcgctacaaagatggcgttaatcacgaaaacactacggcgctggccgattacgccgtgcgcaacatcaatcccgagatccgtcgactgcccggtgtcggtaaactgcagttcttcgactccgaagcggccatgcgtgtgtggatcaacccgcagaagctggtgggttttggcctgtcgatcgatgacgtcaataacgccattcgcgggcagaacgtccaggttccggccggtgcctttggcagcacgccgggcactagcgaacaggagctgaccgcgacgctggcggtcaagggcactttggatacgcctgaggaattcggtcgtattgtgctgcgtgctaaccaggatggttcgagcgtactgctcggcgatgtcgcgcgcctggaagtcggtagccagagttacaacttcagctcccgtcaggacggcaaaccggccgtggccgctgctgtacagctgtcgccaggagccaatgccattcgcaccgctgaagcagtcaaacagcgcctggacgagttgtcggcaagcctcccggacaacgtcgaggtctctgttccctacgacacctcgcgcttcgtcgacgtggccatttccaaggtcatcaccaccctggtcgaggccatggtgttggtatttctggtgatgttcctgttcctgcagaacgtgcgttacaccctgattcccggcatcgtggtgccggtgtgcctggccggtacgctgaccttcatgtacctgcttggcttctcggtgaacatgatgaccatgttcggcatggtgctggccatcggcatcctagtggacgatgccatcgtggtggtggagaacgtcgagcgaatcatggccgatgaaggcctaccgccagtggaggcaaccatcaaagcgatggggcaggtttccggggcgatcatcggtatcaccctggtgctgtcggcggtgtttctgccgctggcctttatggccggctcggtaggggtgatctaccagcagttctcgctgtcgctggccgtatcgatcatgttctccggcttcctggcgctgacctttaccccggcgctgtgcgccacgctgctcaagccgatcccgcaggggcatcatgaaaagcgcgggttctttggcggcttcaaccgcgtcttcggccgactgacccagcgctacaccgcgctcaacagcaagctggtgccgcgtgccgggcgcttcatgtttatctacctggccatcgtcgtggtgatgggtttcttctacctacgtctgccggagtccttcgtgcccgcagaagaccagggctacatgatcgtcgacgtgcaattgccgccaggcgcgacccgcgagcgcacatccgagacgggcgcgcagctggaagagttcctcatgtcacgtgaggccatgggcagttccttcttggtcttgggcttcagcttctcgggcatgggcgaaaacgccgcgctggctttcccggtgctcaaggattggtccgagcgtaattcggatcagtcggtcgaggccgagacagcagccgtgaacgagcatttcgccaacctcgacgacggtaccatcatggccgtgccgccaccgccaatcgaaggcctaggtaactccggcggtttcgccctgcgtctgcaggatcgcggcagcttgggccgtgaagccttactggctgctcgcgacgagttgctgggccaggtcaacggcaatccgaaattcctctacgccatgatggaaggcctggctgaagcgccacaactgcgcctggtcatcgatcgcgagcaggcgcgcgcccagggcgtgagcttcgagtcgatcagcaccgctctgtccacggcgtttggctccacggtgatcaacgattactcgaatgctggtcgtcaacagcgcgtggtggtgcaggcagagcaaggtgagcgcatgaccccggagagcgtgctcaaacttcacgtgcccaacgatagcggtggtctggtacccctgagtgccttcgtcaccacgaagtgggaagagggtccggtacagatgtctcgctacaacggctacccgtcgatccgtatcaccggcgacgccgctccgggtgtaagtaccggcgaggccatggctgagctggagcgcattattggcgagctgccggccggcatcggctacgaatggacgggcctgtcctatcaggagcgggtcgccagtggtcaggcgctgatgctgttcgcactggctatcgtcgtcgtgttcctattgctggtcgccctctacgagagctgggcaattccactgacggtgatgttgatcgtgccgattggtgctctcggttcggtgctggcggtgacgagtgttggcctgtcgaacgacgtgtacttcaaggtcggtctgatcaccatcatcggcctggcggcgaagaacgccattctgattgtcgagttcgccaaggatctctgggaacagggttactcgctgcgcgacgcggccatcgaggcggcgcggattcgcttccgcccgatcatcatgacctccatggcgttcatcctcggcgtcgtgccgctggtgatcgccagtggtgccggcgctgccagccagcgcgccatcggcaccggtgtcatcggaggcatgcttagtgcgacgctgttgggggtgatcttcgtgccgatcttcttcgtttgggtgctgtcgctgctgcgcagcacgccccatacgccgtccactactgacggccctgttgcccggatcaaggactaa

SEQ ID NO: 74251 - protein, 1047 aa, uncultured bacterium
MSLFFIRRPNFAWVVALFISMAGLLAMPFLPVAQYPSVAPPQITISATYPGASAQVLTDSVTGVIEEELNGAKNLLYFESSSNANGIAEITVTFQPGTNPELAQVEVQNRLKKAEARMPQAVLTQGIQTEQASAGFLLIYALRYKDGVNHENTTALADYAVRNINPEIRRLPGVGKLQFFDSEAAMRVWINPQKLVGFGLSIDDVNNAIRGQNVQVPAGAFGSTPGTSEQELTATLAVKGTLDTPEEFGRIVLRANQDGSSVLLGDVARLEVGSQSYNFSSRQDGKPAVAAAVQLSPGANAIRTAEAVKQRLDELSASLPDNVEVSVPYDTSRFVDVAISKVITTLVEAMVLVFLVMFLFLQNVRYTLIPGIVVPVCLAGTLTFMYLLGFSVNMMTMFGMVLAIGILVDDAIVVVENVERIMADEGLPPVEATIKAMGQVSGAIIGITLVLSAVFLPLAFMAGSVGVIYQQFSLSLAVSIMFSGFLALTFTPALCATLLKPIPQGHHEKRGFFGGFNRVFGRLTQRYTALNSKLVPRAGRFMFIYLAIVVVMGFFYLRLPESFVPAEDQGYMIVDVQLPPGATRERTSETGAQLEEFLMSREAMGSSFLVLGFSFSGMGENAALAFPVLKDWSERNSDQSVEAETAAVNEHFANLDDGTIMAVPPPPIEGLGNSGGFALRLQDRGSLGREALLAARDELLGQVNGNPKFLYAMMEGLAEAPQLRLVIDREQARAQGVSFESISTALSTAFGSTVINDYSNAGRQQRVVVQAEQGERMTPESVLKLHVPNDSGGLVPLSAFVTTKWEEGPVQMSRYNGYPSIRITGDAAPGVSTGEAMAELERIIGELPAGIGYEWTGLSYQERVASGQALMLFALAIVVVFLLLVALYESWAIPLTVMLIVPIGALGSVLAVTSVGLSNDVYFKVGLITIIGLAAKNAILIVEFAKDLWEQGYSLRDAAIEAARIRFRPIIMTSMAFILGVVPLVIASGAGAASQRAIGTGVIGGMLSATLLGVIFVPIFFVWVLSLLRSTPHTPSTTDGPVARIKD

SEQ ID NO: 74252 - DNA, 3171 bp, Xanthomonas campestris pv. campestris str. ATCC 33913
  CDS (1)..(3171): transl_table=11
atggacttttcccgttttttcatcgaccgaccgatcttcgcggcggtgctgtcgatcatcatcttcgcggctggcctgatcgccatgccgctgctgcccatcagcgaataccccgaagtggtgccgccgagcgtgcaggtgcgtgcggtgtatccgggcgccaatcccaaggtcatcgccgagaccgtcgccacgccgcttgaggaagccatcaacggcgtggaaaacatgatgtacatgaagtcggtcgccggctccgatggcgtgctggtggtcaccgtgaccttcaagccgggcaccgatccggaccaggcgcaggtgcaggtgcagaaccgcgtcagtcaggcgcaggcgcgtctgcccgaggacgtgcggcgccagggtgtgaccacgcagaagcagtcgccgacgctgaccatggtcgtgcatctgacctcccccaagggcaagtacgactcgctgtacctgagcaactacgccaccttgaaggtcaaggacgagctgtcgcgcctgccgggcgtgggccagatccagatcttcggtgccggcgattacgccatgcggatctggctggatccggacaaggtcgccgcgcgcgggctcaccgccagcgatgtagtggccgccatccgcgagcagaacgtgcaggtgtccgccggccagctcggcgccgagccgatgccgaacaagagcgagttcctgctgtcgatcaatgcacagggccgcctgaccaccgaagaagaattcggcaacatcgtgatccgcagcggtaccagcggcgagatcgtgcgcctgtcggatgtggcgcggctggaactgggtgccggcaagtacacgctgcgctcgcaactggacagcaagagcgcggtgggcatgggtgtcttccagtccccgggcgccaatgcgatcgagttgtccgatgcggtgcgcgccaagatggcggagctggaaaaacagttcccgcaggacatggcctggtcggcggcctacgaccccaccatcttcgtgcgcgattccatcaaggcggtggtgagcaccttgctggaggcggtgctgctggtggtgctggtggtgatcctgttcctgcagacctggcgtgcgtcgatcattccgttgctggcggtgccggtgtcggtggtgggcaccttcgcagcgctgtatgtgcttggcttttcgatcaatacgctgaccctgttcggcctggtgctggcgatcggcatcgtggtcgacgatgcgatcgtggtggtggaaaacgtcgagcgcaacatcgaagaaggtttgagcccgctggctgctgcgcatcaggcgatgcgcgaagtgtccgggcccatcatcgccatcgcgctggtgttgtgcgcggtgttcgtgccgatggcgttcctgtcgggcgtgaccggccagttctacaagcagttcgcggtgaccatcgccatctccacggtgatctcggcgatcaactcgctgaccctgtcgcctgcactggcagccatgctgctcaaggcccatgacgccccgaaggatggtccgacgcggttgatcgaccggttgttcggctggatttttcgtccgttcaaccgcttcttcaacaccagctcgcacaagtatcagggtgcggtttcgcgcgcgctgggcaagcgcggtatggtcttcatggtgtatctgttgctgttggtcggcaccggggtgatgttcaaactggtgccgggcggcttcattccgacccaggacaagttgtacctgatcgccggtgccaagctgcccgaaggcgcatcgctggagcgcaccagcgaggtgatcagccagatcagcgatattgcgctgcagaccgagggcgttgcgcacgcggtggcgtttcctggcctcaatccactgcagttcaccaatacgcccaacaccggcaccctgttcctgaccctcaagcccttcagcgaacgcagccggaccgcagcgcagatcaatgccgagatcaacgcgcgcatcagccagatcgagaagggcttcgccttcgccttcatgccgccgccgattcttggcttgggtcaaggctccggctattcgctgtacatccaggatcgtgccgggctcggttacgggcagttgcagactgcggtaacggcgatgtccggtgcgatctcgcagacgccgggcatgcagttcccgatcggcacctatcaggccaacgtgccgcagctcgatgcaaaggtcgatcgcgacaaggccaaggcgcagggtgtgccgctgaccaatgtgttcgacacgctgcagacctatctggggtctgcgtacatcaacgacttcaatcgcttcggtcgtacctatcaggtgatcgcccaggccgatggacagttccgcgacagcgtcgaagacatcgccaacctgcgcacccgcaacgatcgcgggcagatggtgccgatcggcagcatggtcacgctgggccagacctacggcccggatccggtgatccgctacaacggctacccggccgccgatctgatcggtgaagcggacacgcgcgtgctgtcgtccgcccaggcgatgcagacgctggccggcatggcgccgaaggtgttgcccaacggcatgaacatcgagtggaccgatctgagttatcagcaatccatccagggcaattcggcgttgatcgtgttcccgatggcggtgttgctggcgttcctggtgctggccgcgttgtacgaaagctggaccttgccgctggcggtgatcctgatcgtgccgatgaccttgctgtctgccttgttcggcgtatggctcaccggtggcgacaacaacgtgttcgtgcaggtgggactggtggtgttgatgggcctggcgtgcaagaacgcgatcctgatcgtggagtttgcccgcgaactggagatgcacggcaagggcatcgtcgaagccgcgctggaagcctgccgcctgcgtctgcgcccgatcgtgatgacctccatcgccttcatcgccggcaccgtgccgctggtgttcggccatggcgctggcgcagaagtgcgctcggtcaccggcatcaccgtgttcgccggcatgttgggcgtgaccctgttcggcctgttcctgacgccggtgttctacgtggccctgcgcaagtgggtgacccgtggcgaacccgccgcaccggccgccgtggcacatgatccggtcaaggcctga

SEQ ID NO: 74253 - protein, 1056 aa, Xanthomonas campestris pv. campestris str. ATCC 33913
MDFSRFFIDRPIFAAVLSIIIFAAGLIAMPLLPISEYPEVVPPSVQVRAVYPGANPKVIAETVATPLEEAINGVENMMYMKSVAGSDGVLVVTVTFKPGTDPDQAQVQVQNRVSQAQARLPEDVRRQGVTTQKQSPTLTMVVHLTSPKGKYDSLYLSNYATLKVKDELSRLPGVGQIQIFGAGDYAMRIWLDPDKVAARGLTASDVVAAIREQNVQVSAGQLGAEPMPNKSEFLLSINAQGRLTTEEEFGNIVIRSGTSGEIVRLSDVARLELGAGKYTLRSQLDSKSAVGMGVFQSPGANAIELSDAVRAKMAELEKQFPQDMAWSAAYDPTIFVRDSIKAVVSTLLEAVLLVVLVVILFLQTWRASIIPLLAVPVSVVGTFAALYVLGFSINTLTLFGLVLAIGIVVDDAIVVVENVERNIEEGLSPLAAAHQAMREVSGPIIAIALVLCAVFVPMAFLSGVTGQFYKQFAVTIAISTVISAINSLTLSPALAAMLLKAHDAPKDGPTRLIDRLFGWIFRPFNRFFNTSSHKYQGAVSRALGKRGMVFMVYLLLLVGTGVMFKLVPGGFIPTQDKLYLIAGAKLPEGASLERTSEVISQISDIALQTEGVAHAVAFPGLNPLQFTNTPNTGTLFLTLKPFSERSRTAAQINAEINARISQIEKGFAFAFMPPPILGLGQGSGYSLYIQDRAGLGYGQLQTAVTAMSGAISQTPGMQFPIGTYQANVPQLDAKVDRDKAKAQGVPLTNVFDTLQTYLGSAYINDFNRFGRTYQVIAQADGQFRDSVEDIANLRTRNDRGQMVPIGSMVTLGQTYGPDPVIRYNGYPAADLIGEADTRVLSSAQAMQTLAGMAPKVLPNGMNIEWTDLSYQQSIQGNSALIVFPMAVLLAFLVLAALYESWTLPLAVILIVPMTLLSALFGVWLTGGDNNVFVQVGLVVLMGLACKNAILIVEFARELEMHGKGIVEAALEACRLRLRPIVMTSIAFIAGTVPLVFGHGAGAEVRSVTGITVFAGMLGVTLFGLFLTPVFYVALRKWVTRGEPAAPAAVAHDPVKA

SEQ ID NO: 74254 - DNA, 3171 bp, Xanthomonas campestris pv. campestris str. ATCC 33913
  CDS (1)..(3171): transl_table=11
atgcctaagttttttatcgaacacccggtctttgcctgggtggtggcgatcctgatctcgctcgcgggcgtgatctcgatcctgaatctgggtatcgagtcgtaccccacgatcgccccgccgcaggtcaccgtcaccgccaacttccccggtgccagcgccgataccgccgaaaaggcggtgacgcaggtcatcgaacagcagctcaccggtatcgaccacctgctgtacttcaactcctcgtcggcctccaacggccgcgtgaccatcacgctgaccttcgaaaccggcaccgacgcggatatcgcgcaggtgcaggtgcagaacaaggtgtcgctggccacgccgcgcttgccttcggaagtgacccaacagggtgtggtggtggccaaggccaacgccggcttcctgatggtggccgcgctgcgctcggacaacccgtcgatcgaccgcgatgcgctcaacgacatcgtcggttcgcgcgtgctcgaacagatctcgcgtgtgcccggcgtgggcagcaccaaccagttcggcgccgagtacgccatgaacatctggttgaacccggagaagctgcagggctacaacctgtcggccacccaggtgctgaccgcggtgcgtaaccagaacgtgcagttcgcggccggttcggtcggtgccgaccccaccccgcagggcatcagcttcaccgcgacggtttcggccgaaggccgtttcagctcgccgcaggagttcgaaaacatcatcctgcgcaccgataacaacggtgccacggtgcgtctgaaagacgttgcacgcgtcacggtgggcccaagcaactacggcttcgacacccagtacaacggcaagccgaccggtgcctttggtatccagttgctgccgggcgccaatgcgctgaacgtctccgaggcggtcggtgccaagctcgacgagctgcagcccaccttcccgcagggcgtgacctggttcgcgccgtacgagtccaccaccttcgtgcgtatttccatcgaagaagtggtgcacacgctggtggaagccatcgtgctggtgttcctggtgatgctgctgttcctgcagaacttccgcgccacggtcatcccgaccctggtgatcccggtggcgctgctgggcacgttcttcggcatgtacgtgatcggcttcaccatcaaccagctgacgctgtttgcgatggtgctggcgatcggcatcgtggtggacgacgcgatcgtggtgatcgagaacgtcgaacgcatcatgagcgaggagcacctggagccgaaggcggccacgcagaaggcgatgacccagatcaccggcgcggtggtggccatcaccgtggtactggcggcggtgttcattccctcggccatgcagccgggcgcctcgggcgcgatctacaagcagttcgcattgaccatcgcgatggcgatggcgttctccgcgttcctggcgttgagcttcaccccggccctgtgcgcggcgttcctgaagtccacccattcggacaagaagaactggatctaccgcaccttcgacaagtactacgacaagctggcgcatcgctatgtcggcgtggtcggcaacacgctcaagcgttcgccggcctggatggtggtgttcgtggtgctggtggtgctgtgcggcttcctgttcacgcgcatgccgggcagcttcctgccggaagaagaccagggctttgccgtggccatcgtgcagctgccgccgggtgccaccaagatccgcaccaacgaggccttcgcgcagatgcgtgcggtgctggaaaagcagccggccgtggaaggcatgctgcagatcgccggcttcagcttcctgggttcgggcgaaaacgtcggcatgggcttcatccggctcaagccgtgggaagagcgtgacgtcaccgccgagcagttgatccagcaactcaacggtgccttctacggcatcaagggcgcgcagatcttcgtggtcaacctgcccaccgtgcagggtcttggccagttcggcggcttcgacatgtggctgcaggaccgttccggtgcaggccaggaggcgctgacccaggcccgcaacatcgtgctcggcaaggcggcgcagaagcaggacaccgtggtgggcgtgcgcccgaacggcctggaaaactcgccgcagctgcagttgcatgtggaccgcgtgcaggcgcagtcgatgggcctggaagtgagcgacatctacagctcgatccagctgatgctggccccggtgtacgtcaacgactacttctccgaaggccgcatcaagcgcgtcaacatccgtgccgacgaccagttccgcaccggccccgagtcgctgcgtaacttcttcacccccagcagcacggcgaccggtgcagatggtcagccggggatgatcccgctgagcaacgtggtcaaggccgagtggacctacgcctcgccggcattgaaccgctacaacggctattcggcggtgaacatcgtcggtaacccggccccgggcggcagctccggccaggcgatgcaggccatggaggagatcgtcaacaacgatctgccgccgggcttcggcttcgactggagcggcatgtcgtaccaggaaatcatcgccggtaacgccgccacgctgctgctcgcgttgtcggtggtggtggtgttcctctgcctggcggcgctgtacgaaagctggtcgattccggtggccgtgctgttggtggtgccgatcggcgtgctgggtgcgatcaccttctcgatgctgcgtggcctgccgaacgatctgtacttcaagatcggcatgatcacggtgatcggcctggcggcgaagaacgcgatcctgatcgtggagttcgcagtcgagcagcgcgcggccggcaagacgctgcgcgaggcaacgctggaagcggcgcatctgcgcttccgcccgatcctgatgacctcgttcgcgttcatcctgggtgtgttgccgctggccatttccaccggtgccggcgccaactcgcgtcactccatcggtaccggcgtgatcggcggcatggtgttcgccaccgtgctcggcgtgatcttcatcccgctgttcttcgtggtggtccgccgcatgctcggcgacaagctcgacgagccgcccaaggaatacctggccgtgcagaacgacagcggcacgcaccgcccggatcgttga

SEQ ID NO: 74255 - protein, 1056 aa, Xanthomonas campestris pv. campestris str. ATCC 33913
MPKFFIEHPVFAWVVAILISLAGVISILNLGIESYPTIAPPQVTVTANFPGASADTAEKAVTQVIEQQLTGIDHLLYFNSSSASNGRVTITLTFETGTDADIAQVQVQNKVSLATPRLPSEVTQQGVVVAKANAGFLMVAALRSDNPSIDRDALNDIVGSRVLEQISRVPGVGSTNQFGAEYAMNIWLNPEKLQGYNLSATQVLTAVRNQNVQFAAGSVGADPTPQGISFTATVSAEGRFSSPQEFENIILRTDNNGATVRLKDVARVTVGPSNYGFDTQYNGKPTGAFGIQLLPGANALNVSEAVGAKLDELQPTFPQGVTWFAPYESTTFVRISIEEVVHTLVEAIVLVFLVMLLFLQNFRATVIPTLVIPVALLGTFFGMYVIGFTINQLTLFAMVLAIGIVVDDAIVVIENVERIMSEEHLEPKAATQKAMTQITGAVVAITVVLAAVFIPSAMQPGASGAIYKQFALTIAMAMAFSAFLALSFTPALCAAFLKSTHSDKKNWIYRTFDKYYDKLAHRYVGVVGNTLKRSPAWMVVFVVLVVLCGFLFTRMPGSFLPEEDQGFAVAIVQLPPGATKIRTNEAFAQMRAVLEKQPAVEGMLQIAGFSFLGSGENVGMGFIRLKPWEERDVTAEQLIQQLNGAFYGIKGAQIFVVNLPTVQGLGQFGGFDMWLQDRSGAGQEALTQARNIVLGKAAQKQDTVVGVRPNGLENSPQLQLHVDRVQAQSMGLEVSDIYSSIQLMLAPVYVNDYFSEGRIKRVNIRADDQFRTGPESLRNFFTPSSTATGADGQPGMIPLSNVVKAEWTYASPALNRYNGYSAVNIVGNPAPGGSSGQAMQAMEEIVNNDLPPGFGFDWSGMSYQEIIAGNAATLLLALSVVVVFLCLAALYESWSIPVAVLLVVPIGVLGAITFSMLRGLPNDLYFKIGMITVIGLAAKNAILIVEFAVEQRAAGKTLREATLEAAHLRFRPILMTSFAFILGVLPLAISTGAGANSRHSIGTGVIGGMVFATVLGVIFIPLFFVVVRRMLGDKLDEPPKEYLAVQNDSGTHRPDR

SEQ ID NO: 74256 - DNA, 3141 bp, Xanthomonas campestris pv. campestris str. ATCC 33913
  CDS (1)..(3141): transl_table=11
atgaacatctccgcgcccttcatcaagcgcccgatcggcacctcgttgctggcgatcggtttgttcgtgatcggattgatgtgctacctgcggctgggcgtggcggcgttgccgaatatccaaatcccggtgatcttcgtgcacgccacgcagtccggcgccgacgccagcaccatggcctccacggtcaccgcgccactggaacgccacctgggccagctacccggcatcgaccgcatgcgctcctccagttcggagagcagcagcatggtgttcatgattttccagagtaatcgcgacattgattcggccgcgcaggatgtgcagaccgcgatcaactcggcacagtccgatctgccctccgggctcggcacgccgatgtaccagaaggccaacccgaacgacgacccggtcatcgccattgcgctgacctccgacacccaatcggccgatgagctctacaacgtggccgattcgctgctggcgcaacggctgcggcagatcaccggcatcagttcggtggatatcgccggtgcctccacgccagccgtgcgcgtggatgtggacctgcgcgcgctcaacgcattgggcttgaccccggacgacctgcgcaacgctgtgcgcgcggccaacgtcacctcgccgaccggctttttgtccgacggcaacaccaccatggcgatcatcgccaacgattcggtggccaaggccgccgacttcgcgcagctggcgatctccacccaatccaacgggcgcatcgtgcgcctgggcgatgtggccaccgtctacgacggtcagcaggatgcctaccaggccgcctggttcaacggcaaacccgcggtggtgatgtatgccttcacccgcgccggtgccaacattgtcgaaaccgtggaccaggtgaaggcgcagattcccgagctgcgcgcctacctgcaacccggcacgacccttacaccgtatttcgaccgcacgcccaccatccgcgcctcgctgcatgaagtgcaggccacgctgatgatcagcctggcgatggtggtgctgaccatggcgctgttcctgcgccgcctggcgcccacgctcatcgccgcggtcaccgtgccgctgtcgctggccggctcggcgttggtgatgtacgtgctcggcttcaccttgaacaacctcagcctgctggcgctggtgatcgcgattggcttcgtggtcgacgatgcgatcgtggtgatcgaaaacatcatgcgccacctcgacgagggcatgccgcgcctgcaggccgcactcaccggcgcgcgcgagatcggcttcaccatcgtgtcgatcactgcctcactggtggcggtgttcattccgatgttgtttgccagcggcatggtcggcgcgttcttccgcgagttcaccgtgaccttggtggccgccatcgtggtttcgatgctggtgtcgctgacgctgacgccggcgttgtgcagccgcttcctctccgcccataccgcgccggaaaaacccagccgtttcggcgcctggctggatcgcatgcacgaccgcatgctcgcggtgtacacggtggcactggatttttcgttgcggcatgccttgctgttgtcgctgacgccgctggtgctgatcgccgccaccatcttcctgggtggtgcggtcaagaaaggctcgttcccgccacaggacaccggcctgatctggggccgcgccaattccagcgccatggtgtcgtttgccgacatggtcagccgccagcgccgcatcaccgacatgttgatggccgacccggcggtgaaaaccgtgggcgcgcggctgggctccggccgccaggggtccagcgcctcattcaacatcgaactgaaaaaacgcgacgaaggccggcgcgagaccaccgcgcaggtggttgcgcgcctgagcgccaaggccgaccgttacccggatctagatttgcgcctgcgcgcaatccaggacctgcccagcgatggcggtggcggtaccagtcaaggagcgcaataccgcgtgtcgctgcagggcaacgatctcgcgcaactgcaggaatggctgcccaaggtgcaggccgcactgaaaaagaacccgcgcctgcgcgatgtcggtaccgacgtggatacctcgggcctgcgccagaacatcgtgatcgaccgcgccaaggccgcgcgcctgggaatttcagtgggtgccatcgacggcgcactgtatggcgcgttcggccagcgctccatctccaccatctattcggatctcaaccagtacagcgtggtggtcaatgcactgccatcgcagaccgccacgcccaaggcactggatgaagtgttcgtgcccaatcgcgccggccagatggtgccgatcaccgcggtggccacgcaggtgccgggcctggcgccgccgcagatcacccacgacaaccagtattcgacgatggatctgagctacaacctcgcaccgggcgtgagcaccggcgaggcggatctgatcatcaagaacaccgtggaagggctgcgcatgcccggcgacatccgcatcagcgatggtggcggtttcaacgtgcaactcaatcccaattcgatgggcgtgttgctgctggccgcagtgctcaccgtgtacatcgtgctgggcatgctctacgagagcctgatccacccggtgaccatcctgtccacgctgccggccgccggcgtgggcgcgctgctggcgttgttcatcaccaacaccgagctgtcggtgatttcgatgatcgcgctggtgctgctgatcggcattgtcaaaaagaacgccatcatgatgatcgacttcgcactggtggcgcagcgcgagcatggcaaggatgcacgtgcggctgcacgcgaggcatcgatcgtgcgcttccgcccgatcatgatgaccacgatggtggcgatcctggccgcggtgccgctggcggtggggctgggcgaaggctcggaactgcgccggccgctgggtatcgcgatgattggcgggttggtgttctcgcagggcctgaccctgctcagcaccccggcgctgtacgtgatcttttcctgcctgagcgagcgctggaaggcgcgccgcgcgcgcaagcgtgcacagcgggccgagcgcgccgccgcacgccgcccggcagcctccgcacactaa

SEQ ID NO: 74257 - protein, 1046 aa, Xanthomonas campestris pv. campestris str. ATCC 33913
MNISAPFIKRPIGTSLLAIGLFVIGLMCYLRLGVAALPNIQIPVIFVHATQSGADASTMASTVTAPLERHLGQLPGIDRMRSSSSESSSMVFMIFQSNRDIDSAAQDVQTAINSAQSDLPSGLGTPMYQKANPNDDPVIAIALTSDTQSADELYNVADSLLAQRLRQITGISSVDIAGASTPAVRVDVDLRALNALGLTPDDLRNAVRAANVTSPTGFLSDGNTTMAIIANDSVAKAADFAQLAISTQSNGRIVRLGDVATVYDGQQDAYQAAWFNGKPAVVMYAFTRAGANIVETVDQVKAQIPELRAYLQPGTTLTPYFDRTPTIRASLHEVQATLMISLAMVVLTMALFLRRLAPTLIAAVTVPLSLAGSALVMYVLGFTLNNLSLLALVIAIGFVVDDAIVVIENIMRHLDEGMPRLQAALTGAREIGFTIVSITASLVAVFIPMLFASGMVGAFFREFTVTLVAAIVVSMLVSLTLTPALCSRFLSAHTAPEKPSRFGAWLDRMHDRMLAVYTVALDFSLRHALLLSLTPLVLIAATIFLGGAVKKGSFPPQDTGLIWGRANSSAMVSFADMVSRQRRITDMLMADPAVKTVGARLGSGRQGSSASFNIELKKRDEGRRETTAQVVARLSAKADRYPDLDLRLRAIQDLPSDGGGGTSQGAQYRVSLQGNDLAQLQEWLPKVQAALKKNPRLRDVGTDVDTSGLRQNIVIDRAKAARLGISVGAIDGALYGAFGQRSISTIYSDLNQYSVVVNALPSQTATPKALDEVFVPNRAGQMVPITAVATQVPGLAPPQITHDNQYSTMDLSYNLAPGVSTGEADLIIKNTVEGLRMPGDIRISDGGGFNVQLNPNSMGVLLLAAVLTVYIVLGMLYESLIHPVTILSTLPAAGVGALLALFITNTELSVISMIALVLLIGIVKKNAIMMIDFALVAQREHGKDARAAAREASIVRFRPIMMTTMVAILAAVPLAVGLGEGSELRRPLGIAMIGGLVFSQGLTLLSTPALYVIFSCLSERWKARRARKRAQRAERAAARRPAASAH

SEQ ID NO: 74258 - DNA, 3150 bp, Xanthomonas axonopodis pv. citri str. 306
  CDS (1)..(3150): transl_table=11
atggcccgtttcttcatcgaccgtcccatcttcgcctgggtcatcgccatcgtgatcaccctggccggcgcgctctcgatcctgtcgctgccgctggagcagtatcccaacatcgccccaccgacgatcaacgtcagcgccacctacaccggcgcctcggcgcagaccgtacagaactcggtgacgcagatcctcgagcagcagatgaccggcctggatcacctgctgtacatgtcctccagcagcagctcggccggtaccgcctcgatcaccctgaccttcgagtccggcaccgacccggacaccgcccaggtgcaggtgcagaacaaggtctcgcagggcgaggcgatgctgccggaggcggtgcagagcaatggcgtgaccgtcaccaagtccaccggcagcagcatgttcatggtgctggccttcacctccgaagacggcagcatggacagcaccgacatcggcgactacatggtgtccacgctgcaggacccgatcagccggctcaacggcgttggcggggtcaacgtgttcggctccgaatatgcgatgcgggtgtggctggatccggagaagctgcgcacctattcgctgatgcccgcggacgtgagcaacgcgatttcggcgcagaacgccgacgtctcctcgggcgcgctgggcgcgttgccggcggtgcagggccagcagctcaacgccacggtcacctcgcgcagcaagctcaagaccccggcgcaattcgaggcgatcgtgctgaagtcgcagcccggcggcgccaccgtgtatctgcgcgacgtggcgcgggtggagctgggttccaagtcgtatgcatccagttccaagtacaacggcaagtcggcctcgggcatgggcctggagctggcgaccggcgccaacgcgctggatgcggccaaggcggtggaagccaagctcgaacagcttaagccgtacttccccaccgggctcacgtacgaagtcgcctacgacaccacgccgttcgtgcgtatttccatcgaggaagtggtcaagaccctgctcgaggcgatcgtgctggtagtgctggtgatgtacctgttcctgcagaactggcgcgccacgctggtgccggtgatcgcggtgccggtggtgctgctgggcaccttcggcgtgctggccttgctcggctattcgatcaacacgctgaccatgttcgcgatggtgctggcgatcggcctgctggtcgacgacgccatcgtggtggtggagaacgtcgagcgtctgatgagcgagcaaggcatgtcgccgcggcaggcgacctacacctcgatgggacagatctccggcgcgctggtcggcatcgccctggtgctgaccgcggtgttcctgccgatggccttcttcggcggcgccaccggcgagatctaccgccagttctcggtgaccatcgccgcggcgatgctgctgtcgctgctggtggcgctgaccttgagcccggcgttgtgcgcgagcctgcttaggccgatcgcgcacggccaacaggtgtcgcgcaagggagtgctcgggcgcttcttcggttggttcaacgtgcgcttcgaccgcggcgccgatggctatggtcgcggtgtgggcaagttgatcggccatcgcaaactcggcgggctggtctatctggcgctgctcgtggtaatggcgctgttgttctggcgcctgcccagttcgttcctccccgacgaagaccagggcatgttgatggtgatgttcaccacgccggccggcgccacccagcagcgcacgcagcagtcgatcgaccaggccaccagcttcatcctcaagcaaccggaggtggcggggatgatgaccatctccggcttcagctttgccggcagcagccagaactcgggcatgggtttcatcaagctcaaggattgggcgcagcgcgatgcgcccgcgcaggagatcgccaaccgcatcaccggcgcgatgatgggcacgctgcccgatgcgcaggtgttcgcattgtcgccgccggcgatcaacggcctgggcagcagttccggcttcaccctggagctgcaggacgtggccggcaagggccacgacgcgctggtcgccgcgcgccagcagctgctgcagctggccagcgccgacaaggatctgaccgcggtgcgcttcaacggcctggaagacgcgccgacctaccgcgtgcagatcgacgacgccaaggccggcgcgctcggcctggatgcgtctgacatcaacaccacgctggccacggtgatgggcggcagctacgtcaacgacttcctcaacaacaaccgggtcaagcgcgtctacgtgcagggcgaggcgcgcgcgcgcatgctgcccgccgacatcggctgctggtacgtgcgcaacagcagctcggagatggtgccgttctctgccttctccagcagcgcatgggcgtatgcgccgcaggtgctgagccgcttcaacggcgtggagtcgatggagatcaccggcagcgccgccactggcatcagttccggcgaggcgatgaacggcatcgccgcgctggtgggcaagctcggcaaggacgtgagctacgcctggtcgggcatgtcctaccaggagcaggccgccggcgcgcagacctggatgctgtacgcggtgtcgctggtgttcgtgttcctgtgcctggccgccctttacgagagttggtcgatcccgatctcggtgatgctggcggtgccggtgggcatcgtcggcgcgctgctggcaacatggctgcgcgggctctccaacgacatctatttccaggtcggcctgctggcgacgatgggcctggcggccaagaacggcatcctgatcgtggagttcgccaaggaactggaagagaagggccagccgctgatcgaagcgaccttgcatgccgcgcgcatgcgcttgcgcccgatcgtgatgacctcgctggcgttcctgctcggcgtgctgccgatggtggtcagcagcggcgccggctccggtggacgccattcgctgggtaccggtgtgctcggcggcacgctggtctctacgctgctgggcatcttcttcgtgccgttgttctacgtgatggtgcgcagcgtgtttcctggtagggcgtctgatcacgcgacagccgctgagacgtccgaggtggccccgtga

SEQ ID NO: 74259 - protein, 1049 aa, Xanthomonas axonopodis pv. citri str. 306
MARFFIDRPIFAWVIAIVITLAGALSILSLPLEQYPNIAPPTINVSATYTGASAQTVQNSVTQILEQQMTGLDHLLYMSSSSSSAGTASITLTFESGTDPDTAQVQVQNKVSQGEAMLPEAVQSNGVTVTKSTGSSMFMVLAFTSEDGSMDSTDIGDYMVSTLQDPISRLNGVGGVNVFGSEYAMRVWLDPEKLRTYSLMPADVSNAISAQNADVSSGALGALPAVQGQQLNATVTSRSKLKTPAQFEAIVLKSQPGGATVYLRDVARVELGSKSYASSSKYNGKSASGMGLELATGANALDAAKAVEAKLEQLKPYFPTGLTYEVAYDTTPFVRISIEEVVKTLLEAIVLVVLVMYLFLQNWRATLVPVIAVPVVLLGTFGVLALLGYSINTLTMFAMVLAIGLLVDDAIVVVENVERLMSEQGMSPRQATYTSMGQISGALVGIALVLTAVFLPMAFFGGATGEIYRQFSVTIAAAMLLSLLVALTLSPALCASLLRPIAHGQQVSRKGVLGRFFGWFNVRFDRGADGYGRGVGKLIGHRKLGGLVYLALLVVMALLFWRLPSSFLPDEDQGMLMVMFTTPAGATQQRTQQSIDQATSFILKQPEVAGMMTISGFSFAGSSQNSGMGFIKLKDWAQRDAPAQEIANRITGAMMGTLPDAQVFALSPPAINGLGSSSGFTLELQDVAGKGHDALVAARQQLLQLASADKDLTAVRFNGLEDAPTYRVQIDDAKAGALGLDASDINTTLATVMGGSYVNDFLNNNRVKRVYVQGEARARMLPADIGCWYVRNSSSEMVPFSAFSSSAWAYAPQVLSRFNGVESMEITGSAATGISSGEAMNGIAALVGKLGKDVSYAWSGMSYQEQAAGAQTWMLYAVSLVFVFLCLAALYESWSIPISVMLAVPVGIVGALLATWLRGLSNDIYFQVGLLATMGLAAKNGILIVEFAKELEEKGQPLIEATLHAARMRLRPIVMTSLAFLLGVLPMVVSSGAGSGGRHSLGTGVLGGTLVSTLLGIFFVPLFYVMVRSVFPGRASDHATAAETSEVAP

SEQ ID NO: 74260 - DNA, 3177 bp, Xanthomonas axonopodis pv. citri str. 306
  CDS (1)..(3177): transl_table=11
atggacttttcccgttttttcatcgaccggccgatctttgccgcggtgctgtcgatcatcatcttcgcggccggcctgatcgccatgccgcttctgccgatcagcgaataccccgaagtggtgccgccgagcgtgcaggtgcgcgcggtgtatccaggcgccaaccccaaggtcattgccgaaaccgtcgccacgccgcttgaggaagccatcaacggcgtggaaaacatgatgtacatgaagtcggtggccggctcggacggcgtgctggtggtcacggtgaccttcaagcccggcaccgacccggaccaggcgcaggtgcaggtgcagaaccgcgtcagccaggcgcaggcgcgtctgcccgaagacgtgcgccgccagggcgtgactacgcagaagcaatcgccgacgctgaccatggtcgtgcatctgacctcgcccaagggcaagtacaactcgctgtacctgagcaactacgccaccttgaaggtcaaggatgagctgtcgcgcctgccgggcgtgggccagatccagatcttcggtgccggcgactacgccatgcgcatctggttgaacccggacaaggtggccgcacgcgggcttaccgccagcgatgtggtcgccgccatccgcgagcagaacgtgcaggtctccgccggccagctcggcgcagaacccatgcccaacaagagcgatttcctgctctcgatcaatgcgcaaggccgcctcaccaccgaagaagagttcggcaacatcgtcatccgcagcggcaacagcggcgagatcgtgcggctgagcgatgtggcgcgcctggagctgggcgccggcaactacaccttgcgctcgcagctggacaaccagaacgcggtgggcatgggcgtgttccagtcgcccggtgccaacgcgatcgaattgtccgatgcggtgcgcgccaagatggccgagctggaaaggcagttcccgcaggacatggcctggtccgctgcgtacgacccgaccgtgttcgtgcgcgattcgatcagcgcggtggtgcacacattgctggaagcggtgctgctggtggtgctggtggtgatcctgttcctgcagacctggcgcgcctcgatcattccgttgctggcggtgccggtgtcggtggtcggtacgttcgctgcgttgtacctgctgggcttttcgatcaatacgctgagcctgttcggtctggtgctggcgatcggcatcgtggtcgacgacgcgatcgtggtggtggaaaacgtcgagcgcaacatcgaagaagggctgagcccgctggcggcagcgcatcaggccatgcgcgaagtgtccgggccgatcatcgccatcgcgttggtgctgtgcgcggtgttcgtgccgatggcgttcctgtcgggcgtgaccggccagttctacaagcagttcgcggtgaccatcgccatttccacggtgatttcggcgatcaactcgctgaccctgtcgccggcgttggcggcgatgttgctcaagtcgcacgacgcgcccaaggatggcccgtcgcggttgatcgaccgtctgttcggctggttgttccgcccgttcaaccgtttcttcaccaccagctcgcacaagtaccaaggtgcggtgtcgcgtgcgctgggcaagcgaggtgcggtgttcgtggtctacctgctgctgctggtcggtaccggtttcatgttcaagctggtgccgggcggcttcattccgacccaggacaagctgtatctgatcgccggcaccaagctgccggaaggctcgtcgctggagcgcaccaacgaagtgatccgccagatcacccagatcgcgctgcagaccgacggcgtggatcatgcaatcgcgttccccggcctgaatccgctgcagttcaccaatacgcccaacaccggcacggtgtttctgacgctcaagccgttcagtcagcgcagccgcaccgccgcgcagatcaatgcggaaatcaacgcgcgcatcagccagatccagcagggcttcgcgttcgccttcatgccgccaccggtccttggcttgggccagggctcgggctactcgctgtacatccaggaccgtgccggcctgggctatggccagttgcagagtgcggtgaatgcgatgtccggtgcgatctcgcaaacgccgggcatgcagttcccgatcggtacttatcaggccaacgtgccgcagctcgacgccaaggtcgaccgcgacaaggccaaggcgcagggcgtgccgttgaccaatctgttcgacacgctgcagacctatctgggttcgtcctacatcaacgacttcaatcgcttcggtcgtacctatcaggtgatcgcccaggccgatggacagttccgcgatagcgtggaagacatcgccaacctgcgcacgcgcaacgccaacggcgacatggtgccgatcggcagcatggtcacgctgggccagacctacggcccggacccggtgatccgttacaacggctacccggcggccgacctcatcggcgaagcggacccgcgcgtgctgtcgtccaccgaggccatgcagaagctgtccagcatggcgccgcaggtgctgcccaacggcatgaacatcgagtggaccgacctgagctatcagcagtccacgcaaggcaactcggcattgatcgtgttcccgatggcagtgttgctggcgttcctggtgctggctgcgctgtacgaaagctggaccctgcccctggcggtgatcctgatcgtgccgatgaccttgctgtctgcgttgttcggtgtgtggctcaccggcggcgacaacaacgtgttcgtgcaggtgggtctggtggtgttgatgggcctggcgtgcaagaacgcgatcctgatcgtggagttcgcccgcgaactggaaatgcacggcaagggcatcgtcgaagccgcactggaggcctgccgcttgcgcctgcgtccgatcgtgatgacctccatcgccttcatcgccggcaccgtgccgttggtgttcggccatggtgctggcgccgaagtgcgctcggtcaccggtatcacggtgttcgccggcatgctcggtgtgaccttgttcggcctgttcctgactccggtgttctacgtggcgctgcgcaagtgggtgacccgtcgcgggcccgcgacaccgcccgcagttgcgcacgatcacgcgcacgtcaacgcctaa

SEQ ID NO: 74261 - protein, 1058 aa, Xanthomonas axonopodis pv. citri str. 306
MDFSRFFIDRPIFAAVLSIIIFAAGLIAMPLLPISEYPEVVPPSVQVRAVYPGANPKVIAETVATPLEEAINGVENMMYMKSVAGSDGVLVVTVTFKPGTDPDQAQVQVQNRVSQAQARLPEDVRRQGVTTQKQSPTLTMVVHLTSPKGKYNSLYLSNYATLKVKDELSRLPGVGQIQIFGAGDYAMRIWLNPDKVAARGLTASDVVAAIREQNVQVSAGQLGAEPMPNKSDFLLSINAQGRLTTEEEFGNIVIRSGNSGEIVRLSDVARLELGAGNYTLRSQLDNQNAVGMGVFQSPGANAIELSDAVRAKMAELERQFPQDMAWSAAYDPTVFVRDSISAVVHTLLEAVLLVVLVVILFLQTWRASIIPLLAVPVSVVGTFAALYLLGFSINTLSLFGLVLAIGIVVDDAIVVVENVERNIEEGLSPLAAAHQAMREVSGPIIAIALVLCAVFVPMAFLSGVTGQFYKQFAVTIAISTVISAINSLTLSPALAAMLLKSHDAPKDGPSRLIDRLFGWLFRPFNRFFTTSSHKYQGAVSRALGKRGAVFVVYLLLLVGTGFMFKLVPGGFIPTQDKLYLIAGTKLPEGSSLERTNEVIRQITQIALQTDGVDHAIAFPGLNPLQFTNTPNTGTVFLTLKPFSQRSRTAAQINAEINARISQIQQGFAFAFMPPPVLGLGQGSGYSLYIQDRAGLGYGQLQSAVNAMSGAISQTPGMQFPIGTYQANVPQLDAKVDRDKAKAQGVPLTNLFDTLQTYLGSSYINDFNRFGRTYQVIAQADGQFRDSVEDIANLRTRNANGDMVPIGSMVTLGQTYGPDPVIRYNGYPAADLIGEADPRVLSSTEAMQKLSSMAPQVLPNGMNIEWTDLSYQQSTQGNSALIVFPMAVLLAFLVLAALYESWTLPLAVILIVPMTLLSALFGVWLTGGDNNVFVQVGLVVLMGLACKNAILIVEFARELEMHGKGIVEAALEACRLRLRPIVMTSIAFIAGTVPLVFGHGAGAEVRSVTGITVFAGMLGVTLFGLFLTPVFYVALRKWVTRRGPATPPAVAHDHAHVNA

SEQ ID NO: 74262 - DNA, 3144 bp, Xanthomonas axonopodis pv. citri str. 306
  CDS (1)..(3144): transl_table=11
atggcacgtttctttatcgatcgtccgatcttcgcctgggtgttggccatcatcgtgatgctggccggcatcctctccatcgccaccttgccgattgcgcaataccccgccatcgcaccgccggctgtcgccatcaccgccaactacccgggcgcctcggcgcagacgctggaagacaccgtcacccaggtcatcgagcagaagatgaaggggctggatcacctcagctacatggcgtccaccagcgaatccagcggggcggtgaccatcaccctgactttcgaaaacggcaccgaccccgacaccgcgcaggtgcaggtgcagaacaagttgtcgctggccacgccgttgttgccgcaggaagtgcagcagcagggcgtcacggtgaccaagtcggccaccaacttcctcaacgtgctggcctttacgtccgaagacggcagcatgagcgattcggacctgtccgattacgtggctgccaacgtgcaggaaaccatcagccgcctcgaaggcgtgggcgacaccaccttgttcggttcgcagtacgcgatgcgggtgtggatggaccccaacaagttgagcaatttcagcctcacgcccgtggatgtgcgcaacgcgatccaggcacagaacgcgcagatttccgccggccagttgggcgcattgccggcgctggccaaccagcagctcaacgccaccatcactgcccagacccggctgaagaccgccgagcaattcgagaatatcctgctgcgcacgcagtccgatggctcgcaggtgcgcttgcgcgatgtggcgcgcatcgagctgggcagcgaaagctacaacacggtgggccgttacaacggcaagccggcggccggtctggcgatcaagctggcgaccggggccaatgcgctggatacggtgcgcgcgatcgataaaagcctggaagagcaggaaaagttcttcccgcccggcatgaaggtgcaaaagccgtacgacaccaccccgttcgtgcgcatctccatcgagcaggtggtacacacgctggtggaggcggtggtgctggtgttcctggtgatgtacctgttcctgcagaacttccgcgccaccctgatcccgaccattgcggtgccggtggtgctgctgggcaccttcggtgtgcttgcggcgttcggcttcaccatcaataccttgaccatgttcgcgatggtgctggcgatcggtttgctggtggacgatgcgatcgtggtggtggaaaacgtcgaacgcgtgatgggcgaggagcagttatcgcccaaggacgccacgcgtaaatcgatggaccagatttccggcgcattgatcggcgtggcgctggtgctggcggcggtgttcgtcccgatggcgtttttcagcggctccaccggcgtgatctaccggcagttctcgatcacgattgtctcggccatgaccttgtcggtgctggtggcgatgatcctgaccccggccttgtgcgccaccttgctcaagccggtccacaagggccatggcctggcgaccaccgggttcttcggttggttcaaccgcctgttcgatcgcggcaacaccggctaccagggcgtggtgcggcacatgcttggcaagggctggcgctacatgctcgcctacgccgcgttgctggccttggtggtgttcgggttcatgaaattgccggtgggattcctgccggacgaagaccagggcaccttgttcgtgctggtgcagttgccgcccggtgccaccaatgcgcgcaccagcgatgtgctcaagcaggtggagcatcatttcctggtcgatcagaaggagtctgttgccggtgtcttcgccgtgaccggtttcagttttgccggtagcggccagaacgtgggctttgccttcgtcaagttgcggccttgggacgagcgcaccggtaagggccagagcgtcaccgacgtggcggccaaggccggggcatttttttccggtatccgcgatgccaaggtgtttgcgttcgcaccgcctgcggtgtcggagttgggcaatgccaccggcttcgatctgatgctgcaggaccgcgccaatctgggtcacgccgcgttgatgcaggcgcgtaatcaattgttggccgaactgtcccaggacaagcgtctggtggcggtacgcccgaatgggcaggaagacacgccggaattcaagctggaaatcgacccgcataaggcacaggcgatgggcgtgtcgatctccgacatcaacgacaccttctccagcgcgtggggcagcacctacgtcaacgacttcatcgacaagggccgggtcaagaaggtgatgctgcaggccgctgcgccataccgcatgaacccacaggacatcgaccattggttcgtgcgcaacagcgccggcaccatggtgccattcaacgccttcgccacggcaagctggcaatccggttcgccgcgcctggagcgttacaacagcgtgccgtcgatggagatcctgggcatggcgttgccgggtgcggcctccagcggcgaggcgatgcagatcgtcgaagccgcagccgccaagctgcccccgggcatcggcttcgagtggaccggattgtcgcggcaggaaaaagcctcgtccggccagaccgggctgttgtacagcgtctcgatcctgatcgtgttcctgtgcctggccgcgttgtacgaaagctgggcgattccgttctcggtgattctggtggtgccgctgggcgtgttcggcacgttgctggcagccatgctgacctggaaaatgaacgacgtgtacttccaggtgggcttgctcaccaccattggcctggcatcgaagaacgcgatcttgatcgtggagttcgcaagggagttgcacgaaggcggcaagagcctggtggctgcagcactggaagcggcgcgcatgcgtttgcgaccgatcctgatgacctcgttggccttcatcctcggcgtggtgccgctggtgttgaccagtggcgccggcgccggcgcgcagcacgcgctgggcacggccgtgatcggcggcatggtctccggcacggtgctggcgatcttcttcgtgccgctgttcttcgtgctggtgtgtggcctgttccagcgccgtccacagcctgcttcgcccgcaccgcaaccgacaggacactga

SEQ ID NO: 74263 - protein, 1047 aa, Xanthomonas axonopodis pv. citri str. 306
MARFFIDRPIFAWVLAIIVMLAGILSIATLPIAQYPAIAPPAVAITANYPGASAQTLEDTVTQVIEQKMKGLDHLSYMASTSESSGAVTITLTFENGTDPDTAQVQVQNKLSLATPLLPQEVQQQGVTVTKSATNFLNVLAFTSEDGSMSDSDLSDYVAANVQETISRLEGVGDTTLFGSQYAMRVWMDPNKLSNFSLTPVDVRNAIQAQNAQISAGQLGALPALANQQLNATITAQTRLKTAEQFENILLRTQSDGSQVRLRDVARIELGSESYNTVGRYNGKPAAGLAIKLATGANALDTVRAIDKSLEEQEKFFPPGMKVQKPYDTTPFVRISIEQVVHTLVEAVVLVFLVMYLFLQNFRATLIPTIAVPVVLLGTFGVLAAFGFTINTLTMFAMVLAIGLLVDDAIVVVENVERVMGEEQLSPKDATRKSMDQISGALIGVALVLAAVFVPMAFFSGSTGVIYRQFSITIVSAMTLSVLVAMILTPALCATLLKPVHKGHGLATTGFFGWFNRLFDRGNTGYQGVVRHMLGKGWRYMLAYAALLALVVFGFMKLPVGFLPDEDQGTLFVLVQLPPGATNARTSDVLKQVEHHFLVDQKESVAGVFAVTGFSFAGSGQNVGFAFVKLRPWDERTGKGQSVTDVAAKAGAFFSGIRDAKVFAFAPPAVSELGNATGFDLMLQDRANLGHAALMQARNQLLAELSQDKRLVAVRPNGQEDTPEFKLEIDPHKAQAMGVSISDINDTFSSAWGSTYVNDFIDKGRVKKVMLQAAAPYRMNPQDIDHWFVRNSAGTMVPFNAFATASWQSGSPRLERYNSVPSMEILGMALPGAASSGEAMQIVEAAAAKLPPGIGFEWTGLSRQEKASSGQTGLLYSVSILIVFLCLAALYESWAIPFSVILVVPLGVFGTLLAAMLTWKMNDVYFQVGLLTTIGLASKNAILIVEFARELHEGGKSLVAAALEAARMRLRPILMTSLAFILGVVPLVLTSGAGAGAQHALGTAVIGGMVSGTVLAIFFVPLFFVLVCGLFQRRPQPASPAPQPTGH

SEQ ID NO: 74264 - DNA, 3141 bp, Xanthomonas axonopodis pv. citri str. 306
  CDS (1)..(3141): transl_table=11
atgaacatctccgcgcccttcatcaagcgcccgatcggcacctcgctgctggcgatcggtttgttcgtgatcggattgatgtgctacctgcggctgggcgtggcggcgctgccgaacatccagattccgatcatcttcgtgcacgctacccaatccggtgccgacgccagcaccatggcctccaccgtcaccgcgccgctggaacgtcacctgggccagttgcccgggatcgaccgcatgcgctcgtccagctcggagagcagcagcctggtcgtactggtgttccagagcagccgcaacatcgattcggccgcgcaggacatccagaccgcgatcaacgcatcgcaatcggacctgccctccgggctaggaacgccgatgtactccaaggccaacccgaacgacgacccggtgatcgccatcgcgttgacctcggagacgcaatcggccgatgagctctacaacgtggccgattcgctgctggcgcagcggctgcgccagatcaccggcatcagctcggtggacatcgccggtgcgtccaccccggcagtacgcgtggacgtggacctgcgcgcactcaacgcgctgggcctgacaccggacgatctgcgcaatgcggtgcgcgcggccaatgtgacctcgccgaccggattcctgtccgacggcaacaccaccatggccatcatctccaacgattcggtgtccaaggccgccgattttgcgcagctggcgatctccacccagtccaacgggcgcatcgtgcgcctgggcgatgtggccaccgtttacgacggccagcaggatgcctatcaagccgcctggttcgacggcaaaccggcggtggtgatgtacgccttcacccgcgccggcgccaacatcgtcgagaccgtcgaccaggtgaaggcgcagattcccgaactgcgtagctatctgcagcccggcaccacgctcacgccctacttcgaccgcacgcccaccattcgcgcctcgctgcacgaggtgcaggccacgctgatgatcagcctggcgatggtgatcctgaccatggcgctgttcctgcgccggctcgcgcccaccctgatcgccgctgtcaccgtgccgctgtcgctggccggctcggcgctggtgatgtacgtgctcggcttcaccttgaacaacctcagcctgctggcgttggtcattgcgattggcttcgtggtcgacgatgcgatcgtggtgatcgaaaacgtcatgcgccatctggacgaaggcatgtcgcgcctggacgcggcgttggccggtgcgcgcgagatcgggttcaccatcgtgtcgatcaccgcctcgctggtggcggtgttcatcccgatgctgttcgccagcggcatgatcggtgcgttcttccgcgagttcaccgtgacgttggtggcggcgatcgtggtgtcgatgctggtctcgctgaccttgacgccggcgctgtgcagccgtttcctgtcgccgcacgccgagcctgaaacacccgaccgtttcggcgcctggctggaccgcatgcacgaacgcatgctgcgcgcgtacacggtggcgctggatttctcgctgcgccacgcactcctgctgtcgttgacgccgttgttgctgatcgccgccaccatctttctgggcagtgcggtcaagaagggctcgttccccgcgcaggacaccggcctgatctggggccgcgccaattccagcgccacggtgtcgtttgccgacatggtcagccgccagcgccgcatcaccgacatgctgatggccgacccggcggtgaaaaccgtcggcgcacgcctgggctccggccgtcagggctccagcgcatcgttcaatatcgagctcaaaaagcgcgatgagggccgtcgcgacaccaccgccgaagtggtcgcgcgcctgagcgccaaggccgaccgttacccggacctggacttgcgcctgcgggcgatccaggacctgcccagcgacggcggcggcggcaccagccagggcgcgcaataccgcgtgtcgctgcagggcaacgacctggcgcagctgcaggaatggcttcccaaactgcaggctgcgctgaaaaagaacccgcacctgcgcgatgtcggtaccgacgtggataccgccggcctgcgccagaacatcgtgatcgaccgcgccaaggcggcgcgcctgggcatctcggtgggcgccatcgatggtgcgctgtatggcgcgttcggccagcgctcgatttccaccatctattccgatctcaatcagtacagcgtggtggtcaatgcactgccctcgcagacagccacccccaaggcgctggatcagatcttcgtgcccaaccgtgccggccagatggtgccgatcaccgcggtcgccacccaggcaccgggcctggcgccgccgcagatcatccacgaaaaccagtacaccacgatggagctgagctacaacctggcaccgggcgtcagcacgggcgaggcggacttgatcatcaaatccaccgtggagggcctgcgcatgcccgacggcatccgcctcagtggcgacgacagcttcaacgtgcagctcagtcccaattcgatgggcatcctgctgctggccgcagtgctcaccgtctacatcgtgctgggcatgctctacgagagcctgatccatccggtgaccatcctgtccaccttgccggccgccggcgtgggcgcgctgctggcgttgttcatcaccaacaccgaactgtcggtgatctcgatgatcgcgctggtgctgctgatcggcatcgtcaagaaaaacgccatcatgatgatcgacttcgcgttggtggcgcagcgcgtgcatggcatggatgcgcgcgcagccgcacgcgaggcctcgatcgtgcgcttccgcccgatcatgatgaccacgatggtggcgatcctggccgccgtgccgctggcggtgggcctgggcgagggctcggagctgcgtcgccctctaggtatcgcgatgatcggcgggctggtgttctcgcagagcctgaccctgctcagcacgccggcgctatacgtgatcttctcgtgcctgagcgagcgctggaaggcgcgtcgcgcccgcgcgcgggcacgccgtgcagaacgcgcagcggcgcgtcgcccggccgcccaagcgcactga

SEQ ID NO: 74265 - protein, 1046 aa, Xanthomonas axonopodis pv. citri str. 306
MNISAPFIKRPIGTSLLAIGLFVIGLMCYLRLGVAALPNIQIPIIFVHATQSGADASTMASTVTAPLERHLGQLPGIDRMRSSSSESSSLVVLVFQSSRNIDSAAQDIQTAINASQSDLPSGLGTPMYSKANPNDDPVIAIALTSETQSADELYNVADSLLAQRLRQITGISSVDIAGASTPAVRVDVDLRALNALGLTPDDLRNAVRAANVTSPTGFLSDGNTTMAIISNDSVSKAADFAQLAISTQSNGRIVRLGDVATVYDGQQDAYQAAWFDGKPAVVMYAFTRAGANIVETVDQVKAQIPELRSYLQPGTTLTPYFDRTPTIRASLHEVQATLMISLAMVILTMALFLRRLAPTLIAAVTVPLSLAGSALVMYVLGFTLNNLSLLALVIAIGFVVDDAIVVIENVMRHLDEGMSRLDAALAGAREIGFTIVSITASLVAVFIPMLFASGMIGAFFREFTVTLVAAIVVSMLVSLTLTPALCSRFLSPHAEPETPDRFGAWLDRMHERMLRAYTVALDFSLRHALLLSLTPLLLIAATIFLGSAVKKGSFPAQDTGLIWGRANSSATVSFADMVSRQRRITDMLMADPAVKTVGARLGSGRQGSSASFNIELKKRDEGRRDTTAEVVARLSAKADRYPDLDLRLRAIQDLPSDGGGGTSQGAQYRVSLQGNDLAQLQEWLPKLQAALKKNPHLRDVGTDVDTAGLRQNIVIDRAKAARLGISVGAIDGALYGAFGQRSISTIYSDLNQYSVVVNALPSQTATPKALDQIFVPNRAGQMVPITAVATQAPGLAPPQIIHENQYTTMELSYNLAPGVSTGEADLIIKSTVEGLRMPDGIRLSGDDSFNVQLSPNSMGILLLAAVLTVYIVLGMLYESLIHPVTILSTLPAAGVGALLALFITNTELSVISMIALVLLIGIVKKNAIMMIDFALVAQRVHGMDARAAAREASIVRFRPIMMTTMVAILAAVPLAVGLGEGSELRRPLGIAMIGGLVFSQSLTLLSTPALYVIFSCLSERWKARRARARARRAERAAARRPAAQAH

SEQ ID NO: 74266 - DNA, 3192 bp, Chlorobium tepidum TLS
  CDS (1)..(3192): transl_table=11
atgtttgaacgtttcatctcccgccctgtgctggcgaccgtcatttcggtcatcctcgtgattctcggtctggtcagcatgaggcagctttcgatcacccgtttccctgacatcgctccgccgagcgtttcggtgacggcgagttatcccggcgcggacgccgaaaccgtcggccgtacggtggctccgccgctcgaagaggcgatcaacggcgtcgagaacatgacctacatgacctcgacttcgtcgaacgacggttcgctctccatcaacgttttcttcaagcagggcactgatcccgatcaggcggcggtgaacgtgcaaaatcgcgtggcgcaggctaccagccagcttcccaccgaggtgaaccagatcggcatatcaaccatcaagcgccagaacagccagatcatgctcatcaatctggccagtaatgtcaaggctttcgacgcgaccttcctgcagaactatgccaaaatcaacatcgtcgatgacctggcccgagtgccgggggtcgggcaggtgtcggtctatggcaagatggattactccatgcgcgtctggctgcgtccggcgcagatggctgcttacggcttgtcaccgcaggaggtgtcggcggcgatccagagccagaaccttgaagccgctcccggtcagtttggcgagatgagcggcgagccgatgcagtacgtaatgaagtaccgcggcaagttccagcgcccggaggagtacgagaacatcgtgattcgcgccaaccccgatggctcgctgcttcgcctcaaggacattgcccgcgtcgagttcggcgcgtacagctacacggtcaactccaaggtcaacggcaagccgggcgtggtgatggcggtctatcagtctcccggctccaacgccaacgaggtcgagacccaactgcgcaaggtgctcgaaaaggcgtcgcagaactttccgaccggcatcgagtattcgattccgttcagctccaaaaaggtggtcgatgagtccatcgcgcaggtgcagcacacgctgatcgaggcgttcctgctcgtgtttctcgtggtgttcctcttcttgcaggatttccgctcgaccctgattcctgccatcgccgtgccggtggcgatcatcggcaccttcttcttcatgaacctgttcggcttttcgatcaacgtgctgacgctcttcggcctggtgctggccatcggcatcgttgttgacgacgccattgtggtggtcgaggcggtgcacgccaagatcgaggagaagcagtggccggccaagatcgccacggtctcggcgatgcgcgaaatcacaacggccatcgtgaccattacgctcgtcatggcctcggtcttcctgccggtgggatttctcgaaggttcgactggcgtcttctaccgtcagttcgccttcacgctcgccatcgcgatcctcatctcggcggttaacgccctgaccctcagcccggcgctttgcgcgattttcctgacagacctgcacaagcattcgaaagagaagcactcgcgcttcggcggtttcggcgggcgctttgtcaagggcttcaacgccgggtttgatgcggtgcgccagcgctacaccggtattctcgactactttatgcgcaaccggaaggtggcattcatcggtcttgcgctggtgaccgccgtgtcgttctggatgttcaaaaccacgccgaccggcttcattcccgacgaagacaacggcttcgtgatcgtatcggtttccacgccgcccggcgcgtcgatggctcgtacgcaggcggtgacggatcgggcggacaacattctgcgcactatgcccgcgatcaagaaggtgatctccgtgaccggcatcaacattctcacccgcagctcgtcgccctcggctggcctgatgttcattcagctcaacgatctgaaggagcgaggcaaggttcgagacatcaaggcgattctcgggcaggtcaacgaaaagcttgcgccgatcaaggatgccaactttttcgtgctctccatgccgacagtgcccggtttcggcacggtgagtggtctggaaatggtgctgcaagaccgtagcggcggcgacctgcacaagttcgaggatgtggccaagggcttcatcggcgcactgatgcagcggcccgaaattgccgtggctttcaccaccttcaaggcgagctatccgcagtatgagctggtggtcgataacgtcaaggccgccgatctcggcgtgaacgtcaaagagctgatgacggtcttgcaggcctactacggcagtcagcaggcctccgatttcaaccgttttggcaagtatttccgtgtcgtgatgcaggccgagcggggtgatcgccggacgcccgattcgctgaatggcattttcgtcaagaatgccagtggcgaaatggtgccagtcagctcgatcatcagtttgaagcgcgtctatggcccggacgccgtcgatcacttcaacctcttcaacgccatatcgatcaacgccatgcctgctcctggttacagcaccggtcaggcgatccaggcggtggacgaggtgtcgcgcaccagtcttccggcgggtttcacctacgactggaaggggcagagccgcgaggagatcgaatcctccggcggtctttttttcattttcctgctctcggtggtgtttgtctatttcctgctttcggcgctttacgagagctaccttttgccgtttgccgtcatgttctccattccgaccggcctgctcggcgtttttctcggcatcaagctggcggggatcgagaacaatatctacgtgcaggtggccatcattatgctcatcggtcttttggccaagaacgcaatcctgattgtcgagttcgcgctccagcggcgcgtggctggtatgccgctcgtcgaagcggcgatggaaggcgcgaaagcgaggctgcgcccgattctgatgacttcgctggcctttgtggcgggtttgattccactgctctttgtgaccggcccggcagcgatgggcaaccactcgattggtgcgtcggccatcggcggcatgttcgtcggcatggtactcggcatcatggtggtgccggtgcttttcgtggccttccagggcttgcaggagcgcttcaccggcccggcggcggagattgtcgaagccggaaccttgcttgaaaagcagttgaagaaggatggttcgcacgaatga

SEQ ID NO: 74267 - protein, 1063 aa, Chlorobium tepidum TLS
MFERFISRPVLATVISVILVILGLVSMRQLSITRFPDIAPPSVSVTASYPGADAETVGRTVAPPLEEAINGVENMTYMTSTSSNDGSLSINVFFKQGTDPDQAAVNVQNRVAQATSQLPTEVNQIGISTIKRQNSQIMLINLASNVKAFDATFLQNYAKINIVDDLARVPGVGQVSVYGKMDYSMRVWLRPAQMAAYGLSPQEVSAAIQSQNLEAAPGQFGEMSGEPMQYVMKYRGKFQRPEEYENIVIRANPDGSLLRLKDIARVEFGAYSYTVNSKVNGKPGVVMAVYQSPGSNANEVETQLRKVLEKASQNFPTGIEYSIPFSSKKVVDESIAQVQHTLIEAFLLVFLVVFLFLQDFRSTLIPAIAVPVAIIGTFFFMNLFGFSINVLTLFGLVLAIGIVVDDAIVVVEAVHAKIEEKQWPAKIATVSAMREITTAIVTITLVMASVFLPVGFLEGSTGVFYRQFAFTLAIAILISAVNALTLSPALCAIFLTDLHKHSKEKHSRFGGFGGRFVKGFNAGFDAVRQRYTGILDYFMRNRKVAFIGLALVTAVSFWMFKTTPTGFIPDEDNGFVIVSVSTPPGASMARTQAVTDRADNILRTMPAIKKVISVTGINILTRSSSPSAGLMFIQLNDLKERGKVRDIKAILGQVNEKLAPIKDANFFVLSMPTVPGFGTVSGLEMVLQDRSGGDLHKFEDVAKGFIGALMQRPEIAVAFTTFKASYPQYELVVDNVKAADLGVNVKELMTVLQAYYGSQQASDFNRFGKYFRVVMQAERGDRRTPDSLNGIFVKNASGEMVPVSSIISLKRVYGPDAVDHFNLFNAISINAMPAPGYSTGQAIQAVDEVSRTSLPAGFTYDWKGQSREEIESSGGLFFIFLLSVVFVYFLLSALYESYLLPFAVMFSIPTGLLGVFLGIKLAGIENNIYVQVAIIMLIGLLAKNAILIVEFALQRRVAGMPLVEAAMEGAKARLRPILMTSLAFVAGLIPLLFVTGPAAMGNHSIGASAIGGMFVGMVLGIMVVPVLFVAFQGLQERFTGPAAEIVEAGTLLEKQLKKDGSHE

SEQ ID NO: 74268 - DNA, 3153 bp, Yersinia pestis KIM
  CDS (1)..(3153): transl_table=11
atggctaagttctttatagatcgccctattttcgcttgggtcatcgccatcatcatcatgttggctggtgcccttgcgatcatgaaattaccagtagcgcaatatccgaccattgcgccaccggcaattacaattgccgccaactatcctggcgccgatgcgacaactgtgcagaatacagtgacgcaggttatcgaacagaacatgaacggcatcgataacctgctctatatgtcttccagcagtgactcctccggtaacgttcagttgacgttgacctttaactctggcactgacccggatattgctcaggttcaggtccagaataaactgcaattagccatgccactgctgccacaagaagtgcagcaacagggcgtgagcgttgaaaagtccagtagtagcttcctgatggttgccggttttatttctgaagacggtacgatgcagcaggaagatatcgccgactatgtgggctctaacattaaagaccccatcagccgtacaccaggggtaggtgatgttcagttgttcggttcccaatatgccatgcgcatctggatggacccgcataagctgaataactacaagctgacaccggtcgatgtgattaacgcgataaaaatacagaacaaccaggtcgctgcgggtcaattgggggggacaccaccagtaccaggtcaggaattgaactcatcaatcattgcacaaacccgtttgaccaatgcagaagagttcagccagatattactgaaagtgaataccgacgggtcgcaagttcgcttgaaagatgtggctatcgttaaactgggtgctgaaagctataacatcattgcccgttataacggtaaaccggccgcaggtattggtattaagctggccaccggggcgaacgccttgaacacctctgcggcagtgaaagccgagttggccaaattacagccattcttcccatcggggttgaccgtagtttatccgtatgacaccacaccatttgttaaaatttcgattaacgaagtggttaagacactgatcgaagccattatcttggtgttcttggtaatgtacctgttcctacagaacttccgcgcaaccttgatcccaacgattgcggtgccggtagtgctattgggtacctttgctattttgtccgcctttggctattcgataaacaccttaacgatgttcgggatggtgctggcgatagggctattggtcgatgacgccattgtggtggtggaaaacgtcgaacgcgtgatgcaagaggagggcttaccaccgaaagaagcaaccaaaaaatccatggagcagatccagggggcattggttgggatcgcgttggtattgtctgcggtatttgttccgatggcttttttcggtggcgcaactggggctatttaccgtcagttctccattactatcgtttcggccatggtgctttcggttctggtggcattaattctgacaccagcactgtgtgcgaccatgctaaaaccgatcaagaaaggcgatcatggtccaaaaactggcttctttggctggtttaacaacatgttcgaaaagagtacacaccactataccgacagtgtcgccaatattttgcgcagcacaggccgttatctggttatctatctggctattgtgattggtatggcggtgcttttcatgcgtctaccgtcttcattcctgccagaagaagatcagggggtgttcctaaccatggtgcagttgcctgcgggtgctacgcaagaacgtacccagaaagtactgaaccatgtgacggattactatctcgacaaagaaaaaaacgtggttaactccgtgttcaccgttaacggctttggtttcagtggtcaaggtcagaacaccggtttggcattcgtgagtctgaagaattgggatgagcgtaaaggcgagcaaaataaagttccagccattgtcagccgcgcctctgctgcattctcgaaaattaaagacggtatggtgttcgcctttaacttacccgccattgtggagttaggtacggctaccggtttcgacttccagttaattgatcagggtaacctggggcaccaacaattaacggatgcacgtaaccaactgttgggtatggcagcgcaacatccagatatgctggttggcgtgcgccctaatgggctggaagatacaccacagtttaaagtggaagttgatcaggagaaagctcaagccttgggcgttgctatttctgacatcaataccacgctgggttcagccatgggcggcagctatgtaaacgactttatcgaccgaggtcgtgtgaagaaagtttatgtacaagccgatgcaccattccgtatgttgccggatgatatcgataagtggtatgtccgtaataatatgggtcagatggtgtcatttgcgaccttctccaccgcgaaatgggaatatggctcaccacggctcgagcgttataatgggttgccatcaatggagattctgggtcaggctgcaccgggtaagagtaccggcgaagccatggatctgatgcaagagctggcagctaaattaccaagtggcgtaggctatgattggaccggaatgtcctatcaggaacgtctatcgggtaatcaggccccagcactgtatgccatttcattgattgtggtcttcttgtgcttggccgctctgtatgaaagttggtcaattccattctccgttatgctcgtggtaccgctcggggttgttggtgcattactggcagccacactgcgcgggttggaaaacgacgtttacttccaggtaggcttgctgaccaccattgggctatcggccaagaacgccatcttgattgttgagtttgccaaagacttgatggataaagaaggcaagggcttggtggaatcaacattggaatcggtgcgtatgcgtctgcgcccaatattgatgacctcactggcctttatccttggggtaatgccactggttatcagtagtggtgccggttctggtgcacagaacgcggtaggtaccggcgtaatgggggggatgatcactgcgaccgtactggctatcttctttgttccgctattcttcgttgtggttcgtcgccgcttcagcagaaagactgatgatattgaacatagtcatccagttaacacgccggtgaaataa

SEQ ID NO: 74269 - protein, 1050 aa, Yersinia pestis KIM
MAKFFIDRPIFAWVIAIIIMLAGALAIMKLPVAQYPTIAPPAITIAANYPGADATTVQNTVTQVIEQNMNGIDNLLYMSSSSDSSGNVQLTLTFNSGTDPDIAQVQVQNKLQLAMPLLPQEVQQQGVSVEKSSSSFLMVAGFISEDGTMQQEDIADYVGSNIKDPISRTPGVGDVQLFGSQYAMRIWMDPHKLNNYKLTPVDVINAIKIQNNQVAAGQLGGTPPVPGQELNSSIIAQTRLTNAEEFSQILLKVNTDGSQVRLKDVAIVKLGAESYNIIARYNGKPAAGIGIKLATGANALNTSAAVKAELAKLQPFFPSGLTVVYPYDTTPFVKISINEVVKTLIEAIILVFLVMYLFLQNFRATLIPTIAVPVVLLGTFAILSAFGYSINTLTMFGMVLAIGLLVDDAIVVVENVERVMQEEGLPPKEATKKSMEQIQGALVGIALVLSAVFVPMAFFGGATGAIYRQFSITIVSAMVLSVLVALILTPALCATMLKPIKKGDHGPKTGFFGWFNNMFEKSTHHYTDSVANILRSTGRYLVIYLAIVIGMAVLFMRLPSSFLPEEDQGVFLTMVQLPAGATQERTQKVLNHVTDYYLDKEKNVVNSVFTVNGFGFSGQGQNTGLAFVSLKNWDERKGEQNKVPAIVSRASAAFSKIKDGMVFAFNLPAIVELGTATGFDFQLIDQGNLGHQQLTDARNQLLGMAAQHPDMLVGVRPNGLEDTPQFKVEVDQEKAQALGVAISDINTTLGSAMGGSYVNDFIDRGRVKKVYVQADAPFRMLPDDIDKWYVRNNMGQMVSFATFSTAKWEYGSPRLERYNGLPSMEILGQAAPGKSTGEAMDLMQELAAKLPSGVGYDWTGMSYQERLSGNQAPALYAISLIVVFLCLAALYESWSIPFSVMLVVPLGVVGALLAATLRGLENDVYFQVGLLTTIGLSAKNAILIVEFAKDLMDKEGKGLVESTLESVRMRLRPILMTSLAFILGVMPLVISSGAGSGAQNAVGTGVMGGMITATVLAIFFVPLFFVVVRRRFSRKTDDIEHSHPVNTPVK

SEQ ID NO: 74270 - DNA, 3120 bp, Yersinia pestis KIM
  CDS (1)..(3120): transl_table=11
atgttgcatttctttattcgtcgccccaagtttgccattgttatcgcattggtgatcaccctggttggctgggtttcactgtatgttatcccggtcgagcaatacccggatatcacgccgccggtggtctccgtcagtgctgtttatcccggtgccagcgccagagacgtggcgcaagccgtcgcgtcaccactggaagcgcaggtcaatggcgtcagccatatgttgtacatggaatcaaccagcgccaataacggcagctaccaattgagcattacctttgccagtggcaccgatcccgatatggcggcggttgaggtacaaaaccgcatttcacaggtgagcgcgcaactgcctgccgaggtgaatgaaaatggcatctcggtacgcaaacgtgcgtcaaacctactattaggggtcagcgttttctccccgcaacagacccatgacgcactgtttgtcagtaactacaccagcatacaattgcgtgatgctattgcacgtatcagtggtgtcggtgatgtacaggtctttggtgcgcgcgattacagtatgcgtgtctggctggatccacagcgcatggaatcactgaatgtcagcgtgcaggatatcgttgccgcgttacaacagcagaacgtacaagcggcggcagggcagataggctcttcaccgtcgatgcccaatcaacaacagacactgaccatcagtgggcaggggcgcttgaccgatgcacggcagtttgccgatgtgattatccgcagcaaccctcagggcggtatgatccgcttgggcgatgtggcccgcgtggccttgggggcacagaattatcaggtcagtgcggcacaaaaccagactgaatcagccttcttagtggtgtatccggttcccggagccaatgcacttaatgtggccaatggcgtccgtgatgaaatggcccggctgtcggccgcctttccggcggatctcacctatgaaattaattacgactccaccctgccggtgacggcgacactgcatgagattgcggtgtcactgaccttgacactgattgtggtgctcgccgtggtgtacctttttttacaaagtctgcgcgcgacctttattgtggcgctcacggttccggtctcgttacttggcacctttgctgtgctgtatgtctttggttattcagccaatactctcagtttgttcgctattattctggccctgaccattgtggtggatgatgccattgtggtggtcgaaaacgttgagcggttattgtcgaacgaccctcatctttcaccggcagaggccacccggcaggcgatgagccagattgccgggccgatcatcgccaccacactggtgttgatggcggtatttgtgccaatcgctatcttgccggggattattggcgagttgtatcgccagtttgcggtaacgctttcggcggcggtcattctctccagtatcaatgcgttaacgctgagtccggcgctgtgtgccgttctgcttaagcggcgcacactcgcaacgactggcatgttcggcacgattaacaaggggcttgatcgcgcccgtgatggttatgttggcttaacggggcggatcaaccgccgtgcggtatttagtatcgccgcgctgctactggtggggttagcaacatggtggggttatagccgactgccaacctcgttcctaccagaggaagatcagggctatttctttgtcagcttacaattgccagatggtgcctcactgaaccgaacccaaacggtgatggaccagatgtatcaacaggtgagcacgaatgaggccgttgaggatgtaataaaaattacggggttcagcctgctcagtggcaacaatgcgcccaatgccggttttgctattgtgatgctaaaaccttggggccagcggccgcatattgatcgggtgctagccagtattcaggccaatctggcggctatcccctcggcaatgattatggcggtgaacccgccagcgattgccggtttgggcagtgcttcgggctttgatttgcgcattcaggcactgctaggccaatcgccgcaagagctggcgcaggtgagccaagggattatttttgccgccaatcaggacccgacattgagccgggtctttaccaccttcagtgcttcggtgcctgaaaccaatttgagtatcgatcgtgaccgcgcggccttgttacaagtgccggtcagccgaatcttccaaacgctgcaaacctcgctgggggggatgaatgccggtgatttcaccttgaataaccgtatgttccgggtgcaattacaaaacgatatgaatttccgccagcgcacggcgcagatcaataacctaaatgtacgcagcgataacggggcattagtcagtttggcgaacctggtcacgttgaccccgtcagtgggcgcgccctttatcagtaatttcaaccagttcccttcggttgcgatcagcggttcagcggctgatggggccagctcaggtcaggcgatggcggcaatggaagcgctattggcgcagaatttaccgcaaggctacagctacagttggagcgggatgtcatggcaagagcagcagaccggcgggcaagtggtgtttatttatcttgcggcgctggtcttcgcttatctgtttttagtcgcccagtatgaaagctggagtatcccgctggtggtggttctctcggtggtgtttgccgtggggggggcggtggcggggctatcggcgatggggtttgccaacgatgtgtatgcgcaaataggcttagtgctactgatcgggttggcggcaaagaatgcgattctgattgtcgaattctccaaggcgcggcgagaagagggggcgagtattgcggaggctgcacaggacggcgctaaacagcgtttccgcgccgtgatgatgaccgctatttcgtttatcctcggcgtgatgccgttggtttttgccagcggtgccggggcgatgagccgccagattattggtatcacggtatttggcggcatgttgatggctaccgccgtagggatcttatttattccggcgctgtatctgcatattcaacggttgcgcgagtggacaaaaaaccgcaagcaggatgttgacgaaagcctgtaa

SEQ ID NO: 74271 - protein, 1039 aa, Yersinia pestis KIM
MLHFFIRRPKFAIVIALVITLVGWVSLYVIPVEQYPDITPPVVSVSAVYPGASARDVAQAVASPLEAQVNGVSHMLYMESTSANNGSYQLSITFASGTDPDMAAVEVQNRISQVSAQLPAEVNENGISVRKRASNLLLGVSVFSPQQTHDALFVSNYTSIQLRDAIARISGVGDVQVFGARDYSMRVWLDPQRMESLNVSVQDIVAALQQQNVQAAAGQIGSSPSMPNQQQTLTISGQGRLTDARQFADVIIRSNPQGGMIRLGDVARVALGAQNYQVSAAQNQTESAFLVVYPVPGANALNVANGVRDEMARLSAAFPADLTYEINYDSTLPVTATLHEIAVSLTLTLIVVLAVVYLFLQSLRATFIVALTVPVSLLGTFAVLYVFGYSANTLSLFAIILALTIVVDDAIVVVENVERLLSNDPHLSPAEATRQAMSQIAGPIIATTLVLMAVFVPIAILPGIIGELYRQFAVTLSAAVILSSINALTLSPALCAVLLKRRTLATTGMFGTINKGLDRARDGYVGLTGRINRRAVFSIAALLLVGLATWWGYSRLPTSFLPEEDQGYFFVSLQLPDGASLNRTQTVMDQMYQQVSTNEAVEDVIKITGFSLLSGNNAPNAGFAIVMLKPWGQRPHIDRVLASIQANLAAIPSAMIMAVNPPAIAGLGSASGFDLRIQALLGQSPQELAQVSQGIIFAANQDPTLSRVFTTFSASVPETNLSIDRDRAALLQVPVSRIFQTLQTSLGGMNAGDFTLNNRMFRVQLQNDMNFRQRTAQINNLNVRSDNGALVSLANLVTLTPSVGAPFISNFNQFPSVAISGSAADGASSGQAMAAMEALLAQNLPQGYSYSWSGMSWQEQQTGGQVVFIYLAALVFAYLFLVAQYESWSIPLVVVLSVVFAVGGAVAGLSAMGFANDVYAQIGLVLLIGLAAKNAILIVEFSKARREEGASIAEAAQDGAKQRFRAVMMTAISFILGVMPLVFASGAGAMSRQIIGITVFGGMLMATAVGILFIPALYLHIQRLREWTKNRKQDVDESL

SEQ ID NO: 74272 - DNA, 3135 bp, Thermosynechococcus elongatus BP-1
  CDS (1)..(3135): transl_table=11
atgattagcaatttttttattaaacgccctgtttttgcaacggtttgttctctacttattattctagtgggggcgatcgcgctgccaaccctacccattgagtactaccctaacgtcagaccaccaacaattcaggtgtctgccaactatgcaggtgcgaatgccgaaacggtcgaaacgaatgtcaccacgatcctagaaacgcaaattaatggcgtggaagggatggattacattgactccaccagtaacagctttggcaacagcaatatcacgattaccttcacggagggctatgacgaaaacattgctgcggtggatgtgaataacttagttgcctctgttacctcacaactgccaccagaggtcattaacactggggtcaatgttagcaaatccacgaatcagattgttttggccttagccctgtacccagaggaggggtacgactacgacgccaccttcatcagcaactacgcgacactttatgtggtgcaacctctgcaacgtctgaagggtgtagggaaggttcagatctttggtcaacgcacctatgccatgcggatttggcttgatcccaatcgcttagccagtcgcggtctcacggctcaggatgtggtgggcgctctctccgatcagaacgtccaagtgggggccggaattattggtgcccccccagcaccagagggacaggagtttcaaatttccattcaagcccaaagtcgcttagcttcagaagaagagtttgccgacattattattcagcgcggtgaagatggttccgtggttcgtattcgcgatgtcggtcgcaccgagctaggagcacaaaactacaacaccaactttcagtttgatggccgtaacgcagttgggattggtatctatcaactcagtagtgccaatgccctcgacattgcccgtgctgtggaagcagagatggctattttagccgagaaatttccccccggcctcaaatggagtgtgggatttagcaccaccgatgcggtgcaggagtcgatcaaagaggtagtcattaccctgattgtggccatcatccttgtgattgcggtgatctttttatttcttcaagattggcgtgccacaattattccatcggtgacaatccccgtctcgttgatcggcacttttgcctttatgaaggcttttgggttctcgattaacagtttgaccatgtttggtctggtgctggcgacggggctggtggtggatgatgcgattgtggtcgtggaaaatgtcacccgtctcatagaagaggagggcatgactccccaagaagcagccagtcgctcaatggaggaagtaacgggagcgttgattgccacctcattggtgatgatggcggtcttcatccctgtggccttttttccgggggttactgggcggctgtatcagcagtttgctttgacgattgtctttgcgatcgccctttctacttttaatgccttaaccctttctccccctttgtgcgccctgctcctacggcgggaacgccccccgatggcgaactttatcttgtttcgctggatcaaccgcttgattgaaagaacgcggcggggctacgcaggaagcctaaatgtgattgtgcgattaaaatactgggtactggcgggctttgtcgccctgctgggggtgacctactggctgtttcagatcgttcccggtggctttgtccccgaagaggatcagggttattttgtcaccctcgtacaatccccccaaggggtctccctagaatacacgagtaatattgtcttcaaaatagcggacgcgatcgcccgaaatccagcggttgaacatacctttgccattggcggctttagcttcttcggcataggttcagataaaggaattatctttacgagcctcaagccttggtcacagcggccagcccttgatcagttgctaccccagtttcagaaggtggtagcgggtgaactcggagcagtggtgttttcgtccaatgtgccgaccattgaccttggtggcagtggccttggcggctttgatatgcaggtgatggatcagcagggtctaggtcttgaaacccttgccagttcggtgaacgagctgatcctgaaagcaaatagcacgcccggttttgttgctgttaataccccctttgccattaatgccccccagttaaatgtgacggtcgatcgcacccgcgcccttgccttggggatttccctcaaggacatttttaatgctatgcagatttacttggggtcgttatacgttaaccaattcacaatctttgcccgcagttaccaagtgattgtgcaggcggataagcagtttcgctcgaatcccgatgacatcaaccgcatctatgtgcgttcagagcaaaatgccctcattcccctcagtaatctcgtaaaaattgaagaggtctcggcaccgcccattatttatcaccataacttgttccgttcagcagaggtgaccggccaaaatgtgccgcccctcagtgatcgtcaagcaatgatgacaatggcatccttggctgaggaggttctccccaatggcatcggctacagctggacggggttatccctagagtcgctccggtccgcaggccaagcaccgttgatttttggccttggtcttgtgtttgtgttccttgtgctctcagcgcagtacgaaagctatattgaccccttgatcatcatcctttcggtgcctttggcaatcatgggcgctttgctggcacagtggttgcgggggctgaataatgatgtattttgccaaattggcttggtgatgctgattggcctcgccagtaagaatgcaatcttgattgtggagtttgccaaccaaattcgtgaaagcaagggcactgccattgtcaagtcggtgattaatgctgccgaagaacgactgcgccctattttgatgacggcaatctcctttattttgggtatcttcccgctggtaattgccacggggtctggcgcaaaatcccgtcactccttgggaaccagtgtcacgggtggcatgattgcggccacattcctcagtttctttgtggtgccgatcatttacatcctcattaaggaagtggtggcacggctgaccaaggagaagcccgaggacgcaacaccaacggcgtcttaa

SEQ ID NO: 74273 - protein, 1044 aa, Thermosynechococcus elongatus BP-1
MISNFFIKRPVFATVCSLLIILVGAIALPTLPIEYYPNVRPPTIQVSANYAGANAETVETNVTTILETQINGVEGMDYIDSTSNSFGNSNITITFTEGYDENIAAVDVNNLVASVTSQLPPEVINTGVNVSKSTNQIVLALALYPEEGYDYDATFISNYATLYVVQPLQRLKGVGKVQIFGQRTYAMRIWLDPNRLASRGLTAQDVVGALSDQNVQVGAGIIGAPPAPEGQEFQISIQAQSRLASEEEFADIIIQRGEDGSVVRIRDVGRTELGAQNYNTNFQFDGRNAVGIGIYQLSSANALDIARAVEAEMAILAEKFPPGLKWSVGFSTTDAVQESIKEVVITLIVAIILVIAVIFLFLQDWRATIIPSVTIPVSLIGTFAFMKAFGFSINSLTMFGLVLATGLVVDDAIVVVENVTRLIEEEGMTPQEAASRSMEEVTGALIATSLVMMAVFIPVAFFPGVTGRLYQQFALTIVFAIALSTFNALTLSPPLCALLLRRERPPMANFILFRWINRLIERTRRGYAGSLNVIVRLKYWVLAGFVALLGVTYWLFQIVPGGFVPEEDQGYFVTLVQSPQGVSLEYTSNIVFKIADAIARNPAVEHTFAIGGFSFFGIGSDKGIIFTSLKPWSQRPALDQLLPQFQKVVAGELGAVVFSSNVPTIDLGGSGLGGFDMQVMDQQGLGLETLASSVNELILKANSTPGFVAVNTPFAINAPQLNVTVDRTRALALGISLKDIFNAMQIYLGSLYVNQFTIFARSYQVIVQADKQFRSNPDDINRIYVRSEQNALIPLSNLVKIEEVSAPPIIYHHNLFRSAEVTGQNVPPLSDRQAMMTMASLAEEVLPNGIGYSWTGLSLESLRSAGQAPLIFGLGLVFVFLVLSAQYESYIDPLIIILSVPLAIMGALLAQWLRGLNNDVFCQIGLVMLIGLASKNAILIVEFANQIRESKGTAIVKSVINAAEERLRPILMTAISFILGIFPLVIATGSGAKSRHSLGTSVTGGMIAATFLSFFVVPIIYILIKEVVARLTKEKPEDATPTAS

SEQ ID NO: 74274 - DNA, 3132 bp, Brucella suis 1330
  CDS (1)..(3132): transl_table=11
gtgagtaacaagaacccttcttccggcggttcgacggcgcttttcatccgccgccccgtctttgccttcgtcatcaatatcctgatcgttgtggcgggccttgcagcctttaccggcgtcgatatccgtgaattgccggatgtggatcggccggtcatcacgatcagcacggattttagcggcgcatctgccgaaaccatcgaccgtcaggtcacacaggttctggaaaatgcggtcgcgcgtgtttccggcgtgaaatcgatttcctccacctcctccttcgagcgcagccgcgtgacggtggagttcaacgatggcgtcgatctcaacgtcgccgccgccgatatgcgcgatgcgatttcccgcgtcgccaacaatctgccggaagaagccgatccctcgcgcatcatcaaggcggattccaacgccgatccggtgatgcgccttgccgttacctccgacaccatggcggtcgatgacatgacggtgctggtggaagatcagatcgaggacgtgctttccgccgtgcccggcgtcgccgacgtgcagatcaacggtgaccgcgacaagattttccgcatcgatatcgatcaggcccggcttgcaagctacggtctcaccattgctgatatttccaacgcgctttcgtcgatggggctggatgcgcccgcaggttcgcttcgcagttccgaccagtccatcgtggtgcgcgccaccgccaatctggaaaagccggaagatttcgagaatgtctatatcaaggggcgcacgcagatccgcgatgttgcgacagtcacccttgggccggatatcgaaagctcggcggtgcgctccaacagcaagaccgccatcggcctcggcatcgtgcgtcaggcgcagtcgaacacgctcgatatttcgcaaggcgtgcgcgcagccgttgccaatttgcagaaaaccctgccggaaggggtcagcattgccgttaccagtgacgatgcgaacttcatcaacggcgccatccatgaagtcgaaatcgcgctgatcgcgtcggtgattatcgtcgttgccatcatcttcatgtttctgtgggatgcgcgcgcgacactgatccccgcgctctccatgccggtcgccctgatcggcaccattgcggcgatctatctggtgggcttctcggtcaatatcctcacgcttctggcgctggtacttgccacgggcctcgtggtggatgatgccatcgtggttctggaaaacgtggtgcgccgccgcaatcagggcatggggccgcgcgccgcagccgtgctcggtacgcaggaagtgttcttcgccgtcatcgccaccacgcttacgcttgctgccgttttcgtgccgatttccttcctgccggggcaggcgggcggcctgttccgcgaattcggcttcgtgctggcaattgcggttcttctttcctccgtggtcgcgctcacactttgccccatgctcgcctcgcgcttcctgaaggaagcaagcgccacggtggaaagcgaagggcatggcccgctcttcctgcgccgcattggcggcggcttggcgaatttctatcgcaagacgcttcatgcctgcctttcggcgccctttatcgtcgtgctggtggcagtgcttttcgccggtgcgtcctatgtcggctatggcctgatccgccaggaactcacgccttcggaagaccgcgcggtggcgcttctgcgcatcaacgggccgcagggcatcagtgtcgaattccttcagtcccagctcgacaagatcgaggaagcgatccagcccctgcgcgatagcggtgaaatcaccaccacctacgcgattgccggttcaggtggctcgtccaataatggttttgtggtgctgacgcttgccccctggaaggagcgccagcgttcccagcaggaaatcatggccgacatcaccaaccggatcaaaggcattacggcggtgcgcgtctttaccacgcagcccaacagccttggtattcgcggcgcgggcaatggtctgcaattcgctattgtcggtggtgaatatgccaaactccagcctgccgcgcaggcggtggtggcggcgctggagaaagacccgcgcttcgtgcagccccgcctgtcggtggagccgacacaggcgcagatttcggtggagatcaaccgcgagcgtgcttccgatctgggcatcgatatcaccggccttgccaatgccgtgcaggcggttctcgatggccgcaagatcggttcggtctatgtgggcgaccgcagcttcgatgtgaagctcgtctcgaccaccaacccgatcaacgatccgaccgatcttgaaaatattttcatgaaaacagcggatggccgctatgtgccgatgtcatccattgcaagcgttgtcgaaaaggctgttccgccacagcttaatcgggagttgcgccagcgttccgtggcgatcaccaccaatctgcgtgacgattttgcgctcggtaacgcctttgcggcggcgcaggagattgccgccccgcttctgccgcccggcagccacatcatcccgcttgccgaagcgtccacgctcagcgaaacgtcgagcggcatggccatcgtgttcggctttgctatcgttatcattttgctggtgctggcagcacagtttgaaagcttcatcagcgcgttgatcgtcatggccacggtacctttgggcctgggctgtgcagtcttcgccatgatcctcaccggcacgagcctcaacgtctatagccagatcggccttgtgctgcttgtcggcatcatggccaagaacggcattctcatcgtggaattcgccgaccagttgcgcgacaagggcctgaatgttcgcgaggcaatcgaggaggcggcgaatatccgcctgcgtcccgtctgcatgacgatgatctgcgcggtcctgggcggcgtgccgctggtgctggcaagcggcgcgggcgcagaagcccgcgtggcgcttggctgggtcatcgttggcggattgggtcttgcgaccatcgccacgctttatgtgacgcctgttgcctatctcctgcttggccgtttcaccaagccaaaggttgaggaagaggaacggctggaacgcgagcttgtccgcgccgaggctctggaagaaaaactcaaatag

SEQ ID NO: 74275 - protein, 1043 aa, Brucella suis 1330
MSNKNPSSGGSTALFIRRPVFAFVINILIVVAGLAAFTGVDIRELPDVDRPVITISTDFSGASAETIDRQVTQVLENAVARVSGVKSISSTSSFERSRVTVEFNDGVDLNVAAADMRDAISRVANNLPEEADPSRIIKADSNADPVMRLAVTSDTMAVDDMTVLVEDQIEDVLSAVPGVADVQINGDRDKIFRIDIDQARLASYGLTIADISNALSSMGLDAPAGSLRSSDQSIVVRATANLEKPEDFENVYIKGRTQIRDVATVTLGPDIESSAVRSNSKTAIGLGIVRQAQSNTLDISQGVRAAVANLQKTLPEGVSIAVTSDDANFINGAIHEVEIALIASVIIVVAIIFMFLWDARATLIPALSMPVALIGTIAAIYLVGFSVNILTLLALVLATGLVVDDAIVVLENVVRRRNQGMGPRAAAVLGTQEVFFAVIATTLTLAAVFVPISFLPGQAGGLFREFGFVLAIAVLLSSVVALTLCPMLASRFLKEASATVESEGHGPLFLRRIGGGLANFYRKTLHACLSAPFIVVLVAVLFAGASYVGYGLIRQELTPSEDRAVALLRINGPQGISVEFLQSQLDKIEEAIQPLRDSGEITTTYAIAGSGGSSNNGFVVLTLAPWKERQRSQQEIMADITNRIKGITAVRVFTTQPNSLGIRGAGNGLQFAIVGGEYAKLQPAAQAVVAALEKDPRFVQPRLSVEPTQAQISVEINRERASDLGIDITGLANAVQAVLDGRKIGSVYVGDRSFDVKLVSTTNPINDPTDLENIFMKTADGRYVPMSSIASVVEKAVPPQLNRELRQRSVAITTNLRDDFALGNAFAAAQEIAAPLLPPGSHIIPLAEASTLSETSSGMAIVFGFAIVIILLVLAAQFESFISALIVMATVPLGLGCAVFAMILTGTSLNVYSQIGLVLLVGIMAKNGILIVEFADQLRDKGLNVREAIEEAANIRLRPVCMTMICAVLGGVPLVLASGAGAEARVALGWVIVGGLGLATIATLYVTPVAYLLLGRFTKPKVEEEERLERELVRAEALEEKLK

SEQ ID NO: 74276 - DNA, 3156 bp, Brucella suis 1330
  CDS (1)..(3156): transl_table=11
atgaacaggttctttgtcgatcgcccggttttcgcggcggtcatatccatcgttctcgtgctggctggcctcatctgcatccgcattctgccagttgcccaatatcccgagctgacgccgccgcaggtggttgtgagcgcgacctatccgggtgcaagcgcggaaaccgtggcgcagaccgttgcagcgccgctggaacagcagatcaacggcgtcgagaacatgctttatatgcagtcctcgagccttggttcgggcactatgcaattgaccgtgaccttcgcactgggcaccgacccggaccaggccacgatcaacgtgaacaaccgcgttcaacgcgccacctcctcgctgccgcaggaagtgcagcgccttggcgtgaccgtggacaagcgtttcacgaccattctcggcatggtcgcgatgttcgccaccaccgatcgttacgaccgcacctatgtcggcaattatgcgcttttgaacgtcgtggacgatctcaagcgcctgccgggcgtaggtgacgtgcagttgctcggcaatatcgattattcgatgcgcgtctggctgcgcccggacaagcttgcccagtacaatctgacaccgagcgatgtttccgcagccattcaggaacagaacgcgcagttcgccgctggccgtttcggcgatcagcccgatccgcacgcagggcccttcacctatacggccaccacacagggccgtttgccggatgccgccgctttcgagaatatcatcctgcgctcatcgagccagaatgccgcgacgcttcgtctgaaggacgtggcccgtgtcgagcttggcacggaaagctatctggttgatagtaacctgaacggtacgcccgccgttccgatcgcgatctatctccagccgggcgcgaatgcgctcaacacaatggagctgatccagaaccggatgaacgagctgaaggcaagctttcccgccggtatcgactatgcgatccccttcgatacgaccaagttcatcaaggtctccatcgaggaagtggttcacaccttcatcgaggctatcatcctcgtcgtgctggtggtgttcatcttcctgcagaactggcgtgcaacactcattcccgtcatcgcggtgccgatctcgatcatcggtacatttgcgggcatgtatgtgcttggcttctcgatcaatcttctcacattgttcgggcttgtgctcgccatcggtatcgtggtcgacgacgccatcgtggtgctggaaaatgtcgaacgcatcatgaccaccgaaaaactctcgccacgcaaggccgccatcaaggccatgggcgaggtgacggggccggtgatcgctatcgttctcgtgctttgcgccgtgttcattccggttgcgttcatgggcggtctggttggcgaaatgtacaagcagttcgccgtcaccatcgccatttctgtgacgctctccggccttgtggccctgacgctgacgcccgcactgtgcgcgctcatcctcaagcccggccatcatgagccgatcctgccgttccgcattttcaaccgtgccttcgagcgcgtgacgagcggttatacgcgcggtgtccgcttcttcctgaagcgcgccaccatcggcctcatcatctttgcgggcctgctcggcagcacttattacctgttcgagcgggttcccggttcgctattgccggatgaagaccagggcttcctgttcggtgtcgccgttctgcccccagccgcttcgctggagcgcacgactgtcgtgctcgaccaggtgagcgagaacatccgcaagaaccctgccgtggacaatgtcttcgccgtctctggcttcgaccttctgtcgggcggtttgaagaccagtgcaggcaccatgttcatcatgctcaaggactggaaggagcgcaccacgcccgacgcggatgcgcgcaacctgccacgcaccatcatgggcatgaatgccggtatcaaggacggcatggttctggccttcaacccgcctccgatcatgggtctcagcacgacgggcggctttgaactctatgttcaggaccgcacgggcggcggtgtggaatcgctgacgcaggcaacgaagctcatcactgaggcggctgccaagcgccccgaattgcagggcgtgcgcacaaccttcgacccgaatgtcccccaatatgacattcagctcgaccgcgagaaggccaaggcgatgggtgtgccgatcaattcggtgttcaccgccatgcaggcaacctttggcagcctctatgtgaatgacttcacgctctatggccgcaactatcaggttaacctgcaatcggaagcggaattccgccgcgatccgggcgatctcaagcatgttttcgtgcgcgccgattccggcagcatgatccctcttgatgcgctggtgacggtgaagcgtattgtcggtcccgaccagcttgaacgtttcaatgcgttcaacgccgcaaaggtcaccggcaacccggctccgggctatacgtcgggtgatgcgatcaaggccatgcaggaagtggcggcgcaagttctgccgcagggctaccagatcgcatggaccggctcggcctatcaggaagtctccaccagcggcaccggctcgcaggcgatgatcttcggccttatcatggtgttcctgattctcgctgcgcaatatgaacgctggagcctgccgcttgcggttatcaccgccgtgcctttcgccatcttcggtgcgcttctggcgaccgatctgcgcgggcttaccaatgacgtctatttccagatcggtctggtgacgctcatcggtcttgcggcgaaaaacgcgatcctgatcgtggagttcgcggtgctggagcgtgagtcgggtaaatccgcaatcgaggcggcggcatcggcggcgcgcctgcgcttccgcccgatcgtgatgacgtcgcttgccttcatcctgggcgtggtgccgcttgcggtcagcaccggggctggctcggccagccgtcattccatcggtacgggcgtgatcggcggtatgctggcggcgaccttcatcgcaaccttcttcatcccgatgttctacagcctgatcgcgcgcaagccgccgaagaagcatgaggatgagacagccgatacacccgaaacgccgggcggtacgggcggcggtatttga

SEQ ID NO: 74277 - protein, 1051 aa, Brucella suis 1330
MNRFFVDRPVFAAVISIVLVLAGLICIRILPVAQYPELTPPQVVVSATYPGASAETVAQTVAAPLEQQINGVENMLYMQSSSLGSGTMQLTVTFALGTDPDQATINVNNRVQRATSSLPQEVQRLGVTVDKRFTTILGMVAMFATTDRYDRTYVGNYALLNVVDDLKRLPGVGDVQLLGNIDYSMRVWLRPDKLAQYNLTPSDVSAAIQEQNAQFAAGRFGDQPDPHAGPFTYTATTQGRLPDAAAFENIILRSSSQNAATLRLKDVARVELGTESYLVDSNLNGTPAVPIAIYLQPGANALNTMELIQNRMNELKASFPAGIDYAIPFDTTKFIKVSIEEVVHTFIEAIILVVLVVFIFLQNWRATLIPVIAVPISIIGTFAGMYVLGFSINLLTLFGLVLAIGIVVDDAIVVLENVERIMTTEKLSPRKAAIKAMGEVTGPVIAIVLVLCAVFIPVAFMGGLVGEMYKQFAVTIAISVTLSGLVALTLTPALCALILKPGHHEPILPFRIFNRAFERVTSGYTRGVRFFLKRATIGLIIFAGLLGSTYYLFERVPGSLLPDEDQGFLFGVAVLPPAASLERTTVVLDQVSENIRKNPAVDNVFAVSGFDLLSGGLKTSAGTMFIMLKDWKERTTPDADARNLPRTIMGMNAGIKDGMVLAFNPPPIMGLSTTGGFELYVQDRTGGGVESLTQATKLITEAAAKRPELQGVRTTFDPNVPQYDIQLDREKAKAMGVPINSVFTAMQATFGSLYVNDFTLYGRNYQVNLQSEAEFRRDPGDLKHVFVRADSGSMIPLDALVTVKRIVGPDQLERFNAFNAAKVTGNPAPGYTSGDAIKAMQEVAAQVLPQGYQIAWTGSAYQEVSTSGTGSQAMIFGLIMVFLILAAQYERWSLPLAVITAVPFAIFGALLATDLRGLTNDVYFQIGLVTLIGLAAKNAILIVEFAVLERESGKSAIEAAASAARLRFRPIVMTSLAFILGVVPLAVSTGAGSASRHSIGTGVIGGMLAATFIATFFIPMFYSLIARKPPKKHEDETADTPETPGGTGGGI

SEQ ID NO: 74278 - DNA, 3090 bp, Brucella suis 1330
  CDS (1)..(3090): transl_table=11
atgaatttttccgatatcttcatccggcgccccgtgcttgccacggtggtttccctcatgatcgtccttttgggcctgcaggggattgcgcagctttccgtgcgcgaatatccgaaggttgatgaaaccgtcatcaccgtgacaacggcctatgccggtgcgagcgccgatctcattcagggcttcatcactgcgcccattgcggaagcggtcgcaacaaccgaaaacattgactatgtaacctcgtccagccgtccttcgtccagtactgtcaccgtgcagatgaagctcggcgcagacccggatgcggcgctgaccgaggttatcgcgaaggtcaatcaggttcgtggcaatctgcccgacgaatccgacgatcctgtcatcgtcaagggaacgggccagagctttgccaccatgtatctggcggcgcagaaccccaatatgacgagtgagcagatcacggaatacctaaagcgcgtgatccagcctcgtatgtccaccattcagggtgtcgccaaggcggaaattctcggtgggcaggtctattcgatgcgtgtctggctggacccgatccagcttgccgcgcgccagatcaccgcgccggaagttctgtccgcgatcaaggcctcgaacttcctgtctgcgccgggcaagaccaagaacgaatatgttgcgacatcgatcacgctgaagtccaccttgcagacaccggaagctttcggggccatgcctatcaaggcgttgggcgacgaagtggtgcgcctgcgcgatgtggcaaaggtggagcttgcggcagaaagcacggatactatcgtttcgttcaacggttcggccggcacattcctcggggtctatccgacaccggcggcaaaccccatcgacatggcggcagccgtgcgcaaggaattgccatccattcaggcatcgttgccggaaggcatgtcgctcgtcctcgtttatgacgcgaccgagcagatcagttcttcgatcaacgaggcgttcacgaccattggcgaagccgtggccatcgtcattctggtcatcatcgtctttctcggctcgttccgctcggtgctcatcccgattgtcacgatcccgatctcgctgatcggcgtgtgctttttcctttatgtgctgggcttttcgatcaatctcctgtcactgcttgccatggtgctcgctatcggccttgtggtggatgacgcgatcgtggtgctggagaatatccaccggcatatcgaggaaggcttgcaccccatcgatgcggccttcaaggggatgaaggaaattaccggctcgattgtcgcaatgacgatcacgctggcggcagtgtttacgccgctcggatttatcggcggcctgacgggttctctgttccgcgaattcgccttcacgctggcgggcgcggtcattatatccggtatcgctgctttgacgatttcgccgatgatgtgttcgcgcatgttgaagcatggcgaccagacccggttccagaagtttatcgaccgcaccttttcgcgcttcgagaagtggtatcatgcgcgcgtttccaactccctgaactatcgctggatcacgctggcaattgtcttgtgcctcatggggctgacgggcttcctgttcatgaacacgtccagcgagcttgcacctgaagaagattcgggcgcactgttttccatgtttcaggccccgcaatatgcgacgtcggcctataccaatctctatgccgagcagattgatgcgctgaccaaggatctgcccgagcagaaaactcggttccagatcgttggcatggacggcggcacgacttcgggcatcgcgctctgggttttgaaagactggaatgagcgtgaccgttcgcaaaagcaaatccagcaagacctgaccgcgcgtatctccaaggttgcaggcgtgcaggccttcatcttcgcgcctccatccctgccggggacaggtggcggcctgccgatctcgatagcgctgcaatcgaccggccctgccgatcaggtgtttgcgcttgccgaagagatcaaggccgaagcacaggcttcaggccagttcattatcgtgcagaattcgctctccttcaacgcgccgcagaccacgatcacgattgaccgtgactgtgcggcgacgcttggcgtgcaggtgagcgatatcggttcgacactcggtcttttgaccggcggcgcatcgattgccaagttcgaccgcgattccaacagctacgatatcatcacacaggtgccggattcctaccgcgccaacccggaaatgctcggcaacttctatgtccgcagtgtttcaggttcgatggtgccgctgtcctcggttatccagatcaatgaaaatgccgcacctgcggccatcgaacagttcaatcagttgaactcggccacgatttcggcgctgcccttgccgggcgtgacgaccggccagggcctgcaaacactggtggatatcgccagatcgaaaatgccggaaggtttcttcctcgattattccggccagtcccgactggaggtggagcagggcaacacgatcctgatcgcttttggccttgctgttgtcgtgatctatcttgtgcttgcagcgcagtttgaaagcttccgcgatccattcatcatcatgatgtcggttccgctatcgattttcggcgctatcgtcccgctcaatatcggccttggcacgttgaacatctatacgcaggtagggcttatcacccttgtcgggctgataaccaaacacgggattctgatggtggagtttgccaatcagcagcgccgcctgcacggtctttcgcgctgcgacgccattgtggtcgccgcagaaacccgtctgcgtccgatcctgatgaccacagccgccatggcgcttggcgtggtgccgctgataatcgccaccggcgcaggcgctgccgcccgttactcgatggggctggtgatcttcacaggcatcacgatcggcaccatctttacgctgttcgtggtgccgatgttttatactttcattgcaaagaaggatgttgagggcgggtattttacgccctcggaagaaggcagtgaatctgcgccagtgcaacatcactga

SEQ ID NO: 74279 - protein, 1029 aa, Brucella suis 1330
MNFSDIFIRRPVLATVVSLMIVLLGLQGIAQLSVREYPKVDETVITVTTAYAGASADLIQGFITAPIAEAVATTENIDYVTSSSRPSSSTVTVQMKLGADPDAALTEVIAKVNQVRGNLPDESDDPVIVKGTGQSFATMYLAAQNPNMTSEQITEYLKRVIQPRMSTIQGVAKAEILGGQVYSMRVWLDPIQLAARQITAPEVLSAIKASNFLSAPGKTKNEYVATSITLKSTLQTPEAFGAMPIKALGDEVVRLRDVAKVELAAESTDTIVSFNGSAGTFLGVYPTPAANPIDMAAAVRKELPSIQASLPEGMSLVLVYDATEQISSSINEAFTTIGEAVAIVILVIIVFLGSFRSVLIPIVTIPISLIGVCFFLYVLGFSINLLSLLAMVLAIGLVVDDAIVVLENIHRHIEEGLHPIDAAFKGMKEITGSIVAMTITLAAVFTPLGFIGGLTGSLFREFAFTLAGAVIISGIAALTISPMMCSRMLKHGDQTRFQKFIDRTFSRFEKWYHARVSNSLNYRWITLAIVLCLMGLTGFLFMNTSSELAPEEDSGALFSMFQAPQYATSAYTNLYAEQIDALTKDLPEQKTRFQIVGMDGGTTSGIALWVLKDWNERDRSQKQIQQDLTARISKVAGVQAFIFAPPSLPGTGGGLPISIALQSTGPADQVFALAEEIKAEAQASGQFIIVQNSLSFNAPQTTITIDRDCAATLGVQVSDIGSTLGLLTGGASIAKFDRDSNSYDIITQVPDSYRANPEMLGNFYVRSVSGSMVPLSSVIQINENAAPAAIEQFNQLNSATISALPLPGVTTGQGLQTLVDIARSKMPEGFFLDYSGQSRLEVEQGNTILIAFGLAVVVIYLVLAAQFESFRDPFIIMMSVPLSIFGAIVPLNIGLGTLNIYTQVGLITLVGLITKHGILMVEFANQQRRLHGLSRCDAIVVAAETRLRPILMTTAAMALGVVPLIIATGAGAAARYSMGLVIFTGITIGTIFTLFVVPMFYTFIAKKDVEGGYFTPSEEGSESAPVQHH

SEQ ID NO: 74280 - DNA, 3168 bp, Leptospira interrogans serovar Lai str. 56601
  CDS (1)..(3168): transl_table=11
ttgctttccgcagtttctatacgcaatccgattttctcttggatgatgatggcagcgatcattctttttggatcaattggtttttccaggatgggtgtttcccaaatgccagacgtcgactttccggttgtaaacgtttctcttactctcaccggagccaatgcgcaagttatggaaacagacgtagtagacccaatcgaagaagttcttatgaccgtagaaggtgtcaccgaagttagatcgatttcctcagacggttctgctgcggtcactgtggaattagaactgagtcgaaacgtagacgtcgccgttcaagaaattcaaacaaaactcgctcaggtctccaacaaacttccggaagaaatggatcctcctgttatcactaaatccaatccagatgataccccaattatctgggtttccctcaccgcagtcgataaatctgaaaaagaaaaaatgctcttcgtaaaggattttcttaaagataaattccagaaaattccaggtgtgggtgaaatcattttaggtggttacgttgatagaaccatcaatgtttatttagatccgacccaactttccagaaacgaaatcgcggtagacgacatcgtaaacactttaaaagaacagaatttagaagtcccttccggaaggttagaaaatagaacaaacgaaatcagtcttcgtgccgttggcgaagttcctactgcggaacaatttggaaacatatttttaaattcaagaagcggctctcccctttttagatcgattcgtttgaaagacatttcgatcgtagaagacgggttaggcgaagttcgcagaatctctagatttaatggtatttctgcgattgcaatcggtatcaaaaaactcaaaggagcaaacgcggttcaagtaggcaacctcgttaaagacaaagtcaaagaattaaaaccgaaacttccaaaaggttatgatcttaccatttcgaacgacaacacaggttatattcgagacagcgtaaatgaactggaatttaccctaatcttttcagcaatccttaccggttttgtttgtagattgtttttaggaaactggaagagcaccggaaatgttcttcttgcaattcctacttccgtgattggaacctttttgtttttatattttgctggttttacaattaacacatttactatgttaggtttatcactagcaacagggatcgttgtagatgatgcaatcatggttttagaaaatattaccagacatagagaaatgaaaaagtcctggtttcaagccgccctggaaggagcgactgagattcgatttgccgctcttgcggcaacgttagccgtcgttgctatctttcttcctgtcgcttttatgaaaggaattattggaagatattttttagaattcggtgttacaatctctgtttcagttctcctttccctttttgaagccttaagttttactcccatgcgtgcttctttgtatgcggaaaataaaaaaaagaacgataagaaatctatcttttctgtaagtgctcacgaaatttggaatcgatggatttcaaaaatttctattttcaaaaagatggatccgattatggaacgttttttagaatacagtactattttttatgaacgttctatcgacttcgtattaaaatttcctcgttggattgtattcggttccaccatcttgtttattggatctcttggattttttttcctcttaaagaaagaatttattcctcctcaagatatgggacgttttatcgttcgagctagacttcctttaggttcttctttacaaagaactgacgaagccatgaaaaaagtagaacaatatctgatccaaagaaaagaaatagaaaagtatatttctaacataggtggttttggaggaacggaagcaaataccggaatgttttttattacgatgaaagaaatgggacacagacctaaaaatcctaaaacaggaaaagaaatcactcaagccagcttatttagtatattaagaaaagatttaaaagaattagttccagaagctacattttcggtacaagatctttctcaaagaggattttctgcgggaagaggttaccccgtggaactcgtgttaactggtcctgactggaatacgttatcctctctttctgtaaaaattttagataaactcaaagaaagtaaaattctactagacgtggatacagattatgtagcaggacagaaagagcttagacttgtaacaaaccgagaagcagccgctctgagaggagtaagcatggctaacgttggaaataccgtcggaacattgatgggaggaaaaaacgtgagtcgttttacagaaaacggtcggagctacgacgttagagtcaaaattcaaagggaaaagggagaaaccatctcggttattcccaacattggagttagaaacacatttggagaatttgtaaaattaaaagaagttataaatatccaagaaaaagaagctcttaaaacgatcactcgaatcaatcgagaaagagcgatccgagtatttggaaaccctgctcccgatttgggtcaaaacgcttctacggaaaaagcattagaaattgctaaagaaattcttccggaaggatattcggttgccatgaccggttctgcaaaaactgcaaaagaatcaggtaacagcctaactcttgctttattattcggaattctactttcttatatgatccttgcaagtcaattcaacagtttaaaacagcctttgtatattctactcgcaatgccttttagttttacaggtgcgttagtcgctctttatgtatttggacaatcttttaacatgtatagttttatcggactcattcttcttttagggttggtaaaaaagaattccattcttctcgtagagtttgtaaatcacgttcgctctaccggaaaaaatattcaagaatcgatccgagaaggttgtccaatccgtttaaggcctgtgctaatgacttcttttagttctatcgccgcagcaattccgcctgcgttggcgttagggccaggagcagaaactagaattccaatggcagtgaccatactaggtggtatgaccctttcaactttgattacacttttagtggttccagctgcgtattatttaggagaaaaggaggtaaaaattcaaccgaagatcaataaaatataa

SEQ ID NO: 74281 - protein, 1055 aa, Leptospira interrogans serovar Lai str. 56601
MLSAVSIRNPIFSWMMMAAIILFGSIGFSRMGVSQMPDVDFPVVNVSLTLTGANAQVMETDVVDPIEEVLMTVEGVTEVRSISSDGSAAVTVELELSRNVDVAVQEIQTKLAQVSNKLPEEMDPPVITKSNPDDTPIIWVSLTAVDKSEKEKMLFVKDFLKDKFQKIPGVGEIILGGYVDRTINVYLDPTQLSRNEIAVDDIVNTLKEQNLEVPSGRLENRTNEISLRAVGEVPTAEQFGNIFLNSRSGSPLFRSIRLKDISIVEDGLGEVRRISRFNGISAIAIGIKKLKGANAVQVGNLVKDKVKELKPKLPKGYDLTISNDNTGYIRDSVNELEFTLIFSAILTGFVCRLFLGNWKSTGNVLLAIPTSVIGTFLFLYFAGFTINTFTMLGLSLATGIVVDDAIMVLENITRHREMKKSWFQAALEGATEIRFAALAATLAVVAIFLPVAFMKGIIGRYFLEFGVTISVSVLLSLFEALSFTPMRASLYAENKKKNDKKSIFSVSAHEIWNRWISKISIFKKMDPIMERFLEYSTIFYERSIDFVLKFPRWIVFGSTILFIGSLGFFFLLKKEFIPPQDMGRFIVRARLPLGSSLQRTDEAMKKVEQYLIQRKEIEKYISNIGGFGGTEANTGMFFITMKEMGHRPKNPKTGKEITQASLFSILRKDLKELVPEATFSVQDLSQRGFSAGRGYPVELVLTGPDWNTLSSLSVKILDKLKESKILLDVDTDYVAGQKELRLVTNREAAALRGVSMANVGNTVGTLMGGKNVSRFTENGRSYDVRVKIQREKGETISVIPNIGVRNTFGEFVKLKEVINIQEKEALKTITRINRERAIRVFGNPAPDLGQNASTEKALEIAKEILPEGYSVAMTGSAKTAKESGNSLTLALLFGILLSYMILASQFNSLKQPLYILLAMPFSFTGALVALYVFGQSFNMYSFIGLILLLGLVKKNSILLVEFVNHVRSTGKNIQESIREGCPIRLRPVLMTSFSSIAAAIPPALALGPGAETRIPMAVTILGGMTLSTLITLLVVPAAYYLGEKEVKIQPKINKI

SEQ ID NO: 74282 - DNA, 3096 bp, Shewanella oneidensis MR-1
  CDS (1)..(3096): transl_table=11
atgatcctgaccgatctttccgttaaacggccggtgtttgcctcggtcattagtttattgctggtggcctttggtctggtcgcattcggtaaattaccgctgcgggaataccccaatatcgacccgcccattgtatcgattgaaaccaactatcgtggtgccagtgccgcggtggtcgaaagtcgcatcacccaactgattgaggacaggatcagcggggtggagggcattcgccatgtgagttcatcgagcagcgatggtcgctcacaagtgaccttagagtttgatattagtcgtaatattgaggatgcggctaacgatgtgcgtgatagaatttcgggtctattagataacttacccgaagaagccgatcccccagaggtacaaaaagccaacggtggcgatgaagtcatcatgtggttaaatcttgagtcggatcagatgaccacattagagctgactgactacacccgccgttatttagccgaccgtctgtctgtggtagatggtgtgtcgatgatccgtattggtggtggcaaagtgtacgccatgcgcgtctggctcgatagacaagcgttagcatcgcgcagtctgacggttgccgatgttgaagccgcactcagggcggaaaacgtcgagctacccgcaggttcgcttgagtcaaaggagcgccattttaccgtgcgtttagagcgtagctatcgcagcgcggaggactttgccaatttggtgatagtccaaggcgaagatggctatttggtcaagcttggcgatgtggcaagggtggaagttggctcagatgaagatcgcatcatgttccgtggtaatagggagtccatgattggactcggggtgtcgaaacagtcgactgccaataccttagaagtggcccgcggcgtcaatgcgttagttgataagatcaatcctacattaccagcgggaatgtcaattaagcgcagctacgatagttcggtgtttatcgaggcttcgatcaaagaggtgtatcaaacgctgtttaccgccatggtgctggtgattatcgtgatttatctattccttggtagcgtacgcgccatgttaatccccgcgattaccgtgcccgtgtcgttgctcggcacatttatcgtgctttatgccttgggatatacgattaacctgttgacgctgctggcgatgatccttgccatcgggatggtagtagacgatgcgattgtgatgttagaaaacattcaccgccgtatcgaagaaggggactctcccttaaaagccgccttccttggcgcccgtgaagtggcatttgcggtcattgccaccaccttagtgctggtggcggtatttatgccgattacgttccttgaaggggacttaggtaaactctttaaagagtttgcagtggccatgagtgcggcggtgattttctccagtattgtggcgttaaccttaagcccgatgatgtgcgctaagctgctcaaacccgcagagcaggactcatggttagtgcgtaaggttgatagcattatgacgggcatttcccgtcgctatcaaagctcgctagagggcgcgatgacaaaaccggtgctgatgttagttatcgtgttgattgcacttgggagcagcgtgtttcttgcccaaaaagtaccgcaggaatttgcaccacaggaggaccgaggctccttatttttaatggttaatgggccgcagggggcgagttacgagtatatcgaatcctacatgaccgaggtggaaagccgtttaatgccgctggtggattcgggtgatattaagcgcctgttgatccgcgcgccccgaggctttggccgtgcggcggacttctctaacgggatggcgattattgtgctcgaagactggggacaacgtcgtccaatgaaagaagtgattggcgatattaataaacgtctcgccgatttagccggtgtgcaagctttccctgtgatgcgtcaagcctttggccgtggtgtaggcaaacccgtgcaatttgtgattggtgggccaagctatgaggagctggctgcttggcgggatatcatgatgcaaaaggtggcggaaaatcctaaactgcttggccttgaccatgattataaagagaccaaaccgcagctcagagtggtgattgacagggacagggcggcgagtcttggggtgtcgatttccaatatcggccgtactttggagtctatgctaggctcccgcttagtcactacctttatgcgtgatggcgaagagtacgatgtgattgtggaaggggagcgcagtaaccaaaatactgcggccgatctacaaaatatctatgttcgttctgaacggacgaaggagctgatcccattatcaaacttagtcacggtagaagagtttgccgatgccagttcgcttaatcgctataatcgcatgcgggcgattaccatcgaagctagcttggctgatggctatagcttaggtgaagcgcttgattacctcaatcaagtcgcgcgggctaatttgccggcggaagcggtcatcagctacaagggacaatcgctggattatcaagagtctggcagctcaatgtactttgtgttcctgctggcactcgggattgtattcctggtattagccgcgcagtttgaaagctatattcaccctatggtgatcatgctaacggtaccgcttgccacggttggcgccttgctcgggctgtggtttaccgggcagagccttaatatctacagccagattgggattattatgctggtcggtttagcggcgaaaaacggtattttgattgtcgaatttgccaaccagttgcgggataaaggcgtggattttgaccgcgccattatccaagcctcttgccagcgtttacggccgattctgatgacgggaataactacagccgcgggcgccgtccctctggtattggcaacgggcgcaggtgctgaaacccgctttgtgattggcgtagtggtgcttgcgggtattatgctggcgacgctgtttaccatttatgtgatcccaactgcttacggtctctttgcccgtaatagcggctcgccagaagccattgcccagcaattagaaaaggaattagcgcaggattaa

SEQ ID NO: 74283 - protein, 1031 aa, Shewanella oneidensis MR-1
MILTDLSVKRPVFASVISLLLVAFGLVAFGKLPLREYPNIDPPIVSIETNYRGASAAVVESRITQLIEDRISGVEGIRHVSSSSSDGRSQVTLEFDISRNIEDAANDVRDRISGLLDNLPEEADPPEVQKANGGDEVIMWLNLESDQMTTLELTDYTRRYLADRLSVVDGVSMIRIGGGKVYAMRVWLDRQALASRSLTVADVEAALRAENVELPAGSLESKERHFTVRLERSYRSAEDFANLVIVQGEDGYLVKLGDVARVEVGSDEDRIMFRGNRESMIGLGVSKQSTANTLEVARGVNALVDKINPTLPAGMSIKRSYDSSVFIEASIKEVYQTLFTAMVLVIIVIYLFLGSVRAMLIPAITVPVSLLGTFIVLYALGYTINLLTLLAMILAIGMVVDDAIVMLENIHRRIEEGDSPLKAAFLGAREVAFAVIATTLVLVAVFMPITFLEGDLGKLFKEFAVAMSAAVIFSSIVALTLSPMMCAKLLKPAEQDSWLVRKVDSIMTGISRRYQSSLEGAMTKPVLMLVIVLIALGSSVFLAQKVPQEFAPQEDRGSLFLMVNGPQGASYEYIESYMTEVESRLMPLVDSGDIKRLLIRAPRGFGRAADFSNGMAIIVLEDWGQRRPMKEVIGDINKRLADLAGVQAFPVMRQAFGRGVGKPVQFVIGGPSYEELAAWRDIMMQKVAENPKLLGLDHDYKETKPQLRVVIDRDRAASLGVSISNIGRTLESMLGSRLVTTFMRDGEEYDVIVEGERSNQNTAADLQNIYVRSERTKELIPLSNLVTVEEFADASSLNRYNRMRAITIEASLADGYSLGEALDYLNQVARANLPAEAVISYKGQSLDYQESGSSMYFVFLLALGIVFLVLAAQFESYIHPMVIMLTVPLATVGALLGLWFTGQSLNIYSQIGIIMLVGLAAKNGILIVEFANQLRDKGVDFDRAIIQASCQRLRPILMTGITTAAGAVPLVLATGAGAETRFVIGVVVLAGIMLATLFTIYVIPTAYGLFARNSGSPEAIAQQLEKELAQD

SEQ ID NO: 74284 - DNA, 3141 bp, Shewanella oneidensis MR-1
  CDS (1)..(3141): transl_table=11
atgtggctgtccgatgtctcagttaaacgccccgtcgttgcgatcgttttaagcttattgctgtgcgtctttggcttagtgtccttcactaaactttcagtacgggaaatgcctgatgttgaaagccctgtggtgactgtcagcaccagttattccggtgcgtcggctgccattatggaaagccaaatcactaagaccctcgaagatgaacttacggggatcagcggtatcgatgaaatcacctccactacccgcaatggtagctcacggatcacggtcaaattcctcctcggttggaacttaaccgaaggggtgagtgatgtgcgtgacgcagtagctcgtgcccagcgccgcctacctgaagacgctaacgatccagtggtctccaaggacaatggttccggcgagccgtcagtgtatgtgaacctaagttcaagcgtgatggacagaacccaactgaccgattatgcccagcgggtattagaagatagattcagtctgatcagtggtgtgagctcgattagcatctctggcggtctatacaaagtcatgtatgtcaaactcaggcccgagcaaatggcggggcgcaacgtcaccgtcaccgatattaccagcgccctgcgcaaagagaatatcgaaaccccaggcggccaggtacgtaacgataccacagtgatgtcggtgcgcaccaaaaggctctattacaccccaaaggattttgattatttagtcgttcgtactgccagcgacggtacgcctatctatttgaaagatgtggccgatgtggccgtaggcgcacagaacgaaaactccacctttaagagcgatggtattgttaacctaagtctaggggtgatcactcaatccgatgctaaccccttagtcgttgcacaggaagtacataaagaagtcgataaaattcaagactttttacccgaaggcaccagccttgtggtcgactttgactccaccgtctttattgaccgctcgatcaatgaggtttacaacaccctctatgtcactggcgcgctcgtggtgttagtgctgtatatttttatcggtcaagtaagggcaacgcttatccctgcggtgacagtcccggtgtctctgatctcggcctttatcgccgccaatatgtttggctactcgattaacctattaaccttaatggcattaatccttgccattggtctagtggtcgatgatgccattgtggtggtcgaaaacattttccaccatatcgaaaaaggtgaagagccgctgcttgcggcttacaaaggcacacgggaagtcggttttgcggtcgtggcaaccaccgcagtgttagtcatggtgttcctgcctatttcctttatggagggtatggtcggtttactctttaccgagttttccgtgatgctagctgtatcggtactgttctcttccctcattgccctcacactaacacctgtactgagcagcaaactgctaaaagccaatgttaaaccaaaccgtttcaatcgctttgtcgatcgtggttttgctcgaatggaaaagctttaccatgtcggtgtgacccatgcgatccgctttagattactggcgccactggttattcttgcctgtattggcggtagcgtatggttaatgcagcaagtccccgcgcaattagcgccgcaggaagaccgcggtgtactctatgcctttgtgaaaggcgccgagggcactagctataaccgtatgacggcgaacatggatatcgtcgaagacagattaatgccactccttggccaaggtgtattgcggtctttcagtgtgcaagcccctgcctttggtggtcgtgctggcgatcaaaccggctatgtaattatgcagctagaggattgggaacatcgcaatgtcacggcgcaacaggcgttaggtattattagcaaggcattgaaagatattcccgatgtaatggttcgtcctatgatgccaggctttaggggccaatcgagtgagccagtacaatttgtactgggtggctctgattatgccgaactctttaaatgggcacaggtgttaaaagagcaagccaatgccagcccgatgatggaaggcgccgatctggattacgccgaaaccacaccggaactgattgtcaccgttgataaagagcgtgccgcagaactagggatcagcgtcgatgacgtctcccaaaccttagaagtcatgctcggcgggcgcaaagaaaccacctatgtggatcgcggcgaagagtacgatgtgtatctgcgcggtgatgaaaacagctttaacaacgttggagatttaagccaaatctatatgcgttcggccaagggcgaattagtcacgctcgatacggtcacccatatcgaagaagtggcctcggcgcaaagattgagccacaccaataaacaaaaatccatcacccttaaggctaacatcagtaaaggttacaccttaggcgaggccttaacgttcttggaaaacaagtccatagagttgttacccaaggatatttccatcggctataccggtgaatctaaggactttaaagaaaaccaaagcagcatttttattgtgttcggtttagcgctactggtagcttacttagtactcgctgcgcaatttgaaagctttatcaaccccttagtggtgatgtttactgtgccaatgggggtatttggtggtttcctcggcctgttggtaaccagtcaaggtattaacatctatagtcagatcggcatgatcatgttgattggcatggtgaccaaaaatgggatcttaatcgtcgagtttgccaaccaattgcgtgaccgaggtttggccctagacaaagccattatcgacgcctcgacccgccgcttacgcccgattttgatgacggccttcaccactttagtcggcgcgataccgctgattttctcaacgggcgcaggctctgaaagccggattgccgtggggactgtggtgtttttcggcatggcctttgcgacctttgtaaccctgttcgtcatcccggcaatgtaccgtttaatctcggccgccacccattcaccgggttatgttgaagcgaaactcgaagcggccataaaagctcaagagctcgcagcacaagaggcagccaaacagcaggagcaaacggcaaaagcttga

SEQ ID NO: 74285 - protein, 1046 aa, Shewanella oneidensis MR-1
MWLSDVSVKRPVVAIVLSLLLCVFGLVSFTKLSVREMPDVESPVVTVSTSYSGASAAIMESQITKTLEDELTGISGIDEITSTTRNGSSRITVKFLLGWNLTEGVSDVRDAVARAQRRLPEDANDPVVSKDNGSGEPSVYVNLSSSVMDRTQLTDYAQRVLEDRFSLISGVSSISISGGLYKVMYVKLRPEQMAGRNVTVTDITSALRKENIETPGGQVRNDTTVMSVRTKRLYYTPKDFDYLVVRTASDGTPIYLKDVADVAVGAQNENSTFKSDGIVNLSLGVITQSDANPLVVAQEVHKEVDKIQDFLPEGTSLVVDFDSTVFIDRSINEVYNTLYVTGALVVLVLYIFIGQVRATLIPAVTVPVSLISAFIAANMFGYSINLLTLMALILAIGLVVDDAIVVVENIFHHIEKGEEPLLAAYKGTREVGFAVVATTAVLVMVFLPISFMEGMVGLLFTEFSVMLAVSVLFSSLIALTLTPVLSSKLLKANVKPNRFNRFVDRGFARMEKLYHVGVTHAIRFRLLAPLVILACIGGSVWLMQQVPAQLAPQEDRGVLYAFVKGAEGTSYNRMTANMDIVEDRLMPLLGQGVLRSFSVQAPAFGGRAGDQTGYVIMQLEDWEHRNVTAQQALGIISKALKDIPDVMVRPMMPGFRGQSSEPVQFVLGGSDYAELFKWAQVLKEQANASPMMEGADLDYAETTPELIVTVDKERAAELGISVDDVSQTLEVMLGGRKETTYVDRGEEYDVYLRGDENSFNNVGDLSQIYMRSAKGELVTLDTVTHIEEVASAQRLSHTNKQKSITLKANISKGYTLGEALTFLENKSIELLPKDISIGYTGESKDFKENQSSIFIVFGLALLVAYLVLAAQFESFINPLVVMFTVPMGVFGGFLGLLVTSQGINIYSQIGMIMLIGMVTKNGILIVEFANQLRDRGLALDKAIIDASTRRLRPILMTAFTTLVGAIPLIFSTGAGSESRIAVGTVVFFGMAFATFVTLFVIPAMYRLISAATHSPGYVEAKLEAAIKAQELAAQEAAKQQEQTAKA

SEQ ID NO: 74286 - DNA, 3144 bp, Shewanella oneidensis MR-1
  CDS (1)..(3144): transl_table=11
atgttgtcgcagttttttattaaaagaccgatatttgcagccgtgctctcgctgctattttttatcaccggagcgattgccgtttggcaattacccattactgaatacccagaagtagtgccgccgacagtggtggtgaccgccaactaccctggcgcgaaccctaaagtcattgccgaaacggtagcctcgcccctagagcaggaaatcaatggcgtcgaagacatgctgtatatgtcatcgcaggcgacgtccgatggacgcatgaccttgaccatcacctttgccattggcaccgatgtggacagggcgcaaacccaagtgcagagccgagtcgatcgcgctatgccacgtttgccgcaggaggttcaacgcctcgggattgtgaccgaaaaatcgtcgcctgatttaaccatggtggtgcatttactgtcgccggataaccgttatgacatgctgtatttgtctaactatgcggcgctcaacgtaaaagatgagttagcacgcatcaaaggcgtgggcgcggtgcgtttattcggtgcgggcgagtacagcctgcggatttggcttgatccgaataaagtctcggcgcttggcatgtcaccatcggatattatcgctgcagtacgagagcaaaatcagcaagccgctgcgggcagtttaggagcacagcccagtggcaatgccgatttccagttgttgattaacgttaaggggcgcctgactgaactgtcagaatttgaagacattatcatcaaggtcggacaaaacggtgaggtgatccgcttgaaagatgtggcgcgagtcgaacttggtgcgatcagttatgcgctgcgttcattgctggataacaaggatgcggtggcgatcccggtattccaagcatcgggctcgaatgcgattcaaatttccgacgatgtacgcgccgaaatggcaagactagctaagtctttccccgaaggcctgcaatacgagattgtgtacgatccaactgtgttcgtgcgtggctcgattgaagccgtggtcaaaaccttacttgaagccgtgctcttagtggtattagtggtggtgttgttcctacagacttggcgtgcctcgattattccattggtggccgtgcccgtttctttggttggtacctttgcctttatgcacttgatgggcttctcgctcaatgcgttgtcactgtttggtctggtgctggccatcgggattgtggtcgacgatgccattgtggtggtagaaaacgtggagcgaaatattgcctcggggttaagcccgattgcagcgacgcaaaaagccatgaaggaagtgactgggccgattgtggcaaccaccttagtgctggccgcggtctttattccgaccgcctttatgagtggattaacggggcagttttataagcagtttgcgctgactatcactatttcgacctttatttcggccattaactcactcaccttgagtcctgcgttatcggcgttattactcaaaggccatgacgcgcctaaggatgcactcactcggttaatggataagctgtttggtggttggttatttactccttttaatcgcttattcaaccgtgcatctgaaggttatggctatttagtgcgtaaggtgatccgttttggcggcattatcggactggtgtatctgggcatggttgcgctcacgggcgtgcaatttgtgaataccccaacgggctatgtgcccggccaagataaacagtatttagtggcatttgcccaattaccggatgcggcctcactcgagcgtaccgatgtggtgatcaagaaaatgtccgacatcgccttgaatcaccccggtgtggcgcactctattgccttccccggcttgagtatcaacggttttaccaatagtcctaactcgggcgtggtgtttgttgcgctcgatgattttgagttacgtaagagtcctgaactgtcggcgaatgcgattgccggccaattaaatcagcaatttgctggtattcaggatgcgtttattgccatcttcccgccgccacctgtgcaaggcctcggcactattggagggttccgtctgcaaattcaagacagagctaaccttggttatgaggccttgtatcaggtgacccaacaagtgatgtacaaggcgtgggccgatccacaattggcggggattttctccagctatcaagtgaacgtgccacaacttgaactggatatcgatcggactaaagcgaaacagcaggcagtgtcgctcgatcaaattttccagacattacaaacctatatgggctcgacctatgtaaacgatttcaatcgttttggtcgaacctatcaggtgaatatgcaggccgacgaagcgttccgtcaaagcccgcagcagatcagtcagctaaaagtgcctaatgtgaatggcgatatgatcccactaggctcctttatcaatgtgagtcagagcgcggggcccgatcgtgtgatgcactataacggtttcaccacggctgagattaacggtggcccagcaccgggtgtgagttcgggccaagcacaggcggcgattgagaaaatcctcgccgagaccttgcccataggcatgacctacgagtggactgagctgacctatcagcagatcctcgccggtaacactggcttattggtgttcccgctggtgattgtgctggtgtttatggtgctcgcggcgcaatacgagagtttaagtttaccattggcgattatcttaattatcccaatgaccttactctcggcgctcagtggtgtgcttctctatggtggagataataatattttcacccagattggtcttatcgtcctcgtgggcttagcgacgaagaacgcgattctgattgtcgaatttgccaaagagaaacaagaccatggtatggaggttatggagtcaattcttgaggcggcacgcttaaggctgcgccccatcttgatgacttctatcgcctttatcatgggagtggtgcctatggtgttttcgacgggggcgggcgctgagatgcgtcaggccatgggagtggcggtatttgcaggtatgattggagtcactatctttggtctcattctgacaccactgttttactactccttagtaaaacgcggccgtcgtaagaggacgctagaggtctaa

SEQ ID NO: 74287 - protein, 1047 aa, Shewanella oneidensis MR-1
MLSQFFIKRPIFAAVLSLLFFITGAIAVWQLPITEYPEVVPPTVVVTANYPGANPKVIAETVASPLEQEINGVEDMLYMSSQATSDGRMTLTITFAIGTDVDRAQTQVQSRVDRAMPRLPQEVQRLGIVTEKSSPDLTMVVHLLSPDNRYDMLYLSNYAALNVKDELARIKGVGAVRLFGAGEYSLRIWLDPNKVSALGMSPSDIIAAVREQNQQAAAGSLGAQPSGNADFQLLINVKGRLTELSEFEDIIIKVGQNGEVIRLKDVARVELGAISYALRSLLDNKDAVAIPVFQASGSNAIQISDDVRAEMARLAKSFPEGLQYEIVYDPTVFVRGSIEAVVKTLLEAVLLVVLVVVLFLQTWRASIIPLVAVPVSLVGTFAFMHLMGFSLNALSLFGLVLAIGIVVDDAIVVVENVERNIASGLSPIAATQKAMKEVTGPIVATTLVLAAVFIPTAFMSGLTGQFYKQFALTITISTFISAINSLTLSPALSALLLKGHDAPKDALTRLMDKLFGGWLFTPFNRLFNRASEGYGYLVRKVIRFGGIIGLVYLGMVALTGVQFVNTPTGYVPGQDKQYLVAFAQLPDAASLERTDVVIKKMSDIALNHPGVAHSIAFPGLSINGFTNSPNSGVVFVALDDFELRKSPELSANAIAGQLNQQFAGIQDAFIAIFPPPPVQGLGTIGGFRLQIQDRANLGYEALYQVTQQVMYKAWADPQLAGIFSSYQVNVPQLELDIDRTKAKQQAVSLDQIFQTLQTYMGSTYVNDFNRFGRTYQVNMQADEAFRQSPQQISQLKVPNVNGDMIPLGSFINVSQSAGPDRVMHYNGFTTAEINGGPAPGVSSGQAQAAIEKILAETLPIGMTYEWTELTYQQILAGNTGLLVFPLVIVLVFMVLAAQYESLSLPLAIILIIPMTLLSALSGVLLYGGDNNIFTQIGLIVLVGLATKNAILIVEFAKEKQDHGMEVMESILEAARLRLRPILMTSIAFIMGVVPMVFSTGAGAEMRQAMGVAVFAGMIGVTIFGLILTPLFYYSLVKRGRRKRTLEV

SEQ ID NO: 74288 - DNA, 3135 bp, Shewanella oneidensis MR-1
  CDS (1)..(3135): transl_table=11
atggcacgtttttttattgatcgtcccatctttgcgtgggtgatcgccttaattattatgttggcgggggtgctttcaattcgcaccctgccggtttctcaatatcccagcattgcaccgccaaccgtggtgatcagtgctaactaccctggtgcatcggccaagattgttgaagactcagtgactcaggtgattgagcaacgcatgaagggtatcgatcacctacgttatattgcctcaaccagcgatagtttcggtaatgctgaaatcactttgaccttcaatgccgaagccgatcctgatattgctcaggtacaagttcagaacaaattgcagggtgcaatgaccctgttaccacaagaggtacaggctcaaggggttgacgttaacaaatcaagttctggcttyttgatggtgctgggtttcgtatcgactgacggttccttagataaaggcgacatcgccgactatgtgggtgcaaacgtacaagatcccatgagccgtgtaccgggcgtgggtgaaattcagctgtttggtgcccaatatgcgatgcgtatatggcttgatcctttaaaactgactcaatataacttgaccagtttagaggtgatctcggcgattcgtgctcaaaacgcgcaggtgtctgcgggtcagttgggtggtacgccgtcaattcaagggcaagaacttaacgccactgtttcggcgcaaagtcgtttgcaaacccctgaagagtttcgcaagattatcctgaagtctgatacttcgggtgcgaatgtgttcctcggtgatgtggcgcgcgtagagttaggttcagagagttatgccgttgtctcgttctacaatggtaagcctgctactggtttagcgattaaactggcgacaggcgcaaacgcgttggataccgctgaagctgttcgtgataaagttgaagaattgcgacctttcttcccgcaagggttggatgttgtttatccctacgatactacgccattcgttgagaaatcgatagaaggcgtggtacacaccctgctcgaagcgattgttctggtgtttgtcatcatgtacctcttcctgcaaaacttccgtgcgaccttaattccgacgattgcggtaccagtggtcttgctgggaacgtttgcgattttgtcggccacgggcttctctatcaacacccttaccatgtttgctatggtgctggcgattggtctgttggtggacgacgccatcgtggtggttgaaaacgttgagcgggtgatgtcggaagaagggttgagcccactcgaagcgactcgtaaatcgatggatcaaatcactggcgccttagttggtattggtttgacgttatctgctgtatttgtgccaatggcatttatgtcgggttctactggggtcatttaccgtcagttctcgatcactatcgtgtctgcgatggcattgtcggtattagtggccttgattttaacgccggcactttgtgccactatgttaaaacccgtgcagaagggacatggtcatattgaaaccggtttcttcggttggtttaaccgtaactttgatcgcttaactaaccgttacgaatccagtgtggcgggcatagtgaagcgtggctttagagtcatgatgatttatgtggctttagtggtcgccgtcggttggatcttcatgcgtatgccaactgcattcttacccgatgaagaccaaggtatcttgtttacgcaggcgattttgccaacaaactcgactcaagaaagtaccctcaaagtgctggataaggtatccgatcacttcatggctgaagaaggcgtgagatcggtattcagcgtggcgggctttagctttgcgggtcaaggccaaaacatgggtatcgctttcgttggcttgaaggattggtcagagcgtgaagcacctggtatggatgtgcagtctattgcgggtcgtgctatgggtgcctttagtcaaattaaagacgccttcgtatttgccttcgtaccacctgcggttattgagctgggtacggcgaatggttttgacatgtacctgcaagataaaaacggtcaaggccacgataagttaatagcggctcgtaaccaattgctgggtatggcggctcagaatccaaaccttatgggtgttcgccctaatggtcaggaagatgcgccaatctatcaattgcatattgatcatgcaaagttgagcgcattaggcgttgatattgctaacgttaacagtgtgttggcaactgcttggggtggttcctatgtgaacgattttatcgaccgcggccgtgtgaaaaaggtatttgtgcaaggtgatgcccaataccgtatgcagcctgaagacctcaacacttggtacgtgcgtaacaacaagggtgacatggtgccattttcggcctttgcaacaggttcttgggaatacggctcaccgcgtctagaacgttttaacggtttaccagcggtgaatattcaaggcgcaactgcaccaggctttagtacgggtgctgccatgactatcatggaggacttagttaagcagctaccacctggctttggcatcgagtggaacggcttatcctacgaggaacgtttatcgggtaaccaagcaccagccttgtatgcgttgtcgattctggtggtattccttgtattagcagccttgtatgaaagctggtcagtaccgtttgcggttatccttgtggttccattggggattatcggtgctctattggcgatgaatggtcgaggcttgcctaacgacgtgttcttccaagtgggtctgttaacaacggttggtttggcaaccaagaacgccatcttgattgtggaatttgcaaaagaattctacgagaagggggcgggtctggttgaggcgaccttacatgcggtccgcgtgcgtttacgtccgattttaatgacgtcgctcgcttttggtctgggggttgtaccgctagccattagtacaggtgtgggttcgggcagtcagaacgccattggtaccggtgtacttggcggtatgatgagttcgaccttcttaggtatcttcttcgtgccactgttcttcgtcattgttgagcggatcttcagtaaacgagagcgaaaagcgaaagagaaaaatcctacgtcgacggattaa

SEQ ID NO: 74289 - protein, 1044 aa, Shewanella oneidensis MR-1
MARFFIDRPIFAWVIALIIMLAGVLSIRTLPVSQYPSIAPPTVVISANYPGASAKIVEDSVTQVIEQRMKGIDHLRYIASTSDSFGNAEITLTFNAEADPDIAQVQVQNKLQGAMTLLPQEVQAQGVDVNKSSSGFLMVLGFVSTDGSLDKGDIADYVGANVQDPMSRVPGVGEIQLFGAQYAMRIWLDPLKLTQYNLTSLEVISAIRAQNAQVSAGQLGGTPSIQGQELNATVSAQSRLQTPEEFRKIILKSDTSGANVFLGDVARVELGSESYAVVSFYNGKPATGLAIKLATGANALDTAEAVRDKVEELRPFFPQGLDVVYPYDTTPFVEKSIEGVVHTLLEAIVLVFVIMYLFLQNFRATLIPTIAVPVVLLGTFAILSATGFSINTLTMFAMVLAIGLLVDDAIVVVENVERVMSEEGLSPLEATRKSMDQITGALVGIGLTLSAVFVPMAFMSGSTGVIYRQFSITIVSAMALSVLVALILTPALCATMLKPVQKGHGHIETGFFGWFNRNFDRLTNRYESSVAGIVKRGFRVMMIYVALVVAVGWIFMRMPTAFLPDEDQGILFTQAILPTNSTQESTLKVLDKVSDHFMAEEGVRSVFSVAGFSFAGQGQNMGIAFVGLKDWSEREAPGMDVQSIAGRAMGAFSQIKDAFVFAFVPPAVIELGTANGFDMYLQDKNGQGHDKLIAARNQLLGMAAQNPNLMGVRPNGQEDAPIYQLHIDHAKLSALGVDIANVNSVLATAWGGSYVNDFIDRGRVKKVFVQGDAQYRMQPEDLNTWYVRNNKGDMVPFSAFATGSWEYGSPRLERFNGLPAVNIQGATAPGFSTGAAMTIMEDLVKQLPPGFGIEWNGLSYEERLSGNQAPALYALSILVVFLVLAALYESWSVPFAVILVVPLGIIGALLAMNGRGLPNDVFFQVGLLTTVGLATKNAILIVEFAKEFYEKGAGLVEATLHAVRVRLRPILMTSLAFGLGVVPLAISTGVGSGSQNAIGTGVLGGMMSSTFLGIFFVPLFFVIVERIFSKRERKAKEKNPTSTD

SEQ ID NO: 74290 - DNA, 3045 bp, Pseudomonas putida KT2440
  CDS (1)..(3045): transl_table=11
atggcgttcaccgacacgttcatccaacgcccggtgctggccagcgtggtcagcctgctgattctgctgctcggcttccaggcctggaacaagctgcagatccgccagtacccgcaaatggaaaacgccctgatcacggtcaccaccgcctaccccggggccaacgccgaaaccattcagggctatatcacccagccattgcagcaaagcctggccagcgccgaaggcatcgactacatgacctcggtgagccggcagaatttctcgatcatttccatttacgcgcgcattggcgccgacagcgaccggctgttcaccgagctgctggccaaggccaatgaggtgcgaaacaagctaccccaggactccgaagacccggtactgagcaaggaagctgccgacgcctcggcgctgatgtacgtcagcttctacagcaaggaaatgagcaacccgcagatcaccgactacctgtcacgggttatccagcccaagctggccactctgccgggcatggccgaggcggagatcctcggcaaccaggtgttcgccatgcgcctgtggctggacccggtgaagctggccggtttcggcctttcggctaccgacgtgaccaatgccgtacgccgctacaacttcctttccgccgctggcgaggtgaaaggcgaatacgtggtcaccagcgtcaacgccagcaccgagctgaagtcggccgaggcgttcgccgccctgccgctcaagaccagcggtgacagccgcgtgctgctgggcgatgtggcgcgggtcgagatgggcgcagaaaactacgacacggtcagctcgttcgacggcaccccgtcggtctatatcggcatcaaggccaccccggccgccaacccgctggatgtcatcaaggaagtgcggcgcatcatgcctgagctggaaagccagctgccctcggcactgaacgtatcgattgcctacgacgccacgcggttcatccaggcctcgatcgacgaagtgatcaagaccttgggcgaagcggttctgatcgtcatcgtcgtggtgttcctgttcctcggtgccctgcgctcggtactgattccggtggtgaccataccgctgtcgatgatcggtgtactgttcttcatgcagatgatgggctactcgctcaacctgctgaccctgctcgccatggtgctggccatcggcctggtggtggacgatgccattgtggtggtggagaacattcaccggcacatggaagaaggcaagtcgccgttcgatgcagccctggaaggcgcgcgcgaaattgccatgccagtggtgtccatgaccatcacccttgccgccgtgtatgcaccgatcggcttcctcaccgggctcaccggcgcgctgttcaaggagtttgccctgacgctggccggggcggtgatcatttccggaatcgttgccctgaccctgtcaccgatgatgtgcgccctgctgctgcgccgggagcagaacccgagcggcctggcccaccgcctcgatcagctgttcgaacgcctgaaagggcgctaccagcgtttgctgcacgccaccctcgacagccggccggtggtgctggtgtttgccgtgatcatcctgtgcctgatcccggtgctgctcaaattcacccagaacgaactggcgcccaacgaggaccagggggtgatcttcatgatgagcagctcgcctcaaccggccaacctcgactacctcaacgcctacaccgaccagttcacaccgctgttcaaggccttccccgagtattactcgtcgtttcagatcaacggcttcaacggcgtgcagaccggtatcggtggttttttgctcaagccctggaacgagcgcgaacgcacgcagatggagctactgccgctggtgcaggccaaactcgaggaaatcagcgggctgcagatcttcggcttcaacctgccttcgttacccggcactggcgagggcttgccattccagttcgtgatcaataccgctggcgactacccggcactgctggacgtggcccaacgcatcaagacgcgcgctcaggaatcgggcaagttcgccttcctcgatatcgatcttgccttcgacaaacccgaagtggtggtggacatcgaccgggcaaaggcggcgcagatgggggtgtcgatggacaccctcggcggcaccttggcgaccctgctgggcgaggcggaaatcaaccgtttcacccttgaaggccgcagttacaaggtgatcgcccaggttgaacggccttaccgcgacaaccccggctggctgaacaactactacgtgaagaacgaccagggccagttgctaccgctgtcgaccctgatcaccctcaccgaccgcgctcgcccacgccagctcaaccagttccagcaactgaacgctgcgatcattcagggcgtgcccatggtcagcctgggcgaggcgctcaagaccgtgcaggacatcgctcgcgaagaggccccggaaggctttgccttcgactacgccggcgcggcccgccagtatgtacaggaaggcagcgcattgtgggtcaccttcggcctggcgctggcgatcattttcctcgtactggctgcacagttcgaaagcttccgcgacccgttggtgattctggtgacagtgccgttgtccatctgtggcgcgcttttgccgctgttcctgggtgtgtcgagcatgaacatctacacccaggtcgggctggtgacattgatcgggcttatcagcaagcacggtatcctgatcgtcgagttcgccaatcagctacgcgatgagcgtggcctgagtgtgcgcgaagcgatcgaggaagcagcggccattcgcctgcggccggtgctgatgaccactgcggctatggtgttcggcatggtgccgctgattctggcaagcggggcaggagcggtcagccggtttgacatcggtatggtgattgccaccgggatgtcgattggcacgttgtttaccttgtttgtgttgccgtgcatctacaccctgctggcgcacaaggcgagcgccaaggcacctgcaatcgcttga

SEQ ID NO: 74291 - protein, 1014 aa, Pseudomonas putida KT2440
MAFTDTFIQRPVLASVVSLLILLLGFQAWNKLQIRQYPQMENALITVTTAYPGANAETIQGYITQPLQQSLASAEGIDYMTSVSRQNFSIISIYARIGADSDRLFTELLAKANEVRNKLPQDSEDPVLSKEAADASALMYVSFYSKEMSNPQITDYLSRVIQPKLATLPGMAEAEILGNQVFAMRLWLDPVKLAGFGLSATDVTNAVRRYNFLSAAGEVKGEYVVTSVNASTELKSAEAFAALPLKTSGDSRVLLGDVARVEMGAENYDTVSSFDGTPSVYIGIKATPAANPLDVIKEVRRIMPELESQLPSALNVSIAYDATRFIQASIDEVIKTLGEAVLIVIVVVFLFLGALRSVLIPVVTIPLSMIGVLFFMQMMGYSLNLLTLLAMVLAIGLVVDDAIVVVENIHRHMEEGKSPFDAALEGAREIAMPVVSMTITLAAVYAPIGFLTGLTGALFKEFALTLAGAVIISGIVALTLSPMMCALLLRREQNPSGLAHRLDQLFERLKGRYQRLLHATLDSRPVVLVFAVIILCLIPVLLKFTQNELAPNEDQGVIFMMSSSPQPANLDYLNAYTDQFTPLFKAFPEYYSSFQINGFNGVQTGIGGFLLKPWNERERTQMELLPLVQAKLEEISGLQIFGFNLPSLPGTGEGLPFQFVINTAGDYPALLDVAQRIKTRAQESGKFAFLDIDLAFDKPEVVVDIDRAKAAQMGVSMDTLGGTLATLLGEAEINRFTLEGRSYKVIAQVERPYRDNPGWLNNYYVKNDQGQLLPLSTLITLTDRARPRQLNQFQQLNAAIIQGVPMVSLGEALKTVQDIAREEAPEGFAFDYAGAARQYVQEGSALWVTFGLALAIIFLVLAAQFESFRDPLVILVTVPLSICGALLPLFLGVSSMNIYTQVGLVTLIGLISKHGILIVEFANQLRDERGLSVREAIEEAAAIRLRPVLMTTAAMVFGMVPLILASGAGAVSRFDIGMVIATGMSIGTLFTLFVLPCIYTLLAHKASAKAPAIA

SEQ ID NO: 74292 - DNA, 3153 bp, Pseudomonas putida KT2440
  CDS (1)..(3153): transl_table=11
atgtcgaagttctttatcgatcgcccgatcttcgcctgggtgatcgccttggtgatcatgctggtcggggccttgtccatcctgaagctgccgatcaaccagtaccccagtatcgcgccgccagccatcgccatcgccgtgacctacccgggcgcctcggcgcaaaccgtgcaggacaccgtggtgcaggtgatcgagcagcagctcaacggtatcgacaacctgcgttatgtgtcgtcggaaagtaactccgacggcagcatgaccattaccgccaccttcgaacagggcaccaaccccgacaccgcgcaggtacaggtacagaacaagctgaacctggccaccccgctgctgccgcaggaagtgcagcagcaaggtatccgcgtcaccaaagcagtgaagaacttcctgctggtgatcggcctggtctccgaagacggcagcatgaccaaggacgacctggccaactatatcgtctcgaacatgcaggacccgatctcgcgtaccgcgggtgtaggtgacttccaggtgttcggtgcgcagtacgccatgcgtatctggctcgatccggccaagctgaataagttccagctgaccccggtcgacgtcaagaccgctgtggccgcacagaacgtgcaggtgtcttccggccagctcggcggcctgccagccctgccgggcacccagctgaacgccaccatcatcggcaagacccgcctgcaaaccgccgagcagttcgagagtatcctgctcaaggtcaacaaagacggttcacaggtgcgcctgggcgatgtcgcccaagtaggcctggggggtgaaaactacgccgtcagcgcccagttcaacggcaagccggcttccggcctggcggtaaaactggcaaccggcgccaacgcgctggacaccgccaaggcactgcgcgagaccatcaaaggcctggaaccgttcttcccgccgggagtcaaggcggtattcccgtatgacaccaccccagtggtcaccgaatcgatcagcggcgtgatccacaccctgatcgaagccgtggtgctggtgttcctggtgatgtacctgttcctgcagaacttccgcgccaccatcatcaccaccatgaccgtaccggtggtattgctgggtaccttcggcatccttgccgccgcgggcttcagcatcaacaccctgaccatgttcgccatggttctggccatcggcttgctggtggacgacgccatcgtcgtggtggagaacgtcgagcgggtcatgtccgaggaaggcttgccgcccaaggaagcgaccaaacgctcgatggaacagatccagggcgccctggtgggtatcgccctggtgctctcggccgtactgctgcccatggcgttctttggcggctccacgggtgtgatctaccggcagttctccatcaccatcgtctcggccatgggcctgtcggtgctggttgcgctgatcttcaccccggcgctctgcgcaaccatgctcaaaccgctgaagaagggcgagcaccacaccgccaaaggtggcttcttcggctggttcaaccgcaacttcgaccgcagcgtcaacggctacgagcgcagtgtaggcgccatcttgcgcaacaaggtgccattcctgctggcctatgcgctgatcgtggtcggcatgatctggctgttcgcccgcatccctaccgcgttcctgccagaagaagaccagggcgtactgttcgctcaggtgcagaccccggccggctccagtgccgaacgcacgcaggtcgtggtcgaccagatgcgtgaatacctgctcaaggacgaagccgataccgtatcgtcggtgttcacggtcaacggtttcaacttcgcaggccgcggccagagctcgggcatggccttcatcatgctcaaaccctgggatgaacgctcgaaggaaaacagcgtgttcgccctggcccagcgtgcccagcagcacttctttaccttccgtgatgcgatggtgttcgccttcgccccgccagcggtgcttgaactgggtaacgccaccggcttcgacgtgttccttcaggaccgcggcggtgtcggccacgagaagttgatggaggcgcgcaaccagttcctggccaaagctgcgcagagcaagatcctcagcgccgtgcgcccgaacggcctgaacgatgaaccgcagtaccagctgaccattgatgacgaacgtgccagcgccctgggcgtgaccattgccgacatcaacaacaccctgtcgattgccttgggtgccagctacgtcaacgacttcatcgaccgtggccgggtcaagaaggtgtacatccagggcgaacccagcgcgcggatgagcccggaagacctgcaaaaatggtacgtgcgcaacggcgcaggggagatggtgccgttctcctccttcgccaaaggcgaatggacctacggttcgccgaagctgtcgcgttacaacggtgtcgaagcgatggaaatcctcggtgcaccggcgcctggctacagtaccggtgaagccatggccgaggtcgagcgcattgcaggcgagctgccaagcggtatcggcttctcctggaccggcatgtcctacgaggaaaaactctccggctcgcagatgccggcgctgttcgccctctcggtgctgttcgtgttcctgtgcctggcggccctgtacgaaagctggtcgatcccgatcgctgtggtgctggtagtaccgctgggtatcatcggtgcgctgatcgccaccagcctgcgcggcctgtccaacgacgtgtacttcctggttggcctgttgaccaccatcggtcttgcggcgaaaaacgccattctgatcgtggaattcgccaaggagctgcacgaacaaggccgcagcctgtacgacgcagcgatcgaggcgtgccgcatgcgtctgcgcccgatcatcatgacctcgctggcgttcatcctgggcgtggtaccgttgaccatcgccagcggcgccggcgccggcagccagcacgccatcggtactggcgtgatcggcggcatgatcagtgcgaccgtgctggctatcttctgggtaccactgttcttcgtcgcagtgtcgtcgctgttcggcagcaaagagccggaaaaagacgtcacccctgaaaatccacgttatgaggctgggcaatga

SEQ ID NO: 74293 - protein, 1050 aa, Pseudomonas putida KT2440
MSKFFIDRPIFAWVIALVIMLVGALSILKLPINQYPSIAPPAIAIAVTYPGASAQTVQDTVVQVIEQQLNGIDNLRYVSSESNSDGSMTITATFEQGTNPDTAQVQVQNKLNLATPLLPQEVQQQGIRVTKAVKNFLLVIGLVSEDGSMTKDDLANYIVSNMQDPISRTAGVGDFQVFGAQYAMRIWLDPAKLNKFQLTPVDVKTAVAAQNVQVSSGQLGGLPALPGTQLNATIIGKTRLQTAEQFESILLKVNKDGSQVRLGDVAQVGLGGENYAVSAQFNGKPASGLAVKLATGANALDTAKALRETIKGLEPFFPPGVKAVFPYDTTPVVTESISGVIHTLIEAVVLVFLVMYLFLQNFRATIITTMTVPVVLLGTFGILAAAGFSINTLTMFAMVLAIGLLVDDAIVVVENVERVMSEEGLPPKEATKRSMEQIQGALVGIALVLSAVLLPMAFFGGSTGVIYRQFSITIVSAMGLSVLVALIFTPALCATMLKPLKKGEHHTAKGGFFGWFNRNFDRSVNGYERSVGAILRNKVPFLLAYALIVVGMIWLFARIPTAFLPEEDQGVLFAQVQTPAGSSAERTQVVVDQMREYLLKDEADTVSSVFTVNGFNFAGRGQSSGMAFIMLKPWDERSKENSVFALAQRAQQHFFTFRDAMVFAFAPPAVLELGNATGFDVFLQDRGGVGHEKLMEARNQFLAKAAQSKILSAVRPNGLNDEPQYQLTIDDERASALGVTIADINNTLSIALGASYVNDFIDRGRVKKVYIQGEPSARMSPEDLQKWYVRNGAGEMVPFSSFAKGEWTYGSPKLSRYNGVEAMEILGAPAPGYSTGEAMAEVERIAGELPSGIGFSWTGMSYEEKLSGSQMPALFALSVLFVFLCLAALYESWSIPIAVVLVVPLGIIGALIATSLRGLSNDVYFLVGLLTTIGLAAKNAILIVEFAKELHEQGRSLYDAAIEACRMRLRPIIMTSLAFILGVVPLTIASGAGAGSQHAIGTGVIGGMISATVLAIFWVPLFFVAVSSLFGSKEPEKDVTPENPRYEAGQ

SEQ ID NO: 74294 - DNA, 3144 bp, Bradyrhizobium japonicum USDA 110
  CDS (1)..(3144)
atgaacctttccgcgcccttcatcctgcggccaattgcaaccgccctgctgatggccggcttgctgctgtgcggcctcgcggcctatccgttgctgccggtcggtgcgctgccgaacgtcaattacccgaccatccagatctcggcgcaactgcccggcgccgatccgggcaccattgcctcgtcgctggcgacgccgctcgagcagcagctcagccagatccccggcgtcacgcagctcacctcgtccagtgcgctcggcgtcgcccagctcacagtgcagttcgagctgtcgcgcaccgtggacagcgcggcggtggacgtgctggccgcgatcaatgccgcaagccctttcctgccgccgaacatcccctacccgccgacgatcaggaaggtgaatccggcggagacgccgatcatgctgatcgcgctgacgtcggactcgctgccgctgaccacggtcgacgcctatgcggaaaacatcctgctgccgaagatctcgcaggtgccgggtgtgggtctcgtcggcatcggcggccagcagaagcccgcgatccgtgttcgcgtcaatccgcaggcgcttgccgcccgcggcatcggcctcgaagacgtccgcaacgtgatcgccggcgccaacgtcgacctgccgaagggcacgctcaacagcccgcgcgtcacctatacgctgaacaccaacgatcaattgctcaagccctccgcctatgaagacctcatcatcgcctatcgcaacggctcgccggtgcggatacgcgacatcggcacggcgatcgaggggcccgagaacgacctcctggccggctggtacggcaaggagcccgccatcatcctggcagtccagcgcgttcccggcgccaacgtgatcgagacggtcgaccgcatcaagaagctgctgccgcaattgcaggcctccgttccaccggcgatcaaggtgacgatcgccgccgaccggaccgccaccattcgcgccgcggtctccgacgttcaattcacgctgatgctgacggtcgcactggtggtaatggtcatattcctgttcctgcggaatttctgggccaccatcatcccggcgatcacggttcccctgtcgctgatcggcacgttcgcggtcctctacgtgctcggctacagcctggacaacctctcgctgatggcgctgtcgatcgcggtgggcttcgtcgtcgacgatgccgtcgtcgtcatcgagaacatcgtgcgccatctcgagcagggcatgacgccgatggaggccgcgctcaagggttccagcgaaatcggcttcacgatcgtctccatcaccctgtcgctgatcgctgtgttcatcccgcttttcctgatgggaggctacgtcggcaagctgttccaggaattcgccgtcacgatcacggcttcgctgctgctgtcgctggtcatctcgctcacgctgacgccgatgatgtgcgcgcggctgctgaaggacgactcgcggaagaagcacggccgaatctatctcgccttcgaacgcggtttcgacgccctgcttgcgctttatgcgagcggcctgcgaatcgtgctgcgccatcgcttcgtgacgctgctcgtgatgctctcgacgatcgcgctgaccggctatctctacgtgatcattccgaagggtttcttcccgcaacaggataccgggcagattgtcggcatcaccgaagccgcacaggacatttccttccccgccatgtccgaacgccagcaggcgatcgtcgacatcctgtcgaaggatccggcaattcagtcggtggcgagctatatcggtccgggaggtcccacggcgacgctcaaccagggacggatatttatcgtcctgaagccgaagcccgggcgcaaggccagcgccgaccagatcatcgaacggctggggccccagctcgcccatatccagggcatcaggctctacatgcaggccgcgcaggacatcaccatcggcgcacgcctgtccaagacgcaataccagtacacgctgacggacgccgattccaacgagctcaccaactggtcggcgatcttcctcaagaagctccgcgagctcgacctcatcaccgacgtcgcgagcgaccaggccaatgccggtccgcggctggaggtcaccgtcaatcgcgaggtcgcatcgagcttcggcatcctgcccacgacgatcgacaatgccctcgacgacgcattcggccagcgcatcgtctccacgatgttcacctcgctgaaccagtaccatgtcgtgatggaggtcgatccgcgtttccagtacgggccggaagcgctcaaggacatctacctgaactcggccaccggccagcaggtccccctgagcacgctggttcacagcgtcattaagcccgcgcccatcctgatcaaccaccagagcctgtttccgtcggtcacgatctcgttcaacctgcagcccggcgccgcgctcggcgatgcggtgacggcgatccagaacatcgagaagagcacgggcaagcccgcctcgctatcgacctcgttccagggcaacgcccaggccttccagtcttccctgcgaggcacaccgctgctgatcggggcggcgctgatcgtgatctacatcatcctcggcgtgctctatgagagcctgatccatccgatcacgatcctgtcgacgctgccgtcggccggcatcggcgcgctgttgctgctgctggcggtccacatggatctcagcgtcatcgccatcattggcatcatcctgctgatcggcatcgtcaagaagaacggcatcatgctggtcgatttcgccctcgaggtggagcgccagcacgggctcagcccggaagaggcgatctaccaggcctgcacgctgcgcttccgcccgatcctgatgacgacgatggcggcgctgctcggcggcgtgccgctgatgatcggttccggtaccggcgcggagctgcgccagccgctcggctacacgatcgtcggcggcctgatgctctcgcagatcctgacgctctacaccacgcccgtcgtctatctctatctcgaccagctcagcaactggctgaccgggcgcaagccgcaggcggccgcgacacccacttcatccacgaccaaggcagatgcggaattgagccatgaatccgcttga

SEQ ID NO: 74295 - protein, 1047 aa, Bradyrhizobium japonicum USDA 110
MNLSAPFILRPIATALLMAGLLLCGLAAYPLLPVGALPNVNYPTIQISAQLPGADPGTIASSLATPLEQQLSQIPGVTQLTSSSALGVAQLTVQFELSRTVDSAAVDVLAAINAASPFLPPNIPYPPTIRKVNPAETPIMLIALTSDSLPLTTVDAYAENILLPKISQVPGVGLVGIGGQQKPAIRVRVNPQALAARGIGLEDVRNVIAGANVDLPKGTLNSPRVTYTLNTNDQLLKPSAYEDLIIAYRNGSPVRIRDIGTAIEGPENDLLAGWYGKEPAIILAVQRVPGANVIETVDRIKKLLPQLQASVPPAIKVTIAADRTATIRAAVSDVQFTLMLTVALVVMVIFLFLRNFWATIIPAITVPLSLIGTFAVLYVLGYSLDNLSLMALSIAVGFVVDDAVVVIENIVRHLEQGMTPMEAALKGSSEIGFTIVSITLSLIAVFIPLFLMGGYVGKLFQEFAVTITASLLLSLVISLTLTPMMCARLLKDDSRKKHGRIYLAFERGFDALLALYASGLRIVLRHRFVTLLVMLSTIALTGYLYVIIPKGFFPQQDTGQIVGITEAAQDISFPAMSERQQAIVDILSKDPAIQSVASYIGPGGPTATLNQGRIFIVLKPKPGRKASADQIIERLGPQLAHIQGIRLYMQAAQDITIGARLSKTQYQYTLTDADSNELTNWSAIFLKKLRELDLITDVASDQANAGPRLEVTVNREVASSFGILPTTIDNALDDAFGQRIVSTMFTSLNQYHVVMEVDPRFQYGPEALKDIYLNSATGQQVPLSTLVHSVIKPAPILINHQSLFPSVTISFNLQPGAALGDAVTAIQNIEKSTGKPASLSTSFQGNAQAFQSSLRGTPLLIGAALIVIYIILGVLYESLIHPITILSTLPSAGIGALLLLLAVHMDLSVIAIIGIILLIGIVKKNGIMLVDFALEVERQHGLSPEEAIYQACTLRFRPILMTTMAALLGGVPLMIGSGTGAELRQPLGYTIVGGLMLSQILTLYTTPVVYLYLDQLSNWLTGRKPQAAATPTSSTTKADAELSHESA

SEQ ID NO: 74296 - DNA, 3153 bp, Bradyrhizobium japonicum USDA 110
  CDS (1)..(3153)
atggcgagtttcttcatcgacaggccgatcttcgcctgggtcgtggcgctgttcatctgtctgatcggcgcgatctcggtgccgctgctgccgatcgcgcaatacccgatcatcgcgccgccctcgatctcgatctcgaccagctatcccggcgcctcgccggagaacctctacaacagcgtcacgcgcctgatcgaggaggagctcaacggcgcctccggcatccttaatttcgaatcgaccagcgactcgctcggccaggtcgagatcatcgccaatttccagcccggcacggataccagcgcggcgtccgtcgaggtgcagaaccgcatcaagcgcgtcgaggcgcggctgccgcgcgcggtgatccagcagggcattctgatcgaggaagcctcgagcgcggtgctccagatcatcacgctgaactcgaccgacggcagcctcgacgaggtcggcctcggcgacttcatgatccgcaacgtgctcggcgagatccgccgcatccccggcgtcggccgcgccacgctgtattcgaccgagcgctcgcttcgcgtctgggtcgatccggccaagctcgtcggctatggactgaccgccgaggacgtcaacaaggcgatatcggcgcagaatgcgcaggtcgcctcgggcagcatcggcgccgagccgtcgacgtcgacccagcgcacctccgcgctggtgctggtcaagggccagctctcgtcccccgatgaattcggcgccatcatcctgcgcgccaatgccgacggttcgaccgtgcgcctgcgcgacgtcgcgcgcatcgaggtcggcggcctcagctaccagttcaatacgcgcctgaacggcaagccgaccgcgggcctgtccgtgctgatgtcgccgaccggcaatgcgctggcgaccgcgagcgcggtcgaagagaagatgaaggagctgtcgcgctttttcccggccaacatctcctacgagatcccctacaacatcacgcccgtggtcgaggcctcgatcaagaaggtgctgtcgacgctggtcgaagccgtggtgctggtgttcgtggtgatgttcctgttcctgcagaacatccgctacaccatcattccgaccatcgtggtgccggtggcgctcctgggcgcctgcaccacgctgctgctcgccggctactccatcaacatgctctcgatgttcggcatggtgcttgccgtgggcatcctcgtcgacgatgccatcgtcgtggtcgagaacgtcgagcgcatcatgagcgaggaggggctgccgccgaaggaggcgacgcgcaaggcgatgtcgcagatatcgggcgccatcatcggcatcacgctggtgctgatggcggtgttcgtgccgatggcgttcttccccggttcggtcggcatcatctaccgccagttctcggtgaccatggtggccgcgatcggcttctccgccttcctcgcgctgtcgctgacgccggcgctgtgcgcgaccctgctcaagcccgtcgcggccggtcacggccacgccaagaagggcgtgttcggctggttcaaccgcatgctcgaaggcggcaaggaaggctattcccgcaccgtcggcttctcgctgaagcgcaccggccggctgatgctggtctatgtcgcgctgctcgtcggcctgtcctgggccttcgtcaacttgccaggcggcttcctgcccgtcgacgaccagggcttcgtcaccaccgacgtgcagacgccgtcggattcgtcctacgcccgcaccgaagccgtgatcgagaaggtggaaaaatatctggcgcagcggccgggcgtcgacaacgtcaccttcctcaccggcttcagcttctccggtcagggcatgaacaccgcgcaggccttcatcaccttgaaggactggtcggagcgtgggccgaaggagtcggccgccgcgatcgttgccgacatcaaccgcgatctgtcgtcgtcgatccgcgatgcgaagatctccgcgctgcagccgccgccgatcgacaatctcggcaactcctcgggcttctcgttccgtctccaggaccgcggccagaagggctatccggccctgatgcgcgccgccgaccagctcatcgcggaagccaatgcgagcccggtgctgcagaaagtctatgtcgagggcctgcccgaggcgggcgtggtcaatctcgtgatcgatcgcgagaaggccggcgccttcggcgtcaccttcgaggacatcaacaacaccatctcgaccaatctcggctcgaactacatcaacgacttcccgaaccgcggtcgcatgcagcgcgtcgtggtgcaggccgacgcccgcgaccgcatgcgcaccgaggacatcctcaactacaacgtcaagaacagccgcggccagctcgtgccgttctcgtcgttcaccacggtggagtgggcacgcggcccgacacagatcgccggcttcaactactacccggcggtgcgcatctccggtgaggccaagcccggctttacctcgggcgacgccatcgccgagatggagcgccttgccggcaagctgccgcgcggcttcggctatgaatggaccggccagtcgctccaggagaagctgtcgggctcgcaggcgccgttcctgctcgcgctctcggtgttcgtggtgttcctgtgcctcgccgcgctctacgagagctggaccattccgctcgcggtgctgctcaccgtgccgctcggcatcgtcggcgccgtgatcgcggcgatgctgcgcggcctgcccaacgacgtctatttcaccgtcggcctgatcaccatcatcgggctcgcggccaaggacgcgatcctgatcatcgagttcgccaaggatctgcgcaaagaaggcaagccgctggtggacgcgaccatcgaggcctgccgcctgcgcttccgcccgatcctgatgaccggccttgccttcatctgcggcgtgctgccgatggccatcgcccacggcgccggcggcgccagccagcaggcgctcggcagcatcgtcatgggcggcatgatcgcggtggtgatcctggcgctgctgatggtgccggtgttcttcgtctccgtgcagcgcgtgctggcgggtgatcgggagaaggtggcggcggagggcgaggcctacgggccgccggcgccggtgaagctatag

SEQ ID NO: 74297 - protein, 1050 aa, Bradyrhizobium japonicum USDA 110
MASFFIDRPIFAWVVALFICLIGAISVPLLPIAQYPIIAPPSISISTSYPGASPENLYNSVTRLIEEELNGASGILNFESTSDSLGQVEIIANFQPGTDTSAASVEVQNRIKRVEARLPRAVIQQGILIEEASSAVLQIITLNSTDGSLDEVGLGDFMIRNVLGEIRRIPGVGRATLYSTERSLRVWVDPAKLVGYGLTAEDVNKAISAQNAQVASGSIGAEPSTSTQRTSALVLVKGQLSSPDEFGAIILRANADGSTVRLRDVARIEVGGLSYQFNTRLNGKPTAGLSVLMSPTGNALATASAVEEKMKELSRFFPANISYEIPYNITPVVEASIKKVLSTLVEAVVLVFVVMFLFLQNIRYTIIPTIVVPVALLGACTTLLLAGYSINMLSMFGMVLAVGILVDDAIVVVENVERIMSEEGLPPKEATRKAMSQISGAIIGITLVLMAVFVPMAFFPGSVGIIYRQFSVTMVAAIGFSAFLALSLTPALCATLLKPVAAGHGHAKKGVFGWFNRMLEGGKEGYSRTVGFSLKRTGRLMLVYVALLVGLSWAFVNLPGGFLPVDDQGFVTTDVQTPSDSSYARTEAVIEKVEKYLAQRPGVDNVTFLTGFSFSGQGMNTAQAFITLKDWSERGPKESAAAIVADINRDLSSSIRDAKISALQPPPIDNLGNSSGFSFRLQDRGQKGYPALMRAADQLIAEANASPVLQKVYVEGLPEAGVVNLVIDREKAGAFGVTFEDINNTISTNLGSNYINDFPNRGRMQRVVVQADARDRMRTEDILNYNVKNSRGQLVPFSSFTTVEWARGPTQIAGFNYYPAVRISGEAKPGFTSGDAIAEMERLAGKLPRGFGYEWTGQSLQEKLSGSQAPFLLALSVFVVFLCLAALYESWTIPLAVLLTVPLGIVGAVIAAMLRGLPNDVYFTVGLITIIGLAAKDAILIIEFAKDLRKEGKPLVDATIEACRLRFRPILMTGLAFICGVLPMAIAHGAGGASQQALGSIVMGGMIAVVILALLMVPVFFVSVQRVLAGDREKVAAEGEAYGPPAPVKL

SEQ ID NO: 74298 - DNA, 3189 bp, Bradyrhizobium japonicum USDA 110
  CDS (1)..(3189)
atgaatctctcaaaattcttcatcgatcgtccgatttttgccggtgtgctgtcggtcctgattttcctcgcagggctcatctcgctgttcgcgatgccgatctcggaatacccggacgtggtgccgccctccgtcctcgtgcgcgcgacctatcccggcgccaatccgaaggtgatcgcggagacggtggcgacgccgatcgaggagcagatcaacggcgtcgaaggcatgctctacatgtcgagccaggcgaccaccgacggcgcgatgacgctgacggtgacgttccgcctcggcaccgaccccgacaaggcgacgcagctggtgcagaaccgcgtgcagcaggccgagccgcgcctgccggccgtggtgcgccagctcggcatcatcaccaagaagtcctcgcccgacctcaccatggtggtgcatctcttgtcgcccaacggccgctacgacatgacgtatttgcgcaactatgcggtgctcaacgtcaaggaccggctggcgcggatcgacggcgtcggtgacgtccagctgtatggtgccggcgactattcgatgcgggtctgggtcgacccgcagaaggcggccgaacacgggctgaccgcgagcgacatcgtcaaatcgatccaggcgcagaacgtcgaggccgccgccggtgtggtcggctcctccccgaacgtcaaaggcatcgacctgcaactgtccgtcaatgcggaagggcggctcgcgaacgaggagcagttcggcgacatcgtggtcaaaaccggcgcgcgcggtgaagtggtgcggttgcgcgacgtcgcgcgcatcgagctaggggcgtccgaatacggcctgcgctcgctgctcgacaacaagcaggcggtggcgatcccgatcttccaggcgcccggctccaatgcgctgcagatttccgaccacgtccgcgccaccatggccgagatcaagaagaacatgcccgagggcgtgtcctaccagatcgtctacgatccgacccagttcgtgcgctcctcgatcgaggcggtgatccacacgctgctggaggcaatcgcgctggtggtgctggtcgtgatcctgttcctgcagacctggcgcgcctcgatcattccgctgctggcggtgcccgtgtcgatcgtcggcacctttgccgtgatgcacgtgttcggcttctccatcaacgcgctcagcctgttcggcctggtgctcgcgatcggcatcgtcgtcgatgacgccatcgtcgtggtcgagaacgtcgagcgcaacatcgaggccgggctgtcgccgcgcgatgcgacctatcaggcgatgcgcgaggtctccggcccgatcatcgcgatcgccatggtgctgatcgcggtgttcgtgcctctcgccttcatctccggcctgaccgggcagttctacaagcagttcgcgttgacgatcgcgatctcgaccgtgatttccgccgtcaactcgctgacgctgtccccggcgttgtcggcactgctgctcaagggccacaatgagccgaaggaccggctgacgatcatcatggaaaagggccttggctggttcttccgcggtttcaaccgggccttcacgcgttcatccgagaattacagcggcaccgtcaccaaggtgatctccggcaaggccgcggtgatgggtctttacgtcgtgctggtcggcctcaccgccttcctgttccagcaggtgccgagcggcttcgtgccgggccaggacaagcaatatctggtcggcttctcgcggctgcccgacggggcaacgctcgaccgcaccgaagaggtgatccgcaagatgagcgacgtcgcgctgacccagccaggcgtcgagagctctgtcgccttcccgggcctgtcgatctcaggcttcaccaactcgtccaatgccggcatcgtgttctcgacgctgaagccgttcgacgagcgcaagggtgcagccctgagcggcaatgccatcgcggccgagctgaacaagaaatacgccggcatccaggaagccttcatcgccatgttcccgccgccgccggtcaacggcctcggcaccatcggcggcttcaagctgcagatcgaggatcgcgccggcctcggctatgaggcgctgaacgaggcgaccaaagcgttcatggcggcgatgcagaaggcgccggagatcgccggcgtgttctcgagcttccaggtcaacgtgccccagctcttcgccgacatcgaccgcaccaaggcgctccagctcggggtgcccgtgacggaggtgttcaacactctccagatctacctcggctcctactacgtcaacgacttcaacaagtttggccgcacctattccgtccgcgtccaggccgacgcgccgttccgcgcccgggccgacgacatccggcagctcaaggtgcgctcgtcctccggcgacatggtgccgttgtccgcactgctcaagatccgccagagtgcgggtccggagcgcgcgatccgctacaacggcttcctgtcgtccgacatcaacgcggcggccgcgcccggcttttcatcgggccaggcgcaggaagtcgcgacgcggatcgcagcggaagtgctgccgcccggctttgccttcgaatggaccgacctgacctatcaggagttcatcgccggcaattccggaatctgggtgttcccgctggcgatcctgctggtgttcctggtgctggccgcgctctacgagagcctgaccctgccgctctcgatcatcatgatcgtgccgatgggtctgctcgcggcgatgttcggggtctggctctcgaagggcgacaacaacgtcttcacccagatcggcctcatcgttctcgtcgggctctcggccaagaacgcgatcctgatcgtcgaattcgcgcgcgagctcgaattcgccgggcgcaccccgatccgcgccgcgatcgaggcgagccggctgcggctccgtccgatcctgatgacgtcgatggcgttcatcatgggcgtcctgccgctggtgctctcgaccggcgcaggctcagagatgcgacgcgcgatgggtgtcgcggtgttctccggcatgatcggcgtcaccgtgttcggcctgttcctgacgccggtgttctacgtgctgctgcggaccgtcaccggcatgaagccgctgacgcaccacggcagcgacatcagcgccgcgccggtccagggactcacgcactag

SEQ ID NO: 74299 - protein, 1062 aa, Bradyrhizobium japonicum USDA 110
MNLSKFFIDRPIFAGVLSVLIFLAGLISLFAMPISEYPDVVPPSVLVRATYPGANPKVIAETVATPIEEQINGVEGMLYMSSQATTDGAMTLTVTFRLGTDPDKATQLVQNRVQQAEPRLPAVVRQLGIITKKSSPDLTMVVHLLSPNGRYDMTYLRNYAVLNVKDRLARIDGVGDVQLYGAGDYSMRVWVDPQKAAEHGLTASDIVKSIQAQNVEAAAGVVGSSPNVKGIDLQLSVNAEGRLANEEQFGDIVVKTGARGEVVRLRDVARIELGASEYGLRSLLDNKQAVAIPIFQAPGSNALQISDHVRATMAEIKKNMPEGVSYQIVYDPTQFVRSSIEAVIHTLLEAIALVVLVVILFLQTWRASIIPLLAVPVSIVGTFAVMHVFGFSINALSLFGLVLAIGIVVDDAIVVVENVERNIEAGLSPRDATYQAMREVSGPIIAIAMVLIAVFVPLAFISGLTGQFYKQFALTIAISTVISAVNSLTLSPALSALLLKGHNEPKDRLTIIMEKGLGWFFRGFNRAFTRSSENYSGTVTKVISGKAAVMGLYVVLVGLTAFLFQQVPSGFVPGQDKQYLVGFSRLPDGATLDRTEEVIRKMSDVALTQPGVESSVAFPGLSISGFTNSSNAGIVFSTLKPFDERKGAALSGNAIAAELNKKYAGIQEAFIAMFPPPPVNGLGTIGGFKLQIEDRAGLGYEALNEATKAFMAAMQKAPEIAGVFSSFQVNVPQLFADIDRTKALQLGVPVTEVFNTLQIYLGSYYVNDFNKFGRTYSVRVQADAPFRARADDIRQLKVRSSSGDMVPLSALLKIRQSAGPERAIRYNGFLSSDINAAAAPGFSSGQAQEVATRIAAEVLPPGFAFEWTDLTYQEFIAGNSGIWVFPLAILLVFLVLAALYESLTLPLSIIMIVPMGLLAAMFGVWLSKGDNNVFTQIGLIVLVGLSAKNAILIVEFARELEFAGRTPIRAAIEASRLRLRPILMTSMAFIMGVLPLVLSTGAGSEMRRAMGVAVFSGMIGVTVFGLFLTPVFYVLLRTVTGMKPLTHHGSDISAAPVQGLTH

SEQ ID NO: 74300 - DNA, 3126 bp, Bradyrhizobium japonicum USDA 110
  CDS (1)..(3126)
atgaggaacgagaacgtgtcctttaccgacatcttcattcgccggccggtgcttgcgatcgtcgtcagcctgatgatcctggtgctgggtctgaagtcgatgacctcgctgccgatcctgcaatatccgcgaacccagaacgcgatcgtcaccgtgacgacgacgtactacggcgccgatccggcggtcgttgccgggttcatcaccacgccgctggaaaacgccatcgcccaggccaatggcatcgactacatgacgtcgaccagccagcccagcacctccaccatcaccgtcaacctgcggctgaacttcgactccggcaaggcgctgaccgagatcaacaccaaggtgaactcggtgctcaatcagctgccgagcggcgtccagcagccggtgctgacggtcaaggtcggccagaccatcgacgccatgtatctcggcttcagcagcgacgtgctggcgccgaaccagatcaccgactacctgatccgcgtggtgcagcccaagctgcaggccgtatccggcgtgcagaccgcggagctgctcggcaacaagaccttcgcgctgcgcgcctggctcgatccgatcaagcttgccgcctacgggctgaccgcatccgacgtatcgaccgcgctgtccagcaacgactacatcgccgggctcggcaccaccaagggccagatggtgcaggtcaatttgacggccgcgaccaacctgaagtcgttgcaggagtttcgcgacctcgtcgtcaagcaggccggcgcttccaacgtcaagctgtccgacgtggcgaacgttacgctgggctccgaggattacgactcgtcggtcggcttcaacggcaagcgcgcggtctatatcggcatccaggtggcgccaaacgccaaccttctcgacgtcatcaaaggcgtccgcgccgtctatcccgacatcaaggcgcagcagccggaggggctgaactccgagatcatctacgactccaccgatttcgtgaacagctcgatcgacgaggtgatccataccctgctcgaagcgcttctgatcgtcaccgtggtcgtcttcctgtttctcggatcgtggcgttcggtgctgattccggtgatcgccataccgctgtcgctggtcggcaccttcacgatgctgctggcgctaggcttctcgatcaacctcctgacgctgctggcgctggtgctcgcgatcggcctcgtggtcgacgacgccatcatcgtcgtcgagaacgtcaaccggcatctggccgagggtacgaagccgttgcaggcggcgatcatggccgcgcgcgagcttgcgggtccgatcgtggccatgaccatcgtgctgatcgcggtctacgtgccgatcggcttccagggcggcttgaccggtgcgctgttcaccgagttcgccttcacccttgccggtgccgttgccgtgtcggccgtcattgcgttgacgctgacgccgatgtgctgcgccttcatcctgaagccggcgaacaccggcaagccgacgctcaacgaccgcatcgtcggcttcatcgatgcacgcatggacgcgttgcagcatcgatatcggcgcctgcttgccggcagcctgacaacaattccggtcacggtcgtattcgctgccctggtcttgagcagcatctactggctttattcgaactcaaagaacgagttggcgccggaggaggatcagggtgcgatcctgatgcagtcgacgctcgcgccgaatgcgacgttacagcagaagttgctgtattccgccgaggtctaccggcgcatctccgcctatgctgaaaccgccggcgtgttccagctcgatctcacgggcagctcgatcgcgggctgggtgctcaagccctgggacaagcgcgacaagactgcggccgaactacagccggtgcttcagcaggagatggcgggcgttgccggcgccaagatcgtggcgttccagctgccgccgctgcccggagcgagcggccttccgatccagttcgtgatccagaccacggacccgttcgagcggctcgatggcgtcgcgaaagcgttcaccgccgaggccctgaagagcggcaagttcatcttcctcgacaacgacctgaaggtggaccagccgcaaaccacggtgctgatcgatcgcgaaaagaccgctcagctcgggttgaagctcagtgacgtcggcggcgcgctcggcaacatgctgggcggcgggtatgtcaactatttcggcctggacggccgctcctacaaggtcattccccaggtcgagcagcgccagcgactgaacgccgatcaggtgctgaactactacatcaaaacctcggacggcacgtctgttccgctgtcgacggtggcgtcgctcaagacgaccaccgttccgcaatcgttgaaccacttccagcaggtcaatgccgccaccatttccggcgtggccatgcccggtgtgatcaccggcgaagcgctcgcgacgctgaaggagatcgcggaccggaccctgcccaagggctacaccatcgactatggcggtcagtcacgccagttcatccaggaatcatccggattcgccgccaccttcgggtttgccctgatcatcatcttcctggcgctgtcggcgcagttcgagagtttccgcgatcccctgatcattctggtctcggtaccgatgtcgatcgcgggcgcgctgatcttcatcatgctgggcatcaagggcgcgagcctcaatatctacaccgaggtcggcctcgtgacgctgatggggctgatcagcaagcacggcattctcatcgtcgagttcgccaacgagctgcagcacgccggccgctccaagcgcgacgcggtcatcgaagcaaccgcgatccggctgcgcccgatcctgatgacgacagcggccatggtgatcggcgtgatgccattgatcaccgctaccggtgcgggcgcagcctcacgcttcaacatggggctggtcatcgcctcgggactttcgattggaacgttgttcaccctgttcgtggtgccggcgttctacattctgcttgcggccgaccattccgcggcgacgggcgacgacgcggtgaaactcgatgcggccggactcggaacgaacggcgagccgcgcgccgccctatga

SEQ ID NO: 74301 - protein, 1041 aa, Bradyrhizobium japonicum USDA 110
MRNENVSFTDIFIRRPVLAIVVSLMILVLGLKSMTSLPILQYPRTQNAIVTVTTTYYGADPAVVAGFITTPLENAIAQANGIDYMTSTSQPSTSTITVNLRLNFDSGKALTEINTKVNSVLNQLPSGVQQPVLTVKVGQTIDAMYLGFSSDVLAPNQITDYLIRVVQPKLQAVSGVQTAELLGNKTFALRAWLDPIKLAAYGLTASDVSTALSSNDYIAGLGTTKGQMVQVNLTAATNLKSLQEFRDLVVKQAGASNVKLSDVANVTLGSEDYDSSVGFNGKRAVYIGIQVAPNANLLDVIKGVRAVYPDIKAQQPEGLNSEIIYDSTDFVNSSIDEVIHTLLEALLIVTVVVFLFLGSWRSVLIPVIAIPLSLVGTFTMLLALGFSINLLTLLALVLAIGLVVDDAIIVVENVNRHLAEGTKPLQAAIMAARELAGPIVAMTIVLIAVYVPIGFQGGLTGALFTEFAFTLAGAVAVSAVIALTLTPMCCAFILKPANTGKPTLNDRIVGFIDARMDALQHRYRRLLAGSLTTIPVTVVFAALVLSSIYWLYSNSKNELAPEEDQGAILMQSTLAPNATLQQKLLYSAEVYRRISAYAETAGVFQLDLTGSSIAGWVLKPWDKRDKTAAELQPVLQQEMAGVAGAKIVAFQLPPLPGASGLPIQFVIQTTDPFERLDGVAKAFTAEALKSGKFIFLDNDLKVDQPQTTVLIDREKTAQLGLKLSDVGGALGNMLGGGYVNYFGLDGRSYKVIPQVEQRQRLNADQVLNYYIKTSDGTSVPLSTVASLKTTTVPQSLNHFQQVNAATISGVAMPGVITGEALATLKEIADRTLPKGYTIDYGGQSRQFIQESSGFAATFGFALIIIFLALSAQFESFRDPLIILVSVPMSIAGALIFIMLGIKGASLNIYTEVGLVTLMGLISKHGILIVEFANELQHAGRSKRDAVIEATAIRLRPILMTTAAMVIGVMPLITATGAGAASRFNMGLVIASGLSIGTLFTLFVVPAFYILLAADHSAATGDDAVKLDAAGLGTNGEPRAAL

SEQ ID NO: 74302 - DNA, 3168 bp, Xylella fastidiosa Temecula1
  CDS (1)..(3168): transl_table=11
atgccaaaatttttcattgagcacccaatctttgcctgggtggtggcgatcctgatctcacttgcgggtgtgatctcgatcttcaaccttggcgtcgaatcttacccgagcatcgctccaccccaagtgaccatcactgcccattatcctggtgcaagtgcagacacacttgaaaagtcagtcactcaagtgatcgaacagcaactgaccggcattgatcacctgctgtacttcagttccagctcagcctccaacgggcaagccacaatcaccctcacttttgaaagcggcaccaacccggatattgcccaagtacaggtccaaaataaggtatcgctagccactccccgccttcccagtgaggtgacccagcaaggtgtggtggtggctaaagctaacgccggcttcctgatggtggccgcactacgctcagataaccctgcattcgacaaagacgcattgaacgactttgtcggcacacacgtgcttgagcaaatctcgcgagtgcctggtgtcggcagcaccaatcagttcggtgcacagtacgcaatgaatatctggctgaatccagaaaagctgcagggctaccacctgtcggcaagccaggtgtacaacgcaatcagtacccagaatgtgcaatttgctgctggttcaatcggcgctgatccggcaccggccaatcagagcttcaccacaacggtcaccacaaaaggccgcttcaccacgcctgagcaattcgaaaacatcatcctacgtactaataatgacggcagcacagtacggctgaaagacgtggcgcgcgtcaagataggcgcagagagttatggcattgactctcagtacaacggtaaacccgctggtgcctttggtgtacaactgctgcctggtgccaacgcgttacaggttgttgaaagcatacataccaaaatggacgagctgcaaagcacgtttccgcaaggcgtcacttggttcactccttatgaaagcaccacttttatcaagatatcgatcaaggaagtggtgaaaacgctggccgaagcgattgtcttggtcttccttgtgatgctgatctttctgcagaacttccgtgcgacgatcatcccgaccttggtgattccggttgccttgctcggtacctttgcaggcatgttagcgattggattcactatcaaccaactcaccttatttgcaatggtgctagctatcggcatcgtagtcgatgatgcgatcgtggtcatcgaaaatgtcgagcgcatcatgaccgaagaacatttagaacctaaagccgctacgcagaaagcaatgacacaaatcaccggagcggtgatagccatcagcatcgtgttgacagcagtatttatcccttctgcgatgcaaccgggggccgctggagcgatttacaaacaatttgcactgacaattgcgatgtcaatgggtttttcagcattcctggcgctcaccttcacgcccgcactatgcgcgagtttcctgaaatctagccacggacaaaataaaaattggatcttccgtacctttgagaagtactacgagaaactctcgcaccgctatgtccgtctcatcagcaacacactcaagcgtactccacgctggacagcattttttgcggtactcgtcgtcctctgtggctttttatttacacggatgccttcaagcttcctgcctgaggaggaccaaggcttcgcgctagcgattgtgcagcttccaccaggcgccacaaaaacgcgtacgaacgaagtattcactcagatgcgcgctgtattggagaaaataccgtccatcgaagggctcatgcaaatcactggcttcagtttcgttggctcaggtgaaaacgttggaatgggcttcatccgattaaaaccctggcaggaacgtcaggagaccgccgatcaactgattcagcaactgaatggtatgttctacggcatcaagggggcgcaaatctttgtggtcaaccttcccaccgtacaggggcttggccagtttggtggcttcgatatgtggctgcaagaccgcaacggccttggccacgaagcattgactcaagcacgtaatgtggtgctcggcaaagcggcacaacgccaggatgtgatggttgctgtgcgtccgaatgggctggaaaactctcctcagctgcaattgactgttgatcgtgtacaaggagagtcgatgggtctgtcaaccagcgatatctacaaagcaatccaactaatgctggctccgacctacgtaaacgactatttctctgaaggtcgtattaaacgcgtcaacatgcgtgccgatgacatgtaccgcaccagtcctgattcactacgcaatttctacacacccagcagttctgctaccgatgtcaatggccaaccattgatgattccgctcagtaacgtcgtaaaggccgattggatatacgcagcaccatcgctcgatcgttataacggttattcggcaatcaatattgttggaaacacagcccctggtacatcatccggacaagcaatgaaggtgttggcaagtatcgttaacgacgatctgccgcatgggtttggcattgattggagcgggatgtcctaccaagagatcatcgctggcaacgcagcaacgttactactggtgctgtctgttgtcgtggtgttcctatgcttatcagcactttacgaaagttggtcaatccccgtggctgtactgctgatcgtacccatcggtatactcggtacaatcgtgttctccatgcttcgtggcttaccgaacgatctgtacttcaaaatcggcctgatcacggtcattggtcttgctgcaaaaaatgcaatcctgattgtggagttcgcagttgcacaacgcgccactggcaagacactgcgtgaggcgaccattgatgcagcacgtttacgcttccgcccaatcctgatgacatccttagcgttcatcctgggtgtgctgccgctggcaatctcctcgggtgctggcgctaacgcgcgacattcaattggcactggggtgatcgggggcatgacattcgcaaccatcttcggagtgatctttatcccactgctctttgtcgtggtgcgacgcatcatcggcgataagcttgatgagcaatccaaggaataccttgaagcgcaatcaagcagtggacatcttcagaatcgctga

SEQ ID NO: 74303 - protein, 1055 aa, Xylella fastidiosa Temecula1
MPKFFIEHPIFAWVVAILISLAGVISIFNLGVESYPSIAPPQVTITAHYPGASADTLEKSVTQVIEQQLTGIDHLLYFSSSSASNGQATITLTFESGTNPDIAQVQVQNKVSLATPRLPSEVTQQGVVVAKANAGFLMVAALRSDNPAFDKDALNDFVGTHVLEQISRVPGVGSTNQFGAQYAMNIWLNPEKLQGYHLSASQVYNAISTQNVQFAAGSIGADPAPANQSFTTTVTTKGRFTTPEQFENIILRTNNDGSTVRLKDVARVKIGAESYGIDSQYNGKPAGAFGVQLLPGANALQVVESIHTKMDELQSTFPQGVTWFTPYESTTFIKISIKEVVKTLAEAIVLVFLVMLIFLQNFRATIIPTLVIPVALLGTFAGMLAIGFTINQLTLFAMVLAIGIVVDDAIVVIENVERIMTEEHLEPKAATQKAMTQITGAVIAISIVLTAVFIPSAMQPGAAGAIYKQFALTIAMSMGFSAFLALTFTPALCASFLKSSHGQNKNWIFRTFEKYYEKLSHRYVRLISNTLKRTPRWTAFFAVLVVLCGFLFTRMPSSFLPEEDQGFALAIVQLPPGATKTRTNEVFTQMRAVLEKIPSIEGLMQITGFSFVGSGENVGMGFIRLKPWQERQETADQLIQQLNGMFYGIKGAQIFVVNLPTVQGLGQFGGFDMWLQDRNGLGHEALTQARNVVLGKAAQRQDVMVAVRPNGLENSPQLQLTVDRVQGESMGLSTSDIYKAIQLMLAPTYVNDYFSEGRIKRVNMRADDMYRTSPDSLRNFYTPSSSATDVNGQPLMIPLSNVVKADWIYAAPSLDRYNGYSAINIVGNTAPGTSSGQAMKVLASIVNDDLPHGFGIDWSGMSYQEIIAGNAATLLLVLSVVVVFLCLSALYESWSIPVAVLLIVPIGILGTIVFSMLRGLPNDLYFKIGLITVIGLAAKNAILIVEFAVAQRATGKTLREATIDAARLRFRPILMTSLAFILGVLPLAISSGAGANARHSIGTGVIGGMTFATIFGVIFIPLLFVVVRRIIGDKLDEQSKEYLEAQSSSGHLQNR

SEQ ID NO: 74304 - DNA, 3192 bp, Pseudomonas syringae pv. tomato str. DC3000
  CDS (1)..(3192): transl_table=11
atgaacttctccaaattctttatttcacggccgatcttcgccgcagtgctgtcgctgctgatcctgatcgccggtgcaatctcgctgttccagttgccgatcagtgaatacccggaagtcgtgccgccgaccgtagtggtacgcgccagcttccccggcgccaaccccaaggtgatcggcgaaaccgtcgcttcgccgctggaacaggccatcaccggtgtcgagggcatgctctacatgtcgtcccaggccaccgccgacggcaaactgaccctgaccatcacctttgcgctgggcaccgagctggacaacgctcaagtgcaggtgcagaaccgcgtgacacggaccgagcccaagctgcccgaggaagtcacgcgtatcggcattaccgtggacaaggcctctcccgacctgaccatggttgttcacttgacctcgccggaccagcgctacgacatgctgtacctgtccaactacgccgtgctcaacatcaaggatgagctggcgcgactgggcggtgtcggtgatgtgcagttgttcggcatgggcgactactcgctgcgtgtctggctcgatccgaacaagaccgcctcacgcaacctgaccgccaccgacgtggtcaacgcaattcgcgaacaaaaccgtcaggtcgccgccggccagttgggctcgccgccttcgccgaatgccaccagttttcagatgtcgatcaacacccagggccgtctggtcagtgaggaagagtttgaaaacgtcgtggtccgcgccgggccagacggagaaattacccgcctgaaggacgtcgcacgtatcgagctgggttccagtcagtacgccctgcgctcgctgctcaataaccagcctgccgtggcaatgccgatctttcagcgcccaggctccaacgccatcgacatttccaacgatgtgcgggcacggatggccgagctgaaaaaaggcttccccgaaggcatggactacagcatcgtctatgacccgaccatctttgtgcgcggctccatcgaggcggtgatccatacactgttcgaagcactgattctggtggtgctggtggtggtgctgttcctgcagacctggcgcgcctcgatcatcccgctggtggctgtaccggtgtcactgatcggcaccttcgctgtgatgcacatgttcggcttctcgctgaacgcgctgtctttgttcggcctggtactggccatcggcatcgtggtagacgacgcgattgtggtggtcgagaacgtcgaacgtaacatcgagctggggcttgaaccggtcgaggcgacgcacaaggccatggctgaagtgacggggccgatcattgccacggcgctggtgttgtgcgcggtgtttgtaccggcagcgtttatttctggccttaccgggcagttttataaacagttcgcactgaccattgccatctcgacggtcatctcggcgttcaactcgctgaccctgtcgccggcgctggccgcggtattgcttaaagctcacgatgcacccaaggatcgcttctcgcgtttcctcgataaaatactcggaggctggctgttccgcccgttcaaccgcttctttgaaaaagccagccacggctatgtgggcaccgtcgcacgggtcattcgcagcagcggcatcgcgttgctggtctatgcggggctgatggttctgacctggctgggcttcgccagcacgccaaccggttttgtgccaagccaggacaagcaatatctggtggcatttgcccagttgccggacgccgcgagcctggaccgcaccgaggacgtgatcaagcgcatgtcggagctggcactcaagcagcccggtgtggaaaacgcgattgccttcccgggtctgtcgatcaacggcttcaccaacagcccgaacaacggcgtggtattcgtcgccctcaagcctttcgatgaacgcaaggacccaagcctgtcggccaacgccatcgccggtgccctgaacggccagtttgcgtcgattcaggaagcctacatggcgatcttcccgccaccgccggtacaagggctgggcaccattggcggcttccgcttgcagatcgaagaccgtggcaacctgggttacgacgagctgtacaaggaaacccagaacatcatcaccaaaagccgcagcgtgccggaactggccgggttgttcaccagctacacagtgaacgtgccgcaggtcgatgccgcgattgaccgagagaaggccaagacgcatggcgtggccgtcagcgatatcttcgacaccctgcaggtgtacctgggctcgctgtatgccaacgacttcaaccgtttcggccgcacttatcaggtcaacgtccaggctgagcagcagttccgtcaggatgccgatcagatcggtcagctcaaggtgcgcaacaatctgggagaaatgataccgctggcaaccttcgtcaaggtcagtgacaccgcaggtcccgaccgcgtgatgcactacaacggtttcattaccgccgagatcaacggcgcagccgcaccgggcttcagctctggccaggcgcagaccgcggtggaaaagctgctgcgtgaagaactgcccaacggcatggtctacgaatggaccgacctgacctatcagcagattctctcgggcaacaccgcgctgttcgtcttcccgctctgcgtgttgctggcgttcctggtgctggccgctcagtacgaaagctggagcctgccgctggcggtgatcctgatcgtaccgatgaccctgctctcggccattgccggggtgatcattgccggtagcgacaacaacatcttcacccagatcggcctgatcgtactggtggggcttgcgtgcaagaacgcgattctgatcgtcgagttcgccaaggacaaacaggccgagggcatgagcccgctggatgcagtgctggaagcctgccgcctgcgtctgcgtccgatcctgatgacctcgtttgccttcatcatgggtgtggtgccactggtactttccagcggtgccggtgccgagatgcgtcacgcgatgggggtcgcggtgttctccgggatgctcggcgtcaccttcttcggcttgctgctgacgccggtgttctacgtgctgatccgtaactacgttggacgtcaagaggcccgcaaggccgccaaggcgcaaaaactgcaaaacctgcctgcggagatgcattga

SEQ ID NO: 74305 - protein, 1063 aa, Pseudomonas syringae pv. tomato str. DC3000
MNFSKFFISRPIFAAVLSLLILIAGAISLFQLPISEYPEVVPPTVVVRASFPGANPKVIGETVASPLEQAITGVEGMLYMSSQATADGKLTLTITFALGTELDNAQVQVQNRVTRTEPKLPEEVTRIGITVDKASPDLTMVVHLTSPDQRYDMLYLSNYAVLNIKDELARLGGVGDVQLFGMGDYSLRVWLDPNKTASRNLTATDVVNAIREQNRQVAAGQLGSPPSPNATSFQMSINTQGRLVSEEEFENVVVRAGPDGEITRLKDVARIELGSSQYALRSLLNNQPAVAMPIFQRPGSNAIDISNDVRARMAELKKGFPEGMDYSIVYDPTIFVRGSIEAVIHTLFEALILVVLVVVLFLQTWRASIIPLVAVPVSLIGTFAVMHMFGFSLNALSLFGLVLAIGIVVDDAIVVVENVERNIELGLEPVEATHKAMAEVTGPIIATALVLCAVFVPAAFISGLTGQFYKQFALTIAISTVISAFNSLTLSPALAAVLLKAHDAPKDRFSRFLDKILGGWLFRPFNRFFEKASHGYVGTVARVIRSSGIALLVYAGLMVLTWLGFASTPTGFVPSQDKQYLVAFAQLPDAASLDRTEDVIKRMSELALKQPGVENAIAFPGLSINGFTNSPNNGVVFVALKPFDERKDPSLSANAIAGALNGQFASIQEAYMAIFPPPPVQGLGTIGGFRLQIEDRGNLGYDELYKETQNIITKSRSVPELAGLFTSYTVNVPQVDAAIDREKAKTHGVAVSDIFDTLQVYLGSLYANDFNRFGRTYQVNVQAEQQFRQDADQIGQLKVRNNLGEMIPLATFVKVSDTAGPDRVMHYNGFITAEINGAAAPGFSSGQAQTAVEKLLREELPNGMVYEWTDLTYQQILSGNTALFVFPLCVLLAFLVLAAQYESWSLPLAVILIVPMTLLSAIAGVIIAGSDNNIFTQIGLIVLVGLACKNAILIVEFAKDKQAEGMSPLDAVLEACRLRLRPILMTSFAFIMGVVPLVLSSGAGAEMRHAMGVAVFSGMLGVTFFGLLLTPVFYVLIRNYVGRQEARKAAKAQKLQNLPAEMH

SEQ ID NO: 74306 - DNA, 3114 bp, Vibrio parahaemolyticus RIMD 2210633
  CDS (1)..(3114): transl_table=11
atgttactttccgacgtttcagttaaacgccctgtcgcggcgttagttctgagtatgctgttgtgtgtgtttggctttgtgtcattcaccaaattagccgttcgtgaaatgcctgatattgagagcccagtcgtttctatcagcacgcgttatgaaggcgcgtcggcaaccattattgaaagccaaatcacctccgtactggaagatcagctttctgggatcagtggaattgatgaaatcagttccaccactcgtaacagcatgtcacgcatcacgatcacttttgagttaggttacgatctgaatactggggtgagtgatgtgcgtgatgccgttgctcgtgctcagcgctcgttacctgatgaagcagatgacccaattgtttacaagaacaatggttcgggtgaagcgtccctttacatcaatctaagttcttctgaaatggaccgcacacagctgacggattatgccgagcgtgttctgatggatcgtttcagtttgatcacgggtgtgagttctatcgatctctctggtggtttgtacaaagtcatgtacgtaaaactcaaaccagagcttatggctggtcgtgcggtcacggcatcggatattacatcggctttgcgtagtgagaacctagaaagcccgggtggtgaagttcgcaacgactcgacggtgatgtcggtacgtacggctcgtacctataacacgcctgaggacttccaatatcttgtcattaaacgtgcaagcgacaacacgcctatctacttaaaagatgtggcggatgtctttattggtgcagaaaacgaaaactcgaccttcaaaagtgacggtgttgtaaacatcagtcttggtgtggtaccgcagtcagacgcaaacccgttagaagtggcgaagctggttcgttctgaagtcgataacattcagaagttcttaccagaaggaacacgtctcgcgattgattacgacgcgacagtatttatcgagcgttcaatcgaagaggtgtacagcacgctgtttattacaggtggcttggtgatcttggtgttgtatattttcatcggacaagcccgtgcgactctaatcccagcggttacggtgcccgtttctctgatctcttcgttcattgccgcgtactactttggcttttctatcaatttgatcactttgatggcgttgatcctgtctattggtttagtagtggatgacgcgattgtggttgttgaaaacatcttccaccatattgaacgtggtgaatcgcctctgcttgccgcgtacaaaggcactcgagaggttggttttgcggttatcgcgacaacgttggttctggtgatggtgtttctgccaatttcctttatggatggcatggtagggctgctatttacagagttttctgtattgctggctatgtcggtaattttctcctctttgattgcactgacacttacacctgtgttgggcagccagatcctaaaggcaaatgtaaaaccaaatcgattcaacgaagtggtcgatcgtctgtttagcaagctggagaatggctaccgctcattattgaaaggagcattgaaagctcgtttggctgcgccattggtgattctggcttgtatgggcggcagttatttcctaatgaatcaagtaccagctcaattgacgccacaagaagatcgcggtgtgatttttgcgtttgtgcgcggcgcagatgctacgtcgtacaaccgaatgtcagccaatatggatattgtcgaagaccgattgatgccattgctagggcaaggttatctgaagtcattcagcatccaaacgccagcgtttggtggtcaggctggtgaccaaactggctttgtgatcatgattctagaagattggaatgaacgtgatgtaacggctcaggaagcgctcaacaaagtacgtggtgcattggcgggtatccctgatgttcgagtgttcccatttatgccaggtttccaaggtggttcgagtgagccagttcagttcgtattaggtggttctgattatgatgagcttctcgtctgggctgaactgttgaagaacaaagccgaagaatcaccaatgatggaaggcgctgagatagactactccgagaaaacaccagagctgttagttacggtcgacaaacaacgcgcggctgaactcggtgtgagcgtaaaagacatttctgacacgttagaaatcatgctcggcggtaaaagcgaaacgacttatgttgagcgtggcgaagagtatgatgtttaccttcgcggtgatgaaaatagcttcaataatgctgccgatttgagccagatttatctgcgtaccaacagcggcgagctagtgacattagacacggtcacgaaaatagaagaagtggcagcatctatccgtctgtctcattacaacaaacagaagtccatcaccattaccgcaaatctttccgaaggttatacattgggtgaggcgctgaattacctcgatcagcaagccatcgacaacttgccgggtgacatttctgtgagttattcgggtgaatcgaaagactttaaagagaaccaagcgagtgtcgcagttgtatttgcgctggcattgctggtggcgtatctcgtgttggcggctcagtttgaaagcttcgtgaacccgctagtagtgatgttcactgtaccaatgggtgtgtttggtggtttccttggtttggtcgtgatggggcaaggaatgaacatttacagccagatcggcatgatcatgttgatcggtatggtaacgaaaaacggcattttgatcgtagaatttgccaaccagctacgtgaccgtggtgttgagtttgaaaaagcgatcattgatgccgccgcgcgacgtctacgcccaattttgatgaccgcgtttaccacacttgcaggtgcaatcccgttgatcgtatcaacaggtgctggttatgagagccgtattgctgtgggtacggttatctttttcgggatgggatttgctacattggtgaccttgtttgttatccctgcgatgtaccgactgatttctgcgaaaacacaagccccaggtcatgtagaagcagaactgaacaaagcgctcagccacgattcgaaaggccgcacagtgcatccttaa

SEQ ID NO: 74307 - protein, 1037 aa, Vibrio parahaemolyticus RIMD 2210633
MLLSDVSVKRPVAALVLSMLLCVFGFVSFTKLAVREMPDIESPVVSISTRYEGASATIIESQITSVLEDQLSGISGIDEISSTTRNSMSRITITFELGYDLNTGVSDVRDAVARAQRSLPDEADDPIVYKNNGSGEASLYINLSSSEMDRTQLTDYAERVLMDRFSLITGVSSIDLSGGLYKVMYVKLKPELMAGRAVTASDITSALRSENLESPGGEVRNDSTVMSVRTARTYNTPEDFQYLVIKRASDNTPIYLKDVADVFIGAENENSTFKSDGVVNISLGVVPQSDANPLEVAKLVRSEVDNIQKFLPEGTRLAIDYDATVFIERSIEEVYSTLFITGGLVILVLYIFIGQARATLIPAVTVPVSLISSFIAAYYFGFSINLITLMALILSIGLVVDDAIVVVENIFHHIERGESPLLAAYKGTREVGFAVIATTLVLVMVFLPISFMDGMVGLLFTEFSVLLAMSVIFSSLIALTLTPVLGSQILKANVKPNRFNEVVDRLFSKLENGYRSLLKGALKARLAAPLVILACMGGSYFLMNQVPAQLTPQEDRGVIFAFVRGADATSYNRMSANMDIVEDRLMPLLGQGYLKSFSIQTPAFGGQAGDQTGFVIMILEDWNERDVTAQEALNKVRGALAGIPDVRVFPFMPGFQGGSSEPVQFVLGGSDYDELLVWAELLKNKAEESPMMEGAEIDYSEKTPELLVTVDKQRAAELGVSVKDISDTLEIMLGGKSETTYVERGEEYDVYLRGDENSFNNAADLSQIYLRTNSGELVTLDTVTKIEEVAASIRLSHYNKQKSITITANLSEGYTLGEALNYLDQQAIDNLPGDISVSYSGESKDFKENQASVAVVFALALLVAYLVLAAQFESFVNPLVVMFTVPMGVFGGFLGLVVMGQGMNIYSQIGMIMLIGMVTKNGILIVEFANQLRDRGVEFEKAIIDAAARRLRPILMTAFTTLAGAIPLIVSTGAGYESRIAVGTVIFFGMGFATLVTLFVIPAMYRLISAKTQAPGHVEAELNKALSHDSKGRTVHP

SEQ ID NO: 74308 - DNA, 3162 bp, Vibrio parahaemolyticus RIMD 2210633
  CDS (1)..(3162): transl_table=11
atggctcgattttttattgatcgtccggtttttgcttgggtactggcgattctgaccatgcttgcagggatcatgtccttgttcaacttgccagtgtcgcaatatccaaccatttcgccgaccacgatcaccatcagcgcgcgctatcctggtgcttctgctaaaacggtggaggactctgtcactcaggttatcgagcaaaacatgacaggtctggattacctacgttacttgtcttcgagcagtgacgctttcggcaatgcgaccattacactgacttttgatagcgaagccgatcctgatatcgcgcaggttcaagtgcagaacaaactgcaattggcgttgacttcgcttcctatggaagtgcaaagccaaggtattgtggtgaacaaatctaacacctcatttttgatggtggtggcggtttattctgacgatccagactttacacaaaacgacattgccgactttgttgtaaccaacattcaagacccaatcagccgtgtgacgggtgtgggtcaagtacaggcttttggttctcaatatgcgatgcgtgtgtggcttgacccgtttaagctgactcagttcaacctgacggcaattgacgttgcaaatgcgatcagtgagcagaatgcgcaagtgtcatctggtcaattgggtgcagcacctgcgcagaaaggtcaactgcttaacgcgacgatctcttctgcgagtcgtttaagcagtgtggctgagttccaaaacatcatcttgaaatcagatgcgagcggtgcaaacgtttatctaagagacgttgctcgtattgagcgtggagcagaaagttacgatattcaaggtcagtacaacggtttgccggcgtctggtttaggtatttcacttggtacaggtgcgaacgcgctggaaacggcggctgcagtcaaagagcgtttagcagagttgagtgaaaacttcccagatggtctgaaagtcgcttatccatttgagacaacaccgtttgtagaagcatcgattcaagaagtagtgaaaacgctactggaagcgattgtgttggtgttcttaattatgtacctgttcttacagaacttccgtgcaacgatcatcccgacgattgctgttccggttgtactcttgggtacgtttgccattctttacgcgacaggtttcagcgtgaataccctgacgatgtttgcgatggttctggcgattggtttgctggtggatgacgccatcgttgtggtagaaaacgttgagcgtgtgatgcacgaagacgggctcgatccaaaagaagcaactaagaaatcgatggggcagatcactggcgcgttgattggtgttggtttgaccttatcggcagtattcgtcccgatggcatttatgtcaggttcgaccggggtaatttaccgtcagttctcgatcaccatcgttgctgcgatgacgttgtcagtgatggttgcgatcatcctgacaccagcgctgtgtgctacgttactgaaaaaaggtgacgctgaatttacggataaaaaaggcttcttcggttggtttaaccgtaaatttgattcgatgaccgcaggttatgaggctggtgtagccaagttgctaaaacgcactgggcgcatgttgttggtgtttgtggcaatgagcgctggtgcgggttggttatttatgaatctgccgacgtctttcctaccagatgaagaccaaggtacggtgttctcgatggcaatcttgccgccgaactcgactcaagagcagacagaaaaaacactcgataaagtgcgtagctatttcttggaagaagaaaaagacaacgtgagatccgtgtttaccgtggctggttttagttttgctggtcaaggtcaaaacatgggtatggcgtttattggcttgaaagattggtctgagcgcgaagcgccgggttcggatgctgcatctttgacaggccgtgctatgggttacttctcaaccatcaaagaagccatggtatttgcgtttgcacctcctgccatccaagagttgggtaacgcaacgggttttgatttctatctacaagactccctgagccttggtcacgaagcattagttgccgcacaagggcaattactgggaatggcagcgcagaatccaaaactagttggtgttcgtccgaatggccaatctgatgcgccaatgtaccaagtgcatgtagatcacgttaaattgcgcgcgctggatgtcagcatcaacgacgtgaaccaaatcctatccgccgcttggggtggtgcgtacatcaacgactacattgaccgtggtcgcgttaaaaaagtgatggtgcaaagtgacgcagagttccgtatgcagccagaagattttaactcgtggtatgtacgtaatgcgcaaggtgaaatggtgccgttttcggcgtttgcaagtggtgaatggacgtatggttcaccacagcttcaacgctttaatggcctggccgcgatgaacattcaaggtggtgcagctccaggtgtcagtacgggtgaagcaatggctgagattgaagcgatggttgagcagttaccagaaggctttacggtgaactggaacggcatctcttatgaagagcgtttgtccggcaaccaagctccaatgttgtacgcgttgtccattttggtcgtgttcctagtacttgctgcgttgtatgaaagctggtctgtaccgcttgcggtcgtgttggttgtacctttgggcgtattaggcgctgtgctcgcagtacttggtcgtggaatggacaacgacgtgttcttccaagtgagtttgttaaccacagtgggtttggcaacgaaaaacgcgattttgatcgttgagttcgcgaaagaatattacgagaaaggtgcaggtctgattgaagctacactgcacgcggtgcgtgtgcgtcttcgtccaatcattatgacgtccttggcgtttggcttgggtgtggttccgttggcaatcagtgctggcgtgggctctgctggtcaaaacgcggtaggtactggtgtgcttggcggcatgatcagtgcgaccttgcttggcatcttctttgttccggtgttctttgttgtggtagagcgtttgtttgatcgccgtgctcaaaaagaagcgcagaaagaacgatctcaagaactcgctccagcaacggaaaagtcggagtaa

SEQ ID NO: 74309 - protein, 1053 aa, Vibrio parahaemolyticus RIMD 2210633
MARFFIDRPVFAWVLAILTMLAGIMSLFNLPVSQYPTISPTTITISARYPGASAKTVEDSVTQVIEQNMTGLDYLRYLSSSSDAFGNATITLTFDSEADPDIAQVQVQNKLQLALTSLPMEVQSQGIVVNKSNTSFLMVVAVYSDDPDFTQNDIADFVVTNIQDPISRVTGVGQVQAFGSQYAMRVWLDPFKLTQFNLTAIDVANAISEQNAQVSSGQLGAAPAQKGQLLNATISSASRLSSVAEFQNIILKSDASGANVYLRDVARIERGAESYDIQGQYNGLPASGLGISLGTGANALETAAAVKERLAELSENFPDGLKVAYPFETTPFVEASIQEVVKTLLEAIVLVFLIMYLFLQNFRATIIPTIAVPVVLLGTFAILYATGFSVNTLTMFAMVLAIGLLVDDAIVVVENVERVMHEDGLDPKEATKKSMGQITGALIGVGLTLSAVFVPMAFMSGSTGVIYRQFSITIVAAMTLSVMVAIILTPALCATLLKKGDAEFTDKKGFFGWFNRKFDSMTAGYEAGVAKLLKRTGRMLLVFVAMSAGAGWLFMNLPTSFLPDEDQGTVFSMAILPPNSTQEQTEKTLDKVRSYFLEEEKDNVRSVFTVAGFSFAGQGQNMGMAFIGLKDWSEREAPGSDAASLTGRAMGYFSTIKEAMVFAFAPPAIQELGNATGFDFYLQDSLSLGHEALVAAQGQLLGMAAQNPKLVGVRPNGQSDAPMYQVHVDHVKLRALDVSINDVNQILSAAWGGAYINDYIDRGRVKKVMVQSDAEFRMQPEDFNSWYVRNAQGEMVPFSAFASGEWTYGSPQLQRFNGLAAMNIQGGAAPGVSTGEAMAEIEAMVEQLPEGFTVNWNGISYEERLSGNQAPMLYALSILVVFLVLAALYESWSVPLAVVLVVPLGVLGAVLAVLGRGMDNDVFFQVSLLTTVGLATKNAILIVEFAKEYYEKGAGLIEATLHAVRVRLRPIIMTSLAFGLGVVPLAISAGVGSAGQNAVGTGVLGGMISATLLGIFFVPVFFVVVERLFDRRAQKEAQKERSQELAPATEKSE

SEQ ID NO: 74310 - DNA, 3105 bp, Bacteroides thetaiotaomicron VPI-5482
  CDS (1)..(3105): transl_table=11
atgaaagttagtttttttatagacaggccggtattttcggctgtcatttccatcgtgattgtgattgtcggaatcatcgggctgaccatgcttccggtggatcaatatccgcagatcacgcctccggtggtaaagatcagtgcgtcttatccgggtgcgagtgcacttaccgtgtcgcaggcggtggctactccgattgaacaggaaatcaatggtacgcccggtatgctttatatggaatcaaacagttctaactccggtggcttctcggcaacagttacctttgatgtatctgctgacccggatttggctgctgtggaaattcagaaccgtgtgaagctggctgaatcccgtcttccggcggaagtgattcagaatggtatttccgtagagaaacaggcacccagtcagttaatgacactctgtctgacttctaccgatcctaagtttgacgaaatttacctgagcaactttgctacgatcaatgtgctcgatgtgattcgccgtattccgggagtaggacgtgtatccaatattggtagccgttactatgctatgcagatatgggcagagcctgataagctggctaacttcggattgactgtgcaggacttgcagaatgccttgaaagaccagaaccgtgaatcggcagccggtgtattaggtcagcagccggtacagggactggatataacgattcctatcactactcagggacgtctttctacagtagggcaatttgaggatattgtggtacgtgccaatgccaatggttccatcatccggctgaaggatgtggcacgtgtatctctggaggcttcttcatacaataccgagagtggtatcaatggtgagaatgcagcggtactgggtatttacatgttgccgggtgccaatgcgatggaagtagccgagaatgtaaagaaggcgatggaagaaatcagcgagaattttccggaaggattgagttatgagattccgtttgatatgacaacgtatatctctgagtctattcatgaggtatataagacgttgttcgaagcattggtgctggttgtgttggtagtgtatctgtctttgcagagctggcgtgctacattgattccggtggtagcggtacctatctccctgattggtactttcggattcatgctgatttttggtttctctattaatatattgaccttactcggtttgattctcgccatcggtatcgtggtcgatgatgcgattgtagtggtggaaggagtagagcatattatggaaacggagaagctgagtccctatgaggcgacaaagaaagcgatgaacggattatcaagcgcattgatcgctacttcactggtattggcggctgtgtttgttccggtaagttttctgagtggaattaccgggcagctgtatcgtcagtttacggtaactatcgtggtatctgtactgatttctactgtggttgctttaacgctgagccctgtgatgtgttcgctcattttgaaaccggatagtggcaagaagaaaaatatagtattcagaaagatcaatgagtggctgggtatcggaagcaataagtatgtagctgccgtcacccgtactatcaaacatcctcgtcgggttttgagtgcttttggtatggtattgattgctattctgttgattcaccggattattccgaccagtttcttgccggtagaagaccagggatactttaagattgaacttgaactgccggaaggagctaccttggagcgaacccgtgtagtaacggaacgcgcgattgcttatctggagaagaatccatatatagaatatgtgcagaacgtgaccggaagcagtccgcgtgtaggcagtaatcagggacgtgccgagttgaccgttattctgaaaccctgggaagagagaaagagcaccagtattgaaaaaattatggatacggtagaaaaacatttgagagaataccccgaatgtaaagtctacctgtctactcctccggtcataccgggactgggcagctccggtggttttgaaatgcagttggaagctcgtggagaggctactttcgataatttggtagatgcggcagatacgttgatgtattatgcttccaaacgtaaggagcttacaggtttgtcttcttccttgcagtcggagattccccaactttactttgatgtggacagagacaaggtgaaaatgctgggagtacccttggcagatgtgttttctacgatgaaagcgtatacaggttcggtgtatgtgaatgactttaatatgttcaaccgtatatataaggtatatattcaggcggaagctccttatcgggaacataaagacaatatcaacctgttctttgtgaaagcttccaatggagctatggtaccgctgacatctttgggtaatgcttcttatacgacagggccgggaagtatcaagcgtttcaatatgtttactactgccgttatccggggtgctgccgcgcagggatacagttccggtcaggcaatggagattatggagcagatcgcccgtgaccatcttccggataatatcggactggagtggagcggactttcttatcaggagaaacaggcaggcggtcagacggggatggtcatggcactggtgttcttgtttgtcttcctcttccttgccgcacaatatgaaagttggacagtgccgattgctgtattgctatccttgcctgtagcagctttgggagcctatctgggagtctgggtgtgcggactggagaatgatgtttatttccagatcggattggtaatgcttgtcgggcttgccgccaagaatgccattttgattgtagagtttgccaaagtgcaggtagatagaggtgaagatttgattcagtcggcaatctacgcagcgaaattacgtttccgtcctattctgatgacctcccttgcatttgtactgggaatgcttccgatggtactggcgagtggtccgggttcggcgagccgacaggcgattggtacgggcgtattcttcggaatgatattcgctatcgtatttggtatcattctcgtgccgttcttctttgtgatggtgtataaaacaaagtcgaaaatcttaaaacataagaaataa

SEQ ID NO: 74311 - protein, 1034 aa, Bacteroides thetaiotaomicron VPI-5482
MKVSFFIDRPVFSAVISIVIVIVGIIGLTMLPVDQYPQITPPVVKISASYPGASALTVSQAVATPIEQEINGTPGMLYMESNSSNSGGFSATVTFDVSADPDLAAVEIQNRVKLAESRLPAEVIQNGISVEKQAPSQLMTLCLTSTDPKFDEIYLSNFATINVLDVIRRIPGVGRVSNIGSRYYAMQIWAEPDKLANFGLTVQDLQNALKDQNRESAAGVLGQQPVQGLDITIPITTQGRLSTVGQFEDIVVRANANGSIIRLKDVARVSLEASSYNTESGINGENAAVLGIYMLPGANAMEVAENVKKAMEEISENFPEGLSYEIPFDMTTYISESIHEVYKTLFEALVLVVLVVYLSLQSWRATLIPVVAVPISLIGTFGFMLIFGFSINILTLLGLILAIGIVVDDAIVVVEGVEHIMETEKLSPYEATKKAMNGLSSALIATSLVLAAVFVPVSFLSGITGQLYRQFTVTIVVSVLISTVVALTLSPVMCSLILKPDSGKKKNIVFRKINEWLGIGSNKYVAAVTRTIKHPRRVLSAFGMVLIAILLIHRIIPTSFLPVEDQGYFKIELELPEGATLERTRVVTERAIAYLEKNPYIEYVQNVTGSSPRVGSNQGRAELTVILKPWEERKSTSIEKIMDTVEKHLREYPECKVYLSTPPVIPGLGSSGGFEMQLEARGEATFDNLVDAADTLMYYASKRKELTGLSSSLQSEIPQLYFDVDRDKVKMLGVPLADVFSTMKAYTGSVYVNDFNMFNRIYKVYIQAEAPYREHKDNINLFFVKASNGAMVPLTSLGNASYTTGPGSIKRFNMFTTAVIRGAAAQGYSSGQAMEIMEQIARDHLPDNIGLEWSGLSYQEKQAGGQTGMVMALVFLFVFLFLAAQYESWTVPIAVLLSLPVAALGAYLGVWVCGLENDVYFQIGLVMLVGLAAKNAILIVEFAKVQVDRGEDLIQSAIYAAKLRFRPILMTSLAFVLGMLPMVLASGPGSASRQAIGTGVFFGMIFAIVFGIILVPFFFVMVYKTKSKILKHKK

SEQ ID NO: 74312 - DNA, 3147 bp, Bacteroides thetaiotaomicron VPI-5482
  CDS (1)..(3147): transl_table=11
atgttttctaagtttttcattaaccgaccaatttttgctaccgtacttgccctgctcattgtggtagccggtttggtcgcacttaatatattgcctgtggcgcaatttccggagattacacctccgacggttcaggtatcggctgtctatcccggtgcgaatgctgaaactgtagctcaaacggtaggactccccatcgaacagcaggtgaatggggtggacggtatgctctatatgtcttcaaattcttcctcttcgggagcatattctctgacaattacatttgccgtcggtacagatatcgatatggctactgtacaagtccagaacagggtaagtgttgctcaatcatccttgccggaaccggtagtggtacagggggtgactgtgcagaaacagtcttcgaacattgtcatgttcctgacaatgacttcgaaagactctgtatacaacagtctctatctgactaactatgccaaattgaatttggtcgatcagttatcacgtgtgcctggtgtaggagctgttaatgtcatgggagcaggtgattattccatgcgtatctggctggatcctgaagctatgcgtatccggaacatttctccggcacaagtatatcagtccattcagtctcagaatatggaagtgtccgccggctatatcggtcaaccgatcggacaggacaataaaaatgcctttcaatatacacttaatgtacaggggcgacttatttctccggagcaattcgggaatattatcattcgtcgggaacaggatggggcaatgcttcgcctgaaagatattgcgcgaatagatttggggtctgcttcttatagtgtagtatcacgattgaaggggatgcctaccgcagcgattgctatctatcagcagccgggctccaattcgctggacgtttcaaaaggagtgaaggctaagatggaggaactggcgaccagttttcctacaggagtagcctataacgtaactttggatacaacggatgtaattcatgcttctattgatgaagtaatggtgacattttttgagacaacgctgctggtagtactggttattttcctgtttttgcagaactggagagcggttattattccttgtatcacaattcctgtatcgctgatcggtacattggcagttatggcggcatttggtttttcgatcaatacgctgactctgttcggattgattctggcagttgccattgtagtggatgatgctattgtggtggttgagaatgcttcaagattgctggagaccggacaatattcaactcgtgaagcagtcacaaaagctatgggggaaattacggggccgattgtcggagtggtgcttgttttgcttgccgtgtttattccgacgatgatgatcagcggtatttcggggcagttgtataagcagtttgcactgacaattgctgcttctactgtattaagcggttttaactcactgacactgacgcctgctctttgtgctctattcctcaaaaagagcaaaccgtctaacttctttatatacaaaggatttaataaagcgtatgataagacacagggagtctacgatagtacggtgaaatggttgcttcaacgtccgcttatctcttttgtatcttttgctattctgacagtgattgccgtaatactctttatgcgttggccgtcgacatttattccggatgaagatgatggttattttattgcagttgttcagcttcctccggcagccagcttggaacgtacacaagctgtcggggataaaatcaatgctattttggattcttatccggaagtggagaattacattggaatcactggtttctccgtgatgggcggaggtgagcaaagtaactccgcaacctattttgttgtcctgaaaaactgggacgaaaggaaagggaaggagcatacggctgctgccgttgtcgaccgttttaatggcgaagcgtatatggagatacaggcaggacaagcatttgctatggttcctccggctattccaggattgggtgcttccggtggcttgcaacttcaattggaagaccggaggaatctgggaccgacagaaatgcagcaggctattgacgcattgcttgcttcttctcattccaaaccggccttagcttctgtatccagtcagtatcaggcaaatgtccctcaatattttctgaatatcgatcgtgataaggtgcaatttatgggcattgctctgaatgatgtattttctacattaagctattatatgggggcggcatacgttaatgattttgttgaattcggtcatatttatcaggtaaagatcgaagcgcgtgatcaggcacaacgggtcattgatgatgtcttaaaactcagtgtggctaattcggcaggagagatggtccccctttcttctttcaccaaagtggaagagcagttggggcaggatcagatcaatcgttacaatatgtattcaacagctgccctgacttgtaatgtagcgcccggaagcagttccggacaggctattcaagaaatggaaactttgtttaaagaacagctgggagatgaattcggctatgaatggacgtcggttgcctatcaggaaacgcaggcgggaaatacgaccaccattgttttggtcatggccttgattgtagcattccttgttttggctgcgcaatatgaaagctggaccagtccggtggctgccgtgataggtttgccggtggccttgttgggagcaatgataggatgtatgataatgggaactccggtcagcgtatatacacagattggtattatcctgcttgttgcactttcggcaaagaatggtattctgattgtagagtttgcccgtgatttccgtgctgagggaaactcaattcgtgaggctgcatacgaagcaggacacgtccgcttacgtccgattttgatgacttcttttgcttttgtattgggggtaatgcctttgctgtttgctaccggggctggtgcgcagagtcgtatagcgttgggtactgcggttgttttcggtatggcgatgaatactttattagcgacagtctatattcctaatttctatgaattgatgcagaaactgcaagagaagtttagcaggaagaaagatgacgatgtgaaaaaagatacgaatatgtaa

SEQ ID NO: 74313 - protein, 1048 aa, Bacteroides thetaiotaomicron VPI-5482
MFSKFFINRPIFATVLALLIVVAGLVALNILPVAQFPEITPPTVQVSAVYPGANAETVAQTVGLPIEQQVNGVDGMLYMSSNSSSSGAYSLTITFAVGTDIDMATVQVQNRVSVAQSSLPEPVVVQGVTVQKQSSNIVMFLTMTSKDSVYNSLYLTNYAKLNLVDQLSRVPGVGAVNVMGAGDYSMRIWLDPEAMRIRNISPAQVYQSIQSQNMEVSAGYIGQPIGQDNKNAFQYTLNVQGRLISPEQFGNIIIRREQDGAMLRLKDIARIDLGSASYSVVSRLKGMPTAAIAIYQQPGSNSLDVSKGVKAKMEELATSFPTGVAYNVTLDTTDVIHASIDEVMVTFFETTLLVVLVIFLFLQNWRAVIIPCITIPVSLIGTLAVMAAFGFSINTLTLFGLILAVAIVVDDAIVVVENASRLLETGQYSTREAVTKAMGEITGPIVGVVLVLLAVFIPTMMISGISGQLYKQFALTIAASTVLSGFNSLTLTPALCALFLKKSKPSNFFIYKGFNKAYDKTQGVYDSTVKWLLQRPLISFVSFAILTVIAVILFMRWPSTFIPDEDDGYFIAVVQLPPAASLERTQAVGDKINAILDSYPEVENYIGITGFSVMGGGEQSNSATYFVVLKNWDERKGKEHTAAAVVDRFNGEAYMEIQAGQAFAMVPPAIPGLGASGGLQLQLEDRRNLGPTEMQQAIDALLASSHSKPALASVSSQYQANVPQYFLNIDRDKVQFMGIALNDVFSTLSYYMGAAYVNDFVEFGHIYQVKIEARDQAQRVIDDVLKLSVANSAGEMVPLSSFTKVEEQLGQDQINRYNMYSTAALTCNVAPGSSSGQAIQEMETLFKEQLGDEFGYEWTSVAYQETQAGNTTTIVLVMALIVAFLVLAAQYESWTSPVAAVIGLPVALLGAMIGCMIMGTPVSVYTQIGIILLVALSAKNGILIVEFARDFRAEGNSIREAAYEAGHVRLRPILMTSFAFVLGVMPLLFATGAGAQSRIALGTAVVFGMAMNTLLATVYIPNFYELMQKLQEKFSRKKDDDVKKDTNM

SEQ ID NO: 74314 - DNA, 3198 bp, Bacteroides thetaiotaomicron VPI-5482
  CDS (1)..(3198): transl_table=11
atgaatttaagaacctttattgaacgccccgtattatcggcagtcatctctattacgattgtcgttgtgggtatcatcgggctgttcagtctgcccgtcgaacaatatcccgatattgctccgccaaccattatggtgagtaccacctattatggcgccagtgcggaaactttgcagaagagtgtgattgctcctttggaagaagcgatcaatggtgtggaagacatgacttacatgacttctaccgccaccaatgccggtacagtgagtatcaccgtgtacttcaagcagggaacagacccggacatggcagcggtcaacgtacagaaccgcgtgtcgagagcgacgggacagcttccggcagaagtaacgcaggtcggtgtgacaacttccaaacgtcagacgagtatcctgcagatgttctcgctctccagtccggacgatagctacgatgaaaacttcctctccaactatatcagtatcaatatcaaaccgcagattcttcgtatctcgggggtaggtgacctgatgattatgggaggtgaatatagtatgcgtgtatggatgaagccggacgtgatggctcagtacaaactgattccgtcggacatcaccggtgtgctagccgagcagaatatcgaatcggctaccggttcatttggtgaaaactcgaacgaaacctatcagtatacaatgaaatataaaggacgtctgatcactccggaagaatttggagatattgtcattcgttctacggacaatggtgaggtcctgaagttgaaagacatcgccgaggtacagttgggacaggatagctatgcttatcacggtggaatggacggtcatccgggcgtttcgtgtatggtgttccagacggcaggctccaatgcgaccgaagtcaatcagaatattgatgaactacttgaagaagtccgcaaagaccttccgaaaggagtggaactgacgcagatcatgagttcgaacgacttcctgttcgcttctatccatgaggtggtgaagacgttgatcgaggcgattatcttggttatccttgtagtatatgtgttcttgcaggacttccgttctacgctgattcctttggtgggagtcattgtttcgctcatcggtacgtttgctttcatggcgctggcaggattcagtatcaatctgctcacgctgtttgcgctcgtgctcgtcatcggtacggtggtggacgacgccattattgtcgtcgaggcggtgcaggcacgcttcgacgtggggtacaggtcgtcctatatggcaagtatcgatgcaatgaaaggtatcagtaatgctgttatcacctcttcgctggtgtttatggcagtatttattccggtatccttcatgggcggtacttccggtacgttctatacccagtttggtctgacgatggcggttgccgttggtatttccgctattaatgcgttgacgctgagtccggcattgtgtgcgttgctgctgaagccctatatcaatgaagacggtacgcagaagaataactttgcggcaagtttccgtaaagcattcaattcggctttcgatattctgatagagaaatacaagaatgtggtgctgatctttatcaaacgcagatggctggcatggtcgctgctcgtttgctccgtagtgttgcttgtattcctgatgaacacgacgaagaccagtctggtgccggacgaagaccagggtgtggtattcgtcaatgtaagtacggcggccggtagttcgctgactacgaccgacgaagtgatggaacgcatcgaaaagcgtctgatggatattccgcagattaagcacgtgcagaaagtggccggctacggattgctggcaggacagggaagctcgttcggtatgttgattctgaagctgaaaccgtgggacgaacgtccgaatgacgaggataatgtacaggcagtcatcggtcaggtgtacggtcgtacggccgatatcaaggatgccagtgtcttcgctatttcgccgggtatgattccgggttacggtatgggtaatgcgctggaactccatatgcaggataagatgggcggtgatatcaacgaattctttaccactacccagcaatatttgggggtattgaaccagcgtccggaaattgcgatggcatattctacgttcgatgtgcgctatccgcagtggacggtagaggtggatgcagccaagtgtaaacgcgcaggcattacaccggatgcggtactgagtacactgtccggttattatggcggtcagtacgtgtccaacttcaaccgtttctccaaagtatacagagtcatgattcaggcagacccgcaattccgtctggacgaaacctcactggacaatgctttcgtacgtatgtcgaacggagagatggctccgctgagccagttcgtaacgttgacacgcagctacggtgcagagtcgctgagccgtttcaatatgtacaattccatcgccgtgaatgcgatgccggcagacggatatagtacgggagacgctatcaaggccgtacaggaaacagccgtacagtctcttcccaagggatatggctatgattacggaggcatcacccgtgaggaaaatcagcaaagcggtacgactatgatcatctttggtatctgcttcctgatgatttatctgattctgagtgcattgtacgagagctttatcattccgttcgccgtgcttctgagtgtgccttgcggattgatgggaagtttcctcttcgcatggatgttcggactggagaataacatttacttgcagacaggtttgattatgttgatcggtctgttggcaaagacggccatcctgttgaccgaatacgctgccgaacgccgtaaggcaggcatgggactgatcgcttccgcggtaagtgcagccaaagcccgtttgcgtccgattctgatgacagcgttgacgatgatcttcggtctgttcccattgatgttgtccagcggtgtaggagccaatggtaaccgttcgctgggtacgggtgtagtcggtggtatgacgatcggtacgctggcattacttttcatcgtgcctactttgtttatcgctttccagtggttgcaggaacgcttacgccctgtgcagagcagacctacggaagactggcagatcgaggaagaaatcaaggtgagtgaagaagaaaaatctaaagcaggaaaaaaataa

SEQ ID NO: 74315 - protein, 1065 aa, Bacteroides thetaiotaomicron VPI-5482
MNLRTFIERPVLSAVISITIVVVGIIGLFSLPVEQYPDIAPPTIMVSTTYYGASAETLQKSVIAPLEEAINGVEDMTYMTSTATNAGTVSITVYFKQGTDPDMAAVNVQNRVSRATGQLPAEVTQVGVTTSKRQTSILQMFSLSSPDDSYDENFLSNYISINIKPQILRISGVGDLMIMGGEYSMRVWMKPDVMAQYKLIPSDITGVLAEQNIESATGSFGENSNETYQYTMKYKGRLITPEEFGDIVIRSTDNGEVLKLKDIAEVQLGQDSYAYHGGMDGHPGVSCMVFQTAGSNATEVNQNIDELLEEVRKDLPKGVELTQIMSSNDFLFASIHEVVKTLIEAIILVILVVYVFLQDFRSTLIPLVGVIVSLIGTFAFMALAGFSINLLTLFALVLVIGTVVDDAIIVVEAVQARFDVGYRSSYMASIDAMKGISNAVITSSLVFMAVFIPVSFMGGTSGTFYTQFGLTMAVAVGISAINALTLSPALCALLLKPYINEDGTQKNNFAASFRKAFNSAFDILIEKYKNVVLIFIKRRWLAWSLLVCSVVLLVFLMNTTKTSLVPDEDQGVVFVNVSTAAGSSLTTTDEVMERIEKRLMDIPQIKHVQKVAGYGLLAGQGSSFGMLILKLKPWDERPNDEDNVQAVIGQVYGRTADIKDASVFAISPGMIPGYGMGNALELHMQDKMGGDINEFFTTTQQYLGVLNQRPEIAMAYSTFDVRYPQWTVEVDAAKCKRAGITPDAVLSTLSGYYGGQYVSNFNRFSKVYRVMIQADPQFRLDETSLDNAFVRMSNGEMAPLSQFVTLTRSYGAESLSRFNMYNSIAVNAMPADGYSTGDAIKAVQETAVQSLPKGYGYDYGGITREENQQSGTTMIIFGICFLMIYLILSALYESFIIPFAVLLSVPCGLMGSFLFAWMFGLENNIYLQTGLIMLIGLLAKTAILLTEYAAERRKAGMGLIASAVSAAKARLRPILMTALTMIFGLFPLMLSSGVGANGNRSLGTGVVGGMTIGTLALLFIVPTLFIAFQWLQERLRPVQSRPTEDWQIEEEIKVSEEEKSKAGKK

SEQ ID NO: 74316 - DNA, 3177 bp, Bacteroides thetaiotaomicron VPI-5482
  CDS (1)..(3177): transl_table=11
atgaaaggaaatatatttatcaaacggccggtgatggctatctccatctccgtgctgattctcgccatagggcttatctcgctcttcaccctgccggtggagcaatatcccgacatcgcgcctcccacggtctatgtatccgccagctatacgggcgccgatgccgaagctgtgatgaacagcgtcatcatgccgctggaagagagcatcaacggggtggaagacatgatgtatatcacgtccagcgcctccaatgcaggtctggctatcatacaggtttacttcaagcaaggcaccgaccccgacatggcggctgtcaacgtacagaaccgtgtagccaaagcacagggactgctgcccgccgaagtaacgaaagtcggcgtaagcacgatgaaacgccagaccagcttcctgcaaatcggcgcgctggtctgcaccgacggtcgctacgaccagaccttccttgccaattatctggacatcaacgtcatcccgcagatcaagcgtatcgagggagtaggagacgtcatggagctgggcgatacctacagtatgcgtatctggctgaaaccggaacggatggcacaatacgggctggtgccttcggacatcaccggcgtgctgggcgagcagaacattgaagcccctaccggctcactgggcgagagttcgcagaacgtcttccagttcacgatgaaatatcgcggaagactgaagagcgtggaagagtttcagaacaccgttgtccgctctcgtgaagacggctcgatactccgtctgaaagatgtggcggatgtggaactgggcactatgacttatagtttccgcagtgagatggacagccagcctgccgtgctctatatgatcttccagacagcgggttccaatgcgaccgctgtcaataaagaaattaccgcccagatggagcggatggagaaaaaccttccggaaggaacggagttcgtcaccatgatgagttcgaacgacttcctcttcgcttccatacacaacgtggtggaaacactgattatcgccatcattctggtcatcctcgtggtatacttcttcttgcaggacctgaaaagtacactcatcccgtctatctccatcatcgtgtcactggtaggtacgtttgcctgtctggtagctgcgggattcagtctgaacatcctgaccctgtttgccctggtgcttgccatcggtacggtggtggatgatgccattgtagtagtagaagcggtgcagtccaagtttgatgccggatacaagtcgccctaccttgccaccaaagatgcgatgggcgacgtgacgatggctatcgtctcctgtacctgtgtcttcatggccgtatttatccccgtcaccttcatgggaggtacttcgggcgtgttctatacccaattcggtatcacgatggcaactgccgtaggtatctccatgatctcggctctgaccctgtgtcccgccctgtgcgccatcatgatgcgtccgtcggacggaaccaagagcgccaagagtatcaacggacgggtacgcgcagcttacaacgcttcgttcaatgccgtgctgggcaagtataagaaaggggtgatgtacttcatccgccatcgctggatggtatggacttcactggctgctaccatcgtcctgctggtttatctgatgagcacgaccaagacgggactcgtgccgcaggaagaccagggcgttatcatggtgaatgtcagcatctcaccgggaagcacgctcgaagagacaacgaaagtaatggaccggctggaaaacattctgaaagatacgcccgaaatagaacactacgcccgcgtagcaggatacggtctgatctccggtcagggaacttcttacggtacgatcattgtccgcctgaaagactggagcgaacgaaaaggaaaggaacacggttcggatgccgtagcttcccgcctcaacgcacaattccagtccatcaaggaagcgcagatattcagtttccagcccgccatgattccgggatacggtatgggtaactccctcgaactgaaccttcaggatatgacaggcggtgatcttgctacgttctatgacgcgtccacacagttcctcaatgccttgaaccagcgcccggaagtggctatggcttatacatcctacgccatcaacttcccgcagctctcggtagaagtggatgccgccaaatgtaagcgtgcaggaatttcgccaagcgcggtactcgatgcggtaggcagttattgcggtggagcatatatctccaactacaaccaatacggtaaggtatatcgtgtaatgatgcaggcatcgcccgaatatcgtctggacgagcaggcattgaacaatatgtttgtgcgcaacggtacggaaatggctccggtgagccagttcgttacactgaagcaggtactgggaccggaaacggccaaccgtttcaatctctacagcaccatcacagccaatgtgaatcctgccgacggttactcttcgggtgaagtgcagaaagtgattgaagaagtggccgcagaatcgcttccgataggctacggatacgaatatggcggtatggcacgcgaagaagcaagcagcggtggtgcgcagacggttttcatctacgccatctgcatcttcctgatctatctgattctggcttgtctctacgaaagtttcctcgtaccgtttgccgttatcttctccgtaccgttcggattgatgggctcgttcctgttcgccaagatactcggactggagaataacatctatttgcagacgggtgtgatcatgctgatcggcttgctggccaagacggctattctgattacggagtacgccatcgaacgccgccgcaaagggatgggcatcgtagaatcggcctactctgccgcacaagtccgcctgcgtcctatcctgatgacggtgctgacgatgatcttcggtatgcttccgctgatgttctcttccggtgcgggtgccaatggtaacagttcgctgggtacgggtgtcgtaggcggtatggctgtcggaacggtggcattgctctttgtcgttccggtcttctacatcatctttgaatacttgcaggagaaaatccgcaaaccgatggaggaagaagcagatgtacaagtgcttttggagaaagagaaaagtgaagctgaacgtgaacgttaa

SEQ ID NO: 74317 - protein, 1058 aa, Bacteroides thetaiotaomicron VPI-5482
MKGNIFIKRPVMAISISVLILAIGLISLFTLPVEQYPDIAPPTVYVSASYTGADAEAVMNSVIMPLEESINGVEDMMYITSSASNAGLAIIQVYFKQGTDPDMAAVNVQNRVAKAQGLLPAEVTKVGVSTMKRQTSFLQIGALVCTDGRYDQTFLANYLDINVIPQIKRIEGVGDVMELGDTYSMRIWLKPERMAQYGLVPSDITGVLGEQNIEAPTGSLGESSQNVFQFTMKYRGRLKSVEEFQNTVVRSREDGSILRLKDVADVELGTMTYSFRSEMDSQPAVLYMIFQTAGSNATAVNKEITAQMERMEKNLPEGTEFVTMMSSNDFLFASIHNVVETLIIAIILVILVVYFFLQDLKSTLIPSISIIVSLVGTFACLVAAGFSLNILTLFALVLAIGTVVDDAIVVVEAVQSKFDAGYKSPYLATKDAMGDVTMAIVSCTCVFMAVFIPVTFMGGTSGVFYTQFGITMATAVGISMISALTLCPALCAIMMRPSDGTKSAKSINGRVRAAYNASFNAVLGKYKKGVMYFIRHRWMVWTSLAATIVLLVYLMSTTKTGLVPQEDQGVIMVNVSISPGSTLEETTKVMDRLENILKDTPEIEHYARVAGYGLISGQGTSYGTIIVRLKDWSERKGKEHGSDAVASRLNAQFQSIKEAQIFSFQPAMIPGYGMGNSLELNLQDMTGGDLATFYDASTQFLNALNQRPEVAMAYTSYAINFPQLSVEVDAAKCKRAGISPSAVLDAVGSYCGGAYISNYNQYGKVYRVMMQASPEYRLDEQALNNMFVRNGTEMAPVSQFVTLKQVLGPETANRFNLYSTITANVNPADGYSSGEVQKVIEEVAAESLPIGYGYEYGGMAREEASSGGAQTVFIYAICIFLIYLILACLYESFLVPFAVIFSVPFGLMGSFLFAKILGLENNIYLQTGVIMLIGLLAKTAILITEYAIERRRKGMGIVESAYSAAQVRLRPILMTVLTMIFGMLPLMFSSGAGANGNSSLGTGVVGGMAVGTVALLFVVPVFYIIFEYLQEKIRKPMEEEADVQVLLEKEKSEAERER

SEQ ID NO: 74318 - DNA, 3060 bp, Coxiella burnetii RSA 493
  CDS (1)..(3060): transl_table=11
atggcaagttcgaaatttacggacaaatttataattcgcccggttctcgccattgttgtgagcttgtttatttttattttggggttgcgtgcgattaccgaaatggaagtgcgccagtaccctaaaatgaacaatacgttaattaccatttcgacggcttaccctggcgcgcctgcttctttaatcgaaggttttattacaacgcggcttgaaaaatccatcgcgggcgccgaagggatcgattatatgacttccaccagcactcaaggcgttagcacgattaatgttttcataaaattgaatttcgatcctaatgtggcttttaccgatatcatgagtaaagtcgcccaagtgcaaaatgatttaccgcgagaatctcagctacctgtcattcaaaaacttaccggaacacaaacggcgttaatgtatatcagctttagtagcgatcagatgagttctgagcagattagcgattacctaaatcgtgttgttcaacctaaaattgaaaccgtctttggcgtttcccaagctgaaattttaggtggccaaacgtttgctatgcgagtttggctgaataccaaacgaatggctgccttaaatgtaacgccgaccgacgtgacgcaagcgttgattaataataattttcaatccgcggcgggacaaacgaaaggcgattttattacgctttatataaaagcgaaaacggacattggagacaaacaagcctttgaaaatttggtcatcaaagaggttaatggtacgttgattcggatacgagatatcggccgcgttgagcttggcgctgaagattacgattcaagcgtttatatgaatggaaaaagcgctatatttgttgccgttaatacgacccccacggctaaccccttgagcgtgattgctaacgttaaaaaaatattaccggaccttgaaaaggaatatccgccttctttgcattcaaaagtggtttatgacgccacagaatacattcaggcctcgatttacgaagttattagaaccatttttgaagcgaccttaattgttattgtagttatttttctttttttgggatcaattcgtactgttgtcattccggttattacgattccgctctcgcttattggcgtttgttttcttatgtggtttttaggatattcgctgaatttactcacgcttttgtcgatggtactggctattggtttagtggtggatgacgctattgtcgtcgtggaaaacgtttatcgacatattgaagagggcatggacggcttccacgcagctattcgaggggctcgcgaaattgcttttcctattatttcaatgaccttaacgctggcagcggtttatgcacccatcggttttatgaccggtttaaccggggctttgttcaccgaatttgcttttacgctagccggtgcggttatcgtttcaggtattattgcgctcaccttatcaccgatgatgtgctcaaaatttttaaaccaaaacattggaaaacaacgttatgtgcaatttattgatcgttcgtttgaacgattaaaacaattttattcgcgccgtttgcacggggttttaaatcaccgttttctgatggtcttattggccgttgccgtattggccagttgttttattttttacatgaataccacctcagagttggcgcctgaagaagatcaaggcgcgctcttcgtgcaagcgcaagccccgcaatacgctaacatcgattacgttgaagcttatagcaaacaatacgaaaaatattttaaaaaactaccgtcaatggccaattattttatgattaacggatttggcacagtaaacaccgtcttggcggcgatgataatgaagccgtgggatcaacgacaacaatcgcaaaaacaagcgcaagccattttacagcccgaacttaataccgtggcgggactacaaaccgtcgtttttcctttagcttcgttaccgggcggaggcaccggtttacccgttcaatttgtgattacttcgatcgctccttttaacaaaatttatttagcaacggaacaaatagtggaggaggcgaaaagaagcggcttgtttatttttgtcgatagcgaactgaaatataacaatccgcaattaaatgtaattatcgatcgaaacaaagccggggatttaggcgtcactatgcagagtttaagtcaaatattggcttattcactcggaggtaattacattaatcgttttgcgatgatgggacaaagctataaagtaattcctcaattaagccgattatttcgcttaaatcccagcaatttagaacagatttatgtgaatacagcaggcggccaattaattcctttgtcaacgctcgttaaaatgaatattacgacgcagccgaatttgctttcgcattttcaacaattaaattcggcgcaaatcgatgctgttttagctcccgggcacaccatgggcgaagcgttaacttatttagaacaaaccgcgaataaagtgcttgcccgagacatgagttatgattttgggggacaaatgcgtcaattcgtccaggaagggcaagcattagtggtgacgttttttctagccattattattatttatctcgtattggcggcgcaatttgaaagtttccgcgatccttttgtgatattaatcagcgtgccgatgtctatttgcggtgcgttaatttttttaaatttaggattggccactattaatatttatacccagattggattggtgacgttaatcggattaattagcaagcacggaattttaatggtggaatttgcaaataaattgcaagaagaagaggggctcagtgttcgcgaagccatcgaaaaatccgcagccattcgtttgcgtcccattttgatgacgacagccgcgatggtattaggcgttgtccccttaattttggctacaggcgccggcgctgtgagccgtttcgatattgggcttgtgattgccaccggaatgctaatcggcactatgttcactttatttgtggtgccaaccatgtatttattaattgcgaaaaaacatcaacctttgcggaaggtagatgaataa

SEQ ID NO: 74319 - protein, 1019 aa, Coxiella burnetii RSA 493
MASSKFTDKFIIRPVLAIVVSLFIFILGLRAITEMEVRQYPKMNNTLITISTAYPGAPASLIEGFITTRLEKSIAGAEGIDYMTSTSTQGVSTINVFIKLNFDPNVAFTDIMSKVAQVQNDLPRESQLPVIQKLTGTQTALMYISFSSDQMSSEQISDYLNRVVQPKIETVFGVSQAEILGGQTFAMRVWLNTKRMAALNVTPTDVTQALINNNFQSAAGQTKGDFITLYIKAKTDIGDKQAFENLVIKEVNGTLIRIRDIGRVELGAEDYDSSVYMNGKSAIFVAVNTTPTANPLSVIANVKKILPDLEKEYPPSLHSKVVYDATEYIQASIYEVIRTIFEATLIVIVVIFLFLGSIRTVVIPVITIPLSLIGVCFLMWFLGYSLNLLTLLSMVLAIGLVVDDAIVVVENVYRHIEEGMDGFHAAIRGAREIAFPIISMTLTLAAVYAPIGFMTGLTGALFTEFAFTLAGAVIVSGIIALTLSPMMCSKFLNQNIGKQRYVQFIDRSFERLKQFYSRRLHGVLNHRFLMVLLAVAVLASCFIFYMNTTSELAPEEDQGALFVQAQAPQYANIDYVEAYSKQYEKYFKKLPSMANYFMINGFGTVNTVLAAMIMKPWDQRQQSQKQAQAILQPELNTVAGLQTVVFPLASLPGGGTGLPVQFVITSIAPFNKIYLATEQIVEEAKRSGLFIFVDSELKYNNPQLNVIIDRNKAGDLGVTMQSLSQILAYSLGGNYINRFAMMGQSYKVIPQLSRLFRLNPSNLEQIYVNTAGGQLIPLSTLVKMNITTQPNLLSHFQQLNSAQIDAVLAPGHTMGEALTYLEQTANKVLARDMSYDFGGQMRQFVQEGQALVVTFFLAIIIIYLVLAAQFESFRDPFVILISVPMSICGALIFLNLGLATINIYTQIGLVTLIGLISKHGILMVEFANKLQEEEGLSVREAIEKSAAIRLRPILMTTAAMVLGVVPLILATGAGAVSRFDIGLVIATGMLIGTMFTLFVVPTMYLLIAKKHQPLRKVDE

SEQ ID NO: 74320 - DNA, 3147 bp, Nitrosomonas europaea ATCC 19718
  CDS (1)..(3147): transl_table=11
atggatttctccaagttcttcatcgaccgtcccatatttgccatcgttctctcggtgatcatttttgcggcgggactgatcgccatcccgctgctgcctgcaggtgaatatccggaagtggtgccgccaagcgtggtcgtgcgcgcaacatacccgggcgccaatcccaaagagatcgcagattcaatcgccgttccgctggaagaagcgatcaacagcgttgaagggatcatgtatatgaagtccgttgcaggctccgatggcagcctgcaagtgacggttacttttatgcccggcatcgatccggataccgctgctgtgcgcgtacagaaccgtgtcgcccaggccctgtcccgtctgcctaacgacgtacgccagtacggcgtaaccacacagaagcagtccccgactccgcttatgtacgtgaatctttcttcacccgatggtcgatatgactcggtctatctgcgtaactatatgaccttgaatatcaaggatcagctttcacgcttgaagggtgttggcaacgtcggattgtacggcgaaggtgattatgcgatgcgcctgtggctgaatccgaatgagcttgccgcgcggggccttacagccagcgacgtggtggatgctgttcgtgaacagaatgtgcaggtatccgcggggcaattgggcgccgaaccatcaccccaaggggcagatttcctcgttccgatcaatgtgcgcgggcggcttcgcagtgaacaggagttcggtgatatcgtactcaaaagtgccgacgatggccaattggtccgcttatcggatgtaggtcgcgtcgagctcggctccagcgattacacgctgcatgccatgatcgataacaggggcagcaccagcgccggtatttttctgacgcccagtgctaactctctggaggtggccagaacggtctatgccaagtttgaagaacttgcagcaaattttcctccgggtatcgagtatcgggtggtatgggatcctactgtttttgtccgggattccattcgagccgtgggtcagacactgatcgaggcggtcttcctggtcgtgctggtggtcattctctttctgcagacctggcgcgcgtcgatcattcctctgattgcggtgccggtctcgattatcggcacgttcgcctggctgtacctgcttgggtattccatcaatacattgacattgtttggattggtcctggccgtgggtattgtcgtcgatgatgcgattgtcgtcgtggaaaacgtcgagcgctatattgaaaaaggcctgagccctctcgcagcggcacaccaggcgatgaaagaagtttccggtccgatcatcgccattgcgcttgtgctatgcgccgtattcgtgcccatggcattcctgagcggtgtcaccggagagttctacaagcaatttgccgttaccatcgccatatccaccattatttctgcgatcaattcgctcaccctgtcgccggcattggcagcaaaactgctcaaaggacagagtgccccgaaagataaacttacccgcgtacttgagcgtagtctgggatggctgtttcatcctttcaaccgcctgtttctccgcagctccgacaaatatcaaggcacggtagcccgaacgttgaatcgacggggcatcgtatttgccgtttatgcgggactattgctcgcgactgtcgtactattccatatcgtaccgactggctttattccaaatcaggataaactttatcttttcgctggcgccaaattgccggagggcgcttcgctcgctcgtactgatgccgttacacgtcaactcaatgaccttgctagtagtattgaaggcgtggaaatgaccgaaagctatgtggggatgaatgcattgcagtcagtcaatacgcccaatctggctgcgtcttacgtcatcctcaaacctttcgatcaacgccagcgttctgctgaatcgatcacggccgaactgaatgccaagctgactgatatcaaggacgggcaagcctatgccttattgcctccatccatacagggcctgggcaacgggtcgggctattcgctctatctggtcgatcggggagggctggggtacggggtattgcaaaacgtcatgacacatttccagaatgtgattgcacagacgccaggcatgacttttcctgtcagctcataccaggccaacgtcccacagctcgaggtcaaggtagatcgagtcaaagccaaagctcagggagtaaatctgacagacctcttcaatacgttgcaggtctatctgggttctttctacatcaatgatttcaatctgtatggtcgtatctatcgcgtgatggcccaggcggatgcggcttttcgccagaaagctgaagacatcaacaatctgtatacgcgcaatagtcgaggagaaatggttccgctagggtcgatggtaacgattcaacatacctttggcccggatccggtcattcgctacaacggctaccccgcagctgatctgataggtgacgctgatcctcgcgtactctcctcggggcaagtcattgccaagctttcgcagatcgctgcagaggttttgcctcgcggtattacactggaatggaccgatctgagctatcagcaggtcacccaaggtaatgcagcggccatcgtattccccttgtcgatcatgctgacttttctggtgctggctgccctctatgagagttggacgctacccttggcggtcatcctgattgtgccggtatgtatgtgtgctgcacttttcggcatttggttcacaggtggcgacaataatatattcgtccaggtgggactcgtcgtattgatggggctggcatgcaagaatgccatcctgatcgttgaattcgcacgggaattggagatccaaggcaaggatattgtcgaagctgctctggaagcctgccaccttcgactgcggccgatcgtaatgacttcgatcgctttcatcgccggatctgttcccttggtatttagttacggtgcaggtagtgaggtacgctacgcaaccggtattaccgtcttcgccggcatgctcggagtaacgttatttggattgtttcttactcctgtcttttacgttgctctgcgcaagctggcccatttcaaccatcttaagtcgcaggaagggtga

SEQ ID NO: 74321 - protein, 1048 aa, Nitrosomonas europaea ATCC 19718
MDFSKFFIDRPIFAIVLSVIIFAAGLIAIPLLPAGEYPEVVPPSVVVRATYPGANPKEIADSIAVPLEEAINSVEGIMYMKSVAGSDGSLQVTVTFMPGIDPDTAAVRVQNRVAQALSRLPNDVRQYGVTTQKQSPTPLMYVNLSSPDGRYDSVYLRNYMTLNIKDQLSRLKGVGNVGLYGEGDYAMRLWLNPNELAARGLTASDVVDAVREQNVQVSAGQLGAEPSPQGADFLVPINVRGRLRSEQEFGDIVLKSADDGQLVRLSDVGRVELGSSDYTLHAMIDNRGSTSAGIFLTPSANSLEVARTVYAKFEELAANFPPGIEYRVVWDPTVFVRDSIRAVGQTLIEAVFLVVLVVILFLQTWRASIIPLIAVPVSIIGTFAWLYLLGYSINTLTLFGLVLAVGIVVDDAIVVVENVERYIEKGLSPLAAAHQAMKEVSGPIIAIALVLCAVFVPMAFLSGVTGEFYKQFAVTIAISTIISAINSLTLSPALAAKLLKGQSAPKDKLTRVLERSLGWLFHPFNRLFLRSSDKYQGTVARTLNRRGIVFAVYAGLLLATVVLFHIVPTGFIPNQDKLYLFAGAKLPEGASLARTDAVTRQLNDLASSIEGVEMTESYVGMNALQSVNTPNLAASYVILKPFDQRQRSAESITAELNAKLTDIKDGQAYALLPPSIQGLGNGSGYSLYLVDRGGLGYGVLQNVMTHFQNVIAQTPGMTFPVSSYQANVPQLEVKVDRVKAKAQGVNLTDLFNTLQVYLGSFYINDFNLYGRIYRVMAQADAAFRQKAEDINNLYTRNSRGEMVPLGSMVTIQHTFGPDPVIRYNGYPAADLIGDADPRVLSSGQVIAKLSQIAAEVLPRGITLEWTDLSYQQVTQGNAAAIVFPLSIMLTFLVLAALYESWTLPLAVILIVPVCMCAALFGIWFTGGDNNIFVQVGLVVLMGLACKNAILIVEFARELEIQGKDIVEAALEACHLRLRPIVMTSIAFIAGSVPLVFSYGAGSEVRYATGITVFAGMLGVTLFGLFLTPVFYVALRKLAHFNHLKSQEG

SEQ ID NO: 74322 - DNA, 3195 bp, Nitrosomonas europaea ATCC 19718
  CDS (1)..(3195): transl_table=11
atgaattcccgtttttttattgaacgaccgatttttgcatcagtactatccatcatcatcgtcattgttggtctggtttcactgaaaaatctcccgattgctcagtttccagaaattactccgcccgtcgtgcaaattgatgcggattatcccggtgccagtgcagatgtggtagcggaagccgttgcacgcccgatagaagtacagcttcccggtatcgataatcttctgtattacgaatccaccagtacaaacgatggccacatgacaatgaggctcacgttcgaaatcggaacagatatcgatatcgcacaagtacaaacccagaaccggcagaaactggccgaaccacaactgcccgatgaagttatccggcaggggataaccgtcaagaagacttcacccgatctactgctagtcgttgcgttgagctctactgatccttctcacgacaccatttttctgtcgaattatgccctgctcagggtactcgataatataaaacgccttcccggtgttggggatgcttcaatctttggcggtcagaattattccatgcggctcattcttgatcccgtccggatggcgcaactcaatttcacaccgagtgatatcgtcgctgctgtccgtgagcagaatcgggattttcctgccgggcgaatcggccgcgaacccatggtcaatgaaaccgagctcaccattcccgttatgactaaaggacggatgagtgaggtaaaagaatttgaagaaatgatcatccgggcttatccggatggttccatggtacgactgaaagatgtctcacgagtagagctgggtgcacaatcctatgatctgcaggcacgttggaacggacggcccaatacttttctgctgacttatctttcacctggcgccaacgcacttgaaacagcacagcgcatccgcaacgaaatggacaagcttgctaaagatttcccggctggtgcgtcctatgatgttccttacgacaccaccacctttattgaggtttccattcaggaggttgtaaaaaccctagcagaggccttgttgctggttgtgctggttgttttcatttttttacaaagctggcgcgccacactgatcccggctatcgcggcacccatttctctcatcggtacattcatgggaatggaagcgctggggttttcgataaacacacttaccctgtttggtatggtgctttccatcggtatcgtggtggatgatgcgattgtcgtggtagaaaacgtcgagcgccatatagccgagggcctcacgcctaaaaatgccgcaataaaagccatgcaggaattattcggagcactgattgctatcattctggtactcgcttcggtatttttaccggtcgcatttctgggaggcattactggtgaactgtacaaacaatttgctgtaaccattgcattgtcagtcatgatttccggatttgtcgcactgacactcagtcctgctttgtgtgccctggtactcaaacccggccacgattctcctaacaaactatggaaaactttcaaccgaacgtttgattgggcacagactcgctacgtcagcatggccggtacaatcataaaaagatcggcattatcaatcctcatttttttaatggtaatattttttgccatcggtttattcaaaacagtgccaggaggttttcttccggaagaagatcagggttatttcattacggtagtacaacttccggatggcgcttccatttcccgcacccaaaaggttcttgaaaaaatagagagttatttcctgtccattccatctgttcattcaactgatgcaatggctggcatgaactttgttttcagcagccgtggtccgaatcacgccacgatgttcgtaccgttgcatcactgggatacacgcaaaaatgccgatgagcaggttcaaaacctgatcgccaatgcctttggtgaatttgcaaaaatccctgaagcactggtgctcgcctttaacgcaccctcaatccgcggactgggcgcaacgggtggcttttcaattcaattgcaggacccaagtggaggagacttttcagaatttgccgaaacagcacaggcatttgtaaacaaagccatggaacacccggctatcggaattgccggtaccaatttccgtgtcagcgccccaaggatgtatgctcatgtcgaccgcgaacgtgccaaagccttaggtgtgcccatatccgatgttttcgatacgatgcaagcttattttggcaatttatatgtgaatgactttatcaagtttggccgtgtctaccgggtacaaactgaagcctcacctgagtatcgatccagcccggacaatatcagcaatatctatgttcgtgcccaatccggaacaaccagcacaatgataccgcttgattctgtggttacaaccgagttcaacagcggcccggatccggttacccatttcaacggattcaactctgcactcgtgctgggaagtgcagcgccaggctatagctcagggcaagctctggatgcgctgcaggaagtggccaatgaagtactggcacccaagggttacaccatcgactggagcgggattacctatcaggaaaaaatggcagccagtggacaaaaaatatggatactttcctttgccctgctcatggtatttttggtgttggctgccctgtatgaaagctggtctgtaccgtttgccgtcattctggccgtgcccttcggtatcttgggagcattgctggctatctgggcgcgtggactgactgatgatatttactttcaggtcgggttaattaccctgattggactatccgccaaaaacgctattcttatcgtagagttcgccagtgatctgtatgccaaaggcgcatcactgaccgaagccgctctggaggcagcccgggttcgtttccgtccgatcatcatgacttccatggcctttatcatgggggtattcccgcttgcgatttcatccggcgcaggggctgccagccgtatcgccattggcactactgtacttggcggcatgctggcagcaactttcctcgccatatttttcgtgccgctctttttcgtgctgattggaaaaatcacacgacgcgacaaacatccaactcctgaacctgtacaggctgaaaccggagatcaggcagttaccaccaacgaaaaggaagatactgatggcaaatga

SEQ ID NO: 74323 - protein, 1064 aa, Nitrosomonas europaea ATCC 19718
MNSRFFIERPIFASVLSIIIVIVGLVSLKNLPIAQFPEITPPVVQIDADYPGASADVVAEAVARPIEVQLPGIDNLLYYESTSTNDGHMTMRLTFEIGTDIDIAQVQTQNRQKLAEPQLPDEVIRQGITVKKTSPDLLLVVALSSTDPSHDTIFLSNYALLRVLDNIKRLPGVGDASIFGGQNYSMRLILDPVRMAQLNFTPSDIVAAVREQNRDFPAGRIGREPMVNETELTIPVMTKGRMSEVKEFEEMIIRAYPDGSMVRLKDVSRVELGAQSYDLQARWNGRPNTFLLTYLSPGANALETAQRIRNEMDKLAKDFPAGASYDVPYDTTTFIEVSIQEVVKTLAEALLLVVLVVFIFLQSWRATLIPAIAAPISLIGTFMGMEALGFSINTLTLFGMVLSIGIVVDDAIVVVENVERHIAEGLTPKNAAIKAMQELFGALIAIILVLASVFLPVAFLGGITGELYKQFAVTIALSVMISGFVALTLSPALCALVLKPGHDSPNKLWKTFNRTFDWAQTRYVSMAGTIIKRSALSILIFLMVIFFAIGLFKTVPGGFLPEEDQGYFITVVQLPDGASISRTQKVLEKIESYFLSIPSVHSTDAMAGMNFVFSSRGPNHATMFVPLHHWDTRKNADEQVQNLIANAFGEFAKIPEALVLAFNAPSIRGLGATGGFSIQLQDPSGGDFSEFAETAQAFVNKAMEHPAIGIAGTNFRVSAPRMYAHVDRERAKALGVPISDVFDTMQAYFGNLYVNDFIKFGRVYRVQTEASPEYRSSPDNISNIYVRAQSGTTSTMIPLDSVVTTEFNSGPDPVTHFNGFNSALVLGSAAPGYSSGQALDALQEVANEVLAPKGYTIDWSGITYQEKMAASGQKIWILSFALLMVFLVLAALYESWSVPFAVILAVPFGILGALLAIWARGLTDDIYFQVGLITLIGLSAKNAILIVEFASDLYAKGASLTEAALEAARVRFRPIIMTSMAFIMGVFPLAISSGAGAASRIAIGTTVLGGMLAATFLAIFFVPLFFVLIGKITRRDKHPTPEPVQAETGDQAVTTNEKEDTDGK

SEQ ID NO: 74324 - DNA, 3102 bp, Nitrosomonas europaea ATCC 19718
  CDS (1)..(3102): transl_table=11
atggcgcgattttttatcgaccgcccggtattcgcctgggtcatctcattactgatcattcttgccggattactctccattcgggggctgccggtagcccaatacccggatattgcaccacctgtgatcaacgtatcggccacttatcccggtgcttccgccagaattgtcgaagaatcggtcaccgcgattatcgaacgtgaaatgaatggcgcgccgagattgatgtatacctcagccaccagcagcccgggttccgccaacatcaacctcacattcagacagggcacggaccccgatctggctgccgtggaagtacagaatcgtttgaaaatggtggaagcacgtttaccagaagtcgtgcgccgcaacggtattttcattgaaaaatccgctgacaacatacagctggtggtttccattacttctaacgataatcgcttgacggaaatcgagctgggagaactggcatctgccaatatattgcaggcattgcgccgggtcgagggtgttggcaaggtacagtcgttcagtccggaatatgccatgcgtatatggccggatccagcaaaaatgacttctctcgatctgacggcatccgatctcgcttcggcgatacgcagccataatgcccgtgtggtcatcggttatatcggtgataaggcagtaccggagcacgcacctatcagtgccaatgtcgcggcagacaaagcacttgctacgccggaagatttcaagaatattacgttacggacaaaagcagatgggggtgccatcctgctgcgtgatgtcgccagagtggaatatggcggaagcgattattcgttcttttcccgtgtcaatggcaagaatgccgcggggatggcagtgaaaatggcaccgggatccaacgctgtggctacggtagaacgtatacgcaataccatggatgaactgtccagatatttcccgccaggggtcagctaccagataccttacgatacttcagcgtttgtcgaagtctccatccagaaagtagtgaataccctggtcgaagcagtagtcctcgtgtttctggtgatgctcctgttcatgcagagcatccgggtaacgctcattcccaccctggtcgttccgattgcgctccttggcacctttgcggtcatgtatggcctggggttttccatcaatgtactgaccatgttcggcatggtactggcgattggtatcgtcgtggatgacgccatcgtcgtggtggaaaatgctgagcgtatcatcgtcgaagaaggtctgtctccctacgaagctaccgtcaaagcgatgcagcagatcagcggtgcgattatcggtatcacggtcgttctgacttctgtatttttgcccatggcgtttttcagcggtgcagtcggcaacatttaccgccagttttctctgtcactggcgacttccattgctttttccgcctttctggcactttcattgacgcctgctttgtgcgctaccttgctcaaacctgtcgacaaagaacaccatgaaaataaacgtggattctttggctggttcaaccggacattcatttctctgaccaatcggtaccagcatcgtgtcgggcagatactcaaacgtcctgtgcgctggctggttgtatacggcattatcattgctgctgtagccttgctgttcgcccgtttgccgactgctttcctgccggaagaggatcagggagatttcatgatcatggtcatgctgccacagggtgccacgatgcatgaaaccatgaatacattgggtgaagtgagccagtatctgcaggaaaacgaaccggtgaaatatgtttatgaagtcggtggcttcagtttctatggcacgggcgccagcagcggcatgatttttgcgacattacaggactgggaagaacgcaaacatgccgatcagcacgtgcgatcgattgtcgagcgtgtcaacatgcatttttatggacggcccaatctgacggtatttgcgttgaatacaccgccattacctgaactgggctcatccagtggtttcgatctgcggctgcaggatcgcggcaatgtcggctataaaacgctggccgctgcccgcgaccggctactggccgaaggcggacaacatccggtactgaccaatctgatgttcgccggcttggcagaagcaccggtcatcaacctggatatcaaccggcgcaaggcacaagcgctgggtgttacgatggatgaaatcaatgccacactcgctgtcatgttcggctcggattatattggtgacttcatgcacgggaatcaggtcaggcgtgtcatcgttcaggcggatggcaagaaccgtatcgagctcgatgatattcgtaaactgcgggtaagaaatgctgcgggtaagctggtgccgctgtcatcctttgtttcactggagtgggggatgggtttaccgcaacttacacgctacaacggttttccttcctttaccatcaatggcaatgctgctgccggcaaaagcagcggggaggccatgcgagaaatcgagcatatcgtagccaagttgccgaacgggataggcttcgactggtcaggccagtcgctggaagaacggctctccggcgatcaggctccgttcctgttcgggctatccgtgctgatcgtatttctggcgctggctgccctgtatgaaagctggctgattccacaggcggtcattctggtcgtgccactgggcgtgctgggtgctgtgctgggagtgacgttacgcgatatgccgaatgatatctatttcaaggttggcctgatcgcaatgatcgggctttctgcgaagaacgccattctgatcgtcgaagtggcaaaagaactttacgacagtggtatgagcctgatcgatgcaacactggaagctgcccgtttgcgcctgcgtccgatcatcatgacttccctggctttcggtgccggggtactgcctctggcgttggcaaccggtgcagcatcgggcgctcagaccgcaatcggtaccagtgtatttggagggaatgtcatggcgaccgcactggcaatattcctggtgcccctgttttttgctgtgatagggcgttatatcaagcgttcgcgacactcataa

SEQ ID NO: 74325 - protein, 1033 aa, Nitrosomonas europaea ATCC 19718
MARFFIDRPVFAWVISLLIILAGLLSIRGLPVAQYPDIAPPVINVSATYPGASARIVEESVTAIIEREMNGAPRLMYTSATSSPGSANINLTFRQGTDPDLAAVEVQNRLKMVEARLPEVVRRNGIFIEKSADNIQLVVSITSNDNRLTEIELGELASANILQALRRVEGVGKVQSFSPEYAMRIWPDPAKMTSLDLTASDLASAIRSHNARVVIGYIGDKAVPEHAPISANVAADKALATPEDFKNITLRTKADGGAILLRDVARVEYGGSDYSFFSRVNGKNAAGMAVKMAPGSNAVATVERIRNTMDELSRYFPPGVSYQIPYDTSAFVEVSIQKVVNTLVEAVVLVFLVMLLFMQSIRVTLIPTLVVPIALLGTFAVMYGLGFSINVLTMFGMVLAIGIVVDDAIVVVENAERIIVEEGLSPYEATVKAMQQISGAIIGITVVLTSVFLPMAFFSGAVGNIYRQFSLSLATSIAFSAFLALSLTPALCATLLKPVDKEHHENKRGFFGWFNRTFISLTNRYQHRVGQILKRPVRWLVVYGIIIAAVALLFARLPTAFLPEEDQGDFMIMVMLPQGATMHETMNTLGEVSQYLQENEPVKYVYEVGGFSFYGTGASSGMIFATLQDWEERKHADQHVRSIVERVNMHFYGRPNLTVFALNTPPLPELGSSSGFDLRLQDRGNVGYKTLAAARDRLLAEGGQHPVLTNLMFAGLAEAPVINLDINRRKAQALGVTMDEINATLAVMFGSDYIGDFMHGNQVRRVIVQADGKNRIELDDIRKLRVRNAAGKLVPLSSFVSLEWGMGLPQLTRYNGFPSFTINGNAAAGKSSGEAMREIEHIVAKLPNGIGFDWSGQSLEERLSGDQAPFLFGLSVLIVFLALAALYESWLIPQAVILVVPLGVLGAVLGVTLRDMPNDIYFKVGLIAMIGLSAKNAILIVEVAKELYDSGMSLIDATLEAARLRLRPIIMTSLAFGAGVLPLALATGAASGAQTAIGTSVFGGNVMATALAIFLVPLFFAVIGRYIKRSRHS

SEQ ID NO: 74326 - DNA, 3129 bp, Helicobacter hepaticus ATCC 51449
  CDS (1)..(3129): transl_table=11
atgtcaagattctgtattaatcgtcctatttttgcaatggtgctctcaatcgtcattacacttgtgggttgtatttcaatgtttgttttacccatagaggaatatccacaagtagtgccaaatgaaattatggtgcaggctacttatagtggtgcaagtgcagaagtgatggcaaatacggtagcaagtattatagaagatagtattaatggggtagagggtatgctctatatgaaatcttcttcaacttcaagtggtgtaatgaatctgagtgtattttttagtaatgatacaaatgcagatatggcattagtcaatgtaagtaatcgcgttcaagcagctcttgcccaattaccaacagaagtgcaaagagtggggattactacgcgtaaaagatcttctactatgcttggagtatatgcgatgtattcagataatcctgcctatactgcaacttttgtagcaaactatggtattttaaatgttattaatgagcttaaacgtgtgcccggagtaggtgatgtaactccttttggaacaagagattactcaatgagaatctggcttgatattgataaactctcacaaaataatctcacgccttcagaagtggcaaaagtcattgccgaacaaaactcacaatttgcagtaggctcatttggtaaagaacccgtgcgcagtgatattgcctttacttattctgtaacaacacaagggcgatttgtaagcgcagaggagtttggaaatatcattatccgctcaaataatgatggttcagctttgcgtcttaaagatgtggcaaaaatagagcttggagcaaaagattatagcgtaagcccattatttaatggcaaagatgccgcagcatttggtattgccttgcaacccggagcaaatgcacttgatgtcgcagataatgtagagaaaaaaatgaaagagctctcacaaaattttcccgaagggctacattataaaaatgtttataatacaactgattttgtgaaaatttctattaaagaggtaagaaaaacttttattgaagctatcgtgcttgtagtcattattatgtattttttcttgcaaaatttccgcgcaactattatccctgtaattgctattcccgtatcaattattggcacatttgcaggaatgtatgcgcttggattttcaattaatctcctcacactttttgggcttattttagctattgggattgttgttgatgatgcgattattgtgatagaaaatgtggagagaatcttgcatactgaaacaaaggcaaatggcgaaaaatattcggtaaaagaagctacccttaaagctatgggtgaaattcaaggaccggtagtggctatcgtgcttgtgctttgctcggtgtttattcctgtggcgtttattggtggctttagtggggctatttataagcagtttgccattactattgttatttcagttgtcatttctggctttgtagccctaacacttactcccgcactctgtgtatctatccttaaggcaaaagaaccaaaaccattttatattgtaaagagattcaatgatttttttgattggcttacgcataaatttggtatgcaaataggaagagcattaaggcgaggctcagctcttttactttgttttgtggcaattattgtggttacttgggggctattttcacgattgccgagttctcttgtgccaagtgaagataaaggaagtatgataagttttattcagctgccacccgcagcttcactttctcgcaccactacagagggtaaaaaagctttggctattttagagcaaaatccaaatgtggattatagttttttaatttcaggctttgatatgcttgcaagtgcagcacgctcttcaggggcagtgatttttgtaacgcttaaaaattggagtgagcgaaatgagagttcttttgagatgtctaaaaagatgatgggtgtatttaatgctagtcttgatgccttttcccttgtaactacaccaccagcgattatgggcttatccacggtgggcggctttgagatttatatacaagatagaaatggtggaagtattaaagacttagaaaaatacgcaaatcttcttgtgatggaagctaataagcgtaaagagcttgttggcgtgcgaagtctttttagtgcaaatatcccacaatatcatcttacccttgatagggaacgcgcaaaggcaagcaatgtcaatattgatgatgtatttaccactatgcaaagcacttttgggcagtattatgttaatgattttaatctctatggcaaaacttatcaagtaaatgttcaggcacaaagtgagtttagagaatctccagaagatttaagtcgcatttttgtgaaatcaggcaatggcgatttaatccctattagtgcgcttgtgcattttgagcgcgttattggaccagatattgtagatagatttaatctctttacaagtgcaaaaattgttggcaatcctaatgagagtgaggggtattcaagtggtgatgcgttgcgtgtgattgagcaattagtaaaagaagtgttgccagaaggttatactattgcttattcaggcacaagttatcaagagaaaaatgcaagtggcacaggcgagattgcatttatatttgggcttatctttgtatttttgattctttgtgcccaatatgagcgatggcttatgccgctctctgtgttaagtgctgtgccatttgctgtttttggtgcagtagtagcgacaacattgcgcggacttgataatgatatatattttaatattggattagttatgttgattgccctttcagcaaaaaatgcaattttaatcgttgagtttgcccagcatttacacgaaaaagagggtaagggtattatggaatctgccataggtgctgcgaaattaagattccgtcctatcattatgacttcacttgcctttagcataggcgtgcttcctttagttttaagcacaggagcgggaagtgcagcaagacacgctattggcacaggcgttattggcggaatgatggcggcaacatttatagcaatattttttattccgctcttttggagttatattgcaaggttaagtcaatggcttaaaaataaaatgagctaa

SEQ ID NO: 74327 - protein, 1042 aa, Helicobacter hepaticus ATCC 51449
MSRFCINRPIFAMVLSIVITLVGCISMFVLPIEEYPQVVPNEIMVQATYSGASAEVMANTVASIIEDSINGVEGMLYMKSSSTSSGVMNLSVFFSNDTNADMALVNVSNRVQAALAQLPTEVQRVGITTRKRSSTMLGVYAMYSDNPAYTATFVANYGILNVINELKRVPGVGDVTPFGTRDYSMRIWLDIDKLSQNNLTPSEVAKVIAEQNSQFAVGSFGKEPVRSDIAFTYSVTTQGRFVSAEEFGNIIIRSNNDGSALRLKDVAKIELGAKDYSVSPLFNGKDAAAFGIALQPGANALDVADNVEKKMKELSQNFPEGLHYKNVYNTTDFVKISIKEVRKTFIEAIVLVVIIMYFFLQNFRATIIPVIAIPVSIIGTFAGMYALGFSINLLTLFGLILAIGIVVDDAIIVIENVERILHTETKANGEKYSVKEATLKAMGEIQGPVVAIVLVLCSVFIPVAFIGGFSGAIYKQFAITIVISVVISGFVALTLTPALCVSILKAKEPKPFYIVKRFNDFFDWLTHKFGMQIGRALRRGSALLLCFVAIIVVTWGLFSRLPSSLVPSEDKGSMISFIQLPPAASLSRTTTEGKKALAILEQNPNVDYSFLISGFDMLASAARSSGAVIFVTLKNWSERNESSFEMSKKMMGVFNASLDAFSLVTTPPAIMGLSTVGGFEIYIQDRNGGSIKDLEKYANLLVMEANKRKELVGVRSLFSANIPQYHLTLDRERAKASNVNIDDVFTTMQSTFGQYYVNDFNLYGKTYQVNVQAQSEFRESPEDLSRIFVKSGNGDLIPISALVHFERVIGPDIVDRFNLFTSAKIVGNPNESEGYSSGDALRVIEQLVKEVLPEGYTIAYSGTSYQEKNASGTGEIAFIFGLIFVFLILCAQYERWLMPLSVLSAVPFAVFGAVVATTLRGLDNDIYFNIGLVMLIALSAKNAILIVEFAQHLHEKEGKGIMESAIGAAKLRFRPIIMTSLAFSIGVLPLVLSTGAGSAARHAIGTGVIGGMMAATFIAIFFIPLFWSYIARLSQWLKNKMS

SEQ ID NO: 74328 - DNA, 3435 bp, Rhodopirellula baltica SH 1
  CDS (1)..(3435): transl_table=11
atgttcgaaaaattccttcaccggcccgcgctcgccatcgtcatctcgttgctgatcctgttcatgggcggcctcgcgatcaacgtgttgccgatttcgcaatttccatccgtcgcgccaccgagcgttcgcgtttcggtctcgtatcccggtgcaagtgccaagattctgatcgactcaacgatggtgatcttggaacaagccatcaatggtgttcccaacatgcgttacatgctcagtgacgcgaccagcgccggcgaaggaacgatccaggtcatcttcgaaccgggaactgatccggacgttgccgtgatgaacgtgaacaaccgcgttcaaatggtcaagaacaacctgccgccaatcgttgaacgcgaaggcatcatcgtgatgcagaacatgagcagcatgctgatgtatgtaaacgtgttcagcaccgacgaaaacgtcgaccagaactacctctacaactattccaccgtcaacatcctcaacgaaatcaaacgcatccccggtgtgggcttcgcatcgattttgggcaaccgctcgtacgccatgcgagtggagttggatctggaccgcatgcgggcctaccacatcgacgcagaggacgtgatggaagcacttgctgaacaaagcatgattggcacgccaggacgacttggccaggcaaccggaacgacgtcgcaaacgctcgagtacgtgctgacttgggttggacgatacacgacgccagaggaatacgatcagatcatcttgcgagcgactcccgaaggcgaaatcttacgtctagcggacgttgccaccatctcgctgggttcgtccttttatgacctgtactctgacattgacggactgcctgccgcggcaatcgtcctgaagcaaacgccaggatccaacgccgccgaagtgattgaaaaggtcaaggcaaaggtcgaagagatcaaggagaaacaattcccaccggggatggattacgcggtcacctatgacgtctccaatttcctggacgcatcgattgagaaggtgctgcacacactattcgaagccttcattttggtttcgttggttgtctacttgttcctgggcgacttccgcagcacgctgatcccaacgctcgccgttccggtgtcgttgatcggcacattcttcttcatgctgatgttcggcatgtcaatcaacctgattaccttgttcgcactggtgctcgccatcggggtcgtcgtggacgatgccatcgtggtggtagaggcggttcacgagaagatgcacgccaagcatctcggcccctatcaagcgacccgggaagtggtgcaagagatcagcggcgcgatcattgctatcaccttggtaatgaccgcggttttcattcccgtcacattcatgaccggcccggtcggcgtgttctatcgtcagttcgcgttgaccatggctatgtcgattgtcatctcgggagtcgttgcattgtcactgacgccggtgctgtgcgcgatgattctaaaaccactcgacgacaacacaccgcgtgggattatcggtctgttgaaccgcggaatgcaaaagatcgcaggcaaatatgctttcgttttgcgggctttggcgagtcttcttctcgggtttgcggttggttacggcgtctattcgctgctgcacatcgaactcgtccacgaggtcatttctgaacaggtggaactgaccaacacacgaattcaaatcattgctgttgtggtcgctttgctggccacattctcattccgcgccgcgttctccggtactgatggcaccgcgaaaaaacgaagtccaatcggattgttcctgcatgggtttgaccgcagcgttgaatcggtgaccggcgtctacgcaagattccttcgtcatatcatcagtcgccgagtggtgacgatcgcagtgatcgccgtttttggatatggaattctggttgtcaaccaagtcctgccgactggtttcatcccgctggaagaccaaggcatgatctatggaatcgtgcaaactccacccggatcgacgcttgagtacaccaattcaaaatgccatgaactgcaacaaatctgcaaacagatggacgaggtcacctccgtttcgtcaatcgccggttacgaagttctcaccgagggccgcggatccaatgcgggcacatgcatcatcaatctcaaaccgtgggccgatcgcgagctgacctcgcgagagctcatcgaagaattggaagaacgtgggacggacatcgccaatgtcaaactcgagttctttgaaccaccggccgttccagggtttggtgccgccggcggcttctccgtcaacttgctcgacaaaacgaacagcggcgactatgcaaaactcgggcaggtgaccgacgagttcatggctgcactgggcaaacgtcctgaactgaaaggtttgttcacgttcttcgctgctaactacccacagtacgaagtcatcatcgacaacgacgttgcgatgcaaaaaggtgtctcgatcaaggacgcgatggacaacttgtcgattgtcattggaagcacgtgggagcagggcttcgttcgattcggccaattctacaaagtctatgtccaagcccaaccgaagtttcgtcgctacccagaagacctcgacaacatgttcgtcaagaacgaaggcggggaaatggtgccgtactcggctttcatgcgaatcgaaaagaagcagggactgaacgagatcagccgatacaacctctatccaaccgcacccattcagggagccccagccgcgggctacagcagtggcgaagcgatcgcggctatcaaacaggtcgctgcggaaacgctgccaaacggtttcgacatcgactggcagggtttgtcatacgacgaagccaaatcgggaaacacggcggtctacatcttcttgatcgtggtgatcttcgtttacatggttttggttggccaatatgagagctttatcattcctttggccgtgttgacatcactacccgtcggcatcttcggatcattcgcgttcctacaatccatgggtttggccaacgatgtgtactgtcaaatcggtttagtgatgttggttggcttgttgggtaagaacgccattttgatcatcgaattcgccgttcaacgtcgccaggaaggactgagcatcatggaagcgggcatcgagggaggcaaacttcgattccggcccatcctgatgacatcatttgcgttcatcgccggtctgattccgttggtccgcgccaccggccctggtgcgatcggaaaccgcaccatcggaaccactgctgtcggtggcatgttgctcggcaccctcgtcggcgtcctggtgatcccaggcctatattacctgttcgccaaaatagcggatggtcgttctctgattcgagatgaacatgacgcgccactcagcgagatcttcgagcgtgagcactga

SEQ ID NO: 74329 - protein, 1144 aa, Rhodopirellula baltica SH 1
MFEKFLHRPALAIVISLLILFMGGLAINVLPISQFPSVAPPSVRVSVSYPGASAKILIDSTMVILEQAINGVPNMRYMLSDATSAGEGTIQVIFEPGTDPDVAVMNVNNRVQMVKNNLPPIVEREGIIVMQNMSSMLMYVNVFSTDENVDQNYLYNYSTVNILNEIKRIPGVGFASILGNRSYAMRVELDLDRMRAYHIDAEDVMEALAEQSMIGTPGRLGQATGTTSQTLEYVLTWVGRYTTPEEYDQIILRATPEGEILRLADVATISLGSSFYDLYSDIDGLPAAAIVLKQTPGSNAAEVIEKVKAKVEEIKEKQFPPGMDYAVTYDVSNFLDASIEKVLHTLFEAFILVSLVVYLFLGDFRSTLIPTLAVPVSLIGTFFFMLMFGMSINLITLFALVLAIGVVVDDAIVVVEAVHEKMHAKHLGPYQATREVVQEISGAIIAITLVMTAVFIPVTFMTGPVGVFYRQFALTMAMSIVISGVVALSLTPVLCAMILKPLDDNTPRGIIGLLNRGMQKIAGKYAFVLRALASLLLGFAVGYGVYSLLHIELVHEVISEQVELTNTRIQIIAVVVALLATFSFRAAFSGTDGTAKKRSPIGLFLHGFDRSVESVTGVYARFLRHIISRRVVTIAVIAVFGYGILVVNQVLPTGFIPLEDQGMIYGIVQTPPGSTLEYTNSKCHELQQICKQMDEVTSVSSIAGYEVLTEGRGSNAGTCIINLKPWADRELTSRELIEELEERGTDIANVKLEFFEPPAVPGFGAAGGFSVNLLDKTNSGDYAKLGQVTDEFMAALGKRPELKGLFTFFAANYPQYEVIIDNDVAMQKGVSIKDAMDNLSIVIGSTWEQGFVRFGQFYKVYVQAQPKFRRYPEDLDNMFVKNEGGEMVPYSAFMRIEKKQGLNEISRYNLYPTAPIQGAPAAGYSSGEAIAAIKQVAAETLPNGFDIDWQGLSYDEAKSGNTAVYIFLIVVIFVYMVLVGQYESFIIPLAVLTSLPVGIFGSFAFLQSMGLANDVYCQIGLVMLVGLLGKNAILIIEFAVQRRQEGLSIMEAGIEGGKLRFRPILMTSFAFIAGLIPLVRATGPGAIGNRTIGTTAVGGMLLGTLVGVLVIPGLYYLFAKIADGRSLIRDEHDAPLSEIFEREH

SEQ ID NO: 74330 - DNA, 3114 bp, Rhodopirellula baltica SH 1
  CDS (1)..(3114): transl_table=11
atgtcaaagtttttcatctaccgcccgatctttgccacggtgatctccatcgtgattgtgatcgccggtgcggtctcgttctttggacttccgatcgagaagttcccaccgatcacgccgcccacggtccaagtgacggcggtctatcccggcgcgaatgctcgaacggtcgctgaaaccgttgccgctccgattgaacaagcggtcaatggcgtcgaaggcatgatttacatgtcatcgacaagcactaacgaaggtctgtacaccctgacggttacgttcgagttgggaatggatttggacatcgcttcggtcttggtccagaacctagtcggcagtgcggaagccagcttgcctcaagaggttcggcaacaaggcatcacgaccaagaagcgttccacacaaacacttcaattcatcgcgctgacatcacccggtggagctcacgatggattgttcctgagcaacttctcgctcgatgttcgagacgagatcagtcgcatcaaaggcgtcggcgacgttcagtcatttggcgatggtgactacagcatgcgagtctggttggacccgcgtttgttgaaacagcgtggactgacaaccgaagatgtggtctcggtgatctccgaacaaaacgttcaagtcgcggcgggacaaattggggctccgcctgctgaatccggcaccgcgttccaattttcagtcaacacgcaaggtcgcttttcaagcgtcgaacaattccaagacatcatcgtccgcaccggtgacaacggcgaagtgctgcgtctgggcgatctcgctcgcattgagcttggggccgaggcctacacctattccagttctttcactggcgacgccgccgcgacgctcgcgatctaccagttgccgggcgccaacgctctggaaaccgcagaggcgatccggatcaagatggacgaactgtcttcggcggcaaactggccggatgacgtggaataccaagtcgcatacgacgcgactgaattcgtcaccgcctccatcaccgaagtctacaagacattggcgatggcaatcgcgttggttgtgttcgtcatctttgtcttcctgcaagattggcgagcgacggtggttcccgtcgcggcgattccggtctctttgatcggcaccttcgccatcatggcaggcatcgggttctcgctgaacatgttatccctgttcggcattgtgctcgccattggcatcgtggtcgacgacgccatcgtggtcgttgaaaacgtatcacgacacatcgccgatgggctgtccagccgagacgccgcagtcaaagccatgtccgagatcaccgggccagtgatcgccacaacactcgtgttgctagccgtctttgttccgtgtgcattcatgcccggcatcaccggtgaattgttccgccagtttgcattgacgatctcagcatcggtgatcatcagcacgatcaacgcactgacgctcagtcccgccctttgcgcgattttccttcggccaccaaccgagactaagttcatcggatttcgactgttcaaccaagcctttgaacgaaccacggccatctatggtgccacggtggccagactggttcgcttgacattggttgtgtcggttgcatccatcgccttggtgatggcgacgggctggatcctcacacagttgcccactggatttgttccagacgaggaccaaggtgtgttgttcgtcaacgttcagttgcctgacgcagccagcaaagaacgcaccgatgaagtgatcaaagacttagaccagatcttcgaacaaaccccaggagtccatggctggttgtccgtgaccggctactcgttgctcggtgggagtggtggtcccaacgtcggattctcggttctggtgttgaaaccatgggaagaccgggatgccaaaaccgaaagcgtcactgcgatccagcaatacattcagcaaaaattcgcgtccgaacaacgcgccatcctgttcacgtttgctccacctccgatcgatggtttggggacggccggcggatttcaaatggaagtccaagaccgcggcagcaatggctaccttccgttgcaaaacgcgacggaagaactcgtcgccaacgcatccacccaatccagtttggcagctctgaacagttccttccgagccaccgtccctcaactctacgtggatgttgaccgagaaaaagcgaagacgatggacattccgctgagcagcgtgttcgcgaccttgcaagcatcgctgggttcgtcctacatcaacgacttcactcttaataatcgttcgtatcaagtccgagcgcaggccgaagcaccgtttcgacgatccgcttcggacatcacgcagctcgatgtacgtgacagcaatggcaacatgatcccactcggatcgatcgtgacggtgcgagatgattttgggcctgacgtggtacgtcgatacaacatgtacccgagcgccgccgtcaatggttccgcagcacccggcgtcagctccggaaccgcactggagctgatggaacaaacggctgatcaaaccctacccgcttcattctcttacgaatggacggggatgtcattccaagaaaaacaagcctccggtggtcagtacttgatcttcggcctggcaattttgttcgtcttcttggttcttgccgcacagtacgaaagctggaccagccccgccgcggtcatcgcagtcgtgcctctggccgctctcggtgttgccttgtcgctgatgcttcgaggaagcgataacaacacctacactcaaattggaattgtgttgctggtcgctctggccagcaagaacgcaattctgattgtggagtttgccagcgaacaacgtgctgaggggaaatccccccgcgatgcagcgaccacggcagccaagcttcgattccgagccatcctgatgacggcgttttcgtcgatccttggtttcttaccgctcctggttgcgaccggtgccggtgctgccagtcgccaagcggttggaaccgcggttgtcggcggcatgatcgccgccaccgtcttcgcgctgctactcgtccccacgttctttgtcgtcttccgaacgctgtccgaacgaatggcacccaagtccgacaattga

SEQ ID NO: 74331 - protein, 1037 aa, Rhodopirellula baltica SH 1
MSKFFIYRPIFATVISIVIVIAGAVSFFGLPIEKFPPITPPTVQVTAVYPGANARTVAETVAAPIEQAVNGVEGMIYMSSTSTNEGLYTLTVTFELGMDLDIASVLVQNLVGSAEASLPQEVRQQGITTKKRSTQTLQFIALTSPGGAHDGLFLSNFSLDVRDEISRIKGVGDVQSFGDGDYSMRVWLDPRLLKQRGLTTEDVVSVISEQNVQVAAGQIGAPPAESGTAFQFSVNTQGRFSSVEQFQDIIVRTGDNGEVLRLGDLARIELGAEAYTYSSSFTGDAAATLAIYQLPGANALETAEAIRIKMDELSSAANWPDDVEYQVAYDATEFVTASITEVYKTLAMAIALVVFVIFVFLQDWRATVVPVAAIPVSLIGTFAIMAGIGFSLNMLSLFGIVLAIGIVVDDAIVVVENVSRHIADGLSSRDAAVKAMSEITGPVIATTLVLLAVFVPCAFMPGITGELFRQFALTISASVIISTINALTLSPALCAIFLRPPTETKFIGFRLFNQAFERTTAIYGATVARLVRLTLVVSVASIALVMATGWILTQLPTGFVPDEDQGVLFVNVQLPDAASKERTDEVIKDLDQIFEQTPGVHGWLSVTGYSLLGGSGGPNVGFSVLVLKPWEDRDAKTESVTAIQQYIQQKFASEQRAILFTFAPPPIDGLGTAGGFQMEVQDRGSNGYLPLQNATEELVANASTQSSLAALNSSFRATVPQLYVDVDREKAKTMDIPLSSVFATLQASLGSSYINDFTLNNRSYQVRAQAEAPFRRSASDITQLDVRDSNGNMIPLGSIVTVRDDFGPDVVRRYNMYPSAAVNGSAAPGVSSGTALELMEQTADQTLPASFSYEWTGMSFQEKQASGGQYLIFGLAILFVFLVLAAQYESWTSPAAVIAVVPLAALGVALSLMLRGSDNNTYTQIGIVLLVALASKNAILIVEFASEQRAEGKSPRDAATTAAKLRFRAILMTAFSSILGFLPLLVATGAGAASRQAVGTAVVGGMIAATVFALLLVPTFFVVFRTLSERMAPKSDN

SEQ ID NO: 74332 - DNA, 3219 bp, Rhodopirellula baltica SH 1
  CDS (1)..(3219): transl_table=11
atggatctcacccccaccgaccgccgttccagttgcggatcgcatgacggaggtgaaacgatgaagtttcctcacttcttcattgaacgcccgatcttcgcatcggtgctgtcatttgtgatcgtgctagtgggcggcatcgtgtatttcacgctgccggtttcccaataccccagcgtggcaccgccgaccgttttggttcgggccagctatcccggtgcaacgccggaagtcattgctgacaccgtggcgacacccatcgaacaagagatgaacggtgtcgatgacatgttgtacatggaatcgtcgtccagctcggacggcaccatgcaactgaccgtgacgttcaagctgggcactgacttggacgacgctcaggtgttggtccaaaaccgtgttgcgatcgctgaatcgcgtttgccagaacaagtccgccaaatcggtgtgacgacgaccaagcaaatccccgacatgttgatggtggttcacctgaactcgcccgacgacagccgcgatcaactctacatcagcaactacgcgttccttcgtgttcgcgatgcactgatgcgtttggatggcgtgggtgaaatccgcatcgctggcggcaacgaatacgccatgcggatttggttggacatcgaaaagatgacacacgtcgatttgaccgcgggcgaagtcgtggatgcgattcaagctcaaaacattcaagtcgccgcgggtgtgatcgggcaaccaccgacggatgagacgggtgactttcagttgaacgtcaccacccaaggtcgtttgattcgcgaagacgaatttggcgacatcatcgtcaaacgtggtgaagacggacgaatcacgcgactccgcgacgtggcccggattgaactgggtgcacaggattactcccgtttgagttacctcgatggcaagtccgcaatcgcggtgttggtttaccaacgccccggcacaaacgcggttgacaccgcggccgaagtcaaacgtgtcatgagcgagatgagcgaagaattcccccaaggaattggctacgagatcgcttacaacccaactgattatgtcgaagactcgatcgcggaagtgttcgagacactcttcatcacgaccatcttcgtggtgctgaccgtgttcctcttcttgcacggttggcgtccgacgatcattcccgtgatcgccattccgatttcattgatcggcacattcgcggtgatgcagttcctcggagtgacgctgaatacgctttcactgtttggattggtgttggcgatcggaatcgtggttgatgacgcgattgtggtggttgagaacgtcgaacgtttgatcgccgaaggcatgaccgctcgggaagccacacacaaagcgatggacgaggtgggatccgctttgatagcgacaacactcgttctgattgccgtgttcgtgccgaccgtgtttgtccccggaatcagcggtcagttttatcaacaatttgcgttgaccatttcgatctccaccgcgatttcgaccttcgtctcgctgaccctcagcccggcgttgtgtgcgttgttgctgcgtcctaagaacgctccgaagaaccgcactggcaaagcgatcgacttcctgttcggctggttctttcgactgttcaatcgaacgttcgatgccaccagcaacatttatgcttcgatcattggacgtctgatcaagaagactggattcgcgatggtgctgtatgtcggcttgctgattctcaccgggttcagcttcagcatggtgcccaccgggttcatccccgatcaagaccaaggttacgtcattgtcgcaatcaacttgcccgacggtgcgtccctggcacggaccgaccgcgtgactcggcgcgtcgcggagatcggaaaagaaatcgacggtgtcgcccacgcggttggaatcgcgggactttcgggagcaacgttctcaatcaaacccaacgccgcggtgacgtttttgccgctggaagatgccaaggaacgagccaaacgaggtcgcggtgttgatgcgatcgtcgcggacatgcgtcgggaggttgccgcgatcaacgaagcccaaattttgatcattccaccgccgccaattcgcgggatcgggcgtgggggtggtttcaagatgtatgtccaggaccgcagcggtgcgggtttggacgcgatgaacgaagtcactcagacgatgctcgcgaaagccaatcagcaacccggcgtcacgcaagtgttttccaacctgcggatggatgtgcctcaggtctatgcggacgtggatcgaaccaaagctcagatgctggacgttccggtcaatcgagtcttcgaggctttgcaggtctatctgggatcggtgtacatcaacgacttcaacttcctcggacgcacttatcgtgtgacggctcaagccgaaccaaaattccgcgacgaggcgaccgatatcacaaagatccgaacccgcagtgaccgaggtgcctcgatcgcattgggatcggtcgtcaacatcacacaaaccgccggtccggaccgtttggtgcgattcaacctgttccccgcggctgatttgaatggaacaaccgttcctggattcagcaccggccagtcccttgcgacgatggagcaactggccgaccaaaacttgccgcccggttttggttacgaatggaccgaaatcgcgttccaagaacgccaagccgggaacacgattgtgttcctattcccactcgcggttctgtttgtgttcttggcactttccgctcagtacgagagctggttgctgccgttggcaatcatcttgattgtgccgctgtgcttgctgttcgcgctctcgggcgtatggttccgcgggatggacaacaatgttttgacgcagatcgggttcattgtcttgattggactggcatgcaaaaacgcgatcttgattgtcgaatttgcgaaggcagaagaagacgcgggcaaaaaccgcttcgacgccgccatcgcagcatgccgtttgcgtttgcgtccgattttgatgaccgcgttctcattcatcctcggcgtggtgccattgttggtcgccacgggtgccggtttcgaaatgcgacgtgtattgggaaccgcagtgttcgccggaatgctgggagtgaccgtgttcggcttgttcctgacgccagtgttctacgtgatgctgcgacggttcgcgaaaaagaaggaaccggaaacaacagtggacgctgtttga

SEQ ID NO: 74333 - protein, 1072 aa, Rhodopirellula baltica SH 1
MDLTPTDRRSSCGSHDGGETMKFPHFFIERPIFASVLSFVIVLVGGIVYFTLPVSQYPSVAPPTVLVRASYPGATPEVIADTVATPIEQEMNGVDDMLYMESSSSSDGTMQLTVTFKLGTDLDDAQVLVQNRVAIAESRLPEQVRQIGVTTTKQIPDMLMVVHLNSPDDSRDQLYISNYAFLRVRDALMRLDGVGEIRIAGGNEYAMRIWLDIEKMTHVDLTAGEVVDAIQAQNIQVAAGVIGQPPTDETGDFQLNVTTQGRLIREDEFGDIIVKRGEDGRITRLRDVARIELGAQDYSRLSYLDGKSAIAVLVYQRPGTNAVDTAAEVKRVMSEMSEEFPQGIGYEIAYNPTDYVEDSIAEVFETLFITTIFVVLTVFLFLHGWRPTIIPVIAIPISLIGTFAVMQFLGVTLNTLSLFGLVLAIGIVVDDAIVVVENVERLIAEGMTAREATHKAMDEVGSALIATTLVLIAVFVPTVFVPGISGQFYQQFALTISISTAISTFVSLTLSPALCALLLRPKNAPKNRTGKAIDFLFGWFFRLFNRTFDATSNIYASIIGRLIKKTGFAMVLYVGLLILTGFSFSMVPTGFIPDQDQGYVIVAINLPDGASLARTDRVTRRVAEIGKEIDGVAHAVGIAGLSGATFSIKPNAAVTFLPLEDAKERAKRGRGVDAIVADMRREVAAINEAQILIIPPPPIRGIGRGGGFKMYVQDRSGAGLDAMNEVTQTMLAKANQQPGVTQVFSNLRMDVPQVYADVDRTKAQMLDVPVNRVFEALQVYLGSVYINDFNFLGRTYRVTAQAEPKFRDEATDITKIRTRSDRGASIALGSVVNITQTAGPDRLVRFNLFPAADLNGTTVPGFSTGQSLATMEQLADQNLPPGFGYEWTEIAFQERQAGNTIVFLFPLAVLFVFLALSAQYESWLLPLAIILIVPLCLLFALSGVWFRGMDNNVLTQIGFIVLIGLACKNAILIVEFAKAEEDAGKNRFDAAIAACRLRLRPILMTAFSFILGVVPLLVATGAGFEMRRVLGTAVFAGMLGVTVFGLFLTPVFYVMLRRFAKKKEPETTVDAV

SEQ ID NO: 74334 - DNA, 3111 bp, Haemophilus ducreyi 35000HP
  CDS (1)..(3111): transl_table=11
atgttcacagatatttttattaagcgcccagtattagcgattagtattagtatcgtatttattattttagggctacaagcaatgtttaaattgcaagtacgtgaatatcctgaaatgacaaatacgatcattacggtcacaacaaattatgcgggtgctgacgctgaaacaatgcaagctttcattacttcaaaattagaagaatcgattgcacaagccgataatattgattacatcaaatctgactcggcaccaagcacgagtaatattactattaagatgaaactgaatactaatccaggtatcgcagtagctgatattacttcaaaagtaaacgccgtacgttcacaacttccttccaatattgatgatccatctattcgttcttccactggcgctatggaagcgattgtttttattcgattttcttcaaaagaattatcagcaccacagttaacggattacattgagcgcgtggtgaaaccgcaaatgtttaccgtcaatggcgtatctaaaattaactactttggtggcgcatcttttggattacgtatttggcttgatccggctaaaatagctggcttaggattgtctgctaatgaagtgacagcggcattagcggcaaataatgtgcaaacggctgccggtaattcaaatggttattacactgaataccgtaataaagtagaaacaacgactaaaagcgttgaagaacttgcaagtttagtgattaaaacattgccaaatggttcaaatattaaactaggcgatattgcagaaattagcttagagaaagcgcgtgatgattctcgtggtattgtaaatgggcgagaagcggtcgtattagcggtagaagctgccagtaccgcaaacgccttagatgttgctaaacatatttatccaaaatttgcagaaattcagtcaaatttacccgcttcagtggaagctgaagttatttatgataaaactattgcgattaatagctcaattaaagaagtcgttaaaactattttagaagcagtgataatcgtattagttgtgatagtgttattccttggctcattcagagcaatgattatcccgattgtgactattccgatctccttgattggtgtgttaatggtattacaaggttttggatttaccattaacttgctgaccttacttggactaattttagcgattggattggtagtagatgatgcgattgtagtattagaaaatgttgaacggcatatcaaacaaaacggagaaacaccattcagagcagccattattggtacgcgcgaaattgcaacaccagttattgcaatgaccatcaccttgatggcagtttattcgcctatggcgttaatgagcggtattaccggatctttatttaaagaattttccttaacacttgctggagcggtgtttatttcaggcgtagctgccctaacactttctcctatgatgacaagtaaaattctcaaacaatcagaaaaaccaagctggttagaacaacgtatagaaaaaaccttacataaagtaacggatatctataccaaaatattattggttgttatggcaagccgttatgccatattagtgtttgctggattaatttttgcatctttgccgatgttatttaattcactttctagtgaagtagcccctgccgaagaccgtggtattgtaatgggaatggcaagtggccctgccaacgttaatatggactatatgcaagacgtgatgtttcctgttgctcaacaaattaatcaactgccagaagtaaatgccacacaaattatgcccggttttccttcttctaatggctcatttatgttagtgccgttaaaagattggagtgagcgtactcgttcacagaaagaagtgttggcggaggtgaataaaattactaatgaagttaccgaagcttcagttattggttttgagtttccagaaatttcaacaggtgaaagtggtttaccattctcctttgttatcactaccgcaaatgattaccgcgatttagcacaagtggcaagtgacttcttattagcagcacaaagctcaggacagtttttctttaatcaactagacttaaaatttgataccgcatcaatggccattaagattgatcgcgaaaaaatgggaacttacggggttacagccgcagatatccgctccgttttgggcagtttcttatcaggtgcaacattagcacgtgtcgatattgatggaagagcttatgatattatttcacaagttaaacgttcagaacgtctaagcccacaagaccttgcgaaatattatgttaaattaaaagatggatcttctgtgccattaagtacttttgtcagtatggagttaaaaacacaaccacgcacattacctaaactaaatcagttaaattctgcgactattacaggcgtattagccggttcaatgggtaatgcggttaaatgggcagaagcaaaagctgccgaaattttacccgctggctattactatgattttatgagcgaatcacgccaatataaacaagaaggcaatgcattagcgttaacattcttattagccatagtaatgatctatctcgtgttggcggtccaatttgaatcatggcgtgatccaatggttattttagtttccgtaccactagcaattagcggagcattagtggtgttaaatattctagcactaccgatgattggtaaggcaggtgcaaccttaaatatttactcacaagtaggcttaatcaccttagttggcttgatcaccaaacacggtattttaatgtgcgaagttgcgaaagaagaacagcttcatcacggcaaaaataaatttgatgccataacttatgccgcgcaaattcgcttacgcccaattttaatgaccacagccgcaatgattgccggtttaataccgctactatatgcaaccggtgcgggggcagtaatgcgctttagtattggtattgtgattgtagccggattagcgatcggtactttatttactttatttgtattgccggttatttacaccttcttaggtgaaaatcataaaccgctacaagagtttgaagaaaataagcattatccagtgattgctgagactgagcattcataa

SEQ ID NO: 74335 - protein, 1036 aa, Haemophilus ducreyi 35000HP
MFTDIFIKRPVLAISISIVFIILGLQAMFKLQVREYPEMTNTIITVTTNYAGADAETMQAFITSKLEESIAQADNIDYIKSDSAPSTSNITIKMKLNTNPGIAVADITSKVNAVRSQLPSNIDDPSIRSSTGAMEAIVFIRFSSKELSAPQLTDYIERVVKPQMFTVNGVSKINYFGGASFGLRIWLDPAKIAGLGLSANEVTAALAANNVQTAAGNSNGYYTEYRNKVETTTKSVEELASLVIKTLPNGSNIKLGDIAEISLEKARDDSRGIVNGREAVVLAVEAASTANALDVAKHIYPKFAEIQSNLPASVEAEVIYDKTIAINSSIKEVVKTILEAVIIVLVVIVLFLGSFRAMIIPIVTIPISLIGVLMVLQGFGFTINLLTLLGLILAIGLVVDDAIVVLENVERHIKQNGETPFRAAIIGTREIATPVIAMTITLMAVYSPMALMSGITGSLFKEFSLTLAGAVFISGVAALTLSPMMTSKILKQSEKPSWLEQRIEKTLHKVTDIYTKILLVVMASRYAILVFAGLIFASLPMLFNSLSSEVAPAEDRGIVMGMASGPANVNMDYMQDVMFPVAQQINQLPEVNATQIMPGFPSSNGSFMLVPLKDWSERTRSQKEVLAEVNKITNEVTEASVIGFEFPEISTGESGLPFSFVITTANDYRDLAQVASDFLLAAQSSGQFFFNQLDLKFDTASMAIKIDREKMGTYGVTAADIRSVLGSFLSGATLARVDIDGRAYDIISQVKRSERLSPQDLAKYYVKLKDGSSVPLSTFVSMELKTQPRTLPKLNQLNSATITGVLAGSMGNAVKWAEAKAAEILPAGYYYDFMSESRQYKQEGNALALTFLLAIVMIYLVLAVQFESWRDPMVILVSVPLAISGALVVLNILALPMIGKAGATLNIYSQVGLITLVGLITKHGILMCEVAKEEQLHHGKNKFDAITYAAQIRLRPILMTTAAMIAGLIPLLYATGAGAVMRFSIGIVIVAGLAIGTLFTLFVLPVIYTFLGENHKPLQEFEENKHYPVIAETEHS

SEQ ID NO: 74336 - DNA, 3231 bp, Bordetella pertussis Tohama I
  CDS (1)..(3231): transl_table=11
atgccgcaattttttattgatagaccgatttttgcctgggtagtcgcactgttcatcctgctgacagggatattggccattcccaatatgcccgtgtcgcagtatccggacgtggccccgcctgccatcacgatcaccgcgacctacccgggcgcttccgccaaggaagtggccgagtcggtcaccagtatcatcgaggaccagctcaacggcgccaagggcctgctgtactacgaatcggtcagcgactcgtacggccagtcgcagatcaccgcgacgttcgctccgggcaccgatcccgacctggcccaggtggacgtgcagaaccgcgtgtccaacgtgacggcgcagctgcccgtggcggtgatgcagcagggcctgcagtacgagcagaccagcgccggcttcctgatgatcgtgacgctgtcgtccaccgacggcacgctcgaccagacggcgctggccgactacatcacccgcaacgtcaagaacccggtgtcgcgcgtgcccggcgtgggccagttccagctgttcgccgcgccgcgcgccatgcgcatctgggtcgacccggacaagctggtgggcttcaacctcagcatggccgaggtcaaccaggccatcagccagcagaacgtgctgatttcggccggcagcatcggcgcgccgcccaatccggacagccagcgcgccacggccaccgtgatcgtcaatggccagttgagcacgatcgaaggcttcggccagatcgtgctgcgcgctaacaccgatggctcgaaggtgttgctgcgcgacgtggcccgcatcgaggtgggcgcggacaactaccagttcggcgcgcgcctgaacggcaagcccacggcggcgttcgccatcgtgctctcgcccgacgccaacgcgctggccaccgccgagggcgtgcgccagcagatggcctcgctgtcgcagtacttcccgtccaacatccgctacgacatcccgtacgacaccgcgccctacgtgaaggtgtcgatcgagcaggtgatccacaccctggtcgaagccatggtgctggtgttcctggtgatgttcctgttcctgcagaacgtgcgctataccctgatcccggccctggtggtgccggtggccatgctgggcgcgttcgtggtgatgctggcgctgggcttctcgatcaacgtgctgaccatgttcgccatggtgcttgccatcgggatcctggtcgacgacgccatcgtggtggtcgagaacgtggagcggatcatggccagcgagggcctgtcgccgaaggaggccaccaagaaggccatgccgcagatcagcggcgccatcgtcggcatcacgctggtgctggtcacggtgttcctgccgctggccttcatgaccggctcggtcggcgtgatctatcgccagttctcggtcgcgatggcggtgtcgatcttcttctcggcattcctcgcgctcagcttcacgccggcgctgtgcgcgacgatcctcaagcccatccccaagggccatcaccaggaaaagaaaggcttcttcggctggttcaaccgcaagttcgacgccaccacgcacaactaccagaactgggtctcgcgcatcctgcacaagggcgggcgcatgatgctggcgttcgcgctgctggtggtgctgctgggctggctgtacatgcgcctgccgtcgtcgttcctgcccgaggaagaccagggctacgtggtcagcaacatcgaactgcccaccggcgccagcgccaaccgcaccatcgaggtgatcgaggaagtcgagaattacttccgcaacatccccgcggtggagaacgtcatcacggtgcagggctacagcttcaacggcaacggcctgaacgcggccatcgcgttcaccacgctcaaggatttctccgagcgcaagagccgcgccgactcggccggcgcgattgccttcacggctttttccaagcagctgatgggcattcacgacgcgcaggtgttcaccctggtgccgccggcgatttcgtcgctgggcaacgcttcgggcttcgacttccgcctgcaggaccgcggcggcgccggcaccgaggcgctgggcgcggccaccgccgagctgatgggcatggcggccaagagcccggtgctgtcgcaggtgcgcattaccgggctgggaccgggttcgcagctgagcctgacgatcgaccgcgacaaggcggcggcgctgggggtcaacttcgacgaggcggccaccctgatctccaccgcggtgggctcggccttcctgaacaagttccccaacatgggccggatgcagaacatctgggtgcaggccgaccagcagtaccgcatgcaggtcgaagacctgctcaagctgaacgcccgtaacaaccagggcggcatggtgccgctgtcgaccttcgtgtcggccaagtgggtgcaagggccggtccaggtggtgcgctacaacagctacgagtcggtgcgtatcggcggcgacgcggcggcgggctacaccaccggcgaagccatgcaggaaatgcaggacctggtggcccgcttgccgcagggcttcggctacgaatggaacggcctgtcctaccaggagcggctggccggcaaccaggcgcccatcctgatggggctggcgctgctggtcgtgttcctggtgctggccgccctgtatgagagctgggccatcccgctgtcggtgatgctggtcgtgccgctgggcatgctgggcgccgtcgcgctggtgacggtgctgggcatgtccaacgacgtgtacttccaggtgggcatggtgacggtgatcgggctggcggccaagaacgccatcctgatcgtggagttcgccaaggaccagtacgcgcgcgggcagggcctgtacgagtcggcggtggaggcggcgcgcctgcgtttccgccccatcctgatgacgtcgctggcgttcatcctgggcgtggtgccgctggccatcgccaccggcgccggcgccgccagccagcgcgccgtcggtatcggcgtgctgggcgggatgctggcggccaccccgttcgcggtgattttcgtgccgaccttcttcgtggtggtgctgggcctgttcaagacccggccgcgcctgctgggcgccgaactgcgcgccttcgaggaagagcaggcggccaagcgcgccgccgagcaacagcagccgcaggacggcgccgcgacgccggcgccgcagaccggcggtcaggagaacaaggaatga

SEQ ID NO: 74337 - protein, 1076 aa, Bordetella pertussis Tohama I
MPQFFIDRPIFAWVVALFILLTGILAIPNMPVSQYPDVAPPAITITATYPGASAKEVAESVTSIIEDQLNGAKGLLYYESVSDSYGQSQITATFAPGTDPDLAQVDVQNRVSNVTAQLPVAVMQQGLQYEQTSAGFLMIVTLSSTDGTLDQTALADYITRNVKNPVSRVPGVGQFQLFAAPRAMRIWVDPDKLVGFNLSMAEVNQAISQQNVLISAGSIGAPPNPDSQRATATVIVNGQLSTIEGFGQIVLRANTDGSKVLLRDVARIEVGADNYQFGARLNGKPTAAFAIVLSPDANALATAEGVRQQMASLSQYFPSNIRYDIPYDTAPYVKVSIEQVIHTLVEAMVLVFLVMFLFLQNVRYTLIPALVVPVAMLGAFVVMLALGFSINVLTMFAMVLAIGILVDDAIVVVENVERIMASEGLSPKEATKKAMPQISGAIVGITLVLVTVFLPLAFMTGSVGVIYRQFSVAMAVSIFFSAFLALSFTPALCATILKPIPKGHHQEKKGFFGWFNRKFDATTHNYQNWVSRILHKGGRMMLAFALLVVLLGWLYMRLPSSFLPEEDQGYVVSNIELPTGASANRTIEVIEEVENYFRNIPAVENVITVQGYSFNGNGLNAAIAFTTLKDFSERKSRADSAGAIAFTAFSKQLMGIHDAQVFTLVPPAISSLGNASGFDFRLQDRGGAGTEALGAATAELMGMAAKSPVLSQVRITGLGPGSQLSLTIDRDKAAALGVNFDEAATLISTAVGSAFLNKFPNMGRMQNIWVQADQQYRMQVEDLLKLNARNNQGGMVPLSTFVSAKWVQGPVQVVRYNSYESVRIGGDAAAGYTTGEAMQEMQDLVARLPQGFGYEWNGLSYQERLAGNQAPILMGLALLVVFLVLAALYESWAIPLSVMLVVPLGMLGAVALVTVLGMSNDVYFQVGMVTVIGLAAKNAILIVEFAKDQYARGQGLYESAVEAARLRFRPILMTSLAFILGVVPLAIATGAGAASQRAVGIGVLGGMLAATPFAVIFVPTFFVVVLGLFKTRPRLLGAELRAFEEEQAAKRAAEQQQPQDGAATPAPQTGGQENKE

SEQ ID NO: 74338 - DNA, 3180 bp, Bordetella bronchiseptica RB50
  CDS (1)..(3180)
atggcaaagtttttcatcgacaggccggtgttcgcctgggtgatcgcgattgtgctgatgatggccggcgcgctctccatcctgagcctgccggtcgcgcaatatccgaacatcgcgccgcccgccatcagcatcaacgtgacctatcctggcgcctcggcccagaccgtgcaggacacggtggtgcaggtcatcgagcagcagatgaacggcatcgacaacctgcagtacatctcgtcggaaagcaattccgacggcagcatgtcgatcacgctcacgttctcgcagggcaccaacccggatacggcgcaggtgcaggtgcagaacaagctggcggtggcccagccgctgctgccgctggaagtgcagcagcagggcatccgcgtcaccaaggccaccaagaacttcctgatcgtcgccggcttcgtgtccaccgacggcaccatggacaagtccgacctggccgactacgtggcctcgtacatccaggacccgatcagccgcacgcccggcgtgggcgacttccagctgttcggcgcgccatacgccatgcgcatatggatcagccccgagaaactggtcaatttcggcctgaccgcctccgacgtcaccaccgcgatccgcgagcagaacgtgcaggtctcgtccgggcagctgggcggccagccggcggtgcgcggccagcagctcaacgccacggtgatcggaccgtcgcggctgcagaccccggaagccttcggccgcatcctgctcaaggtcaatagcgacggctcgcaggtgcgcctgaaggacgtggccagcatcgagctgggcgcgcagacgtacgccatcgacagctattacaacggcaagcccgcctcgggcctggccatcaagctggccagcggcgccaacgcgctcgataccgcccaggcggtgcgcgagaccatcaacggcctcaagccgtacttcccgccgggcatggacgtggtgtatccgtacgacaccacgccgttcgtcagcctgtcgatcgagggcgtggtcaagacgctgttcgaagcggtgctgctggtcttcctggtgatgtacctgttcctgcagaacgtgcgcgccacgctcatccccacgctggccgtgccggtggtgctgctgggcacgttcggggtgctggcggcgttcggctattcgatcaacacgctgaccatgttcggcatggtgctggccatcggcctgctggtcgacgacgccatcgtggtggtcgagaacgtcgagcgcgtgatggccgaggaggggctgtcgcccaggcaggccacccgcaagtcgatgagccagatcaccggcgcgctgatcggtatcgccatggtgctggcggcggtgttcgtgcccatggcgttcttcggcggttccaccggggtgatctatcgccagttctccatcaccattgtttcgtccatggtgctgtcggtggtggtggccattgtcttcacgccggcgctgtgcgccaccatgctcaaacccatcccgaagggccaccatggctccaagaagggctttttcggctggttcaaccgcaccttcgagcgttccagccaggcctatgccaacaacgtggctcgcagcatggggcgcaccaagcgcctgttgctgatctacgtggtgatcctgctgggcatggcttggatgttcatgcgcattcccaccgcgttcctgccggacgaagaccagggcatcctgttcgcccaggtgcaggcgccggccggcgccaccagcgagcgcacccaggccaccatcgacgcggcggtcaagtacctgctggaagacgagaaggagtcggtggcctcggtgttcgcggtcaacggctttagcttcggcggccgcgggcagaacgccgccatcctgttcatcaagctgcgcgactggaacgaacgcaagggcgccgagcaccgcgccgccgcggtggccgcgcgcgccaatgccaagttccgcgccgagttgcgcgacgcgcaggcggccgtgttcgcgccgcccgcggtgatggagctgggcaacgccaccggcttcgacttccagctgcaggaccgcgccggcgtcggccacgagaagctgctggcggcgcgcaaccagctgctgcaagaggccggcacaagtcccatgctggtggccgtgcgccccaacggcatcgaggacgcgccgcagtaccagctggacatcgaccgcgagaaggcgcgcgcgctcggcgtgtcgatcaccgagatcaacaacacgctggccaccgcctggggctcgtcctacgtcaatgatttcatcgaccgcggccgggtcaagaaggtgttcgtgcagggcgaggcatcgtcgcgcatgctgccgcaggacctggacaaatggtacgtgcgcaacaacgcgggcgacatggtgccgttctcggccttctcgtcggcgcaatggaccttcgggccgcagaagctgaaccgctacaacggcgtgccgtcgtacaacatccagggccaggccgcgccgggctacagctcgggcgacgccatggccgagatggagcggctggccgacaagctgccgctgggcatcggctacgactggaccggcctgtcgttcgaggagcgcctgtcgggcgcgcaggcgccggcgctgtacgcgatctcgctgatcgtggtgttcctgtgcctggccgcgctctatgaaagctggagcattcccaccgcggtgatgctggtggtgccgctgggcgtggtgggggccttgctggccaccctgacgcggggcctgtccaacgatgtgtacttccaggtggggctgctgaccaccatcgggctggccgccaagaacgccatcctgatcgtggagttcgccaaggagcactacgaggagggcgccagcctgaccgaggcggcggtgcacgccgcgcgccagcgtctgcgccccatcctgatgacgtcgctggcgttcatcctgggcgtggtgccgctggccatctccacgggcgccggctcgggcagccagaacgccatcggcacgggcgtgatcggcggcatgctcaccggcaccttcctggcgatcttcttcgtgcccctgttctttgtccttaccctgcgcctgttcaaggtcaagcgcgcctcggagaaccgcgaggacgacgacccgcatggcggcgcccagccggccacgcacggaggacagccgcaatga

SEQ ID NO: 74339 - protein, 1059 aa, Bordetella bronchiseptica RB50
MAKFFIDRPVFAWVIAIVLMMAGALSILSLPVAQYPNIAPPAISINVTYPGASAQTVQDTVVQVIEQQMNGIDNLQYISSESNSDGSMSITLTFSQGTNPDTAQVQVQNKLAVAQPLLPLEVQQQGIRVTKATKNFLIVAGFVSTDGTMDKSDLADYVASYIQDPISRTPGVGDFQLFGAPYAMRIWISPEKLVNFGLTASDVTTAIREQNVQVSSGQLGGQPAVRGQQLNATVIGPSRLQTPEAFGRILLKVNSDGSQVRLKDVASIELGAQTYAIDSYYNGKPASGLAIKLASGANALDTAQAVRETINGLKPYFPPGMDVVYPYDTTPFVSLSIEGVVKTLFEAVLLVFLVMYLFLQNVRATLIPTLAVPVVLLGTFGVLAAFGYSINTLTMFGMVLAIGLLVDDAIVVVENVERVMAEEGLSPRQATRKSMSQITGALIGIAMVLAAVFVPMAFFGGSTGVIYRQFSITIVSSMVLSVVVAIVFTPALCATMLKPIPKGHHGSKKGFFGWFNRTFERSSQAYANNVARSMGRTKRLLLIYVVILLGMAWMFMRIPTAFLPDEDQGILFAQVQAPAGATSERTQATIDAAVKYLLEDEKESVASVFAVNGFSFGGRGQNAAILFIKLRDWNERKGAEHRAAAVAARANAKFRAELRDAQAAVFAPPAVMELGNATGFDFQLQDRAGVGHEKLLAARNQLLQEAGTSPMLVAVRPNGIEDAPQYQLDIDREKARALGVSITEINNTLATAWGSSYVNDFIDRGRVKKVFVQGEASSRMLPQDLDKWYVRNNAGDMVPFSAFSSAQWTFGPQKLNRYNGVPSYNIQGQAAPGYSSGDAMAEMERLADKLPLGIGYDWTGLSFEERLSGAQAPALYAISLIVVFLCLAALYESWSIPTAVMLVVPLGVVGALLATLTRGLSNDVYFQVGLLTTIGLAAKNAILIVEFAKEHYEEGASLTEAAVHAARQRLRPILMTSLAFILGVVPLAISTGAGSGSQNAIGTGVIGGMLTGTFLAIFFVPLFFVLTLRLFKVKRASENREDDDPHGGAQPATHGGQPQ

SEQ ID NO: 74340 - DNA, 3087 bp, Bordetella bronchiseptica RB50
  CDS (1)..(3087)
atggtgctctcggaaatctgcatccgccggccggtcttcgcgtcggtgctctcgctgatcatcgtcctgatcggccttatttcgtatacgcgcctgagtgtgcgcgaatatcccaagatcgacgagcccatcgtctcggtcgacaccacctacaagggcgcctcgcccgaggtgatcgagtcgcaggtcaccaagcccctggaagaccagctggcgggcatcgagggcgtggacgtgatgacctcgcgcagccgctccgagcgcagcctgatcaacatcaagttcagcctctcgcgcgatccggacgccgcggccgccgaagtgcgcgacaaggtatcgcgggcgcgccgcttcctgcccgacgagatcgacgagcccatcatcggcaaggtcgaggccgattcccagcccatcatctacatcgcggtcgaatccggctcgtactcggccatccagacctcggactacatcaaccgctatatcaagacccgcctgtcggtgctgccgggcgcggccgaggtgcgcgtgttcggcgaacgcctgccgtcgatgcgcatctacgtggaccgcgacaagctggcggcctacgggctgacggtgcaggacgtggaggcggcgctgcgcagccagaacgtggagatcccggccgggcgcatcgaatcgcgcgcgcgcgaattctcggtggtgtcctcgaccgacctgcagacgccggcccagttcgaggatgtggtggtggccaacgtcaagggctatccggtgcgcctgcgcgacgtggccaaggtggagatcggcgcggccaatgatcgcgtgctgtcgcgctacaacgggcgttcggccatcaatatcggcctgacgcgccagtccaccgccaatccgctggagctctccaaggcggtgcgcgccgagatcgtgcagctcaaccagagcctgccggccggaatgaagctgaacatcgcctatgactcgtcggtgttcatcgagcgctcgatcgactcggtgttcaagaccatcggcgaagccatcatcctggtggtgctggtgatcttcttcttcctgcgcaacctgcgcgccagcatcatccccatcgtcaccatcccggtatcgctggtgggcgcctgcgccctgatgtacctgttcggcttttcgatcaacaccctgaccctgctcgcgatggtgctggccatcgggctggtggtcgacgacgccatcgtggtgctggagaacatcttccggcacatcgaggaaggcatgccgcgcaagcaggcggcgttccaggggtcgcgcgagatcggcttcgcggtggtggcgatgaccctgaccctggtcacggtgtacgcgccgctggcgttcgccaccggccgcaccgggcggctgttcatcgaattcgcgctggcgctggcgggcgccgtgctggtgtcgggcttcgtggcgctgacgcttacccccatgatgtgctcggtgctgctgcggcaccagcacagccacaatcgctggtacaacctgatcgagggctggctggaagcgctggggcgcggctaccggcgcgcgctggagctggccttgcgccatcgctggacggtggtgggcgtgggcgccgtggtggcggccgccagcggggtgctgttctcggtggtcaagagcgaactggccccgatcgaggaccgcggcgtcgtgttcggcatcgtcagcgcgcccgaaggcgccacgctgaactacacgctcgacagcatgctgggcatcgaacagttctacgccgccatcccggaggccgccaccgcccaggtgacggtgggctttccgacggtcaccgacggcacggccatcctgcgcctgacgccctgggaggagcgcacccggcgccagcagcagatcgcccaggagctgcagcccaagttcgcgtcgctgccgggcgtgcgggcgttcccgaccaatccgccctcgctggggcagtcggcccgttccaagccggtggaattcatcatcatgagccaggcctcgtatcccgagctggccaagctggtcggcgtgttcaccaatgcgctgcgcgactatcccggcctgcagaacatcgataccgacctgcgcctgaacacccccgaactgcgcgtgcacgtcgatcgcgacaagatggccgacgtgggggccagcgtcgaagtggtcgggcgcaccctggaatccatgctgggggggcggcaggtcacgcgctacaaggaccagggcgaacagtacgacgtgatcgtgcaggtggtgcagggcgaccgcgccacgcccaccgacatctcgggcatttacgtgcgggcgcgcgatggcagcatggtgcagctggacaacctgctgtcggtgcgcgaaagcgtgtcgccgcagtcgctcaaccacttcaaccgcttgcgcgcggtcaaggtcgacgcggcggtggcgccgggctatgcgctgggcgaagtgctcgaccacatgcaccgggtggcgcgcgacgtgctgcccaatacggtgatcaccgacctcgatggccagtcgcgcgagttccgcgactcgtcgggcagcatctacctggtgtttgccatggcgctggccttcatctacctggtgctggcggcccagttcgagagctggcgcaatcccttcatcatcatgctgtcggtgccgctgtcgatgaccggggcgttgctggcgctgtggctgaccggcggcacgctgtccatctacagccagatcggcctgatcaccctggtggggctgatcaccaagcacggcatcctgatcgtcgaattcgccaaccagctgcgcgaccagggcaaggccatgcacgaggccgtggtcgaggccagcgtgctgcgcctgcgtcccatcctgatgacgaccggcgccatggtgctgggcaccgtgccgctggcgctggcgcagggcgcgggcgccgaatcgcgccagcagatcggctgggtgctggtcggcgggctgatgctgggtacactactgactttgttcgtggtgccggtggcgtattcgatgatcgccgcggcgcgcccgcaagggcagcgcaccggcgccagccataccgggccggccgtcgcgccgcccgcctcggagtag

SEQ ID NO: 74341 - protein, 1028 aa, Bordetella bronchiseptica RB50
MVLSEICIRRPVFASVLSLIIVLIGLISYTRLSVREYPKIDEPIVSVDTTYKGASPEVIESQVTKPLEDQLAGIEGVDVMTSRSRSERSLINIKFSLSRDPDAAAAEVRDKVSRARRFLPDEIDEPIIGKVEADSQPIIYIAVESGSYSAIQTSDYINRYIKTRLSVLPGAAEVRVFGERLPSMRIYVDRDKLAAYGLTVQDVEAALRSQNVEIPAGRIESRAREFSVVSSTDLQTPAQFEDVVVANVKGYPVRLRDVAKVEIGAANDRVLSRYNGRSAINIGLTRQSTANPLELSKAVRAEIVQLNQSLPAGMKLNIAYDSSVFIERSIDSVFKTIGEAIILVVLVIFFFLRNLRASIIPIVTIPVSLVGACALMYLFGFSINTLTLLAMVLAIGLVVDDAIVVLENIFRHIEEGMPRKQAAFQGSREIGFAVVAMTLTLVTVYAPLAFATGRTGRLFIEFALALAGAVLVSGFVALTLTPMMCSVLLRHQHSHNRWYNLIEGWLEALGRGYRRALELALRHRWTVVGVGAVVAAASGVLFSVVKSELAPIEDRGVVFGIVSAPEGATLNYTLDSMLGIEQFYAAIPEAATAQVTVGFPTVTDGTAILRLTPWEERTRRQQQIAQELQPKFASLPGVRAFPTNPPSLGQSARSKPVEFIIMSQASYPELAKLVGVFTNALRDYPGLQNIDTDLRLNTPELRVHVDRDKMADVGASVEVVGRTLESMLGGRQVTRYKDQGEQYDVIVQVVQGDRATPTDISGIYVRARDGSMVQLDNLLSVRESVSPQSLNHFNRLRAVKVDAAVAPGYALGEVLDHMHRVARDVLPNTVITDLDGQSREFRDSSGSIYLVFAMALAFIYLVLAAQFESWRNPFIIMLSVPLSMTGALLALWLTGGTLSIYSQIGLITLVGLITKHGILIVEFANQLRDQGKAMHEAVVEASVLRLRPILMTTGAMVLGTVPLALAQGAGAESRQQIGWVLVGGLMLGTLLTLFVVPVAYSMIAAARPQGQRTGASHTGPAVAPPASE

SEQ ID NO: 74342 - DNA, 3438 bp, Prochlorococcus marinus str. MIT 9313
  CDS (1)..(3438): transl_table=11
atgtcagcatcaaatagctttattactcgacctgttttagcaactgtttgcagtttgttgattgtcattgcgggactgatatcgatccctattttgccagttgaaatgcttccggatatagctccgccaacagtaaaagtaaattcaatttacaccggtgccgatgctgaatcggttgaacagggtgtgaccagtgtgctggagcagcagattaatggtgtggagaatatggactatttaacttcctcaagctcggctgatggggttagctcgattgctgttgcgttcgaaagtggtagtaatagcgacattaatcaagttaatgttcagaacagggttgcgctggcagagccacagttgccggaagcagtgcgcaaggcaggggtgagtgttaacaaggcttccaattccatcttgcttctttataattttgttagcgaagatccaagcaatattgaatatagtgtagaaacgattagtgggctgctagatctgggcctaacggacgaagttaagcgggttaagggagtcggtgaagtgacctactttggtaaccgtaaggttgcttttaggctttggctggacaatgaaaagcttgaggtttttggcctgacttcagcggatgtaatgggggcgattgaaagccagaaccgtttggttcctgctgggaatgtaggaggtgaaccatctgcagaaggccagatatttacttttcctgtgcaattaaatggccgccttgtgagcattggagactttgaaaatatggtcgttaggactacagaggatggcggattagtgaggttcagcgatgtcggtcatgttgtgcttggtggtgaaagctattccaacagcgctacagatttgcagggagtaccttctgtgagtatggctgtttatcaattgagtggcagtaatgctctagaggtatccaatggagtcaaagatgttctcgaagaatttaccgccaaaatgcctgtcggcatgaagattgaaaaaatctatgataatacagactttattaatgcatcaattaatggagtgaccaattcacttagagatgcgatcattttggtggttcttattctgtttgtatttttacagaattggaaagctactttggtgcctggtattgccatccctgttgcacttctaggcacattctctctggttttatggtttggcttctcgctcaaccagcttactttatttggattggttctcgctacagggttagtggttgatgatgcaatcacagtgattgaagatacctcaaccaagcagtcattagggatgactgctttggaagctgcgaagtcaacaatggatgagcttttctctgcagttattgctacatccttggttcttttctcagtatttttgccagtgttattttttcctggcgctacgggttcgatctacaagcagtttgcagcaacgattattttcgctatcgcgatttctacctttaatgctttaactttttcccccatgctttctgccttgcttttgggccgggaaggcacagctccgggccgcaatgcatatgcaatttctggtgcagtcattgggtttatatacggactattagttgttggcggtggtgcggcgctggccttgatccttacagcaatggctgcaattcttggctttgtgctgtctcgcttgactggccgttcgttgaggctgccattctctgttgcaggggctgtgattggtcttttcatcgcaggagtttcaagtcccttgccagtcgttttattcgctgggcttggcttgaccttgggttggtatacaccatggatttttagtcatttcaatcgcatttattccgtctttgagctgcgctatgccgatctgctcgagtgggttcttggccgccgttctcttgtgatgggaattcttgcggtaggggttctgctgaccggtgttgcttttactgcgattccaagtggatttgttcctattgaagatcagggctatgccatcggcgtgttgcaggccccagaaggcgtgtcgactcaggtcaccgagaagattaatcagcaagttgctgagatattgcgcagcgaatccgatatcacttcagcagcaatttttagtggagcaagttttgatggcaatagccctaataaaggattattttttattgggatgcgtaattgggatgagaggaaaaatcgtgatcaatccgccgatgcaattgttggacggctcaaccagaagttctttggggctattgatggcgcgaggatttttgttgtagagccacctgcgattcctggatacggcattggcagtggatttgagttccaattacttgacaagagtggaggtgcttatggcttaaacaacttctttgcctcagctggtcaaattattcagcaggcgaaagcaaatccaatgttgagcagtgtaaggactttattctcgcctgaatctccgcagctacgagttgaggtcgatagggacattatggcctctcttgatgttgacttcagctctgcaatgcgtgtgtttagcgctaattttgcaggcgcctatgttaatgataccttccaggaaggtaaggttcgtcgtgtttatgttcaggccgatgaattgggtcggtctgcacctgaaaagctatcttcaatttacgttaagaatcgggtgggtgagcagattcagctctcggaatttttaacagttgaaccttctgttgggccaagtgtgatctctcactttaacctttacagatcgataaaaatagaaggatcacctgctgctggtaagagctcggggcaggcaattaatggtatgaaggagctttttgcagctcagaatcttaagagcctcggatttgattggacagggatatctcgagaggaagtaaaagctggtgcactagctgttgtgatttttgcattgggaattttggtggtttatctcgtgcttgcagctcaatacgagagttatacagaccctctgattattttaatgacagttcctactgcaatgcttggagccttgttttttctggcattgcgtggagaggttctcaacatttatgcacaggttggccttgtgatgttgattggtctagctgctaaaaatgggatcttgattgttgatttggctaatcaacgcatggctgagggagtttcggcccttgaagcagcaaggcaggcagccaagtcgagacttaggcccatcattatgactgctatttcgtctctttttggctttatgccgttggtcttggctagcggagcaggagcccgcagccaagcttctcttggcacggttgtattcggtggccttttggttgctactttcctttcgctgtttgttgtgcctgtcttttacgtcgctgttaaagctcttgtaggaacctttagtgatacggaacaaggcaacaccaatttacttaattcgggagacccctttgggcagggataa

SEQ ID NO: 74343 - protein, 1145 aa, Prochlorococcus marinus str. MIT 9313
MSASNSFITRPVLATVCSLLIVIAGLISIPILPVEMLPDIAPPTVKVNSIYTGADAESVEQGVTSVLEQQINGVENMDYLTSSSSADGVSSIAVAFESGSNSDINQVNVQNRVALAEPQLPEAVRKAGVSVNKASNSILLLYNFVSEDPSNIEYSVETISGLLDLGLTDEVKRVKGVGEVTYFGNRKVAFRLWLDNEKLEVFGLTSADVMGAIESQNRLVPAGNVGGEPSAEGQIFTFPVQLNGRLVSIGDFENMVVRTTEDGGLVRFSDVGHVVLGGESYSNSATDLQGVPSVSMAVYQLSGSNALEVSNGVKDVLEEFTAKMPVGMKIEKIYDNTDFINASINGVTNSLRDAIILVVLILFVFLQNWKATLVPGIAIPVALLGTFSLVLWFGFSLNQLTLFGLVLATGLVVDDAITVIEDTSTKQSLGMTALEAAKSTMDELFSAVIATSLVLFSVFLPVLFFPGATGSIYKQFAATIIFAIAISTFNALTFSPMLSALLLGREGTAPGRNAYAISGAVIGFIYGLLVVGGGAALALILTAMAAILGFVLSRLTGRSLRLPFSVAGAVIGLFIAGVSSPLPVVLFAGLGLTLGWYTPWIFSHFNRIYSVFELRYADLLEWVLGRRSLVMGILAVGVLLTGVAFTAIPSGFVPIEDQGYAIGVLQAPEGVSTQVTEKINQQVAEILRSESDITSAAIFSGASFDGNSPNKGLFFIGMRNWDERKNRDQSADAIVGRLNQKFFGAIDGARIFVVEPPAIPGYGIGSGFEFQLLDKSGGAYGLNNFFASAGQIIQQAKANPMLSSVRTLFSPESPQLRVEVDRDIMASLDVDFSSAMRVFSANFAGAYVNDTFQEGKVRRVYVQADELGRSAPEKLSSIYVKNRVGEQIQLSEFLTVEPSVGPSVISHFNLYRSIKIEGSPAAGKSSGQAINGMKELFAAQNLKSLGFDWTGISREEVKAGALAVVIFALGILVVYLVLAAQYESYTDPLIILMTVPTAMLGALFFLALRGEVLNIYAQVGLVMLIGLAAKNGILIVDLANQRMAEGVSALEAARQAAKSRLRPIIMTAISSLFGFMPLVLASGAGARSQASLGTVVFGGLLVATFLSLFVVPVFYVAVKALVGTFSDTEQGNTNLLNSGDPFGQG

SEQ ID NO: 74344 - DNA, 3111 bp, Synechococcus sp. WH 8102
  CDS (1)..(3111): transl_table=11
ttgcggtcgctctcccagccgtttctgcgccgaccgatcctcacggttgtctgcagcctgctgatcctgctggcaggcctggtggccctcaccggactgggactggaggacctgccgcagttggcgccgacccgggtcagcgttggggccacctttccagcggcgtcaccggaggtggtggagcagagcgtcaccgccgtcctggaacaacagctcaatggtttggaggggctggagagcatcagctccaacagccgtcagggtggcgccagcatcagcctgcgtttcagcgaaggcgatcccgagctgaatgccatcaaggtgcagaacgaggtgaacctcgccacccggcgtctgcctcaagcggtgagccgtcagggcctgagggttcggcgctcctcggacgacctgctgatgatccttggcttcagccatccgcccgatcagtacgttcccaccttcctggccggctggctggatcaatccctgcgggaggcgttgttctccacgcctggaatcggcgatgtacgggtgttcggcagcagtaacctcgcctttcgcctctggctcgatccggatcgcctggaacaggccagcctgacgatctcagatgtcagccgcgctctggccgagcagaacgtgctggccgccatcggcagccttggtgcttcaccggcaccagacggtcagttgatcagcatgccggtggatgccgagggacggctgctcacccagaaggatttcgagaatctgattctgcgccgactcgacaacggcggactgctgcgtctcaaggatgtgggtcgcgtcgagctggggcagcgcagctacggaagccaggcgatgaatctcgacgggcagcgctccgtggccgtggggctctatcagcgggatggcgccaatgccctggaggtgagtcgagccgtcaaagctgaactgaagcgactggagcccagcttcccgcccggtatcgaaacgtcgatgatcgtggatgtggctgacaacgtccaggccaacctcgatcgcaccatcgccaccctgcgtgatgccgtgctgctggtgctggtggtgctggtgctgttcctgggacgctggcgcctggccctgatccctggccttgcagtaccggtggcactggtgggcagcctggtgctggtgaagctgagcggctccaacctgaacagcctgattttgttcggaatggtcatggccaccggcatcgtcgtcgatgacgcgatcgtggtgagtgaagacatcgccggccggatcgaacggggggatgccccaaaagctgcggcggaagacgccatggccgaactggccggagcggttgtggccacctccctggtgctagctgccgtgttcgtgccggtgctgctgatccccggctccgtgggacggctataccaaccgattgccttggccatcagcggcgcgattctgttctccaccctcaatgccctttccttcacacccatggcctgcgcccgggtgctggactctggagaagggcgactgcggggtccgctgcggcggctgagcagcgggctcaggcaaggcatgagcgacctgcaacggtgctacgccaatctgctggagctctggttgcggcgcgcaacgctggtgctgggcctgctgctgacagggctgatcatcaccggcgctgggctggcggcgatgcccaccgccttcatccccaacgaagaccagagccagatccgcggctacttcaccctgccggagggggccagcctggaacggacagtagcggtgatggaacgcatccgtgccgtggtagtggaggagccccttgtgcggacgggcaacttttatgccggccgatccttcggccagagcggcgaagaccgtggctcgttctatctgcggcttcagcccttggagcagcgctccggtcgtgatcagagcagtgacgccgtgaaacgacggctgaaccgcgccatccgcagccgcatcggcgacgcccgtgtggtggtcacaaccccaccaaccgtgcggggcttcagcggcgaatccggcttgaggctggagctgctggaccgcagcggcggacagctcaacctgcaggcgttcgaagccctggcccagcgctttatcaaaaccgcccaagccagcaaccgctttgaacgggtgagcacccgcttcgatgccagctccccccggtggcgcctcagccttgatcgcgatcttctggccagtctcgaccttgatctgagcactaccctgcgcgacatcggcaccgccatcggcggccgctacatcgacgacacctacgaagggggccgcatccgcagcatctatgtgcaactggatggagacaaccgaacaggccccgaggatctcagcggattgatggtgcgcaaccgcagcggagagctggtctctttggagaacgtggccaccctgacccgaaccgaaggagccaacggcatccgccactacggtctgaaccgggccatcacggtgacggccgtgccggcccctggggtgagcagcggtcaggcgattgagcaactcaaggcggctggcgatgcggtggggggcaacaacatcgggctggccttcacaggcctggccctggaagagcaaaaggcagcccgttcaacctgggtgctgttcagcctcggggtggtggtggtgtacctgctgcttgcggctctctacgaaagctttgtcgaccccctgatcatcctgctcaccgtgccgattgccctgatgggggcactgatcgggctgaagctgcggggtctccccctggatgtttacggacagatgggactgctggtgttggtgagcctggcggccaagaacggcatcctgatcgttgaattcgccaatcaacggctggaggccggcctggcattgcgggaggcgatccttggcgccgccgtgaaccgaatgcgaccgatcctgctcactgcggtgacctccctggccggatttctaccgctgctgctggcccagggcagcggctccgccagccggatcagcatcggcactgtggtgttcagcggcctgctggtgtcctcatggctgtccctgtttgtggtgccgacggtgtatttgttgctcaaacgctggcggccgacgtga

SEQ ID NO: 74345 - protein, 1036 aa, Synechococcus sp. WH 8102
MRSLSQPFLRRPILTVVCSLLILLAGLVALTGLGLEDLPQLAPTRVSVGATFPAASPEVVEQSVTAVLEQQLNGLEGLESISSNSRQGGASISLRFSEGDPELNAIKVQNEVNLATRRLPQAVSRQGLRVRRSSDDLLMILGFSHPPDQYVPTFLAGWLDQSLREALFSTPGIGDVRVFGSSNLAFRLWLDPDRLEQASLTISDVSRALAEQNVLAAIGSLGASPAPDGQLISMPVDAEGRLLTQKDFENLILRRLDNGGLLRLKDVGRVELGQRSYGSQAMNLDGQRSVAVGLYQRDGANALEVSRAVKAELKRLEPSFPPGIETSMIVDVADNVQANLDRTIATLRDAVLLVLVVLVLFLGRWRLALIPGLAVPVALVGSLVLVKLSGSNLNSLILFGMVMATGIVVDDAIVVSEDIAGRIERGDAPKAAAEDAMAELAGAVVATSLVLAAVFVPVLLIPGSVGRLYQPIALAISGAILFSTLNALSFTPMACARVLDSGEGRLRGPLRRLSSGLRQGMSDLQRCYANLLELWLRRATLVLGLLLTGLIITGAGLAAMPTAFIPNEDQSQIRGYFTLPEGASLERTVAVMERIRAVVVEEPLVRTGNFYAGRSFGQSGEDRGSFYLRLQPLEQRSGRDQSSDAVKRRLNRAIRSRIGDARVVVTTPPTVRGFSGESGLRLELLDRSGGQLNLQAFEALAQRFIKTAQASNRFERVSTRFDASSPRWRLSLDRDLLASLDLDLSTTLRDIGTAIGGRYIDDTYEGGRIRSIYVQLDGDNRTGPEDLSGLMVRNRSGELVSLENVATLTRTEGANGIRHYGLNRAITVTAVPAPGVSSGQAIEQLKAAGDAVGGNNIGLAFTGLALEEQKAARSTWVLFSLGVVVVYLLLAALYESFVDPLIILLTVPIALMGALIGLKLRGLPLDVYGQMGLLVLVSLAAKNGILIVEFANQRLEAGLALREAILGAAVNRMRPILLTAVTSLAGFLPLLLAQGSGSASRISIGTVVFSGLLVSSWLSLFVVPTVYLLLKRWRPT

SEQ ID NO: 74346 - DNA, 3432 bp, Synechococcus sp. WH 8102
  CDS (1)..(3432): transl_table=11
atgtctgcttccaataacttcatcaccaggccggttctcagcacggtctgcagtctgttgattgtgatcgtcgggttgatcgcaatcccgatcctgccgatcgaaaacctgcctgatatcgcacctcccacggtgaaggtgcagtccacctacgtgggcgctgatgcggtagctgtggaacagggtgtgacctccgtgctcgagcagcagatcaacggggtcgagaacatggacttcatcacctccaacagttcgtcggatggtgtgagttcgatctcggtgtcgtttgaaagcggcaccgacggcaacatcaaccaggtgaatgtgcagaaccgcgtttccctggcagagccccagttgcctgaagaggtgcgcaaatcgggtgtgacggtcaacaaggcctccaactcgattctgctcgtttacaacttcgtcaacgaagatccctccaaaactgaatactcagtggagacgatcagtggatatctcgataaaaacctcaccgacaatgtcaagcgcgtcaaaggcgttggtgatgttacttatttcggcaacaggaagatcgccttccgcctctggctggatccggaaaaactgacggccaacaacctttcggccacggatgttgtccaacagttgaaaagccagaaccgcctcgttcctgccggcaaaatcggcggtgcaccggctccggaaggtcaggaatacaccttcacggtgcagctgcagggtcgtctcaccaccgttcaggaatttgaaaacatcgttctacgcacgacggatgccggaggtttggttcgcctgaaggatgtgggccgtgtggagctcggtggtgagacctatggcatcgacgctatggatctcaaaggcaccccttccgtcggtatcgccatttatcagctttccggcagtaacgccattgaggtgtccaacggtgtgaaggatgtgctcgatgtattcgagaaaactttgccggtgggcctcggtgttcagaagatctacgacaccacggacttcatcaaccagtcgatcaagggtgtgaccaactccctgcgggatgccgtaatcctggtggtgctgatcctgttcctgttcctgcagaactggaaagccaccctggttcctgccattgccatcccggtggccctcatcggcacctttgccctggtgctggccttcggtttctcgctcaaccagctcaccctgtttggcctggtgctggccacaggtttggtggtggatgacgccatcaccgtggtggaagacacctcagccaaaaaggccgaggggatgacgtccgtgcaggcggccatggaaaccatggatgaactgttcggagctgtgatcgccacctccctggtgaagatggccgtgttcctgccggtgctgttcttcccgggtgccaccggcacgatctacaagcagttcgccgccacgatccttttttcgatcggcatctcaaccttcaacgccctcaccttctcgccgatgctttcggccttgttgctttctcgtgaaacgaaggagctcagccgcaatcagtacgccacagcgggcgttgttcttggcttcatgtacggcctgctcagtgcgggcaatggggccgcagctgccctgatcccaaccgtgatcggtgccgtgatcggtttcattgccggcaagatcacaggcctgcctctgcgtcttcccttcactgccggtggcgctgcagtgggtgtggtcaccaccggggtgatcttcagcaacccgattccagtggtgctgttcaccgccatcggcctggtggtgggctacttcgttccggtcatcttcagcaatttcaaccgcttctatggcggttttgagaagcgctatgcatccatcttggatgcggtgttgaaggcccgtccaatcgggatggcggcattggcggcaggcatcctgctcactggctttgccttcacccatatccccggcggcttcgtgccgatcgaagaccagggctatgccatcggctttgtgcaggcgcccgatggcgtgtcgaatgagaagaccctggcgatcaaccgccaggtggccgacgtgctgcgttcggaagaagacatcgcctcagccgctctgttcagcggcgccagcctcgatggcaacgctcccaacaagggcctgttcttcatcggcatgaatcattgggacgagcgcccgggcaacgatcacacggtgggtgctgtggtgaaacggctcaacgccaagatgtacagcgctatcgatgccgggcgggtgttcgtggtggagcccccctcgatccccggttatggaaccggtggtggctttgagttccagctgcttgaccaaagcagcggtgcttacacgctgaatgaattctttggcacggcgcagcagatcatgcaggccggtaacgccaaccccgtgctgaaccgcgtttactcgttgttctcacctcaggctccgcagtacaagatcgatgtggatcgtgagcagatggcatctctcggggtggacttcgggtccgccatgtcggccttcagcgtcaattttggtggtgcctacgtcaacgacaccttccaagagggcaaggtgcggcgggtctacgtgcaggccgacgaagtgagtcgggccactccccagcgactctctgccatctatgtgcccaattcccagggtgagcaggtgccgctttcggagttcttcacggttaaacaaaccgtggggcccagcgtgatcccccacttcaatctctaccgatcgatcaagatcgagggcacgcctaatgaaggcaacagctccggccaggcgatcggagcgatgaagcagatcttcaataccggcagctaccagggcctcggcttcgattggaccggcatctcccgtgaagaggtgaaagctggttccctggctgtggtgatttttgctctgggcatcctggcggtgttcctggtgctgtcggcccagtacgagagctactccgatccgatcatcatcctgctgacggttcctaccgccttgcttggcgctctggtgttccttggcggggccggccaggtgctcaacatctacgcccaggtgggcctggtgatgctgattggtctggcgggcggcaacgcgattctgatcgtcgacctggccaaccagaagatgggtgaaggggagtcggcgctggaggccgccaagttctcagccaagtcgcgtctgcgtccgatcctgatgacggcgatttcctcacttaccggcttccttccgctgatgctggccagtggtgctggtgcccagagccagtcgtctctgggtctggtggtgttcggtggtctgctggtggcgaccttcctctccacccttgtggtgcctgtgttctatgtggtgttgaagtcgctgctgggtcaggccgatgccaagccacaggacgatgctcccagcccaactgcccagccgagctga

SEQ ID NO: 74347 - protein, 1143 aa, Synechococcus sp. WH 8102
MSASNNFITRPVLSTVCSLLIVIVGLIAIPILPIENLPDIAPPTVKVQSTYVGADAVAVEQGVTSVLEQQINGVENMDFITSNSSSDGVSSISVSFESGTDGNINQVNVQNRVSLAEPQLPEEVRKSGVTVNKASNSILLVYNFVNEDPSKTEYSVETISGYLDKNLTDNVKRVKGVGDVTYFGNRKIAFRLWLDPEKLTANNLSATDVVQQLKSQNRLVPAGKIGGAPAPEGQEYTFTVQLQGRLTTVQEFENIVLRTTDAGGLVRLKDVGRVELGGETYGIDAMDLKGTPSVGIAIYQLSGSNAIEVSNGVKDVLDVFEKTLPVGLGVQKIYDTTDFINQSIKGVTNSLRDAVILVVLILFLFLQNWKATLVPAIAIPVALIGTFALVLAFGFSLNQLTLFGLVLATGLVVDDAITVVEDTSAKKAEGMTSVQAAMETMDELFGAVIATSLVKMAVFLPVLFFPGATGTIYKQFAATILFSIGISTFNALTFSPMLSALLLSRETKELSRNQYATAGVVLGFMYGLLSAGNGAAAALIPTVIGAVIGFIAGKITGLPLRLPFTAGGAAVGVVTTGVIFSNPIPVVLFTAIGLVVGYFVPVIFSNFNRFYGGFEKRYASILDAVLKARPIGMAALAAGILLTGFAFTHIPGGFVPIEDQGYAIGFVQAPDGVSNEKTLAINRQVADVLRSEEDIASAALFSGASLDGNAPNKGLFFIGMNHWDERPGNDHTVGAVVKRLNAKMYSAIDAGRVFVVEPPSIPGYGTGGGFEFQLLDQSSGAYTLNEFFGTAQQIMQAGNANPVLNRVYSLFSPQAPQYKIDVDREQMASLGVDFGSAMSAFSVNFGGAYVNDTFQEGKVRRVYVQADEVSRATPQRLSAIYVPNSQGEQVPLSEFFTVKQTVGPSVIPHFNLYRSIKIEGTPNEGNSSGQAIGAMKQIFNTGSYQGLGFDWTGISREEVKAGSLAVVIFALGILAVFLVLSAQYESYSDPIIILLTVPTALLGALVFLGGAGQVLNIYAQVGLVMLIGLAGGNAILIVDLANQKMGEGESALEAAKFSAKSRLRPILMTAISSLTGFLPLMLASGAGAQSQSSLGLVVFGGLLVATFLSTLVVPVFYVVLKSLLGQADAKPQDDAPSPTAQPS

SEQ ID NO: 74348 - DNA, 3144 bp, Chromobacterium violaceum ATCC 12472
  CDS (1)..(3144): transl_table=11
atgttttccgcttttttcatccggcgaccgatcttcgccagcgtgatctccatcgtgatcatgctggcgggcctggccgccatcaaggcgctgccgatcgagcagtaccctgaaatcgtgccgccggtggtgaacgtcaccgccagctatccgggcgcttccgccgaagtcatcgccaacaccgtggccgcgccgctggagcaggcgatcaacggcgtggacgacatgctgtacgtgcagtccaacagcgccagcaacggcacgctgtcgctgaccgtgtcgttcaagatcggcaccaacgccgaccaggccaccatcaacgtcaacaaccgcgtgcagtcggtgctgtcgcagctgccggaagaagtgcggcgccagggcgtcaacgtgcgcaagaagtccgccaccatcctgcaggtggtgtcgctgttctcgcccgacaacagccacgacacgctgttcatcagcaactacgcgctgttgaacgtggtggacgagctgaagcgggtgccgggcgtgggcgacgtggtcaacttcgccggccaggactactcgatgcggatctggctgaagcccgacaagctggcgcagctgaagctgacgcccagcgacgtggccgccgccatccgcgagcagaactcgcagttcgccgccggcaagctgggcgccgagccgacgccgcagaagctggacttcacctacaccgtgaccacccagggccgcctgtccgagccggaagagttcgagaacatcatcgtgcgcgccaacccggacggctcggcggtgaagctgaaggacgtcgcccgcgtcgagctgggcgcgctgtcctacgacttccacggcaagcacaacggcaaggccaccatcccgatcggcatcttcctggcgccgggcgccaaccagctggccaccgcgcaggcggtggagaccgagatgctgcgcctgtccaagagcttcccgaccggcctgtcctacggcatcccctacgacaccaccaagttcgtcgaagtgtcgatcgaggaggtgtacaagacgctggccgaggccatggtgctggtgttcctggtggtgttcctgttcctgcagaactggcgcgccacgctgatcccctgcctggcggtgccggtgtccatcgtcggcgccttcgccggcatgtacgccttcggcttcaccatcaacacgctgacgctgttcggcctggtgctggccatcggcatcgtggtggacgacgccatcgtagtgctggagaacgtcgagcgcctgatgacgcaggaagggctgtcgccgcgcgaggccagcctgaaggcgatgcaggaagtgtccggcgcgctggtcgccatcgtgctggtgctgtgctcggtattcattccggtggccttcctgggcggcatcgccggccagatgtacaagcagttcgcgatgaccatcgcggtgtcggtggtgatttccggcatcgtggcgctgacgctgaccccggcgctgtgcgcgctgatcctgaagtccgaacaccagcaccagaaccgcttcttcgagtggttcaacggctggttcgaccgcctgaccgagcgctacaccggcggcgtggccttcatcaacaagcgcgcgctgctggcggtgatgctgttcggcggcctgctgctggcttccgccggcctgttccgcatcatcccgtccagcctggcgccggacgaggaccagggctacatcctggccgcggccttcctgccggacggcgcgtcgctgcagcgcaccgccgccaccatcgacaagctggacgccatgatggcgaacaacccggcggtgaaggaccggatgagcttcgccggcttcgacatcctgtcgggcggcaacaagtccaacgccggcgtatccttcatcacgctgaagccgtgggacgagcgcaagtcgccggagctgtcgtcgatggcggtggtgaaggacgtgttcgccaagggcgcgatgggcgtcaccgacggcatcatcctggccttcaacccgccgccgatctccggcatgtccaacaccggcggcttcgaagcctacgtgcaggaccgcgccggccgcaccccggccgagctgggcgagatcaccaagaaaatggtggccgccgccgccaagcggccggagctgaagggggtgcagaccaccttctccgccagcgtgccgcaggtcttcgtcaagctggaccgcgacaaggccaaggcgctgggcgtgccggtgaacagcgtgttcgacaccatgcagagcaccttcggcgcgctgtacgtcaacgacttcaacaagttcggccgcaccttccgcgtgcagctgcagtccgaggcgccgttccgcaccaaggtggacgatctgcgcaacgtctacgtgcgctcgcagaccggccagatgatcccgctgaccgcgctggtgaccatccagcagaccaccggcccggaaacgctggaacgcttcaacgtgttcccggcggccaagctggtgggcggcccggccccgggctacagctccggccaggcgctgaccgcgctggaggaagtggccaaggaaacgctgcccgacggctatagcctggcctggaccggctccgccttccaggaaaaatcgaccagcggctcgtctaccctggtgttcggcttcggcatgatcatggtgttcctgatcctggcggcgcagtacgaacgctggaccctgccgatctcggtgctgatggcggtgccgttcgccgtgttcggcgcgctgatggccaactggctgcgcggcctggccaacgacgtgtacttccaggtggcgctggtgacgctgatcggcctgtcggccaagaacgcgatcctgatcgtcgagttcgcggtgcagaaactggaggaaggcatggcgttgaaggaggccgcgctgcaggccgcccgcctgcgcttccgcccgatcgtgatgacctcgctggccttcgtgctgggctgcgtgccgctggccatctccagcggcgccggctccgccagccgccactcgatcggcaccggcgtgatcggcggcatgctggccgccaccttcatcgccaccttcttcatcccgctgttcttcatcctgatcatgaagctcggcaagcagaacaagcctcagcagaacgccgaggccggaggaaacgcagatgcttaa

SEQ ID NO: 74349 - protein, 1047 aa, Chromobacterium violaceum ATCC 12472
MFSAFFIRRPIFASVISIVIMLAGLAAIKALPIEQYPEIVPPVVNVTASYPGASAEVIANTVAAPLEQAINGVDDMLYVQSNSASNGTLSLTVSFKIGTNADQATINVNNRVQSVLSQLPEEVRRQGVNVRKKSATILQVVSLFSPDNSHDTLFISNYALLNVVDELKRVPGVGDVVNFAGQDYSMRIWLKPDKLAQLKLTPSDVAAAIREQNSQFAAGKLGAEPTPQKLDFTYTVTTQGRLSEPEEFENIIVRANPDGSAVKLKDVARVELGALSYDFHGKHNGKATIPIGIFLAPGANQLATAQAVETEMLRLSKSFPTGLSYGIPYDTTKFVEVSIEEVYKTLAEAMVLVFLVVFLFLQNWRATLIPCLAVPVSIVGAFAGMYAFGFTINTLTLFGLVLAIGIVVDDAIVVLENVERLMTQEGLSPREASLKAMQEVSGALVAIVLVLCSVFIPVAFLGGIAGQMYKQFAMTIAVSVVISGIVALTLTPALCALILKSEHQHQNRFFEWFNGWFDRLTERYTGGVAFINKRALLAVMLFGGLLLASAGLFRIIPSSLAPDEDQGYILAAAFLPDGASLQRTAATIDKLDAMMANNPAVKDRMSFAGFDILSGGNKSNAGVSFITLKPWDERKSPELSSMAVVKDVFAKGAMGVTDGIILAFNPPPISGMSNTGGFEAYVQDRAGRTPAELGEITKKMVAAAAKRPELKGVQTTFSASVPQVFVKLDRDKAKALGVPVNSVFDTMQSTFGALYVNDFNKFGRTFRVQLQSEAPFRTKVDDLRNVYVRSQTGQMIPLTALVTIQQTTGPETLERFNVFPAAKLVGGPAPGYSSGQALTALEEVAKETLPDGYSLAWTGSAFQEKSTSGSSTLVFGFGMIMVFLILAAQYERWTLPISVLMAVPFAVFGALMANWLRGLANDVYFQVALVTLIGLSAKNAILIVEFAVQKLEEGMALKEAALQAARLRFRPIVMTSLAFVLGCVPLAISSGAGSASRHSIGTGVIGGMLAATFIATFFIPLFFILIMKLGKQNKPQQNAEAGGNADA

SEQ ID NO: 74350 - DNA, 3057 bp, Chromobacterium violaceum ATCC 12472
  CDS (1)..(3057): transl_table=11
atgaacttcaccgacatcttcatcaagcggccggtgctggccacgaccatcagcctgctgatcgtcgtgctcggcctgcgctcgctgttcggcctgccgatcaaccagtatccgcagacgcagaacgcggtggtgaccatttccaccacctattacggcgccgacgccaagaccgtggccggcttcatcacccagccgctggagtcggcgatcgcccaggcgcagggcatcgactacttgtcgtcctccagcaacaacggcgtgtccaccatcaccgccacgctgcggctgaactacgacgccaaccgcgcgctgaccgagatcaacacccaggtcaactcggtgaagaaccagctgccggcccaggcgcagcagccggtgctgacggtgcagaccggccagaccaccgacgcgatgtacatgggtttctacagcgagacgctgccgaccaacaacgtcaccgactacctggtgcgcgtggtcaagcccaagctggattcggtggccggcgtgcagaccgccgaaatcctgggcgcgcgccagttcgcgctgcgcgcctggctggattcggccaagatggcggcccacggcgtcaccgcggccgacatcagcgccgcgctggccagcaacaacgcgctgagcgcgccgggctccagcaagggccagatggtgaccatcccgctgaccgccgacaccgacctgcacacggtcgccgacttcaagcagctggcgatcaagcgcaacggcgacgccatcgtgcggctggaagacgtggccatggtgacgctgggctcggagaactacgacttcaacgtcgccttcagcggcgtgcgctcggtgttcatcggcatcaaggtggcgccggaggccaacatcctcgacgtcgccgaacgggtgcgcaaggccttccccgccgtccagcagcagctgcccaccggcctgaccggccagatcgtctacgactccaccgacttcatcaacacctcgatccacgaggtggtgaagaccctggtcgaggcgctggtgatcgtgaccgtggtgatcttcctgttcctgggcagtttccgcgcggtggtggtgccggtgatcgcgatgccgctgtcgctgatcggcaccttcttcatcatgctgatgctcggctactcgatcaacctgctgacgctgctggcgctggtgctggccatcggcctggtggtggacgacgccatcatcgtggtggagaacgtggaccgccacatgcgcgagggcaagacgccgttcgaggcctccatcatcgccgcgcgcgagctgggcggccccatcctggcgatgacggtggtgctggtggcggtgtacgtgccgatcggcttccagggcggcctgaccggcgcgctgttcaccgagttcgccttcacgctggcggcgtcggtgacggtgtccggcgtggtggcgctgacgctgtcgccgatgatgtgctcgcgcttcttcaacgccgacatggacaacagccccttcgtccacgcgatcgaccgcaccttcgagcgcgtgcgccacggctaccgccgcatcctgcacagtctgctggaaacctggccggtgctgatcgtgatgggcgccatcctgatcgcgctgctggcggtgatgttcaagatgtccaagtccgaactggcgccggaagaggatcagggcatcgtgctgtcccaggtggtgggcgcgccgacggccacctccgagcagatgcaaacctacgccaagcaagtgttccaggtggccaagggcatgccggaatacgagcagatgttccagatcaccggcgtgccgaccgtcaacgccggcatcggcggggtgctgttcaagccgtgggatcagcgctcgcgcaacgcgcacgaaatccagatggacctgcagtcgcgctggaacaagatcgccggcgcgcgcgtggcggcgttccagttcccgccgctgccgggcgcgtccggcctgccggtgcagttcgtgatcaacaccaccgagccgttcgagaacctgaaccaggtggcgcagcaggtgatggacaaggcgcgcgcctccggcaagttctacttcctggacgccgacctgaagatcgacaagccgcaggccacggtgatgatggatcgcgacaagatcaccgcgctgggcctgacccagcaggacgtcggcaacgcgctgagcgcggcgctgggcggcggctatgtcaactacttctcgatcgacggccgctcctacaaggtgatcccgcaggtgcagcaggtggaccggctcaacccgtcgcagctgctggactactacatcaagaccccgaacaacggcgtgatcccggtcggcaccgtggccacgctgaagtacgacgtggtgccgcagtccatcacccgcttccagcagctcaattcggtgaccatctccggcgtgccaggcgcgtcgcagggcgaggtgctgcaatacctgcgcgacaccgtgcagcaggtggcgccgaccggctattcggtcgactactccggccagtcgcggcagttcatgcaggagtcaggcggcttcctggtgaccatgctgttcgcggtgatcatcgtgttcctggcgctgtcggcgctgttcgagagcttccgcgacccggtagtgatcctggtatcggtgccgctggcgctgttcggcgcgatgatcttcatcttcctgggcttctcctcgctcaacatctacaccgaggtgggcctggtgacgctgatggggctgatcagcaaacacggcatcctgatcgtcgaggtggccaacgagctgcgcaagaccggcctgtccaagcgcgaggcgatcgaagaggcggcgtccatccggctgcgcccgatcctgatgaccaccgcggcgatggtgttcggcgtgatcccgctggtgatcgcttccggcgccggcgcggccggccgctacgcgatgggcctggtgatcttcaccggcctgtccatcggcacgctgttcacgctgttcgtggtgccggcgatgtatatgttcatcgcctcgcgccgcgaggaaaaagctgagcccgcgccggaagaagcggcccagcactaa

SEQ ID NO: 74351 - protein, 1018 aa, Chromobacterium violaceum ATCC 12472
MNFTDIFIKRPVLATTISLLIVVLGLRSLFGLPINQYPQTQNAVVTISTTYYGADAKTVAGFITQPLESAIAQAQGIDYLSSSSNNGVSTITATLRLNYDANRALTEINTQVNSVKNQLPAQAQQPVLTVQTGQTTDAMYMGFYSETLPTNNVTDYLVRVVKPKLDSVAGVQTAEILGARQFALRAWLDSAKMAAHGVTAADISAALASNNALSAPGSSKGQMVTIPLTADTDLHTVADFKQLAIKRNGDAIVRLEDVAMVTLGSENYDFNVAFSGVRSVFIGIKVAPEANILDVAERVRKAFPAVQQQLPTGLTGQIVYDSTDFINTSIHEVVKTLVEALVIVTVVIFLFLGSFRAVVVPVIAMPLSLIGTFFIMLMLGYSINLLTLLALVLAIGLVVDDAIIVVENVDRHMREGKTPFEASIIAARELGGPILAMTVVLVAVYVPIGFQGGLTGALFTEFAFTLAASVTVSGVVALTLSPMMCSRFFNADMDNSPFVHAIDRTFERVRHGYRRILHSLLETWPVLIVMGAILIALLAVMFKMSKSELAPEEDQGIVLSQVVGAPTATSEQMQTYAKQVFQVAKGMPEYEQMFQITGVPTVNAGIGGVLFKPWDQRSRNAHEIQMDLQSRWNKIAGARVAAFQFPPLPGASGLPVQFVINTTEPFENLNQVAQQVMDKARASGKFYFLDADLKIDKPQATVMMDRDKITALGLTQQDVGNALSAALGGGYVNYFSIDGRSYKVIPQVQQVDRLNPSQLLDYYIKTPNNGVIPVGTVATLKYDVVPQSITRFQQLNSVTISGVPGASQGEVLQYLRDTVQQVAPTGYSVDYSGQSRQFMQESGGFLVTMLFAVIIVFLALSALFESFRDPVVILVSVPLALFGAMIFIFLGFSSLNIYTEVGLVTLMGLISKHGILIVEVANELRKTGLSKREAIEEAASIRLRPILMTTAAMVFGVIPLVIASGAGAAGRYAMGLVIFTGLSIGTLFTLFVVPAMYMFIASRREEKAEPAPEEAAQH

SEQ ID NO: 74352 - DNA, 3120 bp, Chromobacterium violaceum ATCC 12472
  CDS (1)..(3120): transl_table=11
atgtggctgacccgcgtaagcgtgcgcaacccgtatttcgccgcagtattgatgatgacgctgatggtgctgggcctgttctcctggcagaagctggccgtggaggaaatgcccgacgtccgtctgccgatggcagtggtggagacgcgctataccggcgcctcgcccgaggtggtggagagcgaggtgagcaagccgctggaggaggcgctcaacaccgtcaacggcatcaaggaaatccgttcctattcttccgagggcagctctttcgtggtggccgagttcgagctgtccgtcgaccccatcgtcgcggtgcagaacgtgcgcgacaaggtggcgtcggtgcaggggcagttccgccgcgagatcggcacgccgtcggtgtcccaggtggaccccaacgacaagcccatgctgtcgctgtcgctgacctccagccagacccggccgcgcgagctgagcagctgggcggagaacgtgctgaagaagcggctgcagatggtggagggcgtcggcgacgtcagcctgatcggcgcggtgaaacgggaaatccgcatcgacatcgatccggtgcggctggaaggctccggcctgtcgctggccgatgtggccgacgccatcaaggccgccaaccaggatttcccggccggcaacgtgtccaccgcgcacaaggagtgggcgatccgggtgtccggcaagctgaagtccgccgacgacttcgccgcgctggctgtcggctatcgcaacggcacgccgatccggctggacgacatcgcggcggtggcggacacccaggcggaacaggacagcgtgtcgctggtcaatggtcagcccggcctgggcgtggacgtcaaggccgcgcgcggtgccaacgaggtggcggtggccgccggggtcaagaaactgctgaccgaactgaagccgcagatgccggccggtaccgagctgcgctacacctatgattccgccgaggacgtgaagaaggcgctgagcagcgtggagtcgatgctgctggaaggcgcggggctgaccatcctgatcgtgttcctgttcctgggcagctggcgcagcacggtgatcaccggcttgacgctgccggtggcgctggtgggcacgctgttcgcgatgcagttgatgggcttcacgctgaacatgctgacgctgttggcgctgtcgctgtccatcggcctgctgatcgacgacgccatcgtggtgcgggaaaacatcgtccgccacgccgcgcttggcaagagccattaccaggccgcgctggacggcaccaatgagatcggcctggcggtgctggccaccacgctgaccgtggtggcggtgttcctgccggtgggcttcatgagcggcatcatcggccgcttcttccatcagttcggcctcaccgtcgcggtggcggtgctgatctcgatgttcgtcagcttctcgctggacccgatgctgtcgtcgatctggcacgacccccaccaccacggcgatcgccactgcggcccgctgggtcggatgctggactggttcgaaacctcgctggaccgcctgtccgagcgctacgcggcagtgatccgctgggtgctcggccatcgcaagaccacattggcgctggcgctgggcgtgaccgtggccagcttcatgctggtgcccaggataggcggcgaattcgtgccggtgcgcgacagcggcaagatcaacgtggtgtaccagaccgcgtcgggctcctcgctggaatacacgacgctgaagggcaaggaactggcggccgcgctgtccggcatcaaggaaatccagaccgtgtcgctggatgtcggcgccggcaacttcggggccggcaagaacgacggccagctgacgctggacatcggcgacaagcgctcgcgccagcgcagcctggaccaggtcatcgccgacgcccgcaagcgggtgcagccggtggccggcgtgctgatcaaggcggtggccaacgacgagcagcagggcaagcccatcttcatcggcctgcgcggctccaatctggccgagctggacgcggtgtcgcgcgacatcatggcccgcatcgccaaggtgaagggcgtcaaggacatcgagtccaacctgaccgaaggcgatccgtcgcttagcctgacgctgaagcgcgacgcggcgctgagcctgggcgtggatctcaaccgggtgggcaacctgctgtccatgttgctggccggcaatgtggtgacgacctgggaggcgccggacggcgagaattacgacgtgcggctccgggtgccgaaggacgagcgccgccaggagctgctggaccagctgaaggtggccggcaaccgcgacgaaaacggcgcggcgcagatggtgccgctgtccacgctgatcgagacccggcagggcgtcagcccgcgccagatcaagcgcaccaatatgatgcgcgagatcagcatcctggccaatgtggagggccgcgacgtcggctcggcgatggccgacatcgacaagctgctggacggcacccagctgccgcagggcgtgcagcgcatgcaccgcggccagcagaaggacatggaggaaaccgtgggcaacgcgctgcgcgcgctgggcctgggcgtgatcttcatctacctgatcctggccgcgcagttccgcagcttcaccatgccggtaaccatcatggtggcgttgccgctggctttcggcggcgtgttcgttgcgctgttcctgtggggctccacgctgaacatgttctccatcatcggcatcatcatgctgatgggcctggtggccaagaacggcattctgctggtggacttcatcaatcgcgcccgccaggacggcatggcccgggaagacgccatcgtcgaggcgggcagggtgcggctgcgccccatcatgatgaccagcctggcgatgatcttcggcatgctgccattggcgctgggcaccggcgacggttcggagaccaatcggccgatggcacacgccatcatcggcggtctggccacttccacgctgttgaccctgctggtggtgccggtggtgtacacctatctggacggcctgcgcgtccgcatccgccgcctgctcggcggccgccgcgcgctgggcctgagcgaggccgggggcaaatag

SEQ ID NO: 74353 - protein, 1039 aa, Chromobacterium violaceum ATCC 12472
MWLTRVSVRNPYFAAVLMMTLMVLGLFSWQKLAVEEMPDVRLPMAVVETRYTGASPEVVESEVSKPLEEALNTVNGIKEIRSYSSEGSSFVVAEFELSVDPIVAVQNVRDKVASVQGQFRREIGTPSVSQVDPNDKPMLSLSLTSSQTRPRELSSWAENVLKKRLQMVEGVGDVSLIGAVKREIRIDIDPVRLEGSGLSLADVADAIKAANQDFPAGNVSTAHKEWAIRVSGKLKSADDFAALAVGYRNGTPIRLDDIAAVADTQAEQDSVSLVNGQPGLGVDVKAARGANEVAVAAGVKKLLTELKPQMPAGTELRYTYDSAEDVKKALSSVESMLLEGAGLTILIVFLFLGSWRSTVITGLTLPVALVGTLFAMQLMGFTLNMLTLLALSLSIGLLIDDAIVVRENIVRHAALGKSHYQAALDGTNEIGLAVLATTLTVVAVFLPVGFMSGIIGRFFHQFGLTVAVAVLISMFVSFSLDPMLSSIWHDPHHHGDRHCGPLGRMLDWFETSLDRLSERYAAVIRWVLGHRKTTLALALGVTVASFMLVPRIGGEFVPVRDSGKINVVYQTASGSSLEYTTLKGKELAAALSGIKEIQTVSLDVGAGNFGAGKNDGQLTLDIGDKRSRQRSLDQVIADARKRVQPVAGVLIKAVANDEQQGKPIFIGLRGSNLAELDAVSRDIMARIAKVKGVKDIESNLTEGDPSLSLTLKRDAALSLGVDLNRVGNLLSMLLAGNVVTTWEAPDGENYDVRLRVPKDERRQELLDQLKVAGNRDENGAAQMVPLSTLIETRQGVSPRQIKRTNMMREISILANVEGRDVGSAMADIDKLLDGTQLPQGVQRMHRGQQKDMEETVGNALRALGLGVIFIYLILAAQFRSFTMPVTIMVALPLAFGGVFVALFLWGSTLNMFSIIGIIMLMGLVAKNGILLVDFINRARQDGMAREDAIVEAGRVRLRPIMMTSLAMIFGMLPLALGTGDGSETNRPMAHAIIGGLATSTLLTLLVVPVVYTYLDGLRVRIRRLLGGRRALGLSEAGGK

SEQ ID NO: 74354 - DNA, 3129 bp, Chromobacterium violaceum ATCC 12472
  CDS (1)..(3129): transl_table=11
atgctggcgcgtttcttcatagaccgcccggtcttcgcctgggtgctggccatcgtcatcatgctggccggcctgttcgcgctgcgcgcgctgccggtgtcgcaatatccggacatcgccccgcccacggtgatggtcagcgccagctaccccggcgcctcggcccaggtggtggagaccagcgtgatccaggtgctggagcaggagctgaagggcctggacaatctgatgtatttcagctccaccagctcctcgtccggccaggccgagatcatgctcaccttccgccagggcgcgaatcccgacaccgcccaggtgcaggtgcagaacaaagtcagccagatgctggcgcggctgccgcagcaggtgcagcagaacggcctgtcggtgcagaagatgcagggcgacttcctgctgatcgcttccttttacgatatcagcggccagcgcggcgacaccgacatcgccgactggctggccagcaatatccaagacccattgagccgggtggacggcgtcggctcggtgcgggccttcggcgcgccgtacgcgatgcggatatggctggacccgcacaagctcaacagctacggcctgattccgtccgatgtcagcgccgccgtttccaagcagaacaccgaagtctcggtcggcgagctgggcgctttgccgtcgccgccgggccagcagctcaacgcgatggtcaccgcctggtcgcgcttgtccacgccggagcagttccgcggcatcgtcgtcaaggcgctgccggacggcggcgcggtgcggctgggcgacgtggcgcgggtggagctggggcaggaggattacggcagcagctcgcggctgaacggccatccggcctccggcctggcggtgatgctggcgccgggcgccaacgcgctggccaccgccgaggcggtgaaggcccgcgtcgccgagttgcagcgcaatttcccgcccggcatccgcgtcgcctatccggaggacaccacccattttgtccggctgtcgatacgcgcggtgatggaaacgctgctggaggcggtggcgctggtggtgctggtgatgttcgtgttcctgcgcaactggcgcgccacgctgatcccggcgctgacggtgccggtggtgctgctgggcaccttcggcgtgctggcggccgccggcttcggcatcaacacgctgacgctgttcggcatggtgctggccatcggcctgttggtggacgacgccatcgtggtggtggagaacgtcgagcgggtgatgcatgagcaaggcgtggacgcgcatgcggccaccgtccgctcgatgggcgagatcggcggcgcgctggtcggcatcggcctggtgctgggcgcggtgttcttgcccatggccttcttcggcggctcggtcggcgtcatctaccgccagttctcgatcaccatcgtcgcggcgatggcgctgtcggtgctgaccgcgctgaccttgacgcctgccttgtgcgcgacgctgctgcggccggaaaaaccatcggacaacggcccgctggccgcgttcgagcgccgcttcctgcgtctgcagtcggcctatgccgagcgctggctgccggcttggctgcgccgtcccttgcgcggcggcctggtctacctggcgctggccgccggcctggccgcgttgtatccgcaactgcccacggctttcatcccggacgaggaccagggcacggtgatggtgcagttcacgctgcccaccggcgccacccacgagcgcgccgacaaggtggcgcgcgcggtggagcagcatttcctggtgaccgagaaggccaatgtggaatcggtgtacatgctgtccggcttcagcttcggcggctccggccagaatgccggcatggctttcgtcgcgctgaaagactggtcgctgcggccgggcgccggcaacagcgcgcaggcgatcgccgaccgcgccaccgccgcgctggcctctcagcgcgacgccgaggtgttcggcatggtgctgccgcctatcggcggcctggggcagaccaacggcttcgaattctggctgcaggacgcgtcaggcatggggcgcgaaggcttggccaaagcgcgcgaccaattgctgaaggccgcgcagggcgacgacaggctgagcgcggtgcgctccggcgccgccgacgacaagccgcagctgcggttggacgtcgaccagagcaaggccgccgcgttggggctggatctggccaatgtcgccgacacgctgggcgcggcctggggcgggcgctacatcaacgattttgtcgaccgaggccgggtgaagaaggtgatgatgcaggccgacgcgccgtatcgttccaagcccgaggatctgggcctgtggttcgtccgcggcgcggacggcgcgatgacgccgttttccgccttcgcccgcgcgcgctgggaatacggcccggcgcagctgagccgctacaacggcttgccggcgctgccgctgtccggctcggccgccgccggaatcagttccggcgaggcgatgcgggcggtggaagcgatagccggcaagctgccgggcacccagtacgaatggagcggcctgtcctaccaggaccggttgtccagcggccagacgccgctgctgtacgcggtgtcgatattgttcgtctttctgtgcctggcggcgctgtacgaaagctggctggtgccgtgcgctgttatgacggcgattccgctcggcgtgctgggcgcggtgctggcggtgatggcgcgcggcctcgccaacgacatttacttccaggtgggcctgctggcgacgataggcctgtcggccaagaacgccattctgatcatcgagttcgccgaggcggcgatccggcgcggcgacgatgcgctgagcgcggcgctggccgccgcccgccaacggctgcggcctatcttgatgacctcgctggctttcggggtcggcgtggcgccgctggtctgggccggcgggccgggcgccggcagccagaacgccatcggcgcggcggtgctgggcggcgtgctgtccgccacgttgttgactctgttcttcgtgccgctggcgcatgtgttgatccggggcctggccggccgcgtcgcagagcggcgctggaagccggcggaggcgcggccatga

SEQ ID NO: 74355 - protein, 1042 aa, Chromobacterium violaceum ATCC 12472
MLARFFIDRPVFAWVLAIVIMLAGLFALRALPVSQYPDIAPPTVMVSASYPGASAQVVETSVIQVLEQELKGLDNLMYFSSTSSSSGQAEIMLTFRQGANPDTAQVQVQNKVSQMLARLPQQVQQNGLSVQKMQGDFLLIASFYDISGQRGDTDIADWLASNIQDPLSRVDGVGSVRAFGAPYAMRIWLDPHKLNSYGLIPSDVSAAVSKQNTEVSVGELGALPSPPGQQLNAMVTAWSRLSTPEQFRGIVVKALPDGGAVRLGDVARVELGQEDYGSSSRLNGHPASGLAVMLAPGANALATAEAVKARVAELQRNFPPGIRVAYPEDTTHFVRLSIRAVMETLLEAVALVVLVMFVFLRNWRATLIPALTVPVVLLGTFGVLAAAGFGINTLTLFGMVLAIGLLVDDAIVVVENVERVMHEQGVDAHAATVRSMGEIGGALVGIGLVLGAVFLPMAFFGGSVGVIYRQFSITIVAAMALSVLTALTLTPALCATLLRPEKPSDNGPLAAFERRFLRLQSAYAERWLPAWLRRPLRGGLVYLALAAGLAALYPQLPTAFIPDEDQGTVMVQFTLPTGATHERADKVARAVEQHFLVTEKANVESVYMLSGFSFGGSGQNAGMAFVALKDWSLRPGAGNSAQAIADRATAALASQRDAEVFGMVLPPIGGLGQTNGFEFWLQDASGMGREGLAKARDQLLKAAQGDDRLSAVRSGAADDKPQLRLDVDQSKAAALGLDLANVADTLGAAWGGRYINDFVDRGRVKKVMMQADAPYRSKPEDLGLWFVRGADGAMTPFSAFARARWEYGPAQLSRYNGLPALPLSGSAAAGISSGEAMRAVEAIAGKLPGTQYEWSGLSYQDRLSSGQTPLLYAVSILFVFLCLAALYESWLVPCAVMTAIPLGVLGAVLAVMARGLANDIYFQVGLLATIGLSAKNAILIIEFAEAAIRRGDDALSAALAAARQRLRPILMTSLAFGVGVAPLVWAGGPGAGSQNAIGAAVLGGVLSATLLTLFFVPLAHVLIRGLAGRVAERRWKPAEARP

SEQ ID NO: 74356 - DNA, 3102 bp, Chromobacterium violaceum ATCC 12472
  CDS (1)..(3102): transl_table=11
atgaatccctcccgtccgttcattatgcggccggtggccaccaccttgctgatggtggccatcctgctgaccggcctggtggcctggcggatgctgccggtatcggcgctgccggaagtcgattacccgaccatccaggtggtgacgctctaccccggcgccagtcccgacgtgatgacctcgtcggtcaccgccccgctggagcgccagttcggccagatgccgggcctgtcgcagatgtcgtcgtccagctccggcggcgcctcggtgatcacgctgcagttcagcctggacctgacgctggacgtcgctgagcaggaagtgcaggcggcgatcaacgccgccggcaacctgctgccgtccgacctgcccagcccgccggtctacaacaaggtcaacccggccgatacgcccatcctgaccatcgccgtcagttcgcccaccatgccgctgaccaagcttgaggacatggtggacacccgtctggcgcaaaagctgtcgcaggtgcagggtgtcggcctagtcagcatcagcggcggccagcgcccggccgtgcgcatccagagcaatcccaaggcgctggcctcgcgcgggctgacgctggaggacatccgcaccgccatcgccagcgccaacgtcaaccaggccaagggcagcttcgacggcccgagccaggcctccaccgtggacggcaacgaccagctgcagtccgcggacgagtacaagaacgtcatcatcgcctaccagaacggcgcgccggtctacctcagggacgtggccaaggtggtggaatcggccgagaacacccggctggccgcctggtccggcaccacgccgtccatcatactcaacgttcagcgtcagcccggcgccaacgtgatccaggtgaccaaccgcatcaagtcgctgctgccgcagttgcagggcacgctgcccggctcggtggacgtgcacgtgctgagcgaccgcaccgtgaccatccgcgcctcggtggaggacgtggagttcgagctgatgctggccatcgcgctggtggtgatggtgatcttcgtcttcctgcgcaacgtgccggccaccatcattccggcggtggcggtgccgctgtcgctggtgggcaccttcggcgtgatgtacctgaccggcttttccatcaacaacctgacgttgatggcgctgaccatcgccaccggcttcgtcgtcgacgacgccatcgtgatgatagagaacatcgcccgctacatcgaggaaggcgacaagccgctggaggcggcgctgaagggctccaaacagatcggcttcaccatcatctcgctgaccatctcgctgatcgcggtgctgatcccgctgctgttcatgggcgacgtggtgggccggctgttccgcgaattcgccatcacgctggcggtgtccatcctgatctccgccttcatctcgctgacgctgacgccgatgatgtgcgcgcggttgctcaagcacgtgccagaggaaaagcagggccgcttctaccacgccagcggcaagttcttcgacgacatcatcgccggctacggcaagatgctggcctgggtgctggacaggcagaagaccaccctgctggtggcggtcggcaccgtggcgctgaccgcggcgctgtatgtctgggtgcccaagggcttcttcccgctgcaggacaccggcgcgatacaaggcatcagcgaggcgtcgcagtccatctccttcagcgcgatggccgaccgtcaggaaaaattggccgaggcgctgctgaaagacccggcggtggacagcctgtcttccttcatcggcgtcgacggcaccaacgccacgctgaacagcggccgcctgctgatcaacctcaagcccaagggagagcgcgacgacatccgcaccgtgctcgcgcggctgcagcagcgcgccggcgacgtgccgggcatgtcgctgtacctgcaggcggtgcaggacctgaccatcgacgcccgcgtcagccgcacccaataccagttcacgctgcaggccaccagccaggacgatctgtcgacctgggtgcccaagctggtgcgccggctgcagcaagagccagcgctggccgacgtcgccagcgacctgcaggacaagggcctgcaagcctacgtcaacatcaaccgcgacgtcgcctcccgcctgggcgtcaccaccgccgcgatcgacaacgcgctgtacgacgccttcggccagcggctgatctccaccatcttcacccagaccaaccagtaccgcgtggtgctggaggtggacaaggaccaccagcgcgatccgctgtcgctgaagggcatctacgtgcccaccgccagcggcggaccggtgccgctgaacgcggtggccagcatagaggagcgtccgacctcgctggcgatcaaccacctgggccaattccccaccgccaccatttccttcaacctgaaagctggcgcgtcgctgggcgaggcggtggacgccatccgccaggccgaagccgagctgggcctgccggccagcatggacaccaagttccagggcgcggccatggccttccaggcgtcgctgtccaacacgctgtggctgatcctggccgccatcgtcaccatgtacatcgtgctgggcgtgctgtacgagagctatatccatccgatcacgattctctccaccctgccctcggccggcatcggcgcgctgctggcgctgatggtgtccggcaccgacctgtcggtgatcgccatcatcggcatcatcctcctgatcggcatcgtgaagaagaacgccatcatgatgatagacttcgcgctggaggccgagcgcgaacagggcatggcgccgcgcgaagccatctaccaggcctgtctgctgcgcttccgccccatcctgatgaccacgatggcggcgctcttgggcgcgctgccgctgatgatgggcggcggcatgggctcggagctgcgccagccgctgggcatcaccatggtgggcggcctgatggtcagccaggtgctgacgctgttcaccaccccggtgatctacctggccttcgaccggctggcgcggcgcttcggccgcaaggacaagcccgagcttgcggaagaggtggacgcatga

SEQ ID NO: 74357 - protein, 1033 aa, Chromobacterium violaceum ATCC 12472
MNPSRPFIMRPVATTLLMVAILLTGLVAWRMLPVSALPEVDYPTIQVVTLYPGASPDVMTSSVTAPLERQFGQMPGLSQMSSSSSGGASVITLQFSLDLTLDVAEQEVQAAINAAGNLLPSDLPSPPVYNKVNPADTPILTIAVSSPTMPLTKLEDMVDTRLAQKLSQVQGVGLVSISGGQRPAVRIQSNPKALASRGLTLEDIRTAIASANVNQAKGSFDGPSQASTVDGNDQLQSADEYKNVIIAYQNGAPVYLRDVAKVVESAENTRLAAWSGTTPSIILNVQRQPGANVIQVTNRIKSLLPQLQGTLPGSVDVHVLSDRTVTIRASVEDVEFELMLAIALVVMVIFVFLRNVPATIIPAVAVPLSLVGTFGVMYLTGFSINNLTLMALTIATGFVVDDAIVMIENIARYIEEGDKPLEAALKGSKQIGFTIISLTISLIAVLIPLLFMGDVVGRLFREFAITLAVSILISAFISLTLTPMMCARLLKHVPEEKQGRFYHASGKFFDDIIAGYGKMLAWVLDRQKTTLLVAVGTVALTAALYVWVPKGFFPLQDTGAIQGISEASQSISFSAMADRQEKLAEALLKDPAVDSLSSFIGVDGTNATLNSGRLLINLKPKGERDDIRTVLARLQQRAGDVPGMSLYLQAVQDLTIDARVSRTQYQFTLQATSQDDLSTWVPKLVRRLQQEPALADVASDLQDKGLQAYVNINRDVASRLGVTTAAIDNALYDAFGQRLISTIFTQTNQYRVVLEVDKDHQRDPLSLKGIYVPTASGGPVPLNAVASIEERPTSLAINHLGQFPTATISFNLKAGASLGEAVDAIRQAEAELGLPASMDTKFQGAAMAFQASLSNTLWLILAAIVTMYIVLGVLYESYIHPITILSTLPSAGIGALLALMVSGTDLSVIAIIGIILLIGIVKKNAIMMIDFALEAEREQGMAPREAIYQACLLRFRPILMTTMAALLGALPLMMGGGMGSELRQPLGITMVGGLMVSQVLTLFTTPVIYLAFDRLARRFGRKDKPELAEEVDA

SEQ ID NO: 74358 - DNA, 3105 bp, Chromobacterium violaceum ATCC 12472
  CDS (1)..(3105): transl_table=11
atgattccgtccgcccccttcatccgccgcccggtggccaccacgctgctgacgctggccatcctgctggccggcgccatcgccttcaagctgctgccggtgtcgccgctgccgcaggtggacttccccaccatctcggtgtcggccaagctgcccggcgccagcccggaaacgatggcggccacggtggccacgccgctggagcgcgcgctgggccgcatcgccggcgtcaccgagatgacgtcgaccagctcgctgggctccaccaacgtcacgctgcagttcgacctggaccgcgacatcaacggcgccgcgcgcgacgtgcaggccgccatcaacgccgcccgctcgctgctgcccaccggcatgccgtccaacccgacctaccgcaaggtgaacccggccgacgcgcccatcatgatcctggcgctgacctcggacaccctgagccgcggccagatgtacgacgcggccgactccatcctggggcagaaactgtcgcaggtggacggcatcggcaacgtgatcatcggcggcggcgcgcagccggcggtgcgggtggaaatgaacccgacgcagctgaaccattacggcatcggcatggagacggtgcgcgccgccatcaccagcaccaacgccaaccggcccaagggtttcctggaaaacgacgagcgccactggcaggtgcaggccaacgaccaggccggcaaggccagcgactacctgccgctgatcgtcagctacaagaacggcagcgcggtgcgcatctcggacgtggccgaggtcaaggattcggtggtggacctgcgcaacgccggcatgctgggcaagcagccggcggtgatgctgatcctgttccgccagcccggcgccaacatcatcgaaaccgtcgatcgggtgaaggcgatgctgccgcagttgcaggcgtcgatcccgccgtcgatcaagatcaaccaggtgatggaccgcacgcccaccatccgcgcctcgctgtccgaagtagagcgctcgctggcgatctcgatcgcgctggtgatcctggtggtgttcctgttcctgcgcaacggccgcgccaccgccatcccggccatcaccgtgccggtgtcgctggtgggcaccttcgccatcatgtacctggccggcttttcgctgaacaacctcagcctgatggcgctgaccatcgccaccggcttcgtcgtggacgacaccatcgtggtgctggagaacatctcccgccatatcgagaatggcatgcagccgttccaggcggcgctgcgcggcgcgcgcgaggtcggcttcaccgtgctgtcgatgagcatctcgctgatcgcggtgttcattcccatcctgctgatgggcggcatcatcggccggctgttccgcgaattcgcggtcacgctgtcggtggccatcatggtgtcgctgctggtgtcgctgaccaccacgcccatgctgtgcgcgcgctggctgaagacgcacgacgcgcacaaggctccgggcaagctgttccaatggagcgagcgcgccttcgacgcgatgctgaacggctaccgccgctcgctgtcctgggcgctgcgccacggccggctgatgatggccgtgctcggcgccaccatcgcgctgaacgtgttcctgtacacggtgattgccaagggtttcttcccgcaacaggacaccggccgcctgaccggcatgatcaaggccgaccagagcatctccttccaggcgatgcagggcaagctgcagcgcttcatcaacgtggtcggcgccgatccggcggtggacaaggtggtgggcttcaccggcggcggccagcgcaacagcgccaatatgttcgtcagcctgaagccgctggccgaacgcaaggaaaacgcagatcaggtgatcgcccggctgcgcaagaaactgtccggcgagcccggcgcccagctgttcctgcaatcggtgcaggacatccgcatcggcagccgctccagcaacgcgcaataccagtacacgctgcagggcgacgacctgaacgagctgcgcgaatggacgcccaaggtgcagctggcgatgagcaagattcccttcctggccgacctcaacaacgaccaggaggtgaagggcctgcaaaccacgctcgccttcgaccgcgcggcgatggcgcggctggggctgacccaggcccaggtggactcggtgctgaacgacgctttcggccagcgccaggtctccaccatctacaatccgctcaaccagtaccacgtggtgctggaagtggcgccgcagtactggcagggccctgaaggcctgcgcgacatctatctgcagacgccgggcggccagccgacgccgctgtcggccttcgccagctggcaaccgacccatgccgcgctgtcggtcaaccaccagagccagttcgcggccaccaccatctccttcaacctgccgcccggctactcgctgtccgacgccacccaggcgatagacgcggccatcgccgacatcggcctgcccagcggcatccacgccagcttccagggcacagccaagtcgttccaggcttcgctggacagccagccggtgctgatcctggcggccctggtggcggtgtacatcgtgctgggcatgctgtacgagagcgtggtgcacccgatcaccatcctctccaccctgccctccgccggcgtcggcgcgctgttggcgctgatggccaccggcggcgagttcaacatcatcgcgctgatcggcatcctgctcttgatcggcatcgtcaagaaaaacgccatcatgatgatagatttcgcgctcacggcggagcgcgagcagggtctgccgccgcaggaagccatcctgcaggcctgcctgctgcgcttccgccccatcatgatgaccacgatggccgccctgttcggcgcgttgccgctggcgctgggccgcggagacggcgccgagatgcgtaccccgctgggcatctccatcgtcggcggcctgctgctcagccagctgctgacgctgtacaccacccccatcgtctacctgtacctggaccgcttccgcctgtggtgcctgaagtggcgcggcggccgcggcccggccttggccgccggcaaagaggaatga

SEQ ID NO: 74359 - protein, 1034 aa, Chromobacterium violaceum ATCC 12472
MIPSAPFIRRPVATTLLTLAILLAGAIAFKLLPVSPLPQVDFPTISVSAKLPGASPETMAATVATPLERALGRIAGVTEMTSTSSLGSTNVTLQFDLDRDINGAARDVQAAINAARSLLPTGMPSNPTYRKVNPADAPIMILALTSDTLSRGQMYDAADSILGQKLSQVDGIGNVIIGGGAQPAVRVEMNPTQLNHYGIGMETVRAAITSTNANRPKGFLENDERHWQVQANDQAGKASDYLPLIVSYKNGSAVRISDVAEVKDSVVDLRNAGMLGKQPAVMLILFRQPGANIIETVDRVKAMLPQLQASIPPSIKINQVMDRTPTIRASLSEVERSLAISIALVILVVFLFLRNGRATAIPAITVPVSLVGTFAIMYLAGFSLNNLSLMALTIATGFVVDDTIVVLENISRHIENGMQPFQAALRGAREVGFTVLSMSISLIAVFIPILLMGGIIGRLFREFAVTLSVAIMVSLLVSLTTTPMLCARWLKTHDAHKAPGKLFQWSERAFDAMLNGYRRSLSWALRHGRLMMAVLGATIALNVFLYTVIAKGFFPQQDTGRLTGMIKADQSISFQAMQGKLQRFINVVGADPAVDKVVGFTGGGQRNSANMFVSLKPLAERKENADQVIARLRKKLSGEPGAQLFLQSVQDIRIGSRSSNAQYQYTLQGDDLNELREWTPKVQLAMSKIPFLADLNNDQEVKGLQTTLAFDRAAMARLGLTQAQVDSVLNDAFGQRQVSTIYNPLNQYHVVLEVAPQYWQGPEGLRDIYLQTPGGQPTPLSAFASWQPTHAALSVNHQSQFAATTISFNLPPGYSLSDATQAIDAAIADIGLPSGIHASFQGTAKSFQASLDSQPVLILAALVAVYIVLGMLYESVVHPITILSTLPSAGVGALLALMATGGEFNIIALIGILLLIGIVKKNAIMMIDFALTAEREQGLPPQEAILQACLLRFRPIMMTTMAALFGALPLALGRGDGAEMRTPLGISIVGGLLLSQLLTLYTTPIVYLYLDRFRLWCLKWRGGRGPALAAGKEE

SEQ ID NO: 74360 - DNA, 3135 bp, Wolinella succinogenes DSM 1740
  CDS (1)..(3135): transl_table=11
atgtcaaagttttttatctataggcccaattttgcttgggtgattgcgattttcatctctctagcgggaatattgtcgattcctaaactaccaatcgctcaatttcctgtggtggctccccctcaaattagcatcagtgcaagttatccaggggcttctgcgaagatggttgctgagacgattacaagtattatcgaagaggagatcaatggggttaaaaatcttctctattacgaatcatctagcagctctgatggctcttcggaggtgacggtgacttttaaatcagggacagattccgatttggctcaggttgatattcaaaaccgcctcaaaaaagcagaagccagattgccgcaagtggtcatcaatcagggtgttcaggtagagcaggctaatgccgactttctcatgatgtacgccctcaactacaaagagggggcttcaggcgatttggtcaccttgagtgactacgcggtgaggaatatcaacaatgaaattcgccgtcttcctggagtgggtcgcgtccagttctttagctctgaggcggctatgagggtttggattgaccccatcaaactgttgggctatggactctccgtctcggatgtgactcaggctataaaagcccaaaaccttcaggtatcagcaggtgctctagggaggaatcccacagatggggtgcaggagatagaggcgatgctaaatgtcaggggcaacctagaaaatacagaggagttcgaaaaaattatactcaaggccaatttggatggctcaactgtctcactctctgacgtggcgcgccttgaaataggcaatttggattacggtttttccaccagcctgaatggaaaagaagcgattgctgcggcaattcagctcgctcctggggctaatgccatcaaaaccgctggattggtcaaggagaaaatggcgcaactctcagcagggtttcctgaggggattgaatactcgattccttatgatacttcgcgctttgtagagattgctatccaaaaggttatacagacacttttagaggcaatcgtgttggtctttttcgtgattttgctttttttgcagaatcttcgttacaccctcattccttccattgttgtccctgtctgtcttttgggtacattggcggtgatgaatgctctaggcttctctgtcaatatgatgacaatgtttggcatggttttggccattggaatcttggtggatgatgcgattgtagtggtggagaatgtcgagcgtatcatgagggaagagagaatctcacccaaagaggcaaccctcaaagcaatgaaacaggtctcaggggcgatcgtggggatcacttctgtactaacggcagtttttctccccttgggttttatggagggctcagtgggggtcatttatcgtcaattctcgctttcgctagcggtttcgattctcttttctggatttcttgcactcacgctcacgccagctttgtgcgcaacgattcttaagccaatcaagagcgaaggggaagaagaggggaaaaaagggaagttttttgctggatttaacaagttgtttgcggctatcggagagagatatgcaggcctcaataagaagaatctcaagcgtcctagtagaattatgctcctttatgtagggctgattggagttttggcggcactctatattcctttgcctcaaagctttgttcctgatgaggatcaagggtattttctggtggatattcagttgcccgcaggagcaaccacccccaggacgatgaacgccacggatgatgtggaggcgtatgctttggggcgcagctccatgcaggatgtgattatcgtgaggggctttagcttttctggggtgggatctaatgcggcggtggcatttcctgttttgaaggattggtcggagcggaatgggatggaatcggtcgaaaatgaggtgatggcttttggggccaagtttgcaggctatgaagaagccaatatcatggcgatcaatcctccacccattgaaggactgggtacgtcaggtgggttttcgttgcgtcttcaagatcgaggagggattggaatggaggcattgcttcaggcgacaaatgaccttttggctaaactctccacctcccctcaaattgcctatgcctatatggaaggacttggcgatgcccctaggctgagtttggaaatcgacaggattaaggcggagagtttagggcttagctttgaagtgataggagatacgctctcctctgtctttggttcgtcgattctaaatgacttcccctatcaagggcgtatgcagcgagtcgtggttcaggcggacgccccctttcgtatgaccccttgggcgctagaagatctctatcttgtgagtcgcatgggggagcaggtggcgctttcaagcgtggtgcactccagatgggatcgagcgcccattcagatcgtgcgttacaacggttaccctagcgttcgcatcactggtgatgcgtcgcctcttcacagtacgggagccgtgatggcgctcgttgaggagatcatcaaagagctccccaaggggattggttatgagtggacgggactctctttgcaagagagagaatcgggggcacaagcacctagactttttgcactctcgattctggtggtttttttgattttggtggtactctatgagagctggttattgcctttttcggtgatgctgattgttcctgttggagcttttggagcggtcttggcggcttggataggcgggatgagcaacgatgtctactttaaggtgggcttggtgacgatcatcggcttggcggctaaaaatgcgattttgattgtggagtttgccaaagagatcagagccgagggtcatagcgttgtcgaatcggcactgaaggcggcttctcttaggtttcgccctatcgtgatgacctctatggcctttattttaggagttttacctttggtgttagcccaaggtgcgggagccgccagtcaaaagtccattgggacgggggtgatgggagggatgctctccgcgacgcttcttggagtgcttttggtgccaattttttatgtctgggtcttttctttagcggaacctagagcaaagaatcaagggggagaaaaaggccatgagtag

SEQ ID NO: 74361 - protein, 1044 aa, Wolinella succinogenes DSM 1740
MSKFFIYRPNFAWVIAIFISLAGILSIPKLPIAQFPVVAPPQISISASYPGASAKMVAETITSIIEEEINGVKNLLYYESSSSSDGSSEVTVTFKSGTDSDLAQVDIQNRLKKAEARLPQVVINQGVQVEQANADFLMMYALNYKEGASGDLVTLSDYAVRNINNEIRRLPGVGRVQFFSSEAAMRVWIDPIKLLGYGLSVSDVTQAIKAQNLQVSAGALGRNPTDGVQEIEAMLNVRGNLENTEEFEKIILKANLDGSTVSLSDVARLEIGNLDYGFSTSLNGKEAIAAAIQLAPGANAIKTAGLVKEKMAQLSAGFPEGIEYSIPYDTSRFVEIAIQKVIQTLLEAIVLVFFVILLFLQNLRYTLIPSIVVPVCLLGTLAVMNALGFSVNMMTMFGMVLAIGILVDDAIVVVENVERIMREERISPKEATLKAMKQVSGAIVGITSVLTAVFLPLGFMEGSVGVIYRQFSLSLAVSILFSGFLALTLTPALCATILKPIKSEGEEEGKKGKFFAGFNKLFAAIGERYAGLNKKNLKRPSRIMLLYVGLIGVLAALYIPLPQSFVPDEDQGYFLVDIQLPAGATTPRTMNATDDVEAYALGRSSMQDVIIVRGFSFSGVGSNAAVAFPVLKDWSERNGMESVENEVMAFGAKFAGYEEANIMAINPPPIEGLGTSGGFSLRLQDRGGIGMEALLQATNDLLAKLSTSPQIAYAYMEGLGDAPRLSLEIDRIKAESLGLSFEVIGDTLSSVFGSSILNDFPYQGRMQRVVVQADAPFRMTPWALEDLYLVSRMGEQVALSSVVHSRWDRAPIQIVRYNGYPSVRITGDASPLHSTGAVMALVEEIIKELPKGIGYEWTGLSLQERESGAQAPRLFALSILVVFLILVVLYESWLLPFSVMLIVPVGAFGAVLAAWIGGMSNDVYFKVGLVTIIGLAAKNAILIVEFAKEIRAEGHSVVESALKAASLRFRPIVMTSMAFILGVLPLVLAQGAGAASQKSIGTGVMGGMLSATLLGVLLVPIFYVWVFSLAEPRAKNQGGEKGHE

SEQ ID NO: 74362 - DNA, 3180 bp, Gloeobacter violaceus PCC 7421
  CDS (1)..(3180): transl_table=11
atgttcgtcaattattttgtccaacggcctatcctcaccatcgcctgctcggtaatcatcgtgctgggcgggtgggtcagcatccggacgctgcctgtcgatcaataccccgacattgctcttccccaggtggtcgtaacggcccgttacgacggggcgagcgccgaggtggtcgagtccacggtcaccaccccgctggagcagcagatcaacggggctgagagcatgcggtacatgacctcgaccagcagcaacgacggcaccagcacaatcaccgttacctttgacctggcgcgcaacatcgacgatgcggccatggacatccagaaccggctcaccgcggtccagggccgtctgcccgaggaggtgcgccgcacaggggtgacaatccgcaaaaatgcgagccaggtcaccgtcgccttcggcctctacgccaaaaacaacgaatacgacaatactttcatcagcaactacgcagacctctacatcagcgatgccctccggcgggtcaaaggggtgggcgatgtgcggatttttggcgaacgccgctactcgatgcgtctgtggctggatgccgaccggctcgctgctcgccgcctgagtgcggtggatgtcgtgcgtgccctggagacccagaacctgcaggtcggtgccggccaggtgggccaaccgccgtcgctggacggacagccctaccagatcagcgtgcgggctgtgggtcgcctgaaaagccccgcccagttcgacaatctcattctcaaacggggggcagacggcgcgcttgtgcggctgaaggacgtcgggcgcaccgaactgggagctgaagattacaccactttcttgcgctttacgggtagaaacgccgtgggtatcgccgtctctcaactgcccggggccaacaccctcgatgtctaccgcgaggtcaaagctgaactggatcggcaggcccgcgctttcccacccggtctcgaatacgaaatcgccttcgacagcgcctcgatggtcgacgaatccatccatgaggtcgtcaaaaccctcattgaggcggttgtgctggtggtagcggtgatgttcatctttttgcaggactggcgcggcacgctcataccggcgatcgccattcccgtctcgctggtgggcacgttcatcttcgtcaagcttctgggcttttcgatcaacacgttgaccctgttcggcatcaccctcgcagccggcctggtcgtcgacgatgcgatcgtcgtggtcgagaacatcgtgcgctacagccgtgagcggggattgacagtgcgcgccgccgcccccgaggctatgcgcgaagtcttcggcgcggtcattgcgacctcgctggtgctcgtggcggtcttcgtgccggtcgctttttttccggggaccgccggacggctctatcagcaattcgccctgacgctcaccttctcgattgccctgtcgacttttatcgccctcacgctgactcctacactctcagcgctgctgctgcgcgccgaaccgccgcgccactggctgttcgaccggatcaacgaccttatcgattggctgcggcgcggttatgcccgttcgctggggtttgcgttgcgctttcgatctgcgatgctgggggttttcgtctgcctgctgggtctggcctggtggctgtttggaaaagttcccccgggcttcgtccccaacgaggaccagagctacttcgtcgtgttcgtgcagtgtccggaaggaagctcgctcgactacaccaacaaggtcatgctccaggtggagcaggagctgcgcaagctccctgaactggccagaatgttcgccatcggcggctacagccccagcggcaacgctcccaacaaagccacgatcttcccgcacctgctgccgcttgccgaacgccgccagccgagccagtccgtcgacgcgattatcgacaaggtgcgcgggccgctctcgcgcatcccaggagcgacggtggcggccttcccgatgcccgccatccagcagggcgtcggtcagttcggcggttttcaactccaggtgcaggaccagcgcaacctcgggctggagaccttggccggggtgacccgcaccctggtcgaacagggcaatgcccaaccggggttgagcggcttgttctcaagcttcagcatcaacgatccgcagttggtggtcgaggtgaaccgagagaaggcggaggccctcgccgttgccccagacgaggtgctcaaggccctgcagatctacatgggttcgctgtatgtcaatgatttcgagatgttcaaccgcccctaccgcgtctacgtgcaggccgaccgccgctttcgctccacaccccaggatctgcggcgcttctacgtccgttcgcagaccggcgcgatgattccgctcggcaacctggtcaccgtgagccggaccgtcgctccccaaatcatcaaccactacaatatgctccgctcggcggaagtgaacggtgccccggctgagggcttcagctccggtcaggccatcgagcaaatgcaaaaattggcggagcaggtgctgccccagggtatacgtttccagtggtcgggagtgtctcttgagcagatcgaatccgggaacaaggcactatttatcttcgtgctgggtgtcgtcttcgtcttcctggtgctggccgcccaatacgagagcctgaccgacccgctggtgatcatgctctcggtgccgctggccatcgtcggtgccctgggggcccaggccctgcgcggcctcgaaaacgacatctactgccagatcggtctggtcatgctcatcggcctggccagtaaaaacgccatcttgattgtcgagtttgccaatcagctgtgcaaagagggcctcacccgcatccaggcggtgagcaaggcggctcaaatccgcctgcgacccatcttgatgacctcgttcgccttcattctcggggtggtgcccctggtgatggcggagggggccggggcagccggtcgccaatcgctgggcactgccgtcttcggcggcatgctcgtctccaccgctttgagtctttacattgttccggtgctctacattgtcatcggtgccctgcgcgaacgattcaaaggcgatagaaccgcaccagacctcctaacgcacgattcttccacccagtccaatgcgctggaaatacccagcccctcccagaaatag

SEQ ID NO: 74363 - protein, 1059 aa, Gloeobacter violaceus PCC 7421
MFVNYFVQRPILTIACSVIIVLGGWVSIRTLPVDQYPDIALPQVVVTARYDGASAEVVESTVTTPLEQQINGAESMRYMTSTSSNDGTSTITVTFDLARNIDDAAMDIQNRLTAVQGRLPEEVRRTGVTIRKNASQVTVAFGLYAKNNEYDNTFISNYADLYISDALRRVKGVGDVRIFGERRYSMRLWLDADRLAARRLSAVDVVRALETQNLQVGAGQVGQPPSLDGQPYQISVRAVGRLKSPAQFDNLILKRGADGALVRLKDVGRTELGAEDYTTFLRFTGRNAVGIAVSQLPGANTLDVYREVKAELDRQARAFPPGLEYEIAFDSASMVDESIHEVVKTLIEAVVLVVAVMFIFLQDWRGTLIPAIAIPVSLVGTFIFVKLLGFSINTLTLFGITLAAGLVVDDAIVVVENIVRYSRERGLTVRAAAPEAMREVFGAVIATSLVLVAVFVPVAFFPGTAGRLYQQFALTLTFSIALSTFIALTLTPTLSALLLRAEPPRHWLFDRINDLIDWLRRGYARSLGFALRFRSAMLGVFVCLLGLAWWLFGKVPPGFVPNEDQSYFVVFVQCPEGSSLDYTNKVMLQVEQELRKLPELARMFAIGGYSPSGNAPNKATIFPHLLPLAERRQPSQSVDAIIDKVRGPLSRIPGATVAAFPMPAIQQGVGQFGGFQLQVQDQRNLGLETLAGVTRTLVEQGNAQPGLSGLFSSFSINDPQLVVEVNREKAEALAVAPDEVLKALQIYMGSLYVNDFEMFNRPYRVYVQADRRFRSTPQDLRRFYVRSQTGAMIPLGNLVTVSRTVAPQIINHYNMLRSAEVNGAPAEGFSSGQAIEQMQKLAEQVLPQGIRFQWSGVSLEQIESGNKALFIFVLGVVFVFLVLAAQYESLTDPLVIMLSVPLAIVGALGAQALRGLENDIYCQIGLVMLIGLASKNAILIVEFANQLCKEGLTRIQAVSKAAQIRLRPILMTSFAFILGVVPLVMAEGAGAAGRQSLGTAVFGGMLVSTALSLYIVPVLYIVIGALRERFKGDRTAPDLLTHDSSTQSNALEIPSPSQK

SEQ ID NO: 74364 - DNA, 3153 bp, Gloeobacter violaceus PCC 7421
  CDS (1)..(3153): transl_table=11
atgttcgtcgattttttcatccgtcggccaattttcgccggggtgtgcgccgtcatcatcttgctggccggcttggtgagcatccccagcctgcccatcgcccagtacccggagatcagcccgccccaggtgacggtcactgccacttacgtcggcgcctcggcggaggtggtcgaagagacggtcaccaccttgctggagcggcaaatcaacggcgtggagggcatgcgctacatcacctccaactccagcgaccagggagtgagcacgatcgtcgtcaccttcgagctggagcgcgacaaggacatcgccgccgtcgatgtgcaaaaccggatctcgacggtgctgccgcaactgcccagtctggttcagcagacaggggtgcagatcagcaagcagtcgggagcgcctttgctggggattggcctgtactccgaaaaaggccaatacaccaacgatttgttgagcaactacgctgacctgtacttagtggacgccctcaagcgcgtccccggcgtcggcaatgtgcagatcttcggtgagcggcgctactcgatgcggctgtggctcgatcctaaccgcctcgccgcccgcagtctcaccgcccaggatgtcgtcaacgccgtcaacgagcagaacgtccaggtgggggccgggtcgatcggccagccgcctctcgacaagtcccagacgtttcagatcggcctgcgggtgctcgggcggctcaaggaaccgggcgaatttgccgacctggtgatccgcaccaacgccgacggctcgctcacccgcctcaaagacgtcggccgcgccgagttgggcgccgaaaactacaactcgtttttgcgttttcgcggccaggacggcgtcggcctgggcatctatccgattcccggctccaacgccctcgacatcggcaaggcggtcaaagcgcgcatggcagaactcgaaaagagcttcccgcccggcgtgcagtaccgggtagccttcgatacgaccgactttatcgaagaatcggcggcggaggtgatcgagactttgatcatcgccatcctgctggtggtgctggtgatgttcatcttcctgcaggactggaagagcaccctcatcccggccatcaccatcccagtctcgctggtgggtacctttatcttcgtgaagctgttcgacttttcgatcaacagtttgacgttgtttggtctgactctggccacaggactggtggtcgacgacgccatcgtcgtcatcgagaatatcgcccgaaccagcaaagagcagtgcaaagaccccaaagagtgcgcctccgacgcgatgcgcgaggtgaccgcggcggtcatcgccatcgccctggtgctgatggcggtgttcgtcccggtggccttcttcccggggaccaccggacagctctacaagcagttcgccctcaccatcgtcttttcgatcgtcatttcgacttttaacgccctcaccctcaccccggccctggcggcgttgctgtcgaccgggcaggtgggcgagtcgcgctttttcttgttccgttggttcaacagcggctttgaggcgttcaaaaacggttatctgcgggtgctggagatactcacccgcttcaagacagtggtggtgctggtgtttatcggcctgctcggcctgacggcgtggttatttgtaaaggtgccgaccgccttcttgccggaagaagaccagggttacttcatcaccctcgtccaggcgccgcagggggtctcgatcaactacaccagcgacgtgatgcgccaggtggagaagattttgctggcgcaggaggaggtggagggcaccttcgcaataggcggcttcggcttcagcggcagtgccgccaacagcggcgtcatctttaccaccctcaagccctggtccgaacggcacaagcccgaggagcagatgctgccgtttatcaaccgggtgcgcggaccactgctgggcatcaaagaagcgctcgtcattcccttcaacgctcccaccatccagggcctcagcgcctttggcggctttgcttttgagctgcaagaccgcggcaacaacggcatcgaagcgctttcggccaccgcccaggaactgatcgccaagggcaacgccacccccggcctgcaggggctgtttaccaccttcaaccccaactcgccccagatcgtcattgaagtcgaccgcaacaaggccaagtctttgaacgtgcccctctcggagatcttcaacaccctgcagacctatctcggatcgcgctacgtcaacgacttcaacctgtttggccgcacctaccgcgtctacgtgcaggccgatgaaaaattccgcgccaacccccgcgacatacgtgccctttacgtgcgctccacctccggccgcatggtctcgatgggcgaactggtgagcaccgagccggtgaccgcaccctcgatcgtcacccactacaacctgtttcgcaacgtcgaaatcaccggcaacgccgccccgggattcagttccggccaggcgatcgcggcgatggagaaactggcggcagagacgttgcctgccagcatgggcttcgagtggtcaggcatctcgctggaggaaaaagtctccggcggcctggcgccctttatttttgccctcgggattttgtttgtctatctggtgctcgccgcccagtacgagagcctggtagaaccgttcatcatcctgcttgcggtgccgctggcagtactcggggcattgttggcgctgtcgtttcgagggatagccaacgacgtctactgccagatcggcctggtgatgctgattggcctggcgagcaaaaactcgattttgatcgtcgaatttgccaaccaggcacgcgaaagaggcatgtcgatcgtcgatgcggccctggaggcttcccgcgagcggctcaggcccatcttgatgacctccttcgcgttcatcctaggcatctggcccctggtgatcgcctccggcgccggggcggcgagccgccagtcgctcggcacggcggttttcggcggcatgatcatctcgacgtttttgagcctgttcgtggtgccgattctctacatcgtgctcgtctccatccgtgagcggtttgtaggcggcaagggcgaacctgccgccgtcccggctaaaaacgaagtcccggctgaatag

SEQ ID NO: 74365 - protein, 1050 aa, Gloeobacter violaceus PCC 7421
MFVDFFIRRPIFAGVCAVIILLAGLVSIPSLPIAQYPEISPPQVTVTATYVGASAEVVEETVTTLLERQINGVEGMRYITSNSSDQGVSTIVVTFELERDKDIAAVDVQNRISTVLPQLPSLVQQTGVQISKQSGAPLLGIGLYSEKGQYTNDLLSNYADLYLVDALKRVPGVGNVQIFGERRYSMRLWLDPNRLAARSLTAQDVVNAVNEQNVQVGAGSIGQPPLDKSQTFQIGLRVLGRLKEPGEFADLVIRTNADGSLTRLKDVGRAELGAENYNSFLRFRGQDGVGLGIYPIPGSNALDIGKAVKARMAELEKSFPPGVQYRVAFDTTDFIEESAAEVIETLIIAILLVVLVMFIFLQDWKSTLIPAITIPVSLVGTFIFVKLFDFSINSLTLFGLTLATGLVVDDAIVVIENIARTSKEQCKDPKECASDAMREVTAAVIAIALVLMAVFVPVAFFPGTTGQLYKQFALTIVFSIVISTFNALTLTPALAALLSTGQVGESRFFLFRWFNSGFEAFKNGYLRVLEILTRFKTVVVLVFIGLLGLTAWLFVKVPTAFLPEEDQGYFITLVQAPQGVSINYTSDVMRQVEKILLAQEEVEGTFAIGGFGFSGSAANSGVIFTTLKPWSERHKPEEQMLPFINRVRGPLLGIKEALVIPFNAPTIQGLSAFGGFAFELQDRGNNGIEALSATAQELIAKGNATPGLQGLFTTFNPNSPQIVIEVDRNKAKSLNVPLSEIFNTLQTYLGSRYVNDFNLFGRTYRVYVQADEKFRANPRDIRALYVRSTSGRMVSMGELVSTEPVTAPSIVTHYNLFRNVEITGNAAPGFSSGQAIAAMEKLAAETLPASMGFEWSGISLEEKVSGGLAPFIFALGILFVYLVLAAQYESLVEPFIILLAVPLAVLGALLALSFRGIANDVYCQIGLVMLIGLASKNSILIVEFANQARERGMSIVDAALEASRERLRPILMTSFAFILGIWPLVIASGAGAASRQSLGTAVFGGMIISTFLSLFVVPILYIVLVSIRERFVGGKGEPAAVPAKNEVPAE

SEQ ID NO: 74366 - DNA, 3126 bp, Gloeobacter violaceus PCC 7421
  CDS (1)..(3126): transl_table=11
gtgaacttctcggcagtgttcatccgccgccccgtcgccacgacgctggtgatgctcggggtgttgttcttcggcctgattgcctaccggctcctgccggtcaacgatctgccgaacgtcgattttccgaccatccaggtatccgccggtttgcccggtgccagtcctgagacgatggccgcagcggtagccacacctctggagcgtcagctctcggcgatcccgggcctcgattcgatgagttcgtccagttcgctgggcagtacgcaaatcaccctccagttcgatctggagcgcgatatcgacgccgccgcccaggatgtgcagacggcgattgccaccgccgcttcgcagttgccgccgggactgcccacgccgcccagttaccgcaaggtcaacccggcggagcagccgatcatgatcctctcgctcaattcgccgacgctgccgctgtggcgggtggacgagtacgcccagacgctcatcgcccagcgcatttcgatggtgagcggcgtggcgcaggtgctggtcttcggcgcccagaagtacgccgtgcgcatccaggtggaccccaacgcccttgccgcgcgcggtatcggcctcgacgaagtcgaaagcgccatccgcaccggcaacaccaacctgcccaccggctacgtcgacggcaaataccgcgcctttacgatcgaatcggacggccagttgctcaacgccgcagccttccggccgctggtggtcgcttaccgcaacggctcgcctgtgcgcctcgaacagctgggcaaagtgatcgacagcgtcgagaacgacaaggtggccggctggtacaacggcacgcgctcgatcaccctgggggtgcagcgccagcccggtgtcaatacgatcgcggtcgtcgatgccatcgaagccttgctgccgacctttcgctcccagattcccggggcggtcaacctcgacatcgtcttcgaccgatccgagtcgatccgccactcggtcgaggacgtccagttcacgctggtgctcgccatcggcctggtggtgctggtgatcttcttgttcctgcgcaacctctcagccacgatcatcccgagtctggcggtgccgctgtcgctggtggccaccttcgcggtgatgtatctgttgggcttcagcctcaacaacctttcgctgatggcgctcaccctctcggtaggcttcgtggtcgacgacgccatcgtcgtgctcgagaacatcgtccgccgtcaggagatgggtgagagccccatggaggcggctttcaacggttcgcgtgagatcacttttacgatcatctcgatgacgctgtcgctggtggcggtctttttgccggtgctctttatgggaggcatcctgggcagactctttaacgagtttgcgatcaccatcgccactgccattctcgtctcggggttcgtctcgctgaccctcaccccgatgctctgcagccgcttcctgcgggccgaatcggtacacccgtccagccgcagccgtttgtatcaaatttccgagggagccttcgacgccctcacccgcgcctacgaccgcagtttgcagtgggtgctgcgtcaccgcgtcttgacgatgctcgcttcggcggcggtgctggcggctacggtttacctgtttaacgccattcccaagggcttcattcccagcgaggacaacggtcaaatcatcgtcaccaccgaggccgcccaggggatctcctttgccgacatggcgcgcaagcagcagcaggtcgtggcggtcctgcgccaggatccggctatcgacggcaccaatgcgagcgtcggctcgggcggtcccgccggtgccagcaacgccgggcgggtcttcgtgcgcctcaagccgcgctccgagcgcgacagcgcccaggacgtcatccagcggttgcggccgaagcttgcccaggtgaccgggattcgcgtgttcatgcagcagcctccggccatccgcattggcggccagcagagcaagagtctctaccagtacacgttgcagagcaccgataccgacgagctgtaccgctataccccgatgttggaggcaaagctgcgcgaggtgccccaactgcaggatgtcacctccgacgtgcagcttaagaacccccagatcaatctggtgatcgaccgcgacaaagcctcctcgctggggatcaccgccgaacagatcgagcgcaccctcagcaacgcctacagctcgcgccagatctcgttgatttatgcccccacaaaccagtaccgggtgatcctctcggtcgacccacagtaccagcaagatccggaggccctctcgctgttgtacgtgcgctcgaccggcggccggctggtgcccctctcgacggtggccaaactcaccccgggcgtcggccccctctcagtcaaccacctgggccagttcaccgccgcgaccatttccttcaacctcaaaccgggcgtctccctcagcgaagcgtcagccatcatcgagcgccgcgccgccgaaacgttgcccgatacgattgccacgagcttccagggcaacgccgaggctttccagtcctccacccagaacctggggctgttgctggcggtggcgatcctggttatctacctcgtgctgggcatcctctacgaaagcttcatccatccgctgacgatcctctccgggctgccttcggccgggttcggggcattgctcacgctgatgctgttcggtttcgatctcgatgtctacggatttgtggggctcttgctgctggtggggatcgtcaagaaaaacgcgattatcatgatcgactttgccctcgaagcccagcgcaaggacggcaagcggccggaggacgccatctacgcggcggcgctggtgcgctttcggccgatcatgatgacgacggtttcagcgattgcgggggctatcccgatcgccatcggctttggggccggggccgagacgcgccagccgttgggtctggcggtggtggggggcttgcttttttcgcagtggctgaccctttacatcaccccggttatctatctctatctcgaccgcttccaggagcgctttagttggggcaaaaacgcccgcccggctcccgcaggtccggtacccgacggccagtttgccgagtga

SEQ ID NO: 74367 - protein, 1041 aa, Gloeobacter violaceus PCC 7421
MNFSAVFIRRPVATTLVMLGVLFFGLIAYRLLPVNDLPNVDFPTIQVSAGLPGASPETMAAAVATPLERQLSAIPGLDSMSSSSSLGSTQITLQFDLERDIDAAAQDVQTAIATAASQLPPGLPTPPSYRKVNPAEQPIMILSLNSPTLPLWRVDEYAQTLIAQRISMVSGVAQVLVFGAQKYAVRIQVDPNALAARGIGLDEVESAIRTGNTNLPTGYVDGKYRAFTIESDGQLLNAAAFRPLVVAYRNGSPVRLEQLGKVIDSVENDKVAGWYNGTRSITLGVQRQPGVNTIAVVDAIEALLPTFRSQIPGAVNLDIVFDRSESIRHSVEDVQFTLVLAIGLVVLVIFLFLRNLSATIIPSLAVPLSLVATFAVMYLLGFSLNNLSLMALTLSVGFVVDDAIVVLENIVRRQEMGESPMEAAFNGSREITFTIISMTLSLVAVFLPVLFMGGILGRLFNEFAITIATAILVSGFVSLTLTPMLCSRFLRAESVHPSSRSRLYQISEGAFDALTRAYDRSLQWVLRHRVLTMLASAAVLAATVYLFNAIPKGFIPSEDNGQIIVTTEAAQGISFADMARKQQQVVAVLRQDPAIDGTNASVGSGGPAGASNAGRVFVRLKPRSERDSAQDVIQRLRPKLAQVTGIRVFMQQPPAIRIGGQQSKSLYQYTLQSTDTDELYRYTPMLEAKLREVPQLQDVTSDVQLKNPQINLVIDRDKASSLGITAEQIERTLSNAYSSRQISLIYAPTNQYRVILSVDPQYQQDPEALSLLYVRSTGGRLVPLSTVAKLTPGVGPLSVNHLGQFTAATISFNLKPGVSLSEASAIIERRAAETLPDTIATSFQGNAEAFQSSTQNLGLLLAVAILVIYLVLGILYESFIHPLTILSGLPSAGFGALLTLMLFGFDLDVYGFVGLLLLVGIVKKNAIIMIDFALEAQRKDGKRPEDAIYAAALVRFRPIMMTTVSAIAGAIPIAIGFGAGAETRQPLGLAVVGGLLFSQWLTLYITPVIYLYLDRFQERFSWGKNARPAPAGPVPDGQFAE

SEQ ID NO: 74368 - DNA, 3150 bp, Photorhabdus luminescens subsp. laumondii TTO1
  CDS (1)..(3150): transl_table=11
atgcctaaattttttatagatcggccaatctttgcatgggtaatcgcaattatcaccatgctggctgggctgttggcaattatgaaattacccgtagcgcaatatcctactattgcaccaccggcgatttctatctctgcaacttatcccggcgcagatgccaccactgtgcaaaacacagtgactcaggttatcgaacagaacatgaatggtatcgataacctagtttatatgtcttccgacagtgattctgctggaaacatgaatatcacactaacctttgaggccggtactgatcccgatattgcacaggtacaagtgcaaaacaagctacaactcgctatgcctctgttaccacaagaagtgcaacagcaaggtatacgtgtagataagtccacgacctctttcttgatggttgccggattcatctctgaagatggttcaatgtcacaggacgatatctctgactacgttggtgcaactgtcaaggaccctttaagtcgcgtaaccggtgtaggtgatacaatgcttttcggtaaccagtatgccatgcgtatctggttaaatcctgacaagctcgttaactacaagatgacgactttggatgtaataaatgcaatcaaagcgcaaaataaccaaatagccgccggtcaattagggggaacccctccggttccaggtcaacgcctgaatgcgtcgatcattgctcaaacacgtctaacttcaccggaagagttcagtaatattctcttgcgcgtcaatactgacggttctcaggtccgtctgaaagatgtagcaaaggtggaactaggtgcacaaagctacaacatcattgcccgctataacggtaaacctgctgcgggtatcggtgtcaaactagcgacaggcgctaacgctttggatacatccaaagcagtaaaagaagcgctaaacaatatggaacctttcttccctcacgggctgaaaatcgtctatccatatgacaccacaccattcgttaaaatctctattaacgaagtggtaaaaacactggttgaagcaattatgctggtgttcgtggtaatgtacctatttctccaaaatttccgcgcaacactcattccaaccattgcagttccagtcgtactcttaggaacatttgcaatactcgctacatttggctattcaataaatacattaaccatgtttgctatggttcttgccattggcttactggtagacgatgccattgttgttgtagaaaatgttgaacgtgttatgcaggaagaaggtctatcgccaaaagaagcaaccaggaaatcaatgggacaaatccaaagcgccttagttggtattgcaatggtgctgtctgctgtatttatcccaatggccttcttcggcggttcaaccggtgcaatttatcgtcaattctcgatcactatcgtatctgcaatggtattgtctgtgctggtagcattaatcctgacaccagctctatgtgctaccatgttgaaacccattgccaaaggtagccatggtaagcagaccggcgtctttggctggttcaaccgcatatttgacaaaagtacccaccactatactgacagcattggtcgcattctacgtaatacaggccgttatctggtaatttatgtattcctggtggcaggtatggccgtcatgttcacacgtttaccatcctcttttcttcctgaagaagatcagggagtattgctgacaatggttcaattacctgcgggggcgacacaggaacaaacagaaaaagttctagataaagtaagcgattacttcaatacagaagaaaaagatcgtgtggtttctgtatttactgtcagtggctttggttttagtgggcaaggtcaaaacactgggttgggatttataagcctgaaagactggggtgaacgtccgggggctgaaaacaaagtacctgctattgttgccagggctagtgctcacttccagacaatcaaagaaggtatggtttttgcgtttaacatcccggcaattgtagagttaggttcagcaactggctttgattttgaattaattgataaagcaaaccttggacatgacaaactgacagcagcccgtaatcaattacttggcatgatacaacagcatccagatatgttagtaggtgttcgtcctaatggtcaggaagatacccctcaatatcggctcagaattgatcaggaaaaagctgaagctctcggtgtttccatcgctgatattaactcaacactcagcacgatgtttggtagtaactatgtgaacgactttattgatcgcggtcgtgtcaaaaaagtttacgttcagtcggaagcaccttatcgtatgttgccaagtgacatctacaagctgtatgtccgtaacaaacagggtgaaatggttccattctctgcctttacagacacgtccaaagaaccctggacctacggttcaccacgtctggaacgttacaacggcttaccatcaatggaaattctgggtgaagccgctccgggtaaaagtaccggtgatgcaatggccctaatggaagagctggcatctaagctaccaaatggaatcggtttcgactggacaggtatgtcctatcaggaacgtttgtctggtaatcaagccccagctctatatgcattatcattgatagtggtattcctctgtctggctgcactgtatgaaagctggtcaattccattctcagttatgctagtagtaccattaggtatcgttggagccttgttagcaacaacattccgcggcttggataacgatgtttactttaaagttggcttgttgaccactatcggtttgtcagctaagaacgcgatactcatcgttgaattcgccaaggacctgatggaaaaagagggcaaggggttgatagaagctacgctagatgcggtaagaatgcgtcttcgcccaatcctaatgacatcactagcatttatgttaggtgttatccccctagtactgagtaatggtgcaggatccggctctcaaaacgcagtgggtactggggtattaggcggaatgattgcagcaacctcgctagccatctttttcgtgccggtattctttgtggttataagacgacgtttcagtaagaaagctgaggagattgaacccgcatcagaatctcactaa

SEQ ID NO: 74369 - protein, 1049 aa, Photorhabdus luminescens subsp. laumondii TTO1
MPKFFIDRPIFAWVIAIITMLAGLLAIMKLPVAQYPTIAPPAISISATYPGADATTVQNTVTQVIEQNMNGIDNLVYMSSDSDSAGNMNITLTFEAGTDPDIAQVQVQNKLQLAMPLLPQEVQQQGIRVDKSTTSFLMVAGFISEDGSMSQDDISDYVGATVKDPLSRVTGVGDTMLFGNQYAMRIWLNPDKLVNYKMTTLDVINAIKAQNNQIAAGQLGGTPPVPGQRLNASIIAQTRLTSPEEFSNILLRVNTDGSQVRLKDVAKVELGAQSYNIIARYNGKPAAGIGVKLATGANALDTSKAVKEALNNMEPFFPHGLKIVYPYDTTPFVKISINEVVKTLVEAIMLVFVVMYLFLQNFRATLIPTIAVPVVLLGTFAILATFGYSINTLTMFAMVLAIGLLVDDAIVVVENVERVMQEEGLSPKEATRKSMGQIQSALVGIAMVLSAVFIPMAFFGGSTGAIYRQFSITIVSAMVLSVLVALILTPALCATMLKPIAKGSHGKQTGVFGWFNRIFDKSTHHYTDSIGRILRNTGRYLVIYVFLVAGMAVMFTRLPSSFLPEEDQGVLLTMVQLPAGATQEQTEKVLDKVSDYFNTEEKDRVVSVFTVSGFGFSGQGQNTGLGFISLKDWGERPGAENKVPAIVARASAHFQTIKEGMVFAFNIPAIVELGSATGFDFELIDKANLGHDKLTAARNQLLGMIQQHPDMLVGVRPNGQEDTPQYRLRIDQEKAEALGVSIADINSTLSTMFGSNYVNDFIDRGRVKKVYVQSEAPYRMLPSDIYKLYVRNKQGEMVPFSAFTDTSKEPWTYGSPRLERYNGLPSMEILGEAAPGKSTGDAMALMEELASKLPNGIGFDWTGMSYQERLSGNQAPALYALSLIVVFLCLAALYESWSIPFSVMLVVPLGIVGALLATTFRGLDNDVYFKVGLLTTIGLSAKNAILIVEFAKDLMEKEGKGLIEATLDAVRMRLRPILMTSLAFMLGVIPLVLSNGAGSGSQNAVGTGVLGGMIAATSLAIFFVPVFFVVIRRRFSKKAEEIEPASESH

SEQ ID NO: 74370 - DNA, 3114 bp, Vibrio vulnificus YJ016
  CDS (1)..(3114): transl_table=11
atgttactctctgatgtctcggtgaaaaggccagttgctgcgctggtattgagtttgttgctgtgtgtgtttggttttgtctcgttcagcaaattggcggtgcgcgagatgccggacatcgaaagcccagttgtctccattagtacgcgttacgatggggcgtcggcgacgatcatcgaaagccagatcacgtcagtgcttgaagatcaactctcaggcatcagtggtattgatgagatttcgtcaaccacgcgtaacagcatgtcacgtatcaccattacctttgaattgggttatgacctcaatactggggtgagtgatgttcgtgatgcagttgcgcgagcgcagcgttcgctacccgaggaagccgacgatcctatcgtgtttaaaaacaacggtagcggtgaggcatccgtttacatcaacctcagctcgtcagagatggatcgtactcagctcaccgattacatcgagcgtgtactcatggatcgctttagtcttatcaccggagtgagttcagttgatatctcgggtggcttgtacaaagttatgtacgtaaagctaagtcctgagctgatggccggacgaggtgtgactgccacggacattaccgccgcgctgcgcagtgagaaccttgaaagtccgggggggcaagtgcggaacgatcaaacggtgatgtctgttcgcaccgcgcgcagctataactcagtagaagacttccaatatctggtggtcaagcgtgccagtgacaacacgccgatttatctcaaagacgtggcggatgtctttattggtgctgagaatgagaactcgacgtttaaaagtgacggggtagtcaacgtcagcatggggattgtccctcagtcggacgccaacccgcttgaggttgcaaaaagagtgcatgaagaagtcgataaagtgcagaagtttttgccagaagggacacgtctcgccatcgactacgattcaaccgtgtttattgaacgctctatttctgaagtttatagcactctgttcatcactggcgggctcgtgatcctcgtgctgtatatcttcatcggtcaagctcgcgcgactttgatcccagcggtgaccgtgcctgtgtcgctgatttcctcttttattgccgcgtactactttggtttctcgattaacctcatcaccttaatggctttgattctctctatcggtttggtggtcgacgatgcgattgttgtcgttgagaacattttccatcatatcgagaaaggtgaatcgcctttgcttgcggcctataaaggcacgcgagaggtaggctttgcggtcattgccaccaccttagtgttggtgatggtgtttttgccgatctccttcatggatggcatggtgggcctactctttaccgagttctcggtgttgctggcgatgtccgtgattttttcatcattgattgcgctgacgctcacccccgtcttaggcagcaaaattctcaaagccaatgttaagaaaaaccgcttcaatgacgtcgtagacgtgttgttcggcaagttagagtccggttatcgcgcgttgctaaagcgagccctcgcatggcgatggcttgcgcccgtgatcatccttgcctgtatgggcggcagctacgcgctaatgaatcaagtgccagcacaattaacaccacaagaagatcgtggggtcatttttgcctttgtccgtggcgccgatgccaccagttacaaccgcatgtctgccaatatggacttagtggaagagcgtttaatgccgctgttagggcaagggttcctcaaatcattcagcatccagtcgccggcgtttgggggccaagcgggtgaccaaaccggattcgttattatgatcttggatgattggaatgaacgttcggtgacagcgcaacaagcgttaggcgaagtgcgtaaggcgctggcgggcattcctgatgtccgtgttttcccgtttatgcccggattccgtggtggttcgagtgagcctgtgcagtttgtgcttggcggctcggattacaacgaactgcgcgattgggccgaggtgctaaagaacaaagcggaagaatccccaattatggaaggggcggagatcaactattctgagaaaacgccggaactggtggtgtcggtggacaaacgtcgtgccgcagaactgggcatcagcatcaaagagatttccgataccttagaaatcatgttgggtgggcgtaaagaaaccacctttgtggagcgtggtgaagagtacgatgtttatcttcgtggtgatgaaaatcgctttaataacgcagcagatctgagccaaatctatctgcgcacaaaaagtggcgatctggttaccttagatacagtgaccaacgttgaagaaattgcgtcgtcgattcgcttatcgcactacaacaagcaaaaggcgattacgatcaccgccaacttatcggatggttacacgctgggtgatgcgttggattttcttgatcagcaagcgatcgagacgctgccgggcgacattaccatcagctactctggtgaatcgaaggacttcaaagaaaaccagtctagcgttgccattgtgtttgcgttggccttgctggtggcttacctcgttcttgctgcgcagtttgaaagcttcatcaaccctctggtggtgatgtttaccgtgccgatgggggtgtttgggggtttcttaggcttgctcatcatgcagcaaggtatgaacatctacagtcagatcggcatgatcatgctgatcggtatggtgaccaaaaacggtatcttgattgttgagtttgctaaccaactgcgtgaccgtggctttgagtttgaacaagccattattgatgcctcggcacgacggttgcgcccgattttaatgaccgccttcacgaccctagcgggcgcgattccacttattctgtcggatggggcgggctacgaaagccgcgtggccgttggtaccgttattttcttcggtatgggttttgccaccctcgtcactttgttcgttatccctgcgatgtatcgtttgatatctcgatacacagaagcgccagggcatgtggaagcggaactcaatcaagccctcagccatgataccaaaggccgagtgagtcacggttaa

SEQ ID NO: 74371 - protein, 1037 aa, Vibrio vulnificus YJ016
MLLSDVSVKRPVAALVLSLLLCVFGFVSFSKLAVREMPDIESPVVSISTRYDGASATIIESQITSVLEDQLSGISGIDEISSTTRNSMSRITITFELGYDLNTGVSDVRDAVARAQRSLPEEADDPIVFKNNGSGEASVYINLSSSEMDRTQLTDYIERVLMDRFSLITGVSSVDISGGLYKVMYVKLSPELMAGRGVTATDITAALRSENLESPGGQVRNDQTVMSVRTARSYNSVEDFQYLVVKRASDNTPIYLKDVADVFIGAENENSTFKSDGVVNVSMGIVPQSDANPLEVAKRVHEEVDKVQKFLPEGTRLAIDYDSTVFIERSISEVYSTLFITGGLVILVLYIFIGQARATLIPAVTVPVSLISSFIAAYYFGFSINLITLMALILSIGLVVDDAIVVVENIFHHIEKGESPLLAAYKGTREVGFAVIATTLVLVMVFLPISFMDGMVGLLFTEFSVLLAMSVIFSSLIALTLTPVLGSKILKANVKKNRFNDVVDVLFGKLESGYRALLKRALAWRWLAPVIILACMGGSYALMNQVPAQLTPQEDRGVIFAFVRGADATSYNRMSANMDLVEERLMPLLGQGFLKSFSIQSPAFGGQAGDQTGFVIMILDDWNERSVTAQQALGEVRKALAGIPDVRVFPFMPGFRGGSSEPVQFVLGGSDYNELRDWAEVLKNKAEESPIMEGAEINYSEKTPELVVSVDKRRAAELGISIKEISDTLEIMLGGRKETTFVERGEEYDVYLRGDENRFNNAADLSQIYLRTKSGDLVTLDTVTNVEEIASSIRLSHYNKQKAITITANLSDGYTLGDALDFLDQQAIETLPGDITISYSGESKDFKENQSSVAIVFALALLVAYLVLAAQFESFINPLVVMFTVPMGVFGGFLGLLIMQQGMNIYSQIGMIMLIGMVTKNGILIVEFANQLRDRGFEFEQAIIDASARRLRPILMTAFTTLAGAIPLILSDGAGYESRVAVGTVIFFGMGFATLVTLFVIPAMYRLISRYTEAPGHVEAELNQALSHDTKGRVSHG

SEQ ID NO: 74372 - DNA, 3168 bp, Rhodopseudomonas palustris CGA009
  CDS (1)..(3168): transl_table=11
atgatctccgcattcttcatcaaaaggccgatcttcgcctgggtgatcgcgatcgtgatcatgctcggcgggctgttggcgctgaccacgttgccggtgtcgcaatatcccgagatcgcgccgccgacgatccagatcagcgcgagctatcccggcgcggacgcgcagacggtcgagaactcggtgaccaaggtcatcgaacagggcatgaccggactcgacaacctcgactacatggctgcgtcgtcgacctcgagcgggcaggccgacatcacgatcaccttcaccaacaaggccaatccggacgtcgcgcagatgcaggtgcagaacaagctgcaactcgtcaccgcgctgctgccgtcgatcgtccagaccacgggtctctcggtcaccaaatcgaccagcggctttctgatgatcgtcggtttcgtctcgaccaacggcaagatgagcgagaccgatatcgccgactatgtgaagagcacgctcaacgacaggctcaagcgggtcgaaggcgtcggcaatacccagctgttcggcggcggctatgcgatgcggatctggctcgatccggagaagctgctgaaatacgcgctgacgccggccgatgtcaccgcggcgattcaggcccagaacacccaggtttcggccggtcagctcggcggcctgccggcgcgcaagggacagcagctcaacgcgaccgtgaccgcgcagagccggctgcagacgccggcgcagttccgcaacatcgtcgttaagagcgacaccaacggatcgatggtgcgcatcaacgatgtcgccaccgtcgagctcggcgccgaggactacacgagcgcgtcgacttacaacggtctggcggcgacggggctcgccatcaatctggcgaccggcgccaatgcgatcaggacagccgctgcggtcaaggcggtgatcgacgggctgaccccgacgctgccgcaaggcatcaaggtcgtctacccctacgacaccacgccgttcgtcgaaatctcgatcggcgacgtcacccgcacgctggtcgaggcggtcgtcctcgtcttcgtggtgatgctggttttcctgcagaactttcgcgcgacgctgattccgacgctagcggtgcctgtcgtgctgctcggcaccttcggcgtgctggcgctcgccggttattcgatcaatacgctgaccatgttcgcgatggtgctggcgatcggccttctggtcgacgacgcgatcgtggtggtcgagaacgtcgaacgcgtgatgcacgacgaggggctgtcaccgcgcgaggccacgagccgatcgatgacggaaatcaccggcgcgctgatcggcatcaccacggttttgtcggctgtgttcgtgccgatggcgttcttcggcggttcggtcggggtgatctatcggcagttcgcggtgacgatcgtctccgcgatggtgctgtcggtgatcgtggcgctggtgctgacgccggccttgtgcgcgacgattctgcgtcggccgaagccgcacgacgagaagcgcggcgtgttcggatggttcaaccgcgtgctgggccgaggcacggatgcctatcaggccggggcgcgcggcatgctgcggcggccgcggcaaggtctgatcgcgttcgtgctcgtcatcgtcgccgccgcggcgttgttcatccgcctgccgacgtcgttcctgccggaagaggaccaaggcctgctgatggtgtcggtgcagttgccggtcggcgccaccaccgaccgcacggagcgcgtactcgacaaggtcacccgccatttcctcgatcacgagaccaaggcggtggatggcctcatgacggtgacgggcttttcgttttccggggccggccagaatgtcggcatggccttcgtgcgtctgagggacttcgccgaacgcaaagacaccgacctctccgccagcgccgtggccgaacgtgcgatggtggtgttcgccgggattcgcgacgcgaaagtgttcgcgctggcaccgccggcgatcgaagggctcggaaccagcaacggcttcgatttctatctgaaggacatcaacggcgcggggcacgacaagctgatggcggtgcgtgatcagctactcggcgccgttggaaaaagccggctcctgagcgggacccggcccaatgggcaggacgatacaccgcaattttcgatcgacatcgatcaggagaaggcgagtgcactcggcctcaatctcgccgacgtcaactcgacgctgtcgattgcgtggggcagcagctatgtgaacgacttcatcgatcgtggccgcgtcaagcgagtctatctgcaggcggcggcggacttccggatgcagccggaggatctggatctctggtacgtccgcaacaacgccggcgcgatggtgccgttctctgccttcgcctcaggccgctggacgttcggctcaccgcgactcgagcgctacaacggagcggccgcggttcagatccagggcgacgctgccccgtcggtcagctccggcgcggcgatgacggagatcgatcgcctcgtcgccggcctgccggccggcttcggccacgaatggacggcgttgtcgcggcaggaacagctctccggcaatcaggcggcgtcgctgtacgcaatctccatcttggtggtgttcttgtgtcttgccgcgctctacgagagctggtcgatcccgttcgccgtgatgctgtcggtgccggtcggcgtgtttggcgcgctggcggctgcgctgctgctcggtcagagcaatgacgtgtacttcaaggtcggtctgctgaccacgatcggtcttgcggccaagaacgccattctgatcatcgaattcgcgatcgcgcgccagcaggcggggctgggattgcatcgcgccaccttgctcgccgcgcggcagcggctgcggccgatcctgatgacgtcgtttgcattcatcctcggtgtcacgccgctggtcgtggccagcggcgcaggctcggcggcgcagaattcgatcggcatcggcgtgatgggcggcatgctggcggcgaccgtgctgggcatcttcttcgtgccgctgctgttcgtcgtggtccggcgtgtgttcaagagcgcggccggcagcgagatcgccgtgagcccgatcccgcccgccgcgttcggcctttccgacccgcgagactcgtga

SEQ ID NO: 74373 - protein, 1055 aa, Rhodopseudomonas palustris CGA009
MISAFFIKRPIFAWVIAIVIMLGGLLALTTLPVSQYPEIAPPTIQISASYPGADAQTVENSVTKVIEQGMTGLDNLDYMAASSTSSGQADITITFTNKANPDVAQMQVQNKLQLVTALLPSIVQTTGLSVTKSTSGFLMIVGFVSTNGKMSETDIADYVKSTLNDRLKRVEGVGNTQLFGGGYAMRIWLDPEKLLKYALTPADVTAAIQAQNTQVSAGQLGGLPARKGQQLNATVTAQSRLQTPAQFRNIVVKSDTNGSMVRINDVATVELGAEDYTSASTYNGLAATGLAINLATGANAIRTAAAVKAVIDGLTPTLPQGIKVVYPYDTTPFVEISIGDVTRTLVEAVVLVFVVMLVFLQNFRATLIPTLAVPVVLLGTFGVLALAGYSINTLTMFAMVLAIGLLVDDAIVVVENVERVMHDEGLSPREATSRSMTEITGALIGITTVLSAVFVPMAFFGGSVGVIYRQFAVTIVSAMVLSVIVALVLTPALCATILRRPKPHDEKRGVFGWFNRVLGRGTDAYQAGARGMLRRPRQGLIAFVLVIVAAAALFIRLPTSFLPEEDQGLLMVSVQLPVGATTDRTERVLDKVTRHFLDHETKAVDGLMTVTGFSFSGAGQNVGMAFVRLRDFAERKDTDLSASAVAERAMVVFAGIRDAKVFALAPPAIEGLGTSNGFDFYLKDINGAGHDKLMAVRDQLLGAVGKSRLLSGTRPNGQDDTPQFSIDIDQEKASALGLNLADVNSTLSIAWGSSYVNDFIDRGRVKRVYLQAAADFRMQPEDLDLWYVRNNAGAMVPFSAFASGRWTFGSPRLERYNGAAAVQIQGDAAPSVSSGAAMTEIDRLVAGLPAGFGHEWTALSRQEQLSGNQAASLYAISILVVFLCLAALYESWSIPFAVMLSVPVGVFGALAAALLLGQSNDVYFKVGLLTTIGLAAKNAILIIEFAIARQQAGLGLHRATLLAARQRLRPILMTSFAFILGVTPLVVASGAGSAAQNSIGIGVMGGMLAATVLGIFFVPLLFVVVRRVFKSAAGSEIAVSPIPPAAFGLSDPRDS

SEQ ID NO: 74374 - DNA, 3108 bp, Rhodopseudomonas palustris CGA009
  CDS (1)..(3108): transl_table=11
atggcctcgatgtccgacccgttcatccgaaggccggtcggcaccacgctgctggcgatcgggttgtttctggtcggcatggtggcctatgcggtgctgccggtggcggcgctgccgaacgtcgatttcccgatgatcatggtgcaggcgtcgcggcctggggcggcgccgtcggtgatggcctcgaccgtcgctgcgccgctggagcggcggctcggcgaaatcgccgggctcgatcagatcacctcgaccagctcgctcggcaacacccgcattcagttgcagttctcgatcggccgcaacgtcgacagcgccgcgcgcgatgtgcaagcggcgatcaacgccgcggtcagcgacctgccgaccgacctgccgacgctgcccaagttccgcaagttcaactccgcggcggcgccggtctacatcctggcgctgacctccaagaccatgccggcgagcgcgatctacgacgtcgccgacacggtgttggcgcagcgcatctcgcaggtgccgggcgtcggcgacgtcacggtctccggcgccgaccagcccgcggtgcggatcgcgctcaacccggtcgcgctgtctaacgccggcatctcgaccgacgacgtccgcaccgcgatcatcaacgccaatccggtgggcccggtcggctcgttcgacggaccgcggctgaccgaaacgctgtcgaccaatccgcagatgcgaaccgcggagcagttccgcagcatcgtcatcaagagcgatacgaacggcacggtgcggctgtcggatgttgccaccgtcagcgacgccacccgcaacgcccgcaccatcgcctggtacaacaagcagccggcggtgatcatccagatcaccaagcagggcgacgccaacgtcatcgagaccgtcgaccgggtcaaagctctgctgcccgagctgaagcagtggattccggcaggcgtcgacatctcggtgctggccgaccgcaccggcacgatccgcgccagcgtcgacgacatgcagtggacgctgctggccaccgcggtgctggtgatggcggtggtgctgctgttcttgcgccggctgacgcccacgatcgccgccggcgtgtcggtgccgctggcgctggccggaacctgcgccggaatgtggatcagcgggttttcgatcaacaatctgtcgctgatggcgctggcgatcgcggtcggcttcgtcgtcgacgatgcgatcgtgatgatcgagaacatgtaccgcaacctcgagcgcggcatggcgccgctgccggccgcgatggagggcgcccggcagatcggctttacggtgctgtcgatcagcctgtcgctggtcgccgcgttcgcgccgctgatcttcatggatggcctgatcggccggctgctgcgcgagttctcgctgacgctgacgtttgcgatcgtggtctcgaccgtggtgtcgctgacggtgacgccgatgatctgcgcccattacatccgcgccgaagcgtcgccgaaacagacttggttcgatcgcgcggtcgaaggcacgctgaaccgcatcgtcggcttctatgcctggacgctgcgcggcgtgctgtcggtgccgtggctgaccgttgtggtgttcatcgccaccatcgcgctcacggtgacgctgtatatcaaggtgcccaagggctatttcccgattgacgattccggcttcatcatcggctcgacccgcgcctcggccgacatctcgttccagtcgatgcggactttgcaggaggagctcgccgacatcgtgatggccgatccggcggtgagcggcgtcggctcggtgctgggtggcggcggaccgggcgccggcggcgccaatcgcggcacgatgttcatcaatctgaagccgaccgccgaacgcgagggtgtcaccactcagatggtgatcgatcgcctgcgccggcagctcagccgcgttgccggcatccggctgtttatgttcgccgcccaggatctgcgcggcggcggccgctccagcgaatccaattatcagtacacgctgagcagtcccgatctcgacctgttgcagaaatgggcgccgatcgtcgccaagcggatgcagaccgtcgacggcatcaccgacgtgaccagcgatcgcgacgacggcggcctgcagctgacgctgtcgatcgaccgcaccatggcgtcgcggctcggcgtgcggattcaggacatcgacaacgcgctcaacaacgcattctcgcagcggcagatcgcgacgatctacacccagcgcaaccagtatcaggtggtgctggagatcgacccgaacttccagaccgatccaaccgacctgaagcggatctatgtcgacagcaccagcggcgatcaggtgccgttgtcggcggtggtgcgcgccgagcgcgggctggcggcgctggcggtcgcccatacccagggcgtgccgtcgaccacggtgtcgttcaacacgttgcccgacgtgccgctgcaggaggcgaccgccaacattcagcgcgcggtcgatgaactgcacatgccggaggggattcgcggctcattcgacggcaacgccggcgatttccgcgccacctccaataagcagccgctgctgatcctggcggccttcatcgcgatgtacatcgtgctcggggtgctctacgagagcctggcgcatccgctgacgatcatctcgacgctgccgtcggcggggctcggcgcgctgctggcgctgctggtcaccggcaccgagctgtcggtgatcgccttcgtcggcatcatcatgttgatcggcatcgtcaagaagaacgggatcatgatggtggacttcgcgctggaggccgaacgcgagcgcggtctgccgtcggccgacgccatcttcgaagcctgcatcgtgcgcttccggccgatcctgatgaccacgctggcggcgctgttcgcggcgatcccgctggtggtggcggtcggccccggcaccgagctgcggcggccgctcggcatcaccatcatcggcgggctgttcgtgtcgcaggtgctgacgttgtatacgacgccggtgatctatctgttgatcgaccgggtgcggcagcggcgctggcgccgcggcgcgccggccgcagtgccggcagagtag

SEQ ID NO: 74375 - protein, 1035 aa, Rhodopseudomonas palustris CGA009
MASMSDPFIRRPVGTTLLAIGLFLVGMVAYAVLPVAALPNVDFPMIMVQASRPGAAPSVMASTVAAPLERRLGEIAGLDQITSTSSLGNTRIQLQFSIGRNVDSAARDVQAAINAAVSDLPTDLPTLPKFRKFNSAAAPVYILALTSKTMPASAIYDVADTVLAQRISQVPGVGDVTVSGADQPAVRIALNPVALSNAGISTDDVRTAIINANPVGPVGSFDGPRLTETLSTNPQMRTAEQFRSIVIKSDTNGTVRLSDVATVSDATRNARTIAWYNKQPAVIIQITKQGDANVIETVDRVKALLPELKQWIPAGVDISVLADRTGTIRASVDDMQWTLLATAVLVMAVVLLFLRRLTPTIAAGVSVPLALAGTCAGMWISGFSINNLSLMALAIAVGFVVDDAIVMIENMYRNLERGMAPLPAAMEGARQIGFTVLSISLSLVAAFAPLIFMDGLIGRLLREFSLTLTFAIVVSTVVSLTVTPMICAHYIRAEASPKQTWFDRAVEGTLNRIVGFYAWTLRGVLSVPWLTVVVFIATIALTVTLYIKVPKGYFPIDDSGFIIGSTRASADISFQSMRTLQEELADIVMADPAVSGVGSVLGGGGPGAGGANRGTMFINLKPTAEREGVTTQMVIDRLRRQLSRVAGIRLFMFAAQDLRGGGRSSESNYQYTLSSPDLDLLQKWAPIVAKRMQTVDGITDVTSDRDDGGLQLTLSIDRTMASRLGVRIQDIDNALNNAFSQRQIATIYTQRNQYQVVLEIDPNFQTDPTDLKRIYVDSTSGDQVPLSAVVRAERGLAALAVAHTQGVPSTTVSFNTLPDVPLQEATANIQRAVDELHMPEGIRGSFDGNAGDFRATSNKQPLLILAAFIAMYIVLGVLYESLAHPLTIISTLPSAGLGALLALLVTGTELSVIAFVGIIMLIGIVKKNGIMMVDFALEAERERGLPSADAIFEACIVRFRPILMTTLAALFAAIPLVVAVGPGTELRRPLGITIIGGLFVSQVLTLYTTPVIYLLIDRVRQRRWRRGAPAAVPAE

SEQ ID NO: 74376 - DNA, 3132 bp, Rhodopseudomonas palustris CGA009
  CDS (1)..(3132): transl_table=11
atggcaagcttcttcatcgcccgtccgatctttgcctgggtggtggcgatcttcatctgcctcgccggcgtgctggcgctgccgttccttccggtggcgcaatatccgatcatcgctccgccgtcgatctcgatcgcgacggtgtatccgggcgcgtcgacgcagaatttgtactacggcgtcacccgcctgattgaagaggaactgaacggcgcagccggcatcctcagctacgagtcgaccagtgacacgacgggcgaggtcgagatcgtcgcctcgtttcagcccggcaccgacatcgcccaggcgaccgtcgacgtccagaaccgcatcaagcggatcgagccgcggttgcccgaggcagtgcgcaaggaaggcatcgccatcaccgaggcgagcagcgcgatcctgcaattcgtcacgctgacatcgagcgacaacagcctcgacgagatcggcctcggcgacgtcgccacccgctacgtgcttccggagctgcggcgattgcgcggcgtcggacgggtccgactgttctcgaccgaacgcgcgatgcggatctggctcgatcccgacaagctcctcgggctcggcctcaccgcgcaggacgtcgacagcgcgatcgccgcgcagaatgcgccagtggcgtcgggcctgctcggcgtgcagccgacgccggtccagcagcgcctgcagaacatggtcctggtgaaggggcagctcgactcgcttgaggagttcggcgacatcgtgctgcgcgccaatccgaacggctcgactgtgcggctcgccgatgtcgcccggctcgaggtcggcggcctggcctactcgttctccacccggctcgacggccggccggccgcggccgtcgcagttcagctcgctccgtcgggcaacgccctcgccacgtcggaagcggtgaaagcgcggatggcggagctggccgcgttctttccgccgggcgtgaagtacgaagtctcctacgacgtcacaccggtgatcgccgcatcggtcaagaaggttctgctgaccctcgccgaggccgtggtgctggtgttcctggtgatgttcctgttcctgcagaacatccgctacacgatgatccccaccatcgtggttccgatcgcgctgctcgggacctgcgcggtgctgctgggcctcggcttctcgatcaacgtcctcaccatgttcggcatggtgctggcgatcggcattctggtcgacgacgccatcgtggtggtcgagaacgtcgaacgcatcatgtccgaggagggactgtcaccacgcgcggcgactgagaaagcgatggagcagatcaccggcgcggtgatcggcatcaccttggtgctgatggcggtgttcgtgccgatggcgttctttccgggctcggtcggcatcatgtatcagcagttctcggcggcgatggtggtgtcgatcggcttctcggcgttcctggcgctgtcgctcacgccggcgctgtgcgcaacgctgctgaagccggtcgaaaagggacacgggcacgccactcgcggcttcttcggttggttcaatcgccggctcgaccgggcgacgcgcagctacggcaatgcgacacgctggatggtggcgcgcggcggtcgcttcatgctgctctacgttgtcctgctggccgtgctgtcctttgcgttctggcgattgccgggcggattcgtcccgatcgacgaccaaggcttcgtcatggtcgatgtcctggcgccctcggacgccagtgccaaccgcaccgccgacgtcgtgcgcagcgtcgagaagacgcttgcggcgacaccgggtatcgacaaggtgaccttcatcaccggcttcagcttcttcggccagggcgcgaacaccgcgcaggccttcgtctctttgaaggactggtcggaacgcagctcgaacgaaagcgccgacgcgctgatcgcccggctcaatccggaattcgccaagatccgcgatgccgacgtctcggtcctggcgccgccaccgatcgacaatctcggcaccaccagcggtttcagcttccgcctgcaggatcgttcgcaacgcggctatgacgccttgatggtcgcgaaggacgagctgctggcggcggcggctcgatccccggtgttgagcagcgttaccgtggaaggcttgccgccggcgccgcaggtgcggctcgacatcgaccggcgaaaagcggcagctctcggtgtcaccttcgcggccatcaacggcgcgctctcgaccaatctcggatcgagttacatcaatgactttctcaatctcggccggatgcagcgggtggtcgttcaagccaacgaagacaagcgcgtgaagccagaagacctgctgagctacagcgtcaggaacaatgccggcgagatggtgcctttctcgtctttcgcccgtgtcgcctgggtggtggggccgactcaggttgttggcttcgatggctacccgtcggtgcggctcaccggcaacccggcgccgggctacagctccggcgatgccatcgctgagatggagcgactgatgcgcaccttgcccggcggcttcggctacgcttggaccgggcaatcgctgcaggaaaagctcgccggttcgcaagcggtctttctgctcggcctatcgatcctgttcgtcttcctgtgtctggcggcgctgtacgagagctggtcgatcccgttcgccgtgatgctcgcggtgccgctcggtcttgtcgggtcggtcgccgcagcgatgctgcgcggactgcccaacgacgtttatctgacggtcgggattgtcaccatcatcggcctgtcggcgaagaacgcgattctgatcatcgagttcgccaaggacctgcgcgcccacggcacgccgctggtggaggcgactatcacggccgccgaactgcgcttccgcccgatcatcatgacgtcgctcgccttcatcctcggcgtggtaccgctggtgatcgcgagtggcgccagcgcagccagtcagcaagcgctcggcacgggcgtgctcggcggaatgatcaccgcgaccgtgctcgcggtgttctgggtcccggtgttcttcgtcgtggtgatgcgattcttcgccggccgccgaacggcaccggaggcggacaccggtcagatgccagcctga

SEQ ID NO: 74377 - protein, 1043 aa, Rhodopseudomonas palustris CGA009
MASFFIARPIFAWVVAIFICLAGVLALPFLPVAQYPIIAPPSISIATVYPGASTQNLYYGVTRLIEEELNGAAGILSYESTSDTTGEVEIVASFQPGTDIAQATVDVQNRIKRIEPRLPEAVRKEGIAITEASSAILQFVTLTSSDNSLDEIGLGDVATRYVLPELRRLRGVGRVRLFSTERAMRIWLDPDKLLGLGLTAQDVDSAIAAQNAPVASGLLGVQPTPVQQRLQNMVLVKGQLDSLEEFGDIVLRANPNGSTVRLADVARLEVGGLAYSFSTRLDGRPAAAVAVQLAPSGNALATSEAVKARMAELAAFFPPGVKYEVSYDVTPVIAASVKKVLLTLAEAVVLVFLVMFLFLQNIRYTMIPTIVVPIALLGTCAVLLGLGFSINVLTMFGMVLAIGILVDDAIVVVENVERIMSEEGLSPRAATEKAMEQITGAVIGITLVLMAVFVPMAFFPGSVGIMYQQFSAAMVVSIGFSAFLALSLTPALCATLLKPVEKGHGHATRGFFGWFNRRLDRATRSYGNATRWMVARGGRFMLLYVVLLAVLSFAFWRLPGGFVPIDDQGFVMVDVLAPSDASANRTADVVRSVEKTLAATPGIDKVTFITGFSFFGQGANTAQAFVSLKDWSERSSNESADALIARLNPEFAKIRDADVSVLAPPPIDNLGTTSGFSFRLQDRSQRGYDALMVAKDELLAAAARSPVLSSVTVEGLPPAPQVRLDIDRRKAAALGVTFAAINGALSTNLGSSYINDFLNLGRMQRVVVQANEDKRVKPEDLLSYSVRNNAGEMVPFSSFARVAWVVGPTQVVGFDGYPSVRLTGNPAPGYSSGDAIAEMERLMRTLPGGFGYAWTGQSLQEKLAGSQAVFLLGLSILFVFLCLAALYESWSIPFAVMLAVPLGLVGSVAAAMLRGLPNDVYLTVGIVTIIGLSAKNAILIIEFAKDLRAHGTPLVEATITAAELRFRPIIMTSLAFILGVVPLVIASGASAASQQALGTGVLGGMITATVLAVFWVPVFFVVVMRFFAGRRTAPEADTGQMPA

SEQ ID NO: 74378 - DNA, 3141 bp, Rhodopseudomonas palustris CGA009
  CDS (1)..(3141): transl_table=11
atgttctcgcgcttcttcatcgaacggccggtgttgtccaacaccctcgccttcctgatcgtcctgctcggcgccttggcgctgatgcggctgccggtgtcgcaatatcctgacgtggtgccgccgacggtgtcggtctccgcgacctatccgggcgccagcgcgcgcaccgtgatggattcggtagcgctgccgatcgagcagcaggtcaacggcgtcgagggcatgatctacatgcaatcgaccagcgccagcgacggcagctacaatctggtcgtcaccttcgacatcggcaccgatccgaacatggcgcaggtgctggtgcagaaccgggtgtcgctggccagcgcgcaattgccgacgtcggtctcgacccaaggcctcaacatcaagaagaagtcgaccgcgatcctgcaattcgtcagcttggtttcgtccgacggccgctacgacaacctgtttctcgccaactacgccaagatcaacatccagaacgagctggcgcggctgcccggcgtcggcgacgtctcggtgctcggctccggctcctacgcgatgcggatctggctcgatccggacaagctgcaaagctatggcctgacgccgagcgacgtgataagcgccgtgcagcagcagagcaaccaggtcaccgccggcctggtcggcggcccgccggcgccgtcgatcgtgaatttccagtacgcgctcgacgtcgtgggccgcttcaacgaagccaccgatttcgagaagatcgtggtcaaagcggtcgaccagggcggcggccagctggtgaggatcggcgacatcggccgcgtcgagctgggcgcgtcgtcttacggccagaacgctacgctcgacggcaagccctcggccgcgatcgcgatttcgctgctcaccggcgccaacgcgctgtcggtggcagaggcggtgaacgccaagatgaaggagatggcgggctcgtttccggccggtctcgactacaaggtgtcgttcgacagcaccaagttcatcaccgcctcggtcgacgaggtgtacgaaacgctgatcatcgccgccgtgctcgtgctggtggtgatcctgatgttcctgcaggactggcgagcgatgctggtccccgccaccaccgtgccggtgacgatcatcggcgcgtttgcggcgatgtcggcgatgggcttcacggtcaacaccaccagcctgttcgcgctggtgctggcgatcggcatcgtggtcgatgacgccatcgtcatcgtcgaaggcgtatcccgccacatcgccggcgggatgtcgagccgcgaggccgcggtgaaggcgatgtcggagttgttcggcccgatcatcggaatcaccctggtgctgatggcggtgttcctgccggccgccgccctgcccggcctcaccggcaagatgtatcagcagttcgcgctggtgatcgccgccaccgcgctgatctcggccgtcaacgcggtgacgctgaagccgacgcaatgcgcgctgtggctgcgcgcgccggtgccgccggagcagcgcggcatcgtctatcgcgtcttcaacgcggtgtatgcgcgttgcgaggcggtgtacgcggcgctgatccgccgcctggtggcgttcagcatcccgaccaccatcgtcggactggcgctggtcggggtcgcgttctacgggctgtcgcgggtgccaaccgccttcctgccctcggaagaccagggctatttcatcatcagcctgaagctgccggatgcggcctccgccgggcgcagcgacgccgccgtggccaaggcggtcgagctggtgcgcaagactccgggcgtcgaaagcgtgatcggcgtatcgggcatctcgccgctcgacaacaacgccacgatgtacaacgccggcatgctgtacgtggtgctgcacgactgggatcagcgcaagaccaaggatctcagcatcgatgcgatcgccgccaaggtgcgcgccgcgctcgcccagctcgacaccgcgaccgcgctggtgctgatgccgccgccgatccagggcatcggcaacaccagcggcttcaccatgatggtggagatgaaaaacggcagctcggatttcctggcgctgcagaacgccaccgaacagctcgccgccaacgcctcgacccagagcggcatcacccacgcggcctcgaccttcaagggcaacgtcaagcagcttcgcctagtggtggaccggatgaaggcggagacgctcggcgtcaccgtcggccaggtgttttccgccgtcgaaagctatctcggctcgacctacgtcaaccaattcaccaagttcaacaacgtgttccaggtctatgtccaggccgacgcgccgttccgcctgcgccccgacgacgtgttgaagctgaaggtgaagggctcgggcggccagatggtgccggtcggcgcggtcgcgtatctgaccgacgaggtcggcccgccgctgatcacgctgtacaacctgtacccggccgcgacactggtcggcagcccggcggccggcttcagctccggcgaagcaatgtcgctgatgagcgaagtcgcggccaagtcgctgcccgcttcgatgggtacggcttggaccgggatgtcgtatcaggagcaggtggtcggcgatcagatctactacgtgttcgcggtggcgctgctcttggtgtatttcgtgctcgccggacaatacgaaagctggctgcagccactggcggtgatcctcgccgtgccgctgaccctgctcggcaccgtcgcggcgctggaatggtcgggcctgccgaatgatctctatacgcaaatcggcatcgtgctgctgatcgcactggcggcgaagaacgcgattctgatcgtcgaatatgcgcgcgagaaatgtatggaaggcatgccgatcgccgaggccgcagtggaggccgcgcggctccggttccgcccgatcctgatgacctcgttcgccttcatcttcggcatgctgccgctggcgctcgcgaccggcgccggtgccggcgcccgcgtgtcgctcggcatcgccgtggtggccggcatgctggcctccacggggctggcggtgctgttcgtgccggcgttcttcgccgtgctgcagcggctggggacgcggcgtcaagccgccgcctctccggccgagggataa

SEQ ID NO: 74379 - protein, 1046 aa, Rhodopseudomonas palustris CGA009
MFSRFFIERPVLSNTLAFLIVLLGALALMRLPVSQYPDVVPPTVSVSATYPGASARTVMDSVALPIEQQVNGVEGMIYMQSTSASDGSYNLVVTFDIGTDPNMAQVLVQNRVSLASAQLPTSVSTQGLNIKKKSTAILQFVSLVSSDGRYDNLFLANYAKINIQNELARLPGVGDVSVLGSGSYAMRIWLDPDKLQSYGLTPSDVISAVQQQSNQVTAGLVGGPPAPSIVNFQYALDVVGRFNEATDFEKIVVKAVDQGGGQLVRIGDIGRVELGASSYGQNATLDGKPSAAIAISLLTGANALSVAEAVNAKMKEMAGSFPAGLDYKVSFDSTKFITASVDEVYETLIIAAVLVLVVILMFLQDWRAMLVPATTVPVTIIGAFAAMSAMGFTVNTTSLFALVLAIGIVVDDAIVIVEGVSRHIAGGMSSREAAVKAMSELFGPIIGITLVLMAVFLPAAALPGLTGKMYQQFALVIAATALISAVNAVTLKPTQCALWLRAPVPPEQRGIVYRVFNAVYARCEAVYAALIRRLVAFSIPTTIVGLALVGVAFYGLSRVPTAFLPSEDQGYFIISLKLPDAASAGRSDAAVAKAVELVRKTPGVESVIGVSGISPLDNNATMYNAGMLYVVLHDWDQRKTKDLSIDAIAAKVRAALAQLDTATALVLMPPPIQGIGNTSGFTMMVEMKNGSSDFLALQNATEQLAANASTQSGITHAASTFKGNVKQLRLVVDRMKAETLGVTVGQVFSAVESYLGSTYVNQFTKFNNVFQVYVQADAPFRLRPDDVLKLKVKGSGGQMVPVGAVAYLTDEVGPPLITLYNLYPAATLVGSPAAGFSSGEAMSLMSEVAAKSLPASMGTAWTGMSYQEQVVGDQIYYVFAVALLLVYFVLAGQYESWLQPLAVILAVPLTLLGTVAALEWSGLPNDLYTQIGIVLLIALAAKNAILIVEYAREKCMEGMPIAEAAVEAARLRFRPILMTSFAFIFGMLPLALATGAGAGARVSLGIAVVAGMLASTGLAVLFVPAFFAVLQRLGTRRQAAASPAEG

SEQ ID NO: 74380 - DNA, 3153 bp, Rhodopseudomonas palustris CGA009
  CDS (1)..(3153): transl_table=11
atgcccgatttcttcatcgcgcggcccgtgttcgcatgggtcgttgccatcttcattatgatcgccggcgcgttggcgatcccgtttctgccggtggcgcaatatcccaatatcgcgccggccaagatctcggttactgcgaactatccgggggcatcatccgaagaaatctaccagggcgtcgtccggctgatcgaagatcagctcgccggcattcccggcctgatgtacttcgagtcgaccacggacgcgaccggccagatctcgatcgaggtgtcgttccagccggggacgtcgctggcgcaggcgacggtggatgtgcagaaccgcatccgccgggtggagtcgcggctgcccagcgccgtgacacagcgcggcattctggtcgacgaagcctccagcaccttcctgatgttcatctcggtgcagactaccgacggctcgctcgatagcatcgcggtcggcgactacatcacccgtaatatcatcagcgagatccgccgggtcgagggcgttggcaaggcgcagttgttcggcacccagcggtcgatgcgggtgtggatcgatccggacaagctgttcggcgtcggcctgaccgtcagcgacgtctctgccgcgatcgccgcgcagaacgcgcaggtcgcagccgggcggatcggcgcgacgcccaaccctgtgtcgcaggaagtcaccgcgccggtcctggtcaagggccagctcggtacgcctgaggaattcggcgccatcgtgctgcgcgccaatcgcgacggctcgtcggtacggctgcgcgatgtcgcccgggtcgaggtcggcggcgaggattacaattcggagagtcggctgaacggccagcccgccgcttcgatcggcgtgcagttgtcggcgactgccaatgcgctcgctacctccagggccgttaccgccaagatgaaggagctttcgcagtatttcccgaaagggatgacctacgagattccttacgacaccaccccgttcatcaaggcgtcgatcgagaaggtgctgtacacgctcgccgaagcgatcgcgctggtgttcgtggtgatgttcctgttcctgcagaacatccgctacaccctgatcccgaccctggtggtgccgatcgcgctgctcggcacctgtgcggtgatgttcgccaccggcttctcgatcaacgtgctgacgatgttcgcgatggtgctggcgattggcattctggtcgacgacgccatcgtggtggtcgaaaacgtcgagcgcctgatggcgaccgagggcctgtcgccgcgcgaggcgaccatcaaggcgatgaagcagatcaagggcgcgatcgtcggcatcacgctggtgctgacggcggtgttcctgccgatggcgttcttccccggcgcggtcggtatcatctatcggcagttcagtctgacgatggtggtgtcgatcctgttctcgagcttcctggcgctgaccctgacgccggcgctgtgtgcgacgttcttgaagccggtacccgacgatcatcacgagaagggcggcttcttcggctggttcaaccggactttcgcacgcatcgcgggccgctatcgcaatggcgtcggctgggcgaccggacggaccgggcggctgatggtggtgtatctggcgctgctggcggggctcggctgggcttacttgcggctgcccgcgtcattcctgccgaccgaggatcagggttatctgatcgtcgacatgcaggcgccgaccgaagcgacgcagacccgcgcgatgacgtcgatcgagcaggccgagaaggtgttcctcgccgatcccagcgtttcgcaggtgttcaccgtctcgggcttcagcttttccggtaactcgcagagcgcagcggtggcgtttgtgacgttgaaggattggagcgagcgtggccacgacagcgcaggtgcgatcgcccggcgcgccaatgttgaactggcgaagatcggcgacgccgcggtgatggcgttcgagccgccgccgatcgacggcctgggcaacttcaccggcttcaccttccgcctgcaggaccgtggcagccgcggcaccgctgcactcgacgatgccgcgacgcgcctgactgcggccggcgccgccagtccggtgctgaccggcgtgcgggtcgaggggctggccaattcggcgcagctgcatctggtgatcgaccgtgagaaggcgaacgcgctcggcgtgtcctttgccgacatcaacgccaccatcaccgcgagtctcggctcggcctatgtcaacgacttccccaacgccggccggatgcagcgcgtcaccatccaggcgcaggatgatcgccgcatgcagacggacgatctactcaagctcaacgtccgcaacgccagtggacggatggtgccgctgtcggccttcgcgcggaccgaatggtcgaaggggccgatccaggtgatcggcttcaacggctatccttcggtgcgttttgccggcgacgccgcacctgggcattcctcgggtgaagccatcgccgagatggaacggctggccaagcagttgccgagcggtttcggcttcgaatgggctgggcagtcgttgcaggaaatcaagtccggcaatcaggcgccgttcctgctcggactgagcgtgctgttcgtgttcctgctgctcgcggcgctttacgaaagctggtcgatcccgctgtcggtgatgctggtcgtgcccctcggcgtcatcggcgcgctgttggcggtgatgctccgcgacatgccgaacgatatctacttcaaggttggcctgatcgcgatcatcggcctgtcagccaagaatgcgatcctgatcgtcgagttcgccgaggacctgcatgccgaaggaaagtcgctgcgcgaggcagcgatcgaggcggctgcggtccgcttccgcccgatcatcatgacctcgctcgccttcatcctcggcgtcacgccgctggcgtttgcgagcggcgtcagcgccggcagccagaacgcgatcggcaccggcgtgttcggcggcatgctgtcacccaccgtactggcggttctgttcgtgccggtgttctacgtcttcgtgctgcagaaagtggaacagcggaaggcggcaggcaacaagggcgcgacaggcaagggcgagccgcaatcgacaacggttgcgcgatcgtag

SEQ ID NO: 74381 - protein, 1050 aa, Rhodopseudomonas palustris CGA009
MPDFFIARPVFAWVVAIFIMIAGALAIPFLPVAQYPNIAPAKISVTANYPGASSEEIYQGVVRLIEDQLAGIPGLMYFESTTDATGQISIEVSFQPGTSLAQATVDVQNRIRRVESRLPSAVTQRGILVDEASSTFLMFISVQTTDGSLDSIAVGDYITRNIISEIRRVEGVGKAQLFGTQRSMRVWIDPDKLFGVGLTVSDVSAAIAAQNAQVAAGRIGATPNPVSQEVTAPVLVKGQLGTPEEFGAIVLRANRDGSSVRLRDVARVEVGGEDYNSESRLNGQPAASIGVQLSATANALATSRAVTAKMKELSQYFPKGMTYEIPYDTTPFIKASIEKVLYTLAEAIALVFVVMFLFLQNIRYTLIPTLVVPIALLGTCAVMFATGFSINVLTMFAMVLAIGILVDDAIVVVENVERLMATEGLSPREATIKAMKQIKGAIVGITLVLTAVFLPMAFFPGAVGIIYRQFSLTMVVSILFSSFLALTLTPALCATFLKPVPDDHHEKGGFFGWFNRTFARIAGRYRNGVGWATGRTGRLMVVYLALLAGLGWAYLRLPASFLPTEDQGYLIVDMQAPTEATQTRAMTSIEQAEKVFLADPSVSQVFTVSGFSFSGNSQSAAVAFVTLKDWSERGHDSAGAIARRANVELAKIGDAAVMAFEPPPIDGLGNFTGFTFRLQDRGSRGTAALDDAATRLTAAGAASPVLTGVRVEGLANSAQLHLVIDREKANALGVSFADINATITASLGSAYVNDFPNAGRMQRVTIQAQDDRRMQTDDLLKLNVRNASGRMVPLSAFARTEWSKGPIQVIGFNGYPSVRFAGDAAPGHSSGEAIAEMERLAKQLPSGFGFEWAGQSLQEIKSGNQAPFLLGLSVLFVFLLLAALYESWSIPLSVMLVVPLGVIGALLAVMLRDMPNDIYFKVGLIAIIGLSAKNAILIVEFAEDLHAEGKSLREAAIEAAAVRFRPIIMTSLAFILGVTPLAFASGVSAGSQNAIGTGVFGGMLSPTVLAVLFVPVFYVFVLQKVEQRKAAGNKGATGKGEPQSTTVARS

SEQ ID NO: 74382 - DNA, 3153 bp, Rhodopseudomonas palustris CGA009
  CDS (1)..(3153): transl_table=11
atgttctccgctattttcgtcgatcgaccgcgctttgccatcgtcatcgccatcctgatgacgatcgtcggactgttggcgctgacccgcatcccggtcgcccagcttcccgacatcgtgccgccgcaggtccaggtcaccacgctgtatcccggcgcctcggcggaggtgttggagtcgaccgtggcgcagccgctcgaagcgcagatcatcggcgtcgacaagatgatctacatgaagtcgtcgagcggcaacgacggcagctacacgctgacggtctcgttcgaactcggcagcaaccccgacatcaacacggtcaacgtcaacaaccgcgtgcagacctcgctgtcgcaattgcccgccgaggtgcagctgcagggcgtcaccgtcaagaagaagtcgtcgtcgattctgcaggtcgtgatgctgtccagcgacggcaagtacgatccactgttcatgaccaacttcgccaccatcaacgtgctcgacgaactggcgcggaccccgggcgtcggatcggcgtcgctgttcgggcgtctgaattattcgatgcggatctggttcgacaccatccggctcaccagcctcgggctggtgccgtcagacgtggtcaaggcgatccagagccagaacattcaagcgccggtcggccgcatcggcgcccgcccggtgagctcggatcagcagcttcagattaatgtgcagacccagggccggctgtcctcgcccgagcagttcaagaacgtcgtgatccgcgccaatccggacggctcggtgttgcgggtcggcgacgtcgcccgggtcgagatgggggcgcagaacgaggacgtcgaggcccgcctcaacacttcgccgtcggtcgcgatcggcatctacctggcgccgggggccaatgcgctcaacgcgtcgaccgcggtcaatgccacgctcgacaaaatccgcggccgggttccggcgggattgaaggttcggtcgatctacgacgccactactatcgtcaacgagaccgtggatgaggtgttgaagacgctggtcgaggcgttcatcctggtcgcgatcgtggtgttcgtcttcctcggcaatttgcgcgccaccatcgtgccggtgatcgcggtgccggtcagcatcattgcctcctacgccgtgctgctggtgctcggctattcgatcaatacgatttcgctattggcgctggttctcgccatcggcatcgtcgtcgacgacgccatcgtggtggtggaaaacgtcgagcgaatcatggaggaggagccggagatttccgccgccgacgccaccaagaaggcgatgcggcaggtcaccgggccgatcatcgcgattaccatggtgctgttctcggtgttcgtgccgattggattcatcccagggatttccggcgaattattccggcagttcgccgtgacgatcagcgcggcgatgtttgtttccgcaatcaacgcgctgacgctgtcgccggcgctgtgcgcggtgttcctgaggcattcgccgcatcgcggcgcgctggcgcggatcggtcacggcatcgacaaggtgcgcaacggctacgccttcgtggtgcacaagtcgctgcggatggcggcgatctcgctgcttttggtcggcggctgcgcgctcgggtccggcttgttgtcgcgcatcactccgaccggcttcctgcccgaggaagaccagggcgctttcttcatcaacatccagcttccggaaagcgcctcggtggaacgcaccagcagggcggtggcgcagctcgaggatattctgggcaagatgccccaggtcaaggataccatcgcggtggtgggattctccattctcgaccaatatggcgcgtccaacagtgccctggtgatcgtcaccctgaagccgttcgagaatcgccgaggcgcgatggactcggcgcaggcgctgatcgccaagaccttcggtgcggcgacgcagatcaaggccgcgaccgtcatcccgttcaatctgccgccggtgatcggactttcgaccagcggcggattcgaaatacagctcgagaatcttgcgggcggcgatttcgccaccatgggcaatgtcacgctgggactgctggccgccgccaatcaggatccgaagctcgcgcgggtgttctcgacctacgcggcgagttcgccgtcgatctatctcgatatcgatcgggaaaaggccgaggcgctcgggctcggtatcaacgacatcttcacgtcgctacaggcgacgctcggcggctactacgtcaacaacttcaatctctatggtcggacctggcaggtcaacatccaggcggagtccgaggaccgacgcgatctgtcggcgctgtggagcatctatgtccgcaacgccaagggcaccatggtccccttgcaagcggtggcctcggtacggaccgtggtcgggccggcggtgatcacgcgctacaacaattatcgctcggtcaccgtgatgggatccaccgcgccaggagtttcgtccggcgacgcgatggcggcgatggagaaggtcgcagccaatacgctgccgtccggatacgccttcgaatggaccgggacctctttccaggagcagaaggtgggcggccagaccccggtgattttggcgcttgcggtgctgttcgcctacctgtttctggtcgcgctgtacgaaagctgggtcattccgatcccggtgctgctgtcggtcacggtcggcgtgcttggcgcgtttttcggtcttctggtcagtgggctggcgctcgatctctatgcccagatcgggctggtggtgctgatcgcgatggccgcgaaaaacggcatcctgatcgtcgaattcgccaaggagcagcgcgaagccggagccagcatcatcgaggcggccgagaccggggcgaagctgcggtttcgcgcggtgatgatgacgtcgatcgccttcatcgccggtcttgcgccgctggtctgggccgacggtgccgcaaagatcgcgcgtcgtagcgtctcgacgccggtgttcgccgggatgctggcggcgagcctgctcggcatcttcgtcattccgatgctctacgtgacctttcagacgctgcgcgaacgggcggcgcgcttccggcgcaagccgggcgagaccaccgcggtcgcgccgcatccgcccaaccggtaa

SEQ ID NO: 74383 - protein, 1050 aa, Rhodopseudomonas palustris CGA009
MFSAIFVDRPRFAIVIAILMTIVGLLALTRIPVAQLPDIVPPQVQVTTLYPGASAEVLESTVAQPLEAQIIGVDKMIYMKSSSGNDGSYTLTVSFELGSNPDINTVNVNNRVQTSLSQLPAEVQLQGVTVKKKSSSILQVVMLSSDGKYDPLFMTNFATINVLDELARTPGVGSASLFGRLNYSMRIWFDTIRLTSLGLVPSDVVKAIQSQNIQAPVGRIGARPVSSDQQLQINVQTQGRLSSPEQFKNVVIRANPDGSVLRVGDVARVEMGAQNEDVEARLNTSPSVAIGIYLAPGANALNASTAVNATLDKIRGRVPAGLKVRSIYDATTIVNETVDEVLKTLVEAFILVAIVVFVFLGNLRATIVPVIAVPVSIIASYAVLLVLGYSINTISLLALVLAIGIVVDDAIVVVENVERIMEEEPEISAADATKKAMRQVTGPIIAITMVLFSVFVPIGFIPGISGELFRQFAVTISAAMFVSAINALTLSPALCAVFLRHSPHRGALARIGHGIDKVRNGYAFVVHKSLRMAAISLLLVGGCALGSGLLSRITPTGFLPEEDQGAFFINIQLPESASVERTSRAVAQLEDILGKMPQVKDTIAVVGFSILDQYGASNSALVIVTLKPFENRRGAMDSAQALIAKTFGAATQIKAATVIPFNLPPVIGLSTSGGFEIQLENLAGGDFATMGNVTLGLLAAANQDPKLARVFSTYAASSPSIYLDIDREKAEALGLGINDIFTSLQATLGGYYVNNFNLYGRTWQVNIQAESEDRRDLSALWSIYVRNAKGTMVPLQAVASVRTVVGPAVITRYNNYRSVTVMGSTAPGVSSGDAMAAMEKVAANTLPSGYAFEWTGTSFQEQKVGGQTPVILALAVLFAYLFLVALYESWVIPIPVLLSVTVGVLGAFFGLLVSGLALDLYAQIGLVVLIAMAAKNGILIVEFAKEQREAGASIIEAAETGAKLRFRAVMMTSIAFIAGLAPLVWADGAAKIARRSVSTPVFAGMLAASLLGIFVIPMLYVTFQTLRERAARFRRKPGETTAVAPHPPNR

SEQ ID NO: 74384 - DNA, 3099 bp, Geobacter sulfurreducens PCA
  CDS (1)..(3099): transl_table=11
atgaacattgccgaaatcttcatccgccggccggtcatgacgagtctcatcatgctggcggttatgcttttcggcctcatcgcctacgacaagctgccggtcaatgacctgcccaccgtcgactatccgaccatccaggtttccgccactctgccgggcgccaaccccgacaccatggcctcatcggtggcacttcccctggagcgcgagttctccaccattgccggtgtcgactctatgacctccaccaacggcatcggcatatcccgcattaccatcaagttcaccctggagcgggacatcgatgccgcggcccaagatgtccaggccgccatttcaagggcccagcgccagcttcctcaggacatgccggcccctccatcgttccagaaggtgaatccggctgatcagccgatcctctatctggtcctcagttcgccgacgcttcccctctccacggtccacgaatacgccgataccatgatcgcccagcggatttccatggtcaacggcgtagcctcggtacagatctacggctcccagaaatatgcggtacgggttcaggtggaccccaaggccctggcggcccgcaaaatcggcattgacgaggtggcccaggccctggagcgggggaacgtgaaccttcccaccggcaccctccagggaaagcacgaggccctgacgatccagaccagtggccagctttacagcgcaaaggagtatgagccgctcatcgtcgcctatcgcaacggttcaccggtccgtctcggagagatcggccgggttattgacagcgtggagaacgacaaggtggccggctggtacaaacagacccgtgccattgtcctcgccatccaacgccagccaggcaccaataccatcgaagtggtaaacaggattaaggagctgcttccccagttccgctcccaactccccggctcggtggacctgagtatccactttgaccggaccgaggggatcaaggagtcggtcgccgatgtgaagttcactatggtgctcaccatctgcctggttatcatggtgatctttctcttcctgcgcaacctgccggcaacggtaattccgagcctggcgctaccgctctccattgtcggtgctttttcggccatgtacctgatggggttttcggtcaataacatctcactgttggctctgaccctgtcggtgggcttcgtggtggacgacgccattgtcatgctggagaacatcgtccgtcacctggagaagggggagagccccatggaggcgtccctccgcggctcccgcgagatcggattcaccattgtctccatgaccatttcattggtggcggtctttatcccggttcttttcatgaaagggatgctcggccggctgctccacgaattcgccgtcaccatcagcctggccattctcatttccggcttcgtatcgctctcgctgacacccatgctatgcagccgcttccttcgtccgcacagtggcgaaaagggccacggcaggttttatacggtcatggagcggtttttcgacggcatgtaccgcctctatgaagtgactctggcaaaggttctgaggctccgccggaccgtgttggccggcacccttgccatgaccctgctcaccatctggctcttcacgagaatccccacagggctgctgcccagcgacgacatcggggccatcttcgctattaccgagggtgcccaggggatttccttcgaggaaatgaaggccaagcagcagcagttggcggccattgtgctccaggacccgaacgttgaaggattcatgtcttcggcgggcgccgccgggagccgggtgtcctccaattcggggttcatgttcattcggctcaagccccgccacgagcggaagcttaacgcggatcaggtcatccagcagctccggccgaaagtcatggctgtgcccgggattctcatgttcctccagaatccgccgccgattcgactggaggctcagttggccaagagccagtatcagttcgtgctccagagtcccgatacggatgaactctaccggcgcgcagccgacctggaggccagattgaagcaggtgccgctcctgctggacgtgaccagcgacctccagctcaataatccccaggtgcaactcgacatagaccgggacaaggcgtcggccctcggcatcaccgcccaccaggtggaggatgccctctattacgcctacggctcccgccaggtttccaccatctttgctccaaacaaccagttcaaggttatcctggaactggagccccgctaccagaccgacccggcagccctgtccatgctttacatccgttcccagcagggcgaccttgttcctctcaacaccctcgccaccctgcggcggaccctcggtcccctttccgtgaaccatctggggcagatcccggcggtgaccatctcctttaacctgcgaccggacacccctctcagcgaggccgtgtcagccatcgagcaggtgagccgcgatacgcttccagcttcattcaccaccagtttccagggagttgcccaggcctaccagcagtcgaccacggggctaattgtcctgatcatcatggcgatcgtggtaatctacattgtcctcggtattctttatgagagctacatccatcccctcaccatcctgtcgggtcttccgtcagccgggttcggggcactcattaccctgatgatcttcggcaaggaactgaatctctacggctttgtcggtctcatcatgctgattggcattgttaagaaaaacgcgatcatgatgatcgacttcgccctggaggcccagcgcaccgaagggaaaccgccgctggaggcaatccaccagggggctctcgtccgtttccgccccattatgatgaccaccatggcggcgctgatggggacactccccattgcgctggggatcggtgccggggccgaggccaggcgcactctggggctggcagtggtgggggggcttctggtgtcccagttgctgaccctttacataacaccggttatttattactacatggaccgcatgcagggatggttcgtcgggaaactgccgggccgccggagggtcagcgcatga

SEQ ID NO: 74385 - protein, 1032 aa, Geobacter sulfurreducens PCA
MNIAEIFIRRPVMTSLIMLAVMLFGLIAYDKLPVNDLPTVDYPTIQVSATLPGANPDTMASSVALPLEREFSTIAGVDSMTSTNGIGISRITIKFTLERDIDAAAQDVQAAISRAQRQLPQDMPAPPSFQKVNPADQPILYLVLSSPTLPLSTVHEYADTMIAQRISMVNGVASVQIYGSQKYAVRVQVDPKALAARKIGIDEVAQALERGNVNLPTGTLQGKHEALTIQTSGQLYSAKEYEPLIVAYRNGSPVRLGEIGRVIDSVENDKVAGWYKQTRAIVLAIQRQPGTNTIEVVNRIKELLPQFRSQLPGSVDLSIHFDRTEGIKESVADVKFTMVLTICLVIMVIFLFLRNLPATVIPSLALPLSIVGAFSAMYLMGFSVNNISLLALTLSVGFVVDDAIVMLENIVRHLEKGESPMEASLRGSREIGFTIVSMTISLVAVFIPVLFMKGMLGRLLHEFAVTISLAILISGFVSLSLTPMLCSRFLRPHSGEKGHGRFYTVMERFFDGMYRLYEVTLAKVLRLRRTVLAGTLAMTLLTIWLFTRIPTGLLPSDDIGAIFAITEGAQGISFEEMKAKQQQLAAIVLQDPNVEGFMSSAGAAGSRVSSNSGFMFIRLKPRHERKLNADQVIQQLRPKVMAVPGILMFLQNPPPIRLEAQLAKSQYQFVLQSPDTDELYRRAADLEARLKQVPLLLDVTSDLQLNNPQVQLDIDRDKASALGITAHQVEDALYYAYGSRQVSTIFAPNNQFKVILELEPRYQTDPAALSMLYIRSQQGDLVPLNTLATLRRTLGPLSVNHLGQIPAVTISFNLRPDTPLSEAVSAIEQVSRDTLPASFTTSFQGVAQAYQQSTTGLIVLIIMAIVVIYIVLGILYESYIHPLTILSGLPSAGFGALITLMIFGKELNLYGFVGLIMLIGIVKKNAIMMIDFALEAQRTEGKPPLEAIHQGALVRFRPIMMTTMAALMGTLPIALGIGAGAEARRTLGLAVVGGLLVSQLLTLYITPVIYYYMDRMQGWFVGKLPGRRRVSA

SEQ ID NO: 74386 - DNA, 3111 bp, Geobacter sulfurreducens PCA
  CDS (1)..(3111): transl_table=11
atgaacattaccgacctttttatccgccgccccgtgctggccctggtggtcagcctgatcatcgtcatcgccggcctccaggcgatccgcagcctgaacgtgcgccagtacccccgcagcgagaacgcggcggtgaccgtaaccaccgtgtacgtgggggccagcgccgacctggtgcggggcttcgtcaccacgccgctggaacgggccattgccgcggcagacggcatcgagtacatggagtcccagagtaccctggggctttccaccatcaaggtgcgcctgaagctgaactacgacggcaccaaggccctggccgagatcagctccaaggtggaccaggtgcgccgcgacctgccgcccgaggcggaggtgccggtcatcaacatcgagtcggccgacagcgagttcgcttcggcctacctgagcttctcctcagacatcctccagcagaacgagatcaccgactacctggtgcggatcgtccagccgcggctttcggcgatccagggggtgcagcgggccgacgtgctgggggcccgcacctttgccatgcggatctggctgaagcccgaccggatggcggccctcaacgtgagcccggcccaggtgcgcgaggccctggcggccaacaacttcctggccgccctggggcggaccaaggggtccctgatccaggtgaacctcaccgccaacaccaacctgaacacggtggaggagttccggcagctggtggtgcggcgccaggacggcgccctggtgcggctgtccgacatcgccgacgtgtcgctgggggccgaggactatgacgccgaggtccgcttctcgggccagaccgccgtgttcatggggatctggcccctgcccaacgccaactccctcgacgtgatcaagcgggtaaggacggagatggcggccatccagagggacctcccctcggggcttcaggcccgcgtggcctacgacgccaccgattacatcgacaacgccatccgggaagtgctcaagaccctgagcgagaccctgctcatcgtcatcgtggtgattttcctcttcctgggctccctccgctcgtccctggtgccggtggtggcgatcccggtgtcgctcatcggcgccgtgttcctgatgcaggccttcggcttcaccgtgaacctgctgacgctcctggccatcgtcctgtcggtggggctcgtggtggacgacgccatcgtggtggtggagaacgtggagcggcacatgcgggaggggcagtcgcccctggaagcggcgttcctcggcgcccgggagctggtggggcccatcatcgccatgaccatcaccctggccgccgtctacctccccatcggcctccaaggggggctgaccggctccctgttccgggagttcgcctttaccctggccggggcggtgaccatttccggagtggttgccctgaccctgtcgccggtcatgtcggccaagttcctgaagccgggcgccggcgagcacggcctggccggacggatcagccgcgacttcaaccggctcaaggatgcctacggccgctggctcgacgccaccctggccgcccggccggcagtctatacggtctggctggtggtgagtctcctggccatccccatgttcactatgtcggcgcgggagctggcccccaccgaggaccagggggtcatcttcggcatcctggacgcctcggccaactcgaccctggaccagacgagccgctacgccgccgcggccaacaaggtgttcatgggcatccccgagaccgacttcaccttccagatcaccttccccaactcgggcttcggcggcatggtcaccaagccgtgggacgagcgggagcggaccgtgttccagatgatgcccgaggttcagcaaaagctggccgccatccccggcatccagatgttcccggtgaccccgccggccctccccggaggcgggcaattcccggtggagttcatcctggcctccaccgccgagaccggccagatcctcgagttcgcccagaagctccagctgaaggccatgcagagcggcatgttcgcctttccgcccatcatcgacgtgaagatcgaccagcccgaggcccggttcgagatcgaccgggacaaggtggccgccctgggcctcaacctggaacaggtgggggccgatctgggcgccatggtgggggggaacttcgtcaaccgtttcgacatcgccggacggagctacaaggtcatcccccagatcgagcgggtgggacgcctcaaccccgagcagctctcgtcggtctacatcaccggccccgagggtaagctcatccccctgtccaccgttgccagcctgaaggagaccgtggttccccgctccctcaaccggttccagcagctgaacgcggtcaagctgagcggcgtggccgtgcgccccctggacgaggcgcttcgcttcctggaaggggaggcggcaaaaatcctgccccagggatacgtgctcgactacaccggcgagtcgcgccagctccgcaccgaggggaacaagttcctcccggccttcgccctggccattgtcctgatcttcctggtgctggcggcccagttcaacagcttccgggaccccttcgtcatcctggccggctcggtccccctggccatattcggggcactcatcttcaccttcctgaagatgccagaccccaacgtggccttctggacccacggctggaccaccaccctcaacatctactcacaggtgggactggtgaccctggtggggctggtgtccaagaacggcatcctgatcgtggagttcgccaaccagccccagctccaggggctgtccaagcacgacgccgtacgccaggcagccatgacccgcctcaggccgatcatgatgaccaccgcggccaccattgccggccactttcccctgaccctggtctccggcgccggcgctgcggcccggaattccatcggcctcgtgctggtgggggggatgttcgtgggcaccctcttcaccctgttcgtggtcccctccatctacatgctggtggcccgcgaccacagccgcgaccgggagcgcgaggcgacggtggcggccgaaggtgcggcgaccaatccctga

SEQ ID NO: 74387 - protein, 1036 aa, Geobacter sulfurreducens PCA
MNITDLFIRRPVLALVVSLIIVIAGLQAIRSLNVRQYPRSENAAVTVTTVYVGASADLVRGFVTTPLERAIAAADGIEYMESQSTLGLSTIKVRLKLNYDGTKALAEISSKVDQVRRDLPPEAEVPVINIESADSEFASAYLSFSSDILQQNEITDYLVRIVQPRLSAIQGVQRADVLGARTFAMRIWLKPDRMAALNVSPAQVREALAANNFLAALGRTKGSLIQVNLTANTNLNTVEEFRQLVVRRQDGALVRLSDIADVSLGAEDYDAEVRFSGQTAVFMGIWPLPNANSLDVIKRVRTEMAAIQRDLPSGLQARVAYDATDYIDNAIREVLKTLSETLLIVIVVIFLFLGSLRSSLVPVVAIPVSLIGAVFLMQAFGFTVNLLTLLAIVLSVGLVVDDAIVVVENVERHMREGQSPLEAAFLGARELVGPIIAMTITLAAVYLPIGLQGGLTGSLFREFAFTLAGAVTISGVVALTLSPVMSAKFLKPGAGEHGLAGRISRDFNRLKDAYGRWLDATLAARPAVYTVWLVVSLLAIPMFTMSARELAPTEDQGVIFGILDASANSTLDQTSRYAAAANKVFMGIPETDFTFQITFPNSGFGGMVTKPWDERERTVFQMMPEVQQKLAAIPGIQMFPVTPPALPGGGQFPVEFILASTAETGQILEFAQKLQLKAMQSGMFAFPPIIDVKIDQPEARFEIDRDKVAALGLNLEQVGADLGAMVGGNFVNRFDIAGRSYKVIPQIERVGRLNPEQLSSVYITGPEGKLIPLSTVASLKETVVPRSLNRFQQLNAVKLSGVAVRPLDEALRFLEGEAAKILPQGYVLDYTGESRQLRTEGNKFLPAFALAIVLIFLVLAAQFNSFRDPFVILAGSVPLAIFGALIFTFLKMPDPNVAFWTHGWTTTLNIYSQVGLVTLVGLVSKNGILIVEFANQPQLQGLSKHDAVRQAAMTRLRPIMMTTAATIAGHFPLTLVSGAGAAARNSIGLVLVGGMFVGTLFTLFVVPSIYMLVARDHSRDREREATVAAEGAATNP

SEQ ID NO: 74388 - DNA, 3099 bp, Bdellovibrio bacteriovorus HD100
  CDS (1)..(3099): transl_table=11
atgacattgtctgatttatctattcgcagacccgtctttgcctggatgttgatgttcggtctgatcgtctttggggcgatcagctttatgcgcatgggcgtcagtgaacttccggatgtggacttcccggtgatttccatctccgtgcgctacgagggcgcggctccggaagtgatggaagccgatgttattgacccgatcgaagatgccctgatcagtatccagggtgtgaagaatatttcttcggtggcccgtaacagcacctcggacatcacagtggagttcgatctggagcgcgatattgatgtcgccttccaggatgtgcaggccaagatgtcccagattcaggatgctttgccgcaaaacatggattcaccgacggtgatgaaaattaatcctgaggacttcccgatcatgtggctgtctctttccagtaacaagatgccactggaagaaatgatggtctttgtaaaggactatgtccgggaccgtttgacgacagtcccaggggtggggaacctgtggatgccgggttatctggagccgaacatgcgggtctgggtccgcaatgaagacctgaatcgttatgctctgtcagtgattgatgtgaccaacactctgcgcacggagcatgcggaacctcccgccggacgtgcggagtacaacaaaaccgaatacagcctgcgcacgttgggtgaagccaaaaccatcgaacagttcaacaagatcctggtgaactcccgtggcggtggaccgaactatatgccgattcctctggaaaaagtggtggagtttaaagagggcatggtcgatgtcgtgcagtttgcgcgtgccaacggcaaagcagccgtgggcctgggcgtggtcaaacaacgcggctcgaatgcggtgacagtggctcacgcagtgaagggccgcattgccgagattcaaaagaccctgccggaaggaatgcagatcgttgtgaattatgacggcaccaagttcgtggaagagtccgtgcacgagctggtgttgaccctgattctggcggccattctgacttctttggtgtgctggcttttcctgggatcctggtcatcaaccttcaacgttttgctggcgatcccgacatccgtgctgggaagtttcatcattctttactttgccggcttcaccctgaatatctttacattgatgggtttaagtttggcgattggtatcgtcgtcgatgatgccatcatggttctggaaaatatcatcaggcacctggaaatggggaaaaccaaacgcgaagccgctctggttggagccagagaaatcaccttcgccgccatggcggcttctgtgtctctggtggccatcttcttgccgatcgcgtttatggaaggtctgatcggtcggttcctgttccagttcggtgtgaccatgagtgctgcggtcatgatttcccttctggaagccctgacgctgacaccgatgcgtgcttctcagtttgtggataccggagagcgcaccacccgtatcggccgcggatttgagcatctgttcgaccgtcttaagaatgcctacacacgcagtctggagatctcgttgaaccatcgctggaaggtgattctcgcctcattgtttttctttgtcttgagctttggatcagtggtcttcctgaaaggggagttccagccggcgcaggatcaaagttccctgatgattcaaatcagcaatccacccaaatcagctatttcattcaccgacgaaaaggtgaagatcattgaagacttcctgcttaaacgttccgaagtcagttcgaccttcgtggcggccggcggcttcaccggtggtgaagccaacaatgccatcatctttgtcgacatgaagcccaaaggccagcgtggcaagtctgcggaaaagaacaaagaactgagccagcaggaattcatcgaagttgtgcgtgagtacctgaataaaaccatcccggattcgaaaccccaggtgcaggatccgtcaacccagggcttcgggggcggcggaggcaagggcttcccggtggagttcagtattcaggggccggattggaatgagctgggtaaattctcagaacagattgtggaggagcttaaaaccagcaagatcatgacggacgtcagttcggactatcaggccggggctccggaagtacagatcatcccgaatcgtcaaaaggcggcggatcgcggtgtcagtgtgattgccatcggcgaagttcttaatgcgatgatgggtggcgtggtggttggaagctatgaaaagggcgggcatcgttatgatattcgcgtgaagatgcttgaaaacggccgcaatccgcaggagcgcatcaaagatctgaaagtgcgcaacaaccgcggggagcttgttccaattgcttcggtggttgatatcaaagaggcatccgttgcttccagcatttcgcgcaagaaccgtcagcggtcgattatcatttatggaaatatcggccccggtctgagtcagcagcagtccgtggacaaggcccaggaagttgctcgcaaggttctgccggcggaatacaaagttttactgagtggatctgctgaagaattccagcaaagcttcatgagtctgatctttgccctcgtgcttggatttatcgtggcttacatgattctggcttcccagtttaacagctttatcgatccggtgacggtcttcatggccttgccattcagcttctcaggggctttcctggcgctgttgattgggggtcagtctttgaatatcttcagcatgatcggtttgatcttgttgatgggtatcgtgaaaaagaactccatcctgctggtggatttcaccaatcaaagaagggatgctgaaaagattcacgtgcatcaggcactgatcgaagcgtgtccgacacgtcttcgtccgatcctgatgacatcctttgcgaccattgccggggctgtgccggcggccatgagtctgggcccgggagcagaggcccggcagccgatggctatcgcggtcatcggcggggtgtttgtttccaccttcctgactctttacgtggttccttgtgtctatagtctgtttgctcgattcgacagacgggaaacttctatgtaa

SEQ ID NO: 74389 - protein, 1032 aa, Bdellovibrio bacteriovorus HD100
MTLSDLSIRRPVFAWMLMFGLIVFGAISFMRMGVSELPDVDFPVISISVRYEGAAPEVMEADVIDPIEDALISIQGVKNISSVARNSTSDITVEFDLERDIDVAFQDVQAKMSQIQDALPQNMDSPTVMKINPEDFPIMWLSLSSNKMPLEEMMVFVKDYVRDRLTTVPGVGNLWMPGYLEPNMRVWVRNEDLNRYALSVIDVTNTLRTEHAEPPAGRAEYNKTEYSLRTLGEAKTIEQFNKILVNSRGGGPNYMPIPLEKVVEFKEGMVDVVQFARANGKAAVGLGVVKQRGSNAVTVAHAVKGRIAEIQKTLPEGMQIVVNYDGTKFVEESVHELVLTLILAAILTSLVCWLFLGSWSSTFNVLLAIPTSVLGSFIILYFAGFTLNIFTLMGLSLAIGIVVDDAIMVLENIIRHLEMGKTKREAALVGAREITFAAMAASVSLVAIFLPIAFMEGLIGRFLFQFGVTMSAAVMISLLEALTLTPMRASQFVDTGERTTRIGRGFEHLFDRLKNAYTRSLEISLNHRWKVILASLFFFVLSFGSVVFLKGEFQPAQDQSSLMIQISNPPKSAISFTDEKVKIIEDFLLKRSEVSSTFVAAGGFTGGEANNAIIFVDMKPKGQRGKSAEKNKELSQQEFIEVVREYLNKTIPDSKPQVQDPSTQGFGGGGGKGFPVEFSIQGPDWNELGKFSEQIVEELKTSKIMTDVSSDYQAGAPEVQIIPNRQKAADRGVSVIAIGEVLNAMMGGVVVGSYEKGGHRYDIRVKMLENGRNPQERIKDLKVRNNRGELVPIASVVDIKEASVASSISRKNRQRSIIIYGNIGPGLSQQQSVDKAQEVARKVLPAEYKVLLSGSAEEFQQSFMSLIFALVLGFIVAYMILASQFNSFIDPVTVFMALPFSFSGAFLALLIGGQSLNIFSMIGLILLMGIVKKNSILLVDFTNQRRDAEKIHVHQALIEACPTRLRPILMTSFATIAGAVPAAMSLGPGAEARQPMAIAVIGGVFVSTFLTLYVVPCVYSLFARFDRRETSM

SEQ ID NO: 74390 - DNA, 3153 bp, Bdellovibrio bacteriovorus HD100
  CDS (1)..(3153): transl_table=11
atgagactgtcggatatttctattaagaatcctgtatttgcgtggatgctgatgttcggtctgatgattttcggactgatttcgttttctcgcatgggcgtcagccagatgccggatgttgacttcccaaccgtgacggtgagcgttagcctggatggggcagctcccgaagttatggaaactcaggtggtggatccgattgaatcctcactgatgacggtggaggggatcgaatccatcaaatccagcagtaaaaccggcagcgccagcatcacggtggaatttgacctggatcgtaatatcgatctggcggttcaggacgtgcaggcgaaaatctcgggcattcaaagaatgcttccggacgacgtggatcctccgtccatttccaaaaccaatcccgatgatcagcccattctgtggttggccctgacttacgataaagaagacccggaattcctgatgcgctatgcgcgtgactatctgaaggaccgcttcacgacggtggaaggtgtcggtgacatcttcctgggtggttacaccgatccggtgatgcgagtgcatgtgcgcccgaaagatctgcttcgttataatatctctgtgaatgacgtggttgatgccatccgcaatgagcattccgagcttccgggtggttatatccagaccgacaaaaaaaccttcaacgtgcgcacgatgggtgaggcaaaaacggaagaggaattccgcaacatcgtgatcagccgccgtgcgggtgtgactgtggccgatccgaccaacatggtaaaaatccgccaggtggccgatgccagcatggggctggacaaaattgaacgtatgtcccgctttaacgggaagacggcgctcggtcttgggatccgcaaacagcgtggcaccaatgccgtgtccgtggcgcgtgcggtgaaagaacaaatcactgttattcaaaaaactctgcctccgggcatgaatcttcaggtgaactttgacagcaccaagttcatcgagcagtccgtgggcgagttgaacaagcacttggttctggcggtgattttcacgtccctggtgtgctggatgttcctgggaagctggtcggcgaccttcaacgtgctgttgtcgattccgacgtcgttgcttggggccttcatcggtctttatttcctgggttacacgctcaacacgttcacgctgttgggcctgaccctggcaatcggtatcgtcgtggatgatgccatcatggttctggaaaatatcttccggtacaatgaaaacgggcgggggcgtatcgagtccgcgatccttggagcgcgcgagatttcgtttgcggcgatggcagccaccgcggccgtgattgcgatcttcctgccggtggccttcatgaagggtatcatcgggaagttcttcatgcagttcggggtgacaatctctatcgccgtgttcctgtcgctggtggagtctttgacgatcacaccgatgcgttgtgcgggcttcgttcaccatggtgaacgaaaaaccaaactgggcaagggctttgaggccctgatggaaaacacgcgcattggttacgaccgctggctgcgtgtcagtttgcagcacccatggaaggtgttgatcggttctttggtgtttgtggcggtgtcctttatttccatcaagttcctgaacaaagaaatgagcccggcccaggatcagagcatctttatggcccgtttgatcatgccggtgggaacatccttggcgtacacggatcagcaaaccaaaaaagctgagcagtggctgttgtcccgtcctgaaatcaagcaggtgtatgcggcgttgggcggctttggcggcggggtttctgattccaatgtcacgatgatgtttatcaccatgaaagaaaagaacgaacgcggcaaggaccctgagaccgggaaagttctgtcccagcaggagttcatgcaagtggctcgtaagaatctttccaagatcgaagacatgcgtccggtcctgatggatctgtcgcagcagggtttctcgggtggtcgtgggtatccgatcgaatttacgatcctgggttcagactgggataagctggcgaagtacaccgaagacatgatgaaggccatgactgacagcggtctgatggtcgatgtggattctaactatctgctgggtatgccagagattcaagttcagccggatcgcctggcggcggctcagcacggggtcagcatttcttccatcggctccacagtcagtgcgctgatcggtggtgtgaaagccggagagtacccacaaggcggacaccgttacgatatcaaactgaagcttctggatcagggtgatccaatgggcgagatcaaaactctgtttgtcggcaacagtcgaggcaacctgatcccgttgccgaaagtgaccaaagaagtgcaaacctccagcttgcagtcgatttcgcgatccaaccgtcagcgtgcgatcacagtcacggcgaatatgaagccgggggtgtcccagcaggcggccatggcttatattgaagacgcggcgaaaaagatgctggagccaggttacatgatcgatcagggcggaagctccaagacctttaaggagtccttccaaagcttgatctttgctttggtgatgggtctggtgatcgcctacatggttctggccagccagttcaattcctttatcgatccagtgacgatcctgatggcactgccattcagcttcagcggggcgttctttgcacttttgatcacggggcagtctttgaacatgttctcgatgattggtttgttgttgttgatgggtatcgtgaaaaagaattccatcttgctgattgaattcaccaacaccgtccgtgaccgtgggaccagtgcggcgctggatgcgctgattgaagcgtgtccgacacgtcttcgaccgatcctgatgacatccgtcgcgacggtggctgcggcgattccgtcggcgacggcgcgtggcgcggggtccgaaaccatgcgcccgatggcgatttgtcttatcgggggtgttgtggtgtccaccgcgctgaccttgttcgtagttccggcggtgtatctgctgatggataagttcaagaagcgtgacgaggttcgcgcgaaaaccaaacaagctttcgccgctgttggcgaggaaggcctggaggcctaa

SEQ ID NO: 74391 - protein, 1050 aa, Bdellovibrio bacteriovorus HD100
MRLSDISIKNPVFAWMLMFGLMIFGLISFSRMGVSQMPDVDFPTVTVSVSLDGAAPEVMETQVVDPIESSLMTVEGIESIKSSSKTGSASITVEFDLDRNIDLAVQDVQAKISGIQRMLPDDVDPPSISKTNPDDQPILWLALTYDKEDPEFLMRYARDYLKDRFTTVEGVGDIFLGGYTDPVMRVHVRPKDLLRYNISVNDVVDAIRNEHSELPGGYIQTDKKTFNVRTMGEAKTEEEFRNIVISRRAGVTVADPTNMVKIRQVADASMGLDKIERMSRFNGKTALGLGIRKQRGTNAVSVARAVKEQITVIQKTLPPGMNLQVNFDSTKFIEQSVGELNKHLVLAVIFTSLVCWMFLGSWSATFNVLLSIPTSLLGAFIGLYFLGYTLNTFTLLGLTLAIGIVVDDAIMVLENIFRYNENGRGRIESAILGAREISFAAMAATAAVIAIFLPVAFMKGIIGKFFMQFGVTISIAVFLSLVESLTITPMRCAGFVHHGERKTKLGKGFEALMENTRIGYDRWLRVSLQHPWKVLIGSLVFVAVSFISIKFLNKEMSPAQDQSIFMARLIMPVGTSLAYTDQQTKKAEQWLLSRPEIKQVYAALGGFGGGVSDSNVTMMFITMKEKNERGKDPETGKVLSQQEFMQVARKNLSKIEDMRPVLMDLSQQGFSGGRGYPIEFTILGSDWDKLAKYTEDMMKAMTDSGLMVDVDSNYLLGMPEIQVQPDRLAAAQHGVSISSIGSTVSALIGGVKAGEYPQGGHRYDIKLKLLDQGDPMGEIKTLFVGNSRGNLIPLPKVTKEVQTSSLQSISRSNRQRAITVTANMKPGVSQQAAMAYIEDAAKKMLEPGYMIDQGGSSKTFKESFQSLIFALVMGLVIAYMVLASQFNSFIDPVTILMALPFSFSGAFFALLITGQSLNMFSMIGLLLLMGIVKKNSILLIEFTNTVRDRGTSAALDALIEACPTRLRPILMTSVATVAAAIPSATARGAGSETMRPMAICLIGGVVVSTALTLFVVPAVYLLMDKFKKRDEVRAKTKQAFAAVGEEGLEA

SEQ ID NO: 74392 - DNA, 3102 bp, Bdellovibrio bacteriovorus HD100
  CDS (1)..(3102): transl_table=11
ttggggaaaaatgtattgtgcgaaaggaccactatgaacctgattgacctctcgattcgacgcccggtgtttgcatgggttctcatgtttgcattaattgtttttggcgccatttgcatgaaccgcatgggtatctcgcagcttcccgatgtggacttcccgattgtcagcgtttctgtggactatgagggcgctgcccctgaagtcgtcgaagccgagctgctggatcctatcgaggaaagactgcttgccatcgagggcatcaaggaaatgcgctcttcggcccgtcaggggtccggctctgtcacgctggaatttgatatcaaccgcaatgtcgacgtggtcttgcaggaagtgcaaaccgccctcagccgcatgcgctggcctccgggtgtggaccctgccaccatccgcaaacaaaatcctgaagaagacccgatcatcattctttccgtctatggcgaggctccgctcaaagagatgatcaactggaccgaaaactatctgctcgaccaagtccgcttcctggagggcgtgggcgaggtcagcatcggtggattcagtcagcgcaatctgcgcatctgggtggatccgaaaaaactttcagccttgtatctgaccctgactgatgttgtggatgccatcagctcccagcatctggaaagtgccgcaggccaattcaccgaaggcgaacgcgaactgcgtgtgcgctggttgggggaagccaccaatgtagaagatgtcgccaacatccagattctgcgacggggcggccagcgcatccacgaccgcaatatctttatccgggatgtcgcccgggttgaggacgggctttcagatatccgccgtgttgcccgggtggatggccgtcaggccgtttccatcatcgtgcgaaagcagcggggcacaaatgaggtcaccgtcgccaacgaggttcgtgaaaaactgaccagcatcaaggacaactttcctaaaggcttcaacttccgcgtgaatgtcgacttcacccgtccgaccgatgcgaccgtgaatctgaccattgaaaaactgtgggtggcggcattgatcaccattctggtctgcttcctgttcctgggaagcatctcggctgccgtcaacattctgttttccatcccgacgtcgattgtgggaacatttgtcatcctgtacttctcagggttcaccctgaatttgttcaccctgctggcactgacattgtcgatttccatcgtcgtggatgatgccatcatgctgcttgaaaatatcgtgcgccactatcgcatgggaaaaccatcggccaaagccgcctcggatggctccaaagaggttctgccggccgccatcgcggcgacattggcggtcatcgccgtgtttctgccggtggtctttatggatggcattatcgggaagttcttcttccaattcggtgtcacgatgagtgcggcggtgtcgctgtcgctgcttgaagcggttacgatcaccccgatgcgtgctgccgccctgttgtccagtgagcccaaagtttccaaactggagcactggctggacgaactgtttgaaaagttcgcgcactcctatcaaaaaattctgcacggcactttgcgattcaaatatgtggtggtgatcggctctttggtgttcttcgttgtgtccctgttcctggtggccaaagtccgtcaggaattcgtaccggcgcaagaccaggactttatcatcatcaatgcgcagatgcctccgggcacttcgcttgaaaaaaccagccgcgaagctgaaaaaatcgaagccatcctgaagcaggatgcatccgttgaaggctttgtcgtttctgtcggtggcggcggtgggggttccaacgtcaatcaggtctttctgcccgtggccctgaaaccccgtgcggatcggcagcaaggtcaccttgaaatcatgaacaaatggcgtgccgagtttcgcaagctgaaggacatgcgtgtttccatgcgtgatatttcggcgcgaaatctttcttcaggccgtcagaatccggtagcgatcaatttgcgtggaccggacttgaatgttctatttgaaaaatcccagcagctgatggagcgcctggaaaaagaaaatctggcggtggatctggattcggatttccgtaaagggatcccggagctggttctgaccccggaccgcaaagccatggccgcccggggagtctctgtcgaagacgtgggccgcattctttcagccggcgtcggaggcttgcgggaaggccgctacaccgccgatggccgtcgctatgacatccgctttaaattcctggaagatcagatccagaagccggaggatttcaaaaaactgtatgtgcgcaacaacttcggaaacctgatcccgctgtcccagttggtgaaaatcgaagaacaatccgccattcagggcatcagccgcgtgaaccgtcagcgtgcgatttccgtcttcggcaatctggcaccgggacagtcgcaggcaaaggttctggaccgcaccagcgccattgccaaagaaattctgccgacagggtattccttcgccctggaaggcgcctcggccggatttgcggattcattcaaaagtctttattccgccatgctggtggggattctggtggcgtatctgattttggcaattcagtttaactctttcatccatccggtgtcagttctggtcgccctgcccttcagtgtgaccggcgccctggtggctttgtggatgtttgatgtgtcactgaacctgttcagtttcatcggcttgattgttttgatgggtattgcaaaaaagaactcgatcttgctggtcgaattcaccaaccaagtgcgctatcacggcgaaaaggatatttccaaagccttgcttcaggcctgcccgatccgcctgcgcccgattctgatgacatcggtggcgaccgtggcggcagccatgccactggtgatcggacatggcatcggttcggaaacccgggtgccgatgggtctgtccatcattggcggaacaatcgtttcgacactgttgactttgttcgtggttccggctttgtatttgatgctgtcaccacttgaaagcaaaaagaaagaggtcgatctgtga

SEQ ID NO: 74393 - protein, 1033 aa, Bdellovibrio bacteriovorus HD100
MGKNVLCERTTMNLIDLSIRRPVFAWVLMFALIVFGAICMNRMGISQLPDVDFPIVSVSVDYEGAAPEVVEAELLDPIEERLLAIEGIKEMRSSARQGSGSVTLEFDINRNVDVVLQEVQTALSRMRWPPGVDPATIRKQNPEEDPIIILSVYGEAPLKEMINWTENYLLDQVRFLEGVGEVSIGGFSQRNLRIWVDPKKLSALYLTLTDVVDAISSQHLESAAGQFTEGERELRVRWLGEATNVEDVANIQILRRGGQRIHDRNIFIRDVARVEDGLSDIRRVARVDGRQAVSIIVRKQRGTNEVTVANEVREKLTSIKDNFPKGFNFRVNVDFTRPTDATVNLTIEKLWVAALITILVCFLFLGSISAAVNILFSIPTSIVGTFVILYFSGFTLNLFTLLALTLSISIVVDDAIMLLENIVRHYRMGKPSAKAASDGSKEVLPAAIAATLAVIAVFLPVVFMDGIIGKFFFQFGVTMSAAVSLSLLEAVTITPMRAAALLSSEPKVSKLEHWLDELFEKFAHSYQKILHGTLRFKYVVVIGSLVFFVVSLFLVAKVRQEFVPAQDQDFIIINAQMPPGTSLEKTSREAEKIEAILKQDASVEGFVVSVGGGGGGSNVNQVFLPVALKPRADRQQGHLEIMNKWRAEFRKLKDMRVSMRDISARNLSSGRQNPVAINLRGPDLNVLFEKSQQLMERLEKENLAVDLDSDFRKGIPELVLTPDRKAMAARGVSVEDVGRILSAGVGGLREGRYTADGRRYDIRFKFLEDQIQKPEDFKKLYVRNNFGNLIPLSQLVKIEEQSAIQGISRVNRQRAISVFGNLAPGQSQAKVLDRTSAIAKEILPTGYSFALEGASAGFADSFKSLYSAMLVGILVAYLILAIQFNSFIHPVSVLVALPFSVTGALVALWMFDVSLNLFSFIGLIVLMGIAKKNSILLVEFTNQVRYHGEKDISKALLQACPIRLRPILMTSVATVAAAMPLVIGHGIGSETRVPMGLSIIGGTIVSTLLTLFVVPALYLMLSPLESKKKEVDL

SEQ ID NO: 74394 - DNA, 3114 bp, Parachlamydia sp. UWE25
  CDS (1)..(3114): transl_table=11
atgatttcccatttttttatcgaccgccctatttttgctttcgttctttctatcattattaccttagcaggcttatttgcactgcgaatgttaccgatcgagcaatatccaaatattacgcctcctcaaattcaagtaacagcttcctatgccggtgctgatgcttcaacagtagcagccagcgttgcagcacccattgagcagctagttaatggagttgaagatatgatttatatgtattctcaaaattcttctaatggagacatagctttaagcatattttttgagattggaagtaatattgatatggctcaagttaatgtgcaaaatagagtcaacatggcccttccgcaacttcctgaagaagtgcagcgaacaggcgtgcaaattaaaaagcaaacgccaaatatattgcaattagttgcgatacagtcacctgatcaacgatatgacaatatttttgtgagtaattatacaactatcaatgttgtggatgaaattttacgtttaccaggaattagtaatgcaatgattgtaaatgcgcgtgattattctatgcgtatttggttaaggccagatcgattggctcaacttcaattgacaacgcatgatgtgatcaaagctgttcaagcgcagaacaataattttactgcaggtttacttggatatcctcctactaatagctccactcaattgacagttcctttgactggtcagggaagattagataacccaaaacaatttgagaatattattttaagagcaaataacgacggatcatatgttcaaattaaagatgttgggcgagttgagttgggtgcagccacgtatgatgtagatggttcattgaatggaaaaacgacatccatgattgctatttatccattatttggagctaatgctttggaagtagctggggaagtcagaaaaacaatggaacgtctttccaaaaatttcccagaagggcttgaatacacgattccttacgataccactgattttattacagcgtcgattcatgaagtgactaaaacaatttttgaagcggctattttggtttctttagtggttttaatttttttacaaaacttgcgagcgacactaattcctattatagccatgatcgtgtcaatcgttggtacctttgcaggaatgtatgtattagggttttctttaaatacactgaccttatttggaatggtattggcaattgggatcgttgttgatgatgcaatcgttgtaatagaaaatgtggaaagaaatatgcgtgagctcaaacttttgccaagagcagcagctcataaagcgatggaagaagtatcaggcccagttgtcgctattgtatttgtcctatgcgctgtattcattccagtcgcatttttgggcggaattgcgggtcaactttataagcagtttgcgattacaatatcagtatccgtggtaatttcaggatttgttgctttaacacttagtccagcattagctgcattaattttaaagcctcacacatctccttctcgtttttctctgttgtttaataaaggatttgatgcttttacaaatggttatatgcatattaccaaatggattttaaatcatgcctgggctgggcttttactttttacttctgttatcactatattagtcattttaaatcatgtgattcctacgagtttcattccccaagaagatcaaggatatttaatggcacttgtgaatatgccagatgcttctagcttagaccgcacaaaagaagtggatactgctattacagaaatagctttggacattccgggggttgaaaatatggtgtctttaacaggttttagtttgcttgaatctttaaatcgcctgcagatgggaactaattttattacattgaaaaattgggatcagcgtagaactcctgtgctacaagccggtgcgattcaagcagccttaaacaaaaaatatagtactatttctgatgcacaaatcatgacgttcaatccaccagccattcagggtcttggaactgttggtggttttgaattttggatagagaatcgaggggatggcgatattcaggcattagaaacagtgacccaaaattttattgcaaaagcacgtggaagaccggaattacagggattaacaacttctatccaaactaacaatatgcaactctatgtcgacttagatcggtataaagctgaaactttaggtgtgactattagtgaggtttttcaaacgttgcaaatctttttgggctctctttatattaacaattttaataaatttgggcgtgtttttcaggtaaatgtccaagctgagcctacttatcgctctaatttacaaaatctggaagatatgtatgtacgctcaatacataatgaaatggtccctttaaagtcatttttgagcactcactatacaaaaggagccaatttagttagccgctttaatggatttacaagtgctaaaattattgggggagctgcaccaggttatagttctgggcaggcgatggcagcaatggaacaactcgcaaaagaagaacttcctgagcaaatgacctatgcttggagcggcgaagcttatcaagaaaaaaaaacaggaggaacgtctacaaacgtcctgttaattggtgtattgatggtttttctgattctttcagctttatacgaacgttggtctcttccttttgctattatactagccgtaccatttggtttgatgggggcatttttagcaatttggatcagaggaatttcaaatgatgtctattttaatgttggcttagtcactttaattgctctgtcagcaaagaatgccattttaattgttgagtttgcaatcatcaaaagagaagaagggttatcagttttggaagcagctatggaagcagctaaactgcgttttagggccattttaatgacttctttaacatttattttaggggtttttcctctagttattagctcaggcgcaggtgctgcaagtcgacactcagttggaacgggtgtatttggaggcatgattgctgcgactatacttgccgtatttttagttcctctactttataaacttattgatcaacgtatagaaaaaaaagagaagagagagcatgtttag

SEQ ID NO: 74395 - protein, 1037 aa, Parachlamydia sp. UWE25
MISHFFIDRPIFAFVLSIIITLAGLFALRMLPIEQYPNITPPQIQVTASYAGADASTVAASVAAPIEQLVNGVEDMIYMYSQNSSNGDIALSIFFEIGSNIDMAQVNVQNRVNMALPQLPEEVQRTGVQIKKQTPNILQLVAIQSPDQRYDNIFVSNYTTINVVDEILRLPGISNAMIVNARDYSMRIWLRPDRLAQLQLTTHDVIKAVQAQNNNFTAGLLGYPPTNSSTQLTVPLTGQGRLDNPKQFENIILRANNDGSYVQIKDVGRVELGAATYDVDGSLNGKTTSMIAIYPLFGANALEVAGEVRKTMERLSKNFPEGLEYTIPYDTTDFITASIHEVTKTIFEAAILVSLVVLIFLQNLRATLIPIIAMIVSIVGTFAGMYVLGFSLNTLTLFGMVLAIGIVVDDAIVVIENVERNMRELKLLPRAAAHKAMEEVSGPVVAIVFVLCAVFIPVAFLGGIAGQLYKQFAITISVSVVISGFVALTLSPALAALILKPHTSPSRFSLLFNKGFDAFTNGYMHITKWILNHAWAGLLLFTSVITILVILNHVIPTSFIPQEDQGYLMALVNMPDASSLDRTKEVDTAITEIALDIPGVENMVSLTGFSLLESLNRLQMGTNFITLKNWDQRRTPVLQAGAIQAALNKKYSTISDAQIMTFNPPAIQGLGTVGGFEFWIENRGDGDIQALETVTQNFIAKARGRPELQGLTTSIQTNNMQLYVDLDRYKAETLGVTISEVFQTLQIFLGSLYINNFNKFGRVFQVNVQAEPTYRSNLQNLEDMYVRSIHNEMVPLKSFLSTHYTKGANLVSRFNGFTSAKIIGGAAPGYSSGQAMAAMEQLAKEELPEQMTYAWSGEAYQEKKTGGTSTNVLLIGVLMVFLILSALYERWSLPFAIILAVPFGLMGAFLAIWIRGISNDVYFNVGLVTLIALSAKNAILIVEFAIIKREEGLSVLEAAMEAAKLRFRAILMTSLTFILGVFPLVISSGAGAASRHSVGTGVFGGMIAATILAVFLVPLLYKLIDQRIEKKEKREHV

SEQ ID NO: 74396 - DNA, 3141 bp, Desulfovibrio vulgaris subsp. vulgaris str. Hildenborough
  CDS (1)..(3141): transl_table=11
atgttctctcgctttttcatcatgcggcccatcttcgccacggtcgtctcgctggtcatcatactggcgggcttcatggcgatgcgcgggctgcccatcgcacagtatcccgacatcatcccgccgcaggtcgaggtcgaggccacctactccggggccagccccgaggtcgtggccgccaccgttgccgcgccgctcgaacagcagatcaacggcgtggacaacatgctgtacatcaactccaccagttcgagtacaggcaccatgaacctcatggtgacgttcgaggtggggaccgaccccgaccaggcgaccatcaacgtcaacaaccgggtgcaggccgcgttgccgcagctgcccgaagacgtgcgccgccgcggcgtcacggtgaccaagaagtcgtcgaacatgcttcaggtcatctccatgaactcgcccgacgagcggtacgacaccatctacatcagcaactatgcgctggtgaacgtcatcgatgaactgcgccgtctcaagggcgtgggtgacgtggtgctgttcacggcgcaggactactccatgcgcgtgtggttgcagcccgacaagatggcccaactgcgcctcacgccttctgacgtcatcggtgccatccaggagcagaacgcccagttcgccgccggtcgcatcgggcagcagccgctgcacgacccggtcgaactgaccttcatggtcaacaccaaggggcgcctctccacccctgaagagttcgagaacatcatcctccgcgtcgaggaggacggctcgaccctcaagctcaagagtgtggcccgcgtcgaactcggcgccaaggactacaacttcatgggcaaggagaacggcaagcccacggttcccatcggcatcttcctcgcgccgggggccaacgcgctggagacggcagaccgtgtcagcgcggccatggccgagatgtcgctgcgtttccccgatggtgtgagctattccataccgtacgacaccaccaagttcgtgcgcgtctccatcgacgaggtggtcaagacgctgttcgaggccatggtgctggtgttcatcgtcatctacctgttcctgcagaactggcgtgccaccatcattccctgcctcgccgtcccggtgtcggtcatcggtgcgttcgcgggcatgtacatgctcggcttcaccatcaacacgctgaccctcttcggtctggttcttgccatcggcctcgtggtcgacgacgccatcatcgtgctcgagaacgtcgagcgcatcatggccgaagagcacctgccggtgaaacaggccaccatcaaggccatgcacgaagtggccagccccatcgtcgccaccgtgctggtgctgtgcgcggtgttcatccccgtcgccttcgcgggcggcctcgcggggcagatgtacaagcagttcgccatcaccatcgcggtgtccatggccatctccggccttgtggcgctgaccctttcgcccgccctgtgcgccatgttcctgaagccgggccatcaggagcccaacaggttcttccgctggttcaacaactggttcgaaggcgtcaccaaccgctatacggcgggcgtcacgttcctgctcaagcgcatggcgctgggccttgtgctcttcgccgggttgtgcggtgtgacgtggcacctgttcagtatcgtgcccggcggcctcgtgcccgacgaagaccaggggtatgtcatggccatggccatcctgcccgacggttcggccctcaaccgcacggaagtggtcaccgaccgtcttgccaaggcggcctccaacgactccagcgtacagagcgtcatggccttcaccggctacgatgcggtctccggcaccaacaagcccaacacgggcttcagctggatcatgctgaagccgtgggaagagcgcaaggaggagtcggaatcgtcatactcggtggtgcagcgcatcttcagggaaggtgcgggctataccgagggcgtcgtcatcgccttcaaccccccgcccatctcgggcatgagcaccacgggcggcttcgaggtgtacctgcagaaccgtggcaccggcgacagcaaggagcttgcggccatggtgcagaagttcgttggcgcggcccagaagcgtcctgaacttgcaggcgtctcatccaccttcggtgccaataccccgcagctcttcgtggaactcgaccgtaaccgcgccaaggcgctgggcgtgtccatcaatgagctgttcgccaccatgcagtcgacgttcggtacctactacgtcaacgacttcaacaagttcggacgtacgttcatggtcatggtgcaggcagatgcccagtaccgcgacaaccccgacgacctcacgaaggtgtacgtgcgctcgaacaagggcgacatgatcccgctcgcctcgctcatcaaggtggagcgcatcacggggacggaagtcgttgagcgcttcaacgtgttccccgccgcgaagatcgtgggcggccctgcccccggctacagttcgggacaggctcttgctgtcatggaggagctcgccgccgaggtgctgcccgccgagtattccctcggctggatcggctcggcctatcaggagcgcctcacgggcggtacctcgttcatggtgttcgccctcggcctcgtgatggtgttcctcatcctcgcggcgcagtacgagaagtggtcgttgcccctggcggtcatcatgatcgtgcccttcgccctgttcggtgccatggccgccacatggctgcgtggcctcgacaacgacgtgtacctgcaggtctcgctggtgacactcatcggccttgcggccaagaacgccatcctcatcgtggaattcgccatgatgcaggtgcatgagggcaagggcatcgtcgaatcggtgaccgaggcggcacgactgcgcttcaggcccatcatcatgacgtccatggccttcgtgctgggctgcgtgccgctggccatcagctcgggtgctggcgcggcaggacggcacgccatcggtaccggcatcatcggcggcatgctggcggcgaccttcatcgccaccttcttcattccgctgttctttaggcttatcatggaactgagcgcccgtttcaccggcggccatcaggcttccggcgacggggaggaggcacgatga

SEQ ID NO: 74397 - protein, 1046 aa, Desulfovibrio vulgaris subsp. vulgaris str. Hildenborough
MFSRFFIMRPIFATVVSLVIILAGFMAMRGLPIAQYPDIIPPQVEVEATYSGASPEVVAATVAAPLEQQINGVDNMLYINSTSSSTGTMNLMVTFEVGTDPDQATINVNNRVQAALPQLPEDVRRRGVTVTKKSSNMLQVISMNSPDERYDTIYISNYALVNVIDELRRLKGVGDVVLFTAQDYSMRVWLQPDKMAQLRLTPSDVIGAIQEQNAQFAAGRIGQQPLHDPVELTFMVNTKGRLSTPEEFENIILRVEEDGSTLKLKSVARVELGAKDYNFMGKENGKPTVPIGIFLAPGANALETADRVSAAMAEMSLRFPDGVSYSIPYDTTKFVRVSIDEVVKTLFEAMVLVFIVIYLFLQNWRATIIPCLAVPVSVIGAFAGMYMLGFTINTLTLFGLVLAIGLVVDDAIIVLENVERIMAEEHLPVKQATIKAMHEVASPIVATVLVLCAVFIPVAFAGGLAGQMYKQFAITIAVSMAISGLVALTLSPALCAMFLKPGHQEPNRFFRWFNNWFEGVTNRYTAGVTFLLKRMALGLVLFAGLCGVTWHLFSIVPGGLVPDEDQGYVMAMAILPDGSALNRTEVVTDRLAKAASNDSSVQSVMAFTGYDAVSGTNKPNTGFSWIMLKPWEERKEESESSYSVVQRIFREGAGYTEGVVIAFNPPPISGMSTTGGFEVYLQNRGTGDSKELAAMVQKFVGAAQKRPELAGVSSTFGANTPQLFVELDRNRAKALGVSINELFATMQSTFGTYYVNDFNKFGRTFMVMVQADAQYRDNPDDLTKVYVRSNKGDMIPLASLIKVERITGTEVVERFNVFPAAKIVGGPAPGYSSGQALAVMEELAAEVLPAEYSLGWIGSAYQERLTGGTSFMVFALGLVMVFLILAAQYEKWSLPLAVIMIVPFALFGAMAATWLRGLDNDVYLQVSLVTLIGLAAKNAILIVEFAMMQVHEGKGIVESVTEAARLRFRPIIMTSMAFVLGCVPLAISSGAGAAGRHAIGTGIIGGMLAATFIATFFIPLFFRLIMELSARFTGGHQASGDGEEAR

SEQ ID NO: 74398 - DNA, 3126 bp, Desulfovibrio vulgaris subsp. vulgaris str. Hildenborough
  CDS (1)..(3126): transl_table=11
gtgaacgtcacggagttcttcatccgcaggccggtgacgaccacgctcgtcatgctggggctgctcttcttcggcgtgatgggctaccgccagcttccggtgagcgacctgcccaacgtcgacttccccaccatacaggtgcgggcgcaactgccgggggcggacccggagaccatggcctcgtcggtggctgcccctctggaacggcaattcgccaccatcgcgggcatcgactccatgagttccaccaacacgcagggcaacacgcgcatcaccatccagttcaacctttcgcgtgacatcgacgcggcggcgcaggacgtgcaagccgccatatcgacagcgcagcgcaagctgccgtcagacctgaccacgccacccagctaccagaaggtgaacccggccgaccagcccatcctctttctcgcgctcacatcgcccacgcttcccctctccaaggtcaacgaatacgccgagacgcgcatcgggcagaccatctccatggtctcgggggtggcgcaggtcaacgtctacggtgccaagaagtacgcggtgcgggtgcaggtcgacccgaggcggctgaaggcgctgggcctcggtatcgacgaggtgtccgccgccgtggacaaggccaacagcaacctgcccacgggcaccctgcaaggcgaacacacggcgagcatcatcaaggcatccgggcagttgtatgacgctgcggcctacaggcccgtggtggtcgcctaccgcaacggagcgcccgtgcgtctcgaagagttgggccgggtcgtggatagcgttgaacaggaccgcatcctcaactggttcaacgacgaacggggcatcgtgctggccgtgcaacgccagcccggcaccaacacggtggaggtggtcgaatccatcaagaggctgctgcccgaattcgagcggcagttgcccgccgccgtgaagctgaacatcctgttcgaccggtccgagtccatcaaggcgtcggtggccgaggttaagttcacgctggtgctcacggtgtgcctcgtggtgctggtcatcttcctgtttctgcgcagcctgtcggccaccgtcattcccagcctcgccctgcccatgtcggtggtggtgaccttcgccgccatgcacatgatgggcttcagcctcgacaacctctctctcatggccctgacgctggcggtgggcttcgtcgtggacgatgccatcgtcatgctggagaacatcgtgcggcacatggagatgggcaagactccgctacgggccgccctcgacggtgcgcgcgagataggcttcaccatcatatccatgacggtgtcccttgcggcggtgttcatccccgtactgttcatggggggcatcgtgggacggttgttccacgaattcgccgtggtcatcaccgtcgccatcctcctttcgggcttcgtctccctgtcgctcacgcccatgctgtgcgcgctgttcctcaagccgcatgtggggcagagacggcacgggcgggtatacaacgcgctggagaccttcttcgagacgctgcaccgggggtatgaacgttcgttgcggttcacgatgcggcaccaccgcatgacgttcggcctgtcgatggtggtgcttggtgtcacggtgtggcttttcgccgccatgcccaagggctttctgcccagtgaggataccgggcagatttccggcttcaccgaggccgaccagtccgtctccttcgggcagatggtgaagctgcagaagaccctgcaccccatcatcgcggctgaccccggcgtggactcgttctcgtccaccgtgggcgcgggcggtcccaacgtgggcggcaactccgggcgtttcttcatcaggctgaaggatttcgacgagcgcgacgagcatgtcgacaccatcatcaaccgcctgcgggccaaactctccggctttccgggcatcaacgtctttctcgtcaacccgcccagtatcaacgtgggcggacgcgcttccaagagcctctaccagtacacactgcaagggcctgacaccgccgaactgtacaaggcgggaacggaacttgaggcggccctgcgcgagttgccccaactgcgcgacgtgaccagcgacctccagatacgcaaccccgaagtgcgggtggacatcgaccgtgacaaggccgccgcactgggcctcagcgtgcatcaggtggaggacgccctgcaatcggcctacggtacgcggcaggtctcgaccatcctcgcaccggacaacgactatcaggtcatcctcgaactgttgcccgaataccagcgcgacgcgtcgtcgatgtcgttgctcaatgtgcgttccgccagcgggcgtctggtgccgctggataccatcgccaccctgcgcccctcggtggggccgctggccgtgaaccactccgggcaattcccgtccgtgaccctgtccttcaacctgcgccccggcgtgtccctcagtgaggcggtgcaggctgtggagggcatcgcggggcagtatctcccgcccaccgccaccggaaccttccagggcacggcgcaggccttccagtcgtccatgcagggcatggcgatgctgctgttcatggcagtggtggtcatctacatcgtgcttggcgtgctgtacgaaagcttcatccatccgctgaccatcctttccggtctgccctcggccgggctgggggcactggtgacgctgttcatcttcggcatcgacctcaacctgtacgccttcgtgggcatcatcatgctcatcggcatcgtgaagaagaacgccatcatgatgatcgacttcgcggtggaggccgaacgcaagaacggtgcaagcccttatgaggccatcctgcagggatgcctcatacgattccggcccatcatgatgacgaccatggccgcactcatgggcacgctgcccatcgccgtgggctgggggccgggggccgaggcccgccagcctcttggcctcgcggtggtgggcgggctgctggtctcgcagttgctcacgctgtacatcacccccgtgtactacacctacctcgatgccctgagtcgccgcatcaaacggcgcatggggcgggtggcgcaggacgtcgaggccgtggcctccggtggtgacggcgcatag

SEQ ID NO: 74399 - protein, 1041 aa, Desulfovibrio vulgaris subsp. vulgaris str. Hildenborough
MNVTEFFIRRPVTTTLVMLGLLFFGVMGYRQLPVSDLPNVDFPTIQVRAQLPGADPETMASSVAAPLERQFATIAGIDSMSSTNTQGNTRITIQFNLSRDIDAAAQDVQAAISTAQRKLPSDLTTPPSYQKVNPADQPILFLALTSPTLPLSKVNEYAETRIGQTISMVSGVAQVNVYGAKKYAVRVQVDPRRLKALGLGIDEVSAAVDKANSNLPTGTLQGEHTASIIKASGQLYDAAAYRPVVVAYRNGAPVRLEELGRVVDSVEQDRILNWFNDERGIVLAVQRQPGTNTVEVVESIKRLLPEFERQLPAAVKLNILFDRSESIKASVAEVKFTLVLTVCLVVLVIFLFLRSLSATVIPSLALPMSVVVTFAAMHMMGFSLDNLSLMALTLAVGFVVDDAIVMLENIVRHMEMGKTPLRAALDGAREIGFTIISMTVSLAAVFIPVLFMGGIVGRLFHEFAVVITVAILLSGFVSLSLTPMLCALFLKPHVGQRRHGRVYNALETFFETLHRGYERSLRFTMRHHRMTFGLSMVVLGVTVWLFAAMPKGFLPSEDTGQISGFTEADQSVSFGQMVKLQKTLHPIIAADPGVDSFSSTVGAGGPNVGGNSGRFFIRLKDFDERDEHVDTIINRLRAKLSGFPGINVFLVNPPSINVGGRASKSLYQYTLQGPDTAELYKAGTELEAALRELPQLRDVTSDLQIRNPEVRVDIDRDKAAALGLSVHQVEDALQSAYGTRQVSTILAPDNDYQVILELLPEYQRDASSMSLLNVRSASGRLVPLDTIATLRPSVGPLAVNHSGQFPSVTLSFNLRPGVSLSEAVQAVEGIAGQYLPPTATGTFQGTAQAFQSSMQGMAMLLFMAVVVIYIVLGVLYESFIHPLTILSGLPSAGLGALVTLFIFGIDLNLYAFVGIIMLIGIVKKNAIMMIDFAVEAERKNGASPYEAILQGCLIRFRPIMMTTMAALMGTLPIAVGWGPGAEARQPLGLAVVGGLLVSQLLTLYITPVYYTYLDALSRRIKRRMGRVAQDVEAVASGGDGA

SEQ ID NO: 74400 - DNA, 3213 bp, Desulfovibrio vulgaris subsp. vulgaris str. Hildenborough
  CDS (1)..(3213): transl_table=11
atggcaagattcttcatagacaggcccgtcttcgcgtgggtcatcgccatcatcatcatgctggcgggggccctgtcgattctgagcctgcccgtctcgcagtatcccaaaatagcgcccacatcggtcaacatcagtgcctcgtatcccggtgcctcggccaagaccgtcgaagacacggtcacgcaggtcatcgaacagaagatgaagggcatcgacagcctgcgctacatgtcgtccaccagtgacgccacagggcaggtctccatcaccctgaccttcgacgccagcaccgaccccgacatcgcgcaggtgcaggtgcagaacaagcttgcgctggccacgcccatgctgcccgaggccgtgcagcggcagggcatcacggtgaacaagagcacgtcgagctttctgatgatcatcgcgctggcgtcggacgacccgtccctgacggggcgcgacctcagcgactatgccgccacctacctgctcgaccccatcagccgtgtggacggcgtgggcgagacgcagctcttcggcgcacagtacgccatgcgcgtgtggctagacccgcacaagctcatgaactacaggatgacccccgcggatgtgcgtagcgccatcaccgcccagaacacccagatatcggtggggcagataggcggtacgcctgccgtgcccggacaggggatgagcttcaccatcctctcgcagtcgctgttgcagacgcgcgagcagttcgagcgcatcgtgctgcgcgtggaacaggatggctcgacggtgcgccttgccgatgtcgcacgggtagaacttggcagcgagaactacgacgccgtctcgcacttcaacggcaagccctccaccggtatcgccatcaagctggcgaccggggccaacgcgctggacacggtcaagcgtgtgcgtaccaccatggaaggtctggccaagaacctgccggaaggcatccgctgcgtcttcccttacgacaccacccccttcgtgcgcgtgagcatcgaagaggtggtcaagacgctggccgaggccatcgtgctggtgttcctcgtcatgtacctgttcctccagaacatccgtgccaccatcatccccaccatcgccgttccggtcgtgcttctcggcaccttcggggcgcttgctgccttcggcttctccatcaacatgctgaccatgttcggcgtggtgctcgccatcggcctgctggtggacgacgccatcgtcgtggtcgagaacgtcgaacgcatcatgaccgaggaggggctgccccctcgcgaggccacccgcaagtccatgggcgaaatcaccggggcactggtgggcatcgcgctggtgctttcggcggtgttcatccccatggcgttcatcaagggttcgtcgggtgtcatctaccgtcagttctcactcaccatcgtctctgccatgaccctgtccgtggtggtcgcgctggtgctcaccccggccctgtgcgccaccttcctgaagcccctgcacaaacacgagcatcaggcgcagggtggcttcttcggctggttcaaccgcatgttcgaccgcaccagccggggctaccgcaagcaggtgacgggcgtgaccggtcgcgtgggccggacgatgtgcatctacgcgctgctgctggcgggtacggcattcctcttcatgcggctgcccacctcgttcctgcccgaagaggaccagggcgtcatcttcagcctcgtgcaactgccaacggggtcaccacaggagaagaccctcgaagtgctcaagaaactggagcaccactacctcgtcgatgagaaggagacggtgaactcgctgttcaccgtggcgggcttcagctttgccggacgcggtcagaacgcggggcttgccttcgtgcagctcaagccgtgggatgaacgcaagggcgagggcatgagcgcggcggcggtggccgggcgtgccatgcgcgccttctcgcgcatccgcaactcggtggtctacgccttcacgccgcctgccgtgcaggaactcggcaacgcatcgggcttcaaccttttcctgcaggacagggagggcgtggggcatgaggcgctcatgcaggcgcgcaaccagcttctgggcatggccgcgcagaaccccgccatcgccgtgctgcgccccaacgggatggaggatacgccgcaattccgcatcgacgtggacgccgccaaggcgggcgcgcacgggctgaccatggcggacgtcaacggcgtgctctccacggcccttggcggtgcgtacgtcaacgacttcatcgaccgcgggcgcgtcaagaaggtctacctgcagggtgacgcccccttccgcatgatgcccgaagacatcaacgcctggcacgtgcgtaacgcgcagggcaacatggtgccgttctcggcgttctcgaccgccagctggacgtacgggtcgccgcgtctcgaacgctacaacggtctgcccgccgtcgaactggtgggttccgccgcccccggcaagagcaccggtgaggccatgcaggccgtcgaggacatggcggcgaagcttccgcccggtgtgggcatctcgtggacgggcctttcctatcaggaacgcatgagcggttcgcaggccccggcactgtatgccatctccatcctcgtggtgttcctgtgccttgcagccctctacgagtcgtggtcggtacccacggcggtcatcctcgtggtgccgctgggcatcataggtgcgctcatggccacactcgggcgcggtctcaacaacgacgtgttctttcaggtgggcctgctgaccaccatcggcctcgcggccaagaacgccatcctcatcgtggaattcgccatgcacctcgtgaagtcgggcaggcccctgctggatgccacggccgaggcggcacgcctgcggctgcggcccatcctcatgacctcgctggccttcctgctgggcgtgctgcccatggccatcagcaccggggcggggtcgggcagccagagggccatcggcaccggcgtcatgggaggcatgttctcggccacagtgctggcggtgtacttcgtgcccgtgttcttcgtgatggtctaccgcttcgccatgcggaaacgtggtggtggccctgaaggtggtggacacgggagtgatgcgcatgggggcgacccccttgcgacggcgcaggatgatggacaggcgaaagcctccggcgaggtggcacgatga

SEQ ID NO: 74401 - protein, 1070 aa, Desulfovibrio vulgaris subsp. vulgaris str. Hildenborough
MARFFIDRPVFAWVIAIIIMLAGALSILSLPVSQYPKIAPTSVNISASYPGASAKTVEDTVTQVIEQKMKGIDSLRYMSSTSDATGQVSITLTFDASTDPDIAQVQVQNKLALATPMLPEAVQRQGITVNKSTSSFLMIIALASDDPSLTGRDLSDYAATYLLDPISRVDGVGETQLFGAQYAMRVWLDPHKLMNYRMTPADVRSAITAQNTQISVGQIGGTPAVPGQGMSFTILSQSLLQTREQFERIVLRVEQDGSTVRLADVARVELGSENYDAVSHFNGKPSTGIAIKLATGANALDTVKRVRTTMEGLAKNLPEGIRCVFPYDTTPFVRVSIEEVVKTLAEAIVLVFLVMYLFLQNIRATIIPTIAVPVVLLGTFGALAAFGFSINMLTMFGVVLAIGLLVDDAIVVVENVERIMTEEGLPPREATRKSMGEITGALVGIALVLSAVFIPMAFIKGSSGVIYRQFSLTIVSAMTLSVVVALVLTPALCATFLKPLHKHEHQAQGGFFGWFNRMFDRTSRGYRKQVTGVTGRVGRTMCIYALLLAGTAFLFMRLPTSFLPEEDQGVIFSLVQLPTGSPQEKTLEVLKKLEHHYLVDEKETVNSLFTVAGFSFAGRGQNAGLAFVQLKPWDERKGEGMSAAAVAGRAMRAFSRIRNSVVYAFTPPAVQELGNASGFNLFLQDREGVGHEALMQARNQLLGMAAQNPAIAVLRPNGMEDTPQFRIDVDAAKAGAHGLTMADVNGVLSTALGGAYVNDFIDRGRVKKVYLQGDAPFRMMPEDINAWHVRNAQGNMVPFSAFSTASWTYGSPRLERYNGLPAVELVGSAAPGKSTGEAMQAVEDMAAKLPPGVGISWTGLSYQERMSGSQAPALYAISILVVFLCLAALYESWSVPTAVILVVPLGIIGALMATLGRGLNNDVFFQVGLLTTIGLAAKNAILIVEFAMHLVKSGRPLLDATAEAARLRLRPILMTSLAFLLGVLPMAISTGAGSGSQRAIGTGVMGGMFSATVLAVYFVPVFFVMVYRFAMRKRGGGPEGGGHGSDAHGGDPLATAQDDGQAKASGEVAR

SEQ ID NO: 74402 - DNA, 3144 bp, Desulfovibrio vulgaris subsp. vulgaris str. Hildenborough
  CDS (1)..(3144): transl_table=11
atgttcgcgaaattcttcatcgaccgccccattctggctaacgtcatcggcatcgtgctcattctcatcggcgtcgtatcggtcatgctgctacccatttcgcagtatcctgaaatcacgccccccacggtcgaagtaaaggccatctatccgggctcgaactcgctggtactcgccgacaccgtcggggcccctatagaacaggaggtcaacggcgtcgaaggcatgctctacatgtcctccaagagtgccaacgacggaacctacaccctgacgatcaccttcgccctcggaaccaacatcgacatggcgaccgtgctcgtccagaaccgcgtcaacgtggccatggcgcgcctgcccgacgaggtgaaacgacagggcgtaacggtcaagaagaagtcgaccgccatccttcaggttgtcacactcacctcgccggacggatcatacgacgacctcttcctgagcaacttcgcatcactgcgcatcagggacgagcttgcccgcataccgggcgtgggcgaagcgacggtgttcggcgccgcaagctattcgatgcgtgtctggcttgatgcgccccggctcaagagcatggggctcacgacaaaggacgtggtcaacgccatcagcgaacagaacgttcaggtcgctgcgggccagataggcgcacagcccgcgcccgacacccagaacttccagttcacggtgcagacgcagggccgtctgtccaatgtcgaggaattcgaggacatcatcatccggacggcgacatccgggcctgcggggcgtgtcgtacgggtgcgcgacgtggcgcgcgtcgaactcggcgggcagacatacgacctctacgcacagaagaacggcaaacctgcggcactcgtcatcatctatcagctgccgggtgccaacgcgctggatgtggcacaacaggtcaacgcacgcatgaagaccctcggcaacgacttcccgcagggggtcgcatgggatgtcccctacgacacgacgcgattcgtcgaagccgccatcgaacaggtctaccacacacttttcgaagcagcggtgctcgttctcgccgtcatactcatcttcctgcaggactggcgtgcgacgctggttccggcatccgtcgtgcccatcaccatcctcggtggtttcatggccatgatgggcctcggtttttcggtgaacctcgtcacgctcttcggcatcatactcgccatcggcatcgtggttgacgacgccatcatcgtcgtcgagggcgccgcgcaccacatggaacatggcgaccccgcgcgcgaggccaccatcaaggccatgatgcaactcttcggccccatcatcggcatcacactggtgctgtcgtgcgtgttcatccccgcatcgttcatgtccggcatcaccgggcaactctacaggcaattcgccctcgtcatcgcatcgacagccctcgtcagcgccctgcttgccgccaccctcaccccggcacagtgcgccctcttcctcaaacccatcgtgccgggtcgcaacgccttctaccgcgggttcaacaagtcctacgatgccgtcgagaacctgttcgtcacgattctgcgcaccatggtgcggcatgcgaagaccaccatgctcgtcttcgtcggcctcatcacggccaccttctgggcgttcacctcgctacccacggggttcctgcccgacgaggaccagggctatgcccttgtggcggtgcagctgcccggtgccgcatcacaggcccgtacgcgcgaggtgaccaccagactcgacgccatcttctccgagacgcagggggtcgcagactggataacctttggcggcatgtccatcctgaacggcgccaacacctccaactccgccacggtgttcgtcatgtacaaggactggagcgaacgcggggcactcacgcaggagagaatcgtcgccgacctgcgtcgcaaggtcgcgtccattcaggaagggatggtgattgtcgtgacgccgccccccatacagggactgggcaacgctggcggattcgaaatgatggtgcaggaccgggcggcgctgggggcccagcaacttgagaccgtggcctactcgatgatggcggctgcacggggacagtcgggccttggcaatgtctcgacgacatacaacgcccgcacaccgcagcttttcgtcaacgtggaccgtacgcaggtcaagaactacgacgtgcaactcaatgacgtcttcagcacgatgcagtcctacctcggctcatcctatgtcaacgacttcaacaagttcggaaagacatatcaggtccgggtgcaggcagacagccgttaccgcctcaccgcagaggacatcggtcgcctcgaagtgcgcaacgcacagggcggcatggtgcctctgggcgcggtgaccgacgtgaaggatgtcgtcggacccgacgtggtcacccgctacaatctctaccctgcggcctccctgataggcgccgccgcaccgggattcagttcgggccaagccctcgccctgatggaagacatggcccgcaagaccctgccgcagtcgatgggattcgaatggacgaccatggcctatcaggagaaggcgacgggcaacgaagccttcgccgttttcggcttcgccgtgctgctcgtctttctcgtgctggcggcccagtacgaaagctggtctgcgccagccgccatcatcatggtcgttccgctggccctgctgggaaccagcatcgccgttgcgacgcgtggcatggacaacaacgtgtacacccagataggcatcgtgcttctcatcgcactggcgagcaagaacgccatcctcatcgtcgaattcgcccgtgaactccgcctgcagaagggcatgtccattcaggatgccgcagtcgagggggcccgcgcgaggttccgccccattctcatgacctcgttcgccttcattcttggcgtcgttcccctgctcaccgcctccggcgccggttcggcaagccagcgagcgctcggcacggcggtcttcggaggcatgctggcatcgacattccttgccgtgctcttcgtcccggtcttcttcactgtcatccagaccttgagcgaaggcctttcgcgtcaatcgtcacccagccagaagaacatcaaccacaagtga

SEQ ID NO: 74403 - protein, 1047 aa, Desulfovibrio vulgaris subsp. vulgaris str. Hildenborough
MFAKFFIDRPILANVIGIVLILIGVVSVMLLPISQYPEITPPTVEVKAIYPGSNSLVLADTVGAPIEQEVNGVEGMLYMSSKSANDGTYTLTITFALGTNIDMATVLVQNRVNVAMARLPDEVKRQGVTVKKKSTAILQVVTLTSPDGSYDDLFLSNFASLRIRDELARIPGVGEATVFGAASYSMRVWLDAPRLKSMGLTTKDVVNAISEQNVQVAAGQIGAQPAPDTQNFQFTVQTQGRLSNVEEFEDIIIRTATSGPAGRVVRVRDVARVELGGQTYDLYAQKNGKPAALVIIYQLPGANALDVAQQVNARMKTLGNDFPQGVAWDVPYDTTRFVEAAIEQVYHTLFEAAVLVLAVILIFLQDWRATLVPASVVPITILGGFMAMMGLGFSVNLVTLFGIILAIGIVVDDAIIVVEGAAHHMEHGDPAREATIKAMMQLFGPIIGITLVLSCVFIPASFMSGITGQLYRQFALVIASTALVSALLAATLTPAQCALFLKPIVPGRNAFYRGFNKSYDAVENLFVTILRTMVRHAKTTMLVFVGLITATFWAFTSLPTGFLPDEDQGYALVAVQLPGAASQARTREVTTRLDAIFSETQGVADWITFGGMSILNGANTSNSATVFVMYKDWSERGALTQERIVADLRRKVASIQEGMVIVVTPPPIQGLGNAGGFEMMVQDRAALGAQQLETVAYSMMAAARGQSGLGNVSTTYNARTPQLFVNVDRTQVKNYDVQLNDVFSTMQSYLGSSYVNDFNKFGKTYQVRVQADSRYRLTAEDIGRLEVRNAQGGMVPLGAVTDVKDVVGPDVVTRYNLYPAASLIGAAAPGFSSGQALALMEDMARKTLPQSMGFEWTTMAYQEKATGNEAFAVFGFAVLLVFLVLAAQYESWSAPAAIIMVVPLALLGTSIAVATRGMDNNVYTQIGIVLLIALASKNAILIVEFARELRLQKGMSIQDAAVEGARARFRPILMTSFAFILGVVPLLTASGAGSASQRALGTAVFGGMLASTFLAVLFVPVFFTVIQTLSEGLSRQSSPSQKNINHK

SEQ ID NO: 74404 - DNA, 3126 bp, Bartonella quintana str. Toulouse
  CDS (1)..(3126): transl_table=11
atgagtcaggaatttagcacgaaacagcctagagcacaggtggagcaaggtggtataatcaccttatttattcgcaggccagtttttacctttgttttgaatgccatgatcgtgattgcggggtttgctgcgtggctgaacgttgatgtacgtgaacttccggatgttgatactccagtgacaacaattgtgacagcttttgctggagcatccgcggaaacaattgatcgtgaagttacgaaaattatagaggacgccgtttctcgtgtttcaggtgttaaaacgatttcttcaacttcttcttttggtcgttcacgtgtggagcttcattttaatgtcggtgttgatttaaatgttgcagcatctgacattcgtgatgctctttctcgtattgcttattctttaccaaaaaatgcggattcacctctgatcattaaagcagattctaacgctgctgcgatgatgtatttggttgtaacttcatcaacgatgaatattgatgatttaacaatggtcgtagacgatcaaattgttgatgcactttctgccgttgatggtgttggtgatgtacaggttgatagtgcgcgcacgaagatttttcaaattgatgttgatcaaacaaggcttgcgagctatggtttgaccgtggcggatatttcacgtgttcttgctgatatgacaacggatgtgccggtggggtcattgcgcaattctaagcaagctttaattgtccgtgctactgcgcgtttaaaaacaccagaagcttttgaacaagttgttttaaaacctcatgtgcgtcttggtgatgttgcgcatgttactttgtcacctgatgtagaaacagttattcttcgtatcaacgggaagacaggaattgggttggggattgtgcgtaaagcacaatctaatactcttaatatttctcagggcattcgaacggttgtcgatcatctcaaaagtgttattccttcttctgtgcatataagcattattagtgatgatgcactttttattaagggtgcacttcatgaagttgaggttgcattggttattgctgttctcagtgttattttgattatttttctttttctgagagattttcgtataacgctcattcccgccttatctattcctgtggctttgattggtacagttgctgccatttaccttgtaggattttcgttgaatattcttacatttttaggacttgttttggcaacagggcttgtggtagatgacgcgattgttgttcttgaaaatattgttcgatggcgcaatatggggttaggtcctcgggcggcggcggtgctcggaacacgagaagtgttttttgccgttttagcaacaacattgactttagtcgctgtttttgtacctatttcttttcttcctgggcaagttggaggactttttagagaatttggttttgtattggcaatttctattcttctttcttcgattgttgctttaacactttgtcctatgttggcctcacgctttcttaaggaatatgctgagagtaatgaggaaggggcgcgtcattttacttttttgtataaattgagctctttttttagcaaggggtatgcgtatagtctgcataaatgtttgggaagaccttggaccgttgtctttgcttcgcttgtttttgctggtctttgtgttgagggctatatgaagttgcaacaagaattgacgcctgcagaagatagagcctttatctttttggttattaatggaccacagggtatttcgacacaatatttgaatgagcaggtagagcaaattgaaacgagtttacaacctttacgtgattctggagagattgttaacagttactctatcgctggcgttggtggttcacccaataccgcttttttgattttgttgctttcatcttgggataagcgtttgcggagtcaacaagagatcatggaagatgttaatgcaaaggttagacggtttccagcagtttttgtgtttgctgtgcagggaaattctttaggtgttagaggaactggtcaaggattacagtttgcaattcttggaaatgattatacaaaattacagccaattgctgataagcttgtgagtgctttgcaagctgacccgcattttattggcccacggcttactgttgatgcaacgcaaccacaattttttattgaaattaatcgagaaaaagcctctgatttaggaattgatatcaccaatttgggcaatacattacaagcaatgttggatggaaaaaaaattggttctatttatgtggatgaccatgcttatgatgttaaactaacatcgcgtaagaatcctattaataatcctcatgatttggaaaatatttttttaaaaaccaaaggcgatcaatatgttcctttatcggttattgcgtacttgcatgaaaaagccattgcgcctcaattaaaacgagagaaacgcatgagtgccattgttttaagcgcaaatcttgctccaggtgttgttttagggagcgcttatcagactgtgcagaaaatcgctgctcctttgttgtcagagggaaattatattgttcctttaggggaagccgctacacttggtgaaacatcttccaattttatgattgtttttggaatggcctttgtgattattctattggttttggctgcgcaatttgaaagttttgtttcaggatttattattatggctactgtcccattagcggttggttgtgctataatttctatgcttttaagtggagtaagtcttaatatttacagtcaaattggtttaattttgttggttggggttatggctaaaaatggtattcttattgttgaatttgcagaccagttacgtgatcaaggtaaaagcgtgcgtgaagctatagaaaaagcagcaaatattcgtcttcgtccagtttgtatgacgatgatttgtgctatcttaggggggattcctttggttttagccaaaggtgctggtgcagaagcacgtatagctttaggttgggttatcgttggtggtttgggtttagcaactatttttacgctttatgtcacaccggttgtttatctctttcttggtcgttttgtgagaccaaaatcagaagaagctacacgcttaataagagaattcagctaa

SEQ ID NO: 74405 - protein, 1041 aa, Bartonella quintana str. Toulouse
MSQEFSTKQPRAQVEQGGIITLFIRRPVFTFVLNAMIVIAGFAAWLNVDVRELPDVDTPVTTIVTAFAGASAETIDREVTKIIEDAVSRVSGVKTISSTSSFGRSRVELHFNVGVDLNVAASDIRDALSRIAYSLPKNADSPLIIKADSNAAAMMYLVVTSSTMNIDDLTMVVDDQIVDALSAVDGVGDVQVDSARTKIFQIDVDQTRLASYGLTVADISRVLADMTTDVPVGSLRNSKQALIVRATARLKTPEAFEQVVLKPHVRLGDVAHVTLSPDVETVILRINGKTGIGLGIVRKAQSNTLNISQGIRTVVDHLKSVIPSSVHISIISDDALFIKGALHEVEVALVIAVLSVILIIFLFLRDFRITLIPALSIPVALIGTVAAIYLVGFSLNILTFLGLVLATGLVVDDAIVVLENIVRWRNMGLGPRAAAVLGTREVFFAVLATTLTLVAVFVPISFLPGQVGGLFREFGFVLAISILLSSIVALTLCPMLASRFLKEYAESNEEGARHFTFLYKLSSFFSKGYAYSLHKCLGRPWTVVFASLVFAGLCVEGYMKLQQELTPAEDRAFIFLVINGPQGISTQYLNEQVEQIETSLQPLRDSGEIVNSYSIAGVGGSPNTAFLILLLSSWDKRLRSQQEIMEDVNAKVRRFPAVFVFAVQGNSLGVRGTGQGLQFAILGNDYTKLQPIADKLVSALQADPHFIGPRLTVDATQPQFFIEINREKASDLGIDITNLGNTLQAMLDGKKIGSIYVDDHAYDVKLTSRKNPINNPHDLENIFLKTKGDQYVPLSVIAYLHEKAIAPQLKREKRMSAIVLSANLAPGVVLGSAYQTVQKIAAPLLSEGNYIVPLGEAATLGETSSNFMIVFGMAFVIILLVLAAQFESFVSGFIIMATVPLAVGCAIISMLLSGVSLNIYSQIGLILLVGVMAKNGILIVEFADQLRDQGKSVREAIEKAANIRLRPVCMTMICAILGGIPLVLAKGAGAEARIALGWVIVGGLGLATIFTLYVTPVVYLFLGRFVRPKSEEATRLIREFS

SEQ ID NO: 74406 - DNA, 3135 bp, Bartonella henselae str. Houston-1
  CDS (1)..(3135): transl_table=11
atgagtcaagaattgaatacaaagcagcttagggtgcaggaagaacaagatggtataattggcttatttattcgcagaccggtttttacctttgttttaaatgctatgattataatcgcagggtttgctgcatggctgaatgttgatgtacgagaacttccggatgttgatactccagtgataacaattatgacagcttttgctggagcatcagcggaaacaatagatcgtgaagttacaagaattatagaagatgccgtttctcgcgtttcaggtgttaaaacgatttcttcaacttcttcttttggccgttcacgtgtggagattcattttaatgtcggtattgatttgaatgttgcagcatctgatattcgtgatgcactctctcgcattacttattctttacccaaaaacgcggattcacctttgattattaaagcagattcaaatgctgctgcgatgatgtatttggttgtgacgtcaccaacgatgagtattgatgatttaacaatgatcgtagacgatcaaattgttgatgcgctttctgccgttgatggtgttggtgatgtacaggttgatagtgcgcgcacgaagatttttcagattgatgttgatcaagcaaaacttgctagctatgggttgaccgtggcggatatttcacgtgttcttgctgatatgacaacggatgtaccggtggggtcattgcgcaattctaaacaaactttagttgtccgtgcgactgcgcgtttaacaacatcggaagcttttgaacaagttgttttaaaacctcatgtgcgtcttggtgatgttgcgcatgttactttatctcctgatttagaaacagttattcttcgtatcaatggaaagacaggaattgggttggggattgtgcgtaaagcgcaatccaatacccttaatatttctcaaggtgttcgagcggttgtcgatcgtctcaaaactgttattccttcttctgtgcatatgagtattattagcgatgatgctatttttattaagggcgcacttcatgaggtcgaggttgcattggtcattgcggttctcagtgttattttggttatttttctttttctgagagatattcgtgtaacgcttattcctgccttatctattcctgttgctttaattggaacaattgctgccatttaccttgtagggttttcattgaatattctcacatttttaggacttgttttggcaacagggcttgtggtggatgacgcgattgttgttcttgagaatattgttcggtggcgcaatatgggatttggttctcgggcagcggcggtgttgggaacacgagaagtgttttttgctgttttagcaacaacattgactttagttgccgtttttgtacctatttcttttcttcccgggcaagttggagcactttttagagaatttggttttgtgttagcaatttctattctgctttcttcgtttgttgctttaacactttgtcctatgttggcttcacgttttctcaaaggacatgctgagagcaatggaaaaggagcgtatcattttacttttttgtataaattaggctctttttttagaaaaggatatcattatagtctacataaatgtttgggaagaccttggacggttatttttgcttcacttatttttgctggtctttgttttggaggctatacgaaattacaacaggaattgacgccagcagaagacagagctcttatctttttggtcattaatggaccacagggtatttcgacacaatatctgaatgaacaggtggagcaaattgaaacgagtttacaaccgttacgtgattctggagaaattattaacagttactctatcgctggcattggtggttcgaccaataccgcttttttggttttgttgctttcatcttgggacaagcgtttgcgtagtcaacaagagatcgtggaagatgttaacgcaaaggttggacagtttccagcagtttttgtgtttgctgtgcaaggaaattctttaggcgttagaggaactggtcaaggattacaatttgcaattcttggaaatgattatacaaaattacagccaattgctgagaagcttgtgaatgctttgcaagctgatccgcattttattcgcccacggcttactgttgatacaacacaaccacaattttttattgaaattaatcgagaaaaagcctctgatttaggagttgatatcatcaatttgggcaatacattacaaacaatgttagatgggaaaaaaattggttccgtttatgtggatgaccattcttatgatgttaaactgacatcacgtaagaatcctattaataatcctcatgatttagaaaatatttttttaaaaactaaagacaatcaatatgttcctttatcggttattgcgagcttacatgaaaaagctattgcgcctcaattaaaacgagagaaacgcatgagtgctgttgttttaagcacaaatcttgctccaggtgtcgttttagggagcgcttatcagactgtacagaaaatcgctgctccgttgttgttagagggaaattacattgttcctttgggagaagccgctacacttggtgaaacatcttccaattttatgattgtttttggaattgcctttgtgattattctattggtcttggcagcacagtttgaaagttttgtttcagggtttattattatggctactgtaccattagggattggttgtgctgtaatttctatgcttttaagtggagtgagtcttaatatttacagtcaaattggtttaattttgttgattggagttatggctaaaaatggtattcttattgttgaatttgcagatcagttacgtgataaaggtaaaagcgtgtgtgaagctatagaagaagcagcgaatattcgttttcgtccagtttgtatgacgatgatttgtgccatcttaggaggaattcctttggttttagccaaaggagctggtgcagaagcacgtatagctttaggttgggttattgttggcggtttgggtttagcaactatttttacgctttatgtcacaccggttgtttatctctttcttggccgttttgtgagatcaaaatcagaagaagcactacgcttaagaagagaactcaaccaagctgaatga

SEQ ID NO: 74407 - protein, 1044 aa, Bartonella henselae str. Houston-1
MSQELNTKQLRVQEEQDGIIGLFIRRPVFTFVLNAMIIIAGFAAWLNVDVRELPDVDTPVITIMTAFAGASAETIDREVTRIIEDAVSRVSGVKTISSTSSFGRSRVEIHFNVGIDLNVAASDIRDALSRITYSLPKNADSPLIIKADSNAAAMMYLVVTSPTMSIDDLTMIVDDQIVDALSAVDGVGDVQVDSARTKIFQIDVDQAKLASYGLTVADISRVLADMTTDVPVGSLRNSKQTLVVRATARLTTSEAFEQVVLKPHVRLGDVAHVTLSPDLETVILRINGKTGIGLGIVRKAQSNTLNISQGVRAVVDRLKTVIPSSVHMSIISDDAIFIKGALHEVEVALVIAVLSVILVIFLFLRDIRVTLIPALSIPVALIGTIAAIYLVGFSLNILTFLGLVLATGLVVDDAIVVLENIVRWRNMGFGSRAAAVLGTREVFFAVLATTLTLVAVFVPISFLPGQVGALFREFGFVLAISILLSSFVALTLCPMLASRFLKGHAESNGKGAYHFTFLYKLGSFFRKGYHYSLHKCLGRPWTVIFASLIFAGLCFGGYTKLQQELTPAEDRALIFLVINGPQGISTQYLNEQVEQIETSLQPLRDSGEIINSYSIAGIGGSTNTAFLVLLLSSWDKRLRSQQEIVEDVNAKVGQFPAVFVFAVQGNSLGVRGTGQGLQFAILGNDYTKLQPIAEKLVNALQADPHFIRPRLTVDTTQPQFFIEINREKASDLGVDIINLGNTLQTMLDGKKIGSVYVDDHSYDVKLTSRKNPINNPHDLENIFLKTKDNQYVPLSVIASLHEKAIAPQLKREKRMSAVVLSTNLAPGVVLGSAYQTVQKIAAPLLLEGNYIVPLGEAATLGETSSNFMIVFGIAFVIILLVLAAQFESFVSGFIIMATVPLGIGCAVISMLLSGVSLNIYSQIGLILLIGVMAKNGILIVEFADQLRDKGKSVCEAIEEAANIRFRPVCMTMICAILGGIPLVLAKGAGAEARIALGWVIVGGLGLATIFTLYVTPVVYLFLGRFVRSKSEEALRLRRELNQAE

SEQ ID NO: 74408 - DNA, 3096 bp, Acinetobacter sp. ADP1
  CDS (1)..(3096): transl_table=11
atgaatatgtcgagattttttattttacgacccgttgcaaccacattattgatgctggcacttttgtttagtggcttgatgatttggcggttccttcctgtttctgctttaccacaagtcgattatccgattattcagatctatacctttcaacctggtgcaaatccagatacggttcagcgaaccattactgcgccgcttgagcgtgaaatgggcaaaattgctggacttaaacagatgtcttccaatagcgctgtcggtgcatcagtcatcaccttacagtttgaactcagtgccgagttaggagtggttgagcaagaagtacaatctgcgctgagtaccgcaagcagtaaattgcccaatgatttgcccacatcgcctgtctatcgaaaagtaaatcctgcggatgtgcctgtaattaccttggcggtaagttcagaaactttgccactcacgaccgtttacgacatggttgatactcgtattgcacagaagttatcgcagttatcgggtgtgggaatggtgagtttggtgggtgggcaacgtcctgcgatacgtgtgcaaatgaatccaactgccttggcggcctataaaataagtgctgaagatgttcgttcagtgattaattctgctaatgccaatcagccgaaaggtagttttgatgggccatatcgcaccaccatgctggatgccaatgatcagatgggttctattgcagaatatgaaaatttgattttacgctggaataatggcgcaccgattcgccttaaagacgtctcacaggtgaaacaaggaagtgaagaccgctatatggcagcgtgggcagatcgtgagtctgctattttaattaatgtacaacgtcaacctaatgccaatgtaattcaggttgttgaccagatcaaaaatattttgcctgaactgcaaaaaaatctgcctgaaaatgtcaagattcgggttctgacagatcgtaccgaaagtattcgtagttcgattggtgatgtacaaaaggaattggtttttgccgtgtgtttggtggtaatggtaacttttctgtttttacggaatttgtcagcgaccattattccaagtattgcagtgcccttatcgattattggtacatttgtactgatgtattttctaggtttttctatcaacaatctcacgttgatggcgctgaccattgccacgggttttgtggttgatgatgcgattgtcatgctagaaaatattacacggcaccgtgaagcaggagcaagcctgctagatgctgcactcaaaggatcaaaagaaattggttttactctaatttcattaacgatttccttaattgcagttttgattccattactgtttatgggcgatgtggtcggacgtttattccatgaatttgccgtgaccttagcggcagccattgcactttctctagtggtgtctttaacccttacgccaatgatgtgcgcttacttacttaaaaataaaaaacataatcaaaagcatagccgctggagtctagataaaattattgatcgttacgcaaaggcattacagtgggtgtttaaacatcagccgttaatgctcgggatcatgctcagcactatagttttagccggcgttttgtactggatgattcccaaaggattctttcctgtacaggatagtggtgtgattcaggtcgtcactgaagcgcccgatgatatttcttttcagacaatgagcgaacgtcagcaaaacgtagctgcacaaattttaaaagatccatcggttgccagtttgtcatcttttactggtatagacgccaataatcctaaactcagcaatggccgtattttaattaatttaaaacctcatgcagagcgtgattcggcacagcaggtgatcaatcgtttacgagatcagctcaaagatgtaccagggattcacgcttggatgcagcctgttcaggaattgagtattgaagacaaaatcagtcgtactcaatatcaagtcagtttgagcgcagcgaaagctgaggatttaaaacaatggacacctattgttggggacgctttaaagcaccaacccgaattttcagatgtgaccagtgaagatggtggacaagcattgcaggcctatatcgatgtgaatcgagatgccgcagcgcgtttaggactttctattgaggatatcagtttggcattgcagaatttatttgcgcaacgccaaatcgcaactttatatacgcagtctaatcagtatcgaattgtactggaacttgatcctgatcaagtgcaaggactggatgccttaaatcaaacatatattcacaatgccaatggtgaagcgatacaactcggtacggtagcaagtattgagcaaaaaagagtggcaagtgtcttgcaacaacaagcgcaacttcctgctgatagcttgtcatttaatttggcacaaggtatttcacttggtgaagcaatccaggcgattgatcgagtcaaacagcagctcaaactacctgctgaaatcaatctgagtttacaaggtgcagcagcagcatttgaaaattcacaacagcacaccttttggctggttattgctgcaattgtgaccatgtatatcgtattgggtattttgtatgaaagtttcattcatcccattaccattctttctactttaccttccgccgcgattggtgcgttattggcgctgtttatgctcaatcagccactcgatatgattgcactgatcgggattattttgctaattggtctggtgaaaaagaacggcattatgatggtcgattttgcactggcagcacaacgcaatgagggattatctcctcagcaagcgatttatcaagctgccttaatgcgctttcgccccattttgatgaccacactggcggctttggttggggcaattccgttaatgctggcttctggttcgggtgctgaattacgtcagccccttggtattgtgatggtcggtgggctgattctgagtcaaattctcacgttgtttactacgcctgtggtttatctcttttttgatcgcttacaaggaatcacgcatcagcacaacaaaacaattccaccgatggatgagtctgaggcaatcacgtga

SEQ ID NO: 74409 - protein, 1031 aa, Acinetobacter sp. ADP1
MNMSRFFILRPVATTLLMLALLFSGLMIWRFLPVSALPQVDYPIIQIYTFQPGANPDTVQRTITAPLEREMGKIAGLKQMSSNSAVGASVITLQFELSAELGVVEQEVQSALSTASSKLPNDLPTSPVYRKVNPADVPVITLAVSSETLPLTTVYDMVDTRIAQKLSQLSGVGMVSLVGGQRPAIRVQMNPTALAAYKISAEDVRSVINSANANQPKGSFDGPYRTTMLDANDQMGSIAEYENLILRWNNGAPIRLKDVSQVKQGSEDRYMAAWADRESAILINVQRQPNANVIQVVDQIKNILPELQKNLPENVKIRVLTDRTESIRSSIGDVQKELVFAVCLVVMVTFLFLRNLSATIIPSIAVPLSIIGTFVLMYFLGFSINNLTLMALTIATGFVVDDAIVMLENITRHREAGASLLDAALKGSKEIGFTLISLTISLIAVLIPLLFMGDVVGRLFHEFAVTLAAAIALSLVVSLTLTPMMCAYLLKNKKHNQKHSRWSLDKIIDRYAKALQWVFKHQPLMLGIMLSTIVLAGVLYWMIPKGFFPVQDSGVIQVVTEAPDDISFQTMSERQQNVAAQILKDPSVASLSSFTGIDANNPKLSNGRILINLKPHAERDSAQQVINRLRDQLKDVPGIHAWMQPVQELSIEDKISRTQYQVSLSAAKAEDLKQWTPIVGDALKHQPEFSDVTSEDGGQALQAYIDVNRDAAARLGLSIEDISLALQNLFAQRQIATLYTQSNQYRIVLELDPDQVQGLDALNQTYIHNANGEAIQLGTVASIEQKRVASVLQQQAQLPADSLSFNLAQGISLGEAIQAIDRVKQQLKLPAEINLSLQGAAAAFENSQQHTFWLVIAAIVTMYIVLGILYESFIHPITILSTLPSAAIGALLALFMLNQPLDMIALIGIILLIGLVKKNGIMMVDFALAAQRNEGLSPQQAIYQAALMRFRPILMTTLAALVGAIPLMLASGSGAELRQPLGIVMVGGLILSQILTLFTTPVVYLFFDRLQGITHQHNKTIPPMDESEAIT

SEQ ID NO: 74410 - DNA, 3108 bp, Acinetobacter sp. ADP1
  CDS (1)..(3108): transl_table=11
gtgaatatctttgctctatttgtacatcgtccagttgctaatattttactgggaattgccatgactttgcttgggatattggccttttttcgcttacccgtagcggccttaccacaggtggatattccaacgattgtggtacgggcaaatttaccaggagcaagtcctgaaagtatgtcggctacagtggccacgccattggaacgtgcgatgatgggcgtatctgggatcaaagcgattaattcatctagtagtcaaaattcaacacaggtcattttacattttgatctggatacagatattaatgaagcggcgcgtgaagtacaggctgctatcaatgtggcgatgtctcaattgccatcagggatgccaagcccacctgaatattttaaggtcaatcccagtcaaagtccgatcttttatctggcactaagctccaggtatttatctgctggcaaattgtatgagttggcaagcaatcaattaaagcccaatcttgctcaaactagcggtgtaggagaagtcgaaattgatggtgcttcaatgcctgctgtgcggattatccttaatccaaatgcgttaatctcacaagggatttcgttggaacaagtacgagatgcagttaaaaaaagtaatgtagttcagtccttgggtgtaattgaacatcaaaacaatcgctggcaagtcgcactttcaacacatataaaagatgcagcagatttttcaaatttaattgtgcatcaaacagcgcaagggattgttcggcttaaagatgtggctgaggtagaagattcagttgagaatcgttatgtcgctggttttcataatggcgaacctgcggtaatgattaaaatcagtcgacagcctaatgccaataccattgcaacgattgaaaaaattaaagcaaaattgcctgaattaaattcgatgattcctgccgatgccaaattgactacggtcatggacggttcagaggtgattcatacgggtttacaggaagcgcgtgagaccttacttttttcaatttttttggtggtcgttgtggttgtgctgatgttagggcgactacgaagtgcgattgtaccaagcatcgcgatgttggtgactttggtgggtgcaatcagtctaatctatctggcaggattttcattcaacaatttatccatcatggcagtgattgttgcgattggattggtggtggatgatgctattgtcgtacttgaaaatattgaacggcacatcgaacagggtgaacatccatttagtgcagcgatacaaggcgttcgagaagttggttttactctggttgccatgaatctggcactcataataatttttatttccgtactatttatggggggcgtaattgagcgactgttccgtgaattttcattgacactggtgtttattgttgttgtttctgtttttgtgtctttgatcttgacaccaagtttatcagcacggtgtttacaatctatcaatgtgcagaataggcaaccattatacgattatagccaacgtatgatgcatggtttaacccgtcattatatccattcattacaatggattatacggcatacctatctagtgatactgctttggctaggggctatcataggttcagtttatgtgtatcagagtttacctaaacggattttgcctgaacaggatacaggacgaattgaatcttttattcgtggtgatgatggcttttcttttcaaattatgcagcccaaaattgcaacatttagccaaagtttgctcaaagatccagcaattaaagatgtgattggaacatcgggtggtgcaggtggcacaaccaattccttttttatggtgagtttgaaacctaaagcagaacgagaaggtaaaacgacgcgtgaaattgctgaaaggattcgtcaaaatgcgccatggatcgcaggtgctattttttcagcacgagtacagcaagacttggaactggatgatccattttctggaaatagtgggcaggattatttacttttattacaatcagatgatgtggctttacttagaaaatgggcacccaaagtcgcagaggctatacaaaaactacctgagcttgaagaagttgaaactttaggtgatgagggcgcacagcatgtcacgcttgacattaaccgagaagcagcacggcgtttgggcgttgatgtcgaaagtatttccagtgtactgaataattcattttcacagcgacaaatttcaacgatctatgatcaaaccaatcagtttcacgtggtgatggaaattgataaacgctttactgaaaaccccgaagcacttgcggatatcaaagttccaaatcaaaacggtgaatatgtgccactgaccaactttgccacgtggtcctatggaatcactaatgatcgggtacatcgacgcaatcagtatgctgcaatgggcattggctatgtcctcaaacaaggttatacagcagaacaagcagagtatgcgatccgtagtgttctgccacaagtgatgcttccgaatcagatttttgtggctacggataaagatgtagaagctgaaagtttacaagcaggtttaagtacaccgatgttgttggtgacggtcattgcactgatttatatcgtattaggtataacttatgaaagcatggttcaccccttaactatattatcgacaattcctgcgattgctttgggtggattactcacgctttggttatttaatttcgaatttactctcattgcattgcttggcatgtttttattgatcgggattgtggtgaaaaatgccattttactgattgattttaccttacagcaacgccgtttgggaaaaacagcccttgagtcggttgtatctgcggcgacattacgttttcggcctattttaatgactaatactgcggctttattaggggccatccctttggcactcagtacaaccgaaggatccgaattacgacaaccgttgggacttgtgattgttggcggtttggcattaggtcaacttttaacactttataccacacctgtgatgtatctcgttttagaaaaattggctcaaatatttaaaaaattcaagatgagcaatgccatcggttatagaaatagatag

SEQ ID NO: 74411 - protein, 1035 aa, Acinetobacter sp. ADP1
MNIFALFVHRPVANILLGIAMTLLGILAFFRLPVAALPQVDIPTIVVRANLPGASPESMSATVATPLERAMMGVSGIKAINSSSSQNSTQVILHFDLDTDINEAAREVQAAINVAMSQLPSGMPSPPEYFKVNPSQSPIFYLALSSRYLSAGKLYELASNQLKPNLAQTSGVGEVEIDGASMPAVRIILNPNALISQGISLEQVRDAVKKSNVVQSLGVIEHQNNRWQVALSTHIKDAADFSNLIVHQTAQGIVRLKDVAEVEDSVENRYVAGFHNGEPAVMIKISRQPNANTIATIEKIKAKLPELNSMIPADAKLTTVMDGSEVIHTGLQEARETLLFSIFLVVVVVVLMLGRLRSAIVPSIAMLVTLVGAISLIYLAGFSFNNLSIMAVIVAIGLVVDDAIVVLENIERHIEQGEHPFSAAIQGVREVGFTLVAMNLALIIIFISVLFMGGVIERLFREFSLTLVFIVVVSVFVSLILTPSLSARCLQSINVQNRQPLYDYSQRMMHGLTRHYIHSLQWIIRHTYLVILLWLGAIIGSVYVYQSLPKRILPEQDTGRIESFIRGDDGFSFQIMQPKIATFSQSLLKDPAIKDVIGTSGGAGGTTNSFFMVSLKPKAEREGKTTREIAERIRQNAPWIAGAIFSARVQQDLELDDPFSGNSGQDYLLLLQSDDVALLRKWAPKVAEAIQKLPELEEVETLGDEGAQHVTLDINREAARRLGVDVESISSVLNNSFSQRQISTIYDQTNQFHVVMEIDKRFTENPEALADIKVPNQNGEYVPLTNFATWSYGITNDRVHRRNQYAAMGIGYVLKQGYTAEQAEYAIRSVLPQVMLPNQIFVATDKDVEAESLQAGLSTPMLLVTVIALIYIVLGITYESMVHPLTILSTIPAIALGGLLTLWLFNFEFTLIALLGMFLLIGIVVKNAILLIDFTLQQRRLGKTALESVVSAATLRFRPILMTNTAALLGAIPLALSTTEGSELRQPLGLVIVGGLALGQLLTLYTTPVMYLVLEKLAQIFKKFKMSNAIGYRNR

SEQ ID NO: 74412 - DNA, 3129 bp, Acinetobacter sp. ADP1
  CDS (1)..(3129): transl_table=11
ctgctctttgagcttggatatgaatggaccatgttatccaaattttttattgatcgacctatttttgcaattgttttagccataattgttatggcattgggtattttctcgcttttgaatttacctgtagaacgctatccagatattgcaccgcctcgtatcgtcgtttcaaccagttatagtggtgcagatgcacaggcagttgaagatagtgtgactcaggtgctagaacaacaaattaaaggcattgaccatctgctttactttagttcaagcagtgatgcgaatggtagcagccagatcagtctatattttcagcagggtaccaatcctgatcaagcacaggttcaggttcaaaatgcgattaatggtgcattaaaccgcttgccagatgatgtacaacgacaaggtgtgattgttcgtaagtcgttaagcgactcatttctggtagtagggctcgcagaccgttctggtaaatctacgaatattgatatttcagactatctttccaataactttgaattaaatcttagccgcatagaaggggtaggtgagatcaatgtttttggctcaccttatgctatgcgaatctggttagatccagtcaagctgcaacattatcagcttatggtgagcgatattcgttctgcacttgaaaatcagaatacgcaggttgcagcaggagcaattggcgctttgcctgcaccgaaggatcaatatttaaatgctaaagtcacttcaggttcgcttttaaaaacaccagagcagtttgaaaatatcatagtaaaagccaatgcaaatggcagttttgtttatttaaaagatgtcgcgcgtgtggagattggcgcgcagaattatcaggtgtttaaccgaatcaatggttatcctggatcaggcttatccgtatcgttggctgctggtgcaaatcttgtcaagactgcagatttggtttatcaggaaatttcccgtttagagaaaaacctgcctgaaggttatttcattatctatccacgtgacgacacactctttgtgaaagaatcgattaaacaagtcatcagtaccttactagaagccattatattggttgtactggtgatgtttatctttttgcaaaactggcgtgccacgctgatcccgaccatcactgttcctgtcgtgattttaggaacctttgcagttttgtctatattagggatgagtatcaatactttaaccttatttgctatggtattggcgattggtttattagtcgatgatgcgattgtcgtggtcgaaaatgtcgagcgtctgatgcatgaacagcagcttgatgccaggcaggccagtattttatctatgcaggagatcagtggtgcactggttggcattacgctggtgttaacagccgtgtttattccgatgtcattttttagtggcgcaacgggaattatttatcgacagttttcgattacgctagtggctgcgatggtgctgtcgcttatggttgcattgattctaaccccagcattgtgtgcgattctgttaaagccacaaaataaatcctttaaatgggcagatgggtttaatcgtaaattagatcaactgagagattactatctcagactgactcatcgaagtgttcaatttaaaaccattagcttgattattttcgtggtattgattgctgcatttatctggatttatcgaagtttgcccaccagctttttacctcaggaagatcaaggtgcattaagtgtacagttcactttgccagagggtacgcctttatccaaaactgaagacgtgggtaaacagatttcagactattttatgtcacatgaaaaaaccaatctaaacggcatcatggtcattcatggacgtaacaactctggtactggacaaaatcttggacaggcttatgtatcgcttaaacactgggatgagcgtacaggtgctgcaaatagcgcacagcaaattcgtactagagcaatgcaatattttgctcaaaataatcaggccagaatttttgtattaatgccgtcggtgattcgtgggctgggtaactccgacaaaatttcgttctggttacaggatgtcaaaggattagggcgagagagcctacttcaatcttttcatgctttgcaaaaccaagagcaaaagtttgatgaacttaaaaatattgataagcgcagtaatgatgaccaatctgttttaaatattcagatcgatcataaaatggcaatggcactgggactgaacattgcgcagatcaatcaaacgctctctactgcatggagtggtagttatatcaacgactttattgatcgtggtcgaatcaagcgtgtctacctacaaggtgatatgcagtatcgcactaagcctgaagatcttgcatattggtatatcaaaaatgctcaaggtcagatgacgccgttttcacagtttagtcgtgtggaatggcaaggtgcaccgccgctattagagcggtttatgggatacccagctttagagatggaagcagatgcggccaatggctttagtacagggcaggccatgcaaaaacttagcaatctggtcgatgctatgcctgatgcaggattggcatggagtggcatgtcgtttcaagagcgagaatcaagtcatcaggcaatttggctctatgtcatctcgattgccttcatttttttatgtttagcggcactatacgaaagctggtcaattccaactgtcgtgatggcagcaattccgttgggaattggaggaacaattttgtttagtgagtggtttaattttgcaaatgatatttactttcagattgcattattaaccaccatcgggctgtcctgtaaaaatgcaattctgatggtggaatatgcagcaaatctacaagaaaatggtgaaacagtacttcatgctgcacttaaagcggctgggttacgtttaagacccattttaatgacctcaattgcgtttggtgctggtgtcgtacctctgatgttttcatctggtgcaggtgcattaagccgtcaggcaatcggttatagtgtatttggtggtgttttatttggcaccattctggttcttatctttatcccgttcatgtatgtgctgatccgttcggtgtttaaacataaaccaaagcccatttaa

SEQ ID NO: 74413 - protein, 1042 aa, Acinetobacter sp. ADP1
MLFELGYEWTMLSKFFIDRPIFAIVLAIIVMALGIFSLLNLPVERYPDIAPPRIVVSTSYSGADAQAVEDSVTQVLEQQIKGIDHLLYFSSSSDANGSSQISLYFQQGTNPDQAQVQVQNAINGALNRLPDDVQRQGVIVRKSLSDSFLVVGLADRSGKSTNIDISDYLSNNFELNLSRIEGVGEINVFGSPYAMRIWLDPVKLQHYQLMVSDIRSALENQNTQVAAGAIGALPAPKDQYLNAKVTSGSLLKTPEQFENIIVKANANGSFVYLKDVARVEIGAQNYQVFNRINGYPGSGLSVSLAAGANLVKTADLVYQEISRLEKNLPEGYFIIYPRDDTLFVKESIKQVISTLLEAIILVVLVMFIFLQNWRATLIPTITVPVVILGTFAVLSILGMSINTLTLFAMVLAIGLLVDDAIVVVENVERLMHEQQLDARQASILSMQEISGALVGITLVLTAVFIPMSFFSGATGIIYRQFSITLVAAMVLSLMVALILTPALCAILLKPQNKSFKWADGFNRKLDQLRDYYLRLTHRSVQFKTISLIIFVVLIAAFIWIYRSLPTSFLPQEDQGALSVQFTLPEGTPLSKTEDVGKQISDYFMSHEKTNLNGIMVIHGRNNSGTGQNLGQAYVSLKHWDERTGAANSAQQIRTRAMQYFAQNNQARIFVLMPSVIRGLGNSDKISFWLQDVKGLGRESLLQSFHALQNQEQKFDELKNIDKRSNDDQSVLNIQIDHKMAMALGLNIAQINQTLSTAWSGSYINDFIDRGRIKRVYLQGDMQYRTKPEDLAYWYIKNAQGQMTPFSQFSRVEWQGAPPLLERFMGYPALEMEADAANGFSTGQAMQKLSNLVDAMPDAGLAWSGMSFQERESSHQAIWLYVISIAFIFLCLAALYESWSIPTVVMAAIPLGIGGTILFSEWFNFANDIYFQIALLTTIGLSCKNAILMVEYAANLQENGETVLHAALKAAGLRLRPILMTSIAFGAGVVPLMFSSGAGALSRQAIGYSVFGGVLFGTILVLIFIPFMYVLIRSVFKHKPKPI

SEQ ID NO: 74414 - DNA, 3162 bp, Acinetobacter sp. ADP1
  CDS (1)..(3162): transl_table=11
atgaatccgtcccgtttgtttatccagcgaccagtggcgaccacactggtgatgatcgcaatttttttgtgtgggctggtgtcctggaaatttttacctgtggcgtctttgccagccgtagattatccaaccatgcaggtgacgacggtatatcctggggcgagtccagaggtgatagcctctaccattactgcaccactggaacgccagtttggtcagatgcctggtttaagccaaatgtcatcgaccagttctaatggggcttcggtcattacattgcagtttaatctcaatctggggttggacgttgccgagcaagaagtacaggcagcaattaacgcctctaataatttactaccttccgatctactgacaccaccgacctatagcaaagtgaaccctgctgataagccaattatgaccatcgctatcagctcaaaagaaatgccgatcaccaagctggaagatttggtagatacgcgcttagcacaacagctctcccaagtgagcggagtggggctgattagcgtgagtggtggtcagcgccctgcggtacgcttacaggtgaactctactgcactggcgaatatgggtttgacgctagaagatgtacgtactgcggttacggcagccaatgtaaatcaggccaaaggaaccatcagtggcagtgttcagtcatctacaattgatggtaatgatcagttgcataccgcagatgattataaaaacctgattattgcctataaaaatggtgcgccgattcgaatgtcggacattgcctcgaccattgactctgccgagaatacccgcttggcggcttgggttgggcatcgcaatcatgatgctgcaacacaaagcccagccattattattaatgtacaacgccaacccaatgccaatgtcattcaggtagccaatcagatcaaacaaattttgccgcaactgcaaagtagctttccacaatcggctaaagtagaaatcttaagtgacagtacccgtaccattcaggcttcgctgaatgatgtcgaatttgaactgctactggcgatggttttggtgattgtggtggtgtttctatttttacgcagtttacgtgcgacgtttattcccgcagtcgcattacccctttcactggtcggaactttcgctgtgatgtatctgctggggttttcagtcgataatttaagtttgatggcactgaccattgccacggggtttgtgattgatgatgccattgtgatgattgaaaacatttctcgctatatcgaacagggcgagtcgcccatgcaggcggcattaaaaggttcggagcaaattgctttcaccattatttcactcaccatttcattgattgcggtgcttattccactgttgtttatgggggatgtggttgggcgtttgtttcgtgagtttgcgattacactggctgtttccattttaatttctgcttttatttctttaaccctgactccgatgttgtctgccagattactcaagtatacgcctgaagcagaacaggggcgtttttatcatgtcatgggagatttttttgacaaactgatcggctggtacgccactgcattacgctgggtattggcacggcaaggtttattcctggtggtcaccattgcgacctttgtatttacggtcatgttgtatgtttttattccaaaaggtttttttcctgttcaggatacgggacaagttattgcgataacggaagcagaccagaccacatcgtttcaggcaatgcgtgttaagcagcagcaagtcgctaacattattctgcatgacccagcagtggacagtatctcttcttttattggggttgatggtagcaatagcgctttaaatatggggcgtattctgattaatctcaaagataaatcggatcgagcagatattcagacagttattcaggatttgcagcaacggctgaatcaggcgcaaggaatgaccgtatatctacagcctgcgcaggatttaacgatcgatgcgaggcagagtcggacacagtatcagtttaccttgcagtcaaccagcgcagatcatttggcaaaatgggtacctaccttgatgcaggcgttggcacaacgtcccgaactgaatcatctggcaagcgactggcaaaataagggcttgcaggtttatgtcgatatcaaccgcgatgctgctgcacaatacggcattactacagcaggcatcgataatattctttacgatgcctttggccaaagactgattagtacgatttttacgcaaaccaatcaatatcacgttgtactggggttatctggacaagatcagaatggattacaggcattacaaaatttatatatcccttccagtcatggcacgcctatacgcttgagtagcattgccagtattcaacccagaagcaccttgcttgaagtcaatcatttagggcaatttccaaccgcaacggtgtcgtttgatacagcagcaggggtttcactacaacaagccgtacaggcagtcaaagataccgaacaacaattaaagatgcctggcagcctaatgacgcagtttcaaggcgcagctttggcctttcaagcttcgctgagcagtaccgtctggttaattgttgcagcgattgtggtgatgtacattattttgggggtgttatatgaaagctttattcatccattaaccattttatcgaccttgccatcggcagggattggtgcgttgctggcattggtattatctcataatgatctgaatatcattgccattatcgggattgtattgctgatcggaatcgtcaaaaaaaatgccatcatgatgattgattttgccttagatgcagagcgacaccaagggctgaccccaatcgagtctatttatcaagcctgtttattacgctttaggcctattttaatgaccactatggcagcattgctgggtgctgtaccgttagtgattggctcgggcatagggtcagagttaaggcatcctttgggaattaccatgattggtggtctgattgtgagccagttacttactttatttacaacacctgtggtgtatttggcctttaatcatttagcacaaaagatcagagggacgcatcgaccagacaagtctgccagtgacttggcaccttacaaacattttaagtcacaggcggatgaggtatga

SEQ ID NO: 74415 - protein, 1053 aa, Acinetobacter sp. ADP1
MNPSRLFIQRPVATTLVMIAIFLCGLVSWKFLPVASLPAVDYPTMQVTTVYPGASPEVIASTITAPLERQFGQMPGLSQMSSTSSNGASVITLQFNLNLGLDVAEQEVQAAINASNNLLPSDLLTPPTYSKVNPADKPIMTIAISSKEMPITKLEDLVDTRLAQQLSQVSGVGLISVSGGQRPAVRLQVNSTALANMGLTLEDVRTAVTAANVNQAKGTISGSVQSSTIDGNDQLHTADDYKNLIIAYKNGAPIRMSDIASTIDSAENTRLAAWVGHRNHDAATQSPAIIINVQRQPNANVIQVANQIKQILPQLQSSFPQSAKVEILSDSTRTIQASLNDVEFELLLAMVLVIVVVFLFLRSLRATFIPAVALPLSLVGTFAVMYLLGFSVDNLSLMALTIATGFVIDDAIVMIENISRYIEQGESPMQAALKGSEQIAFTIISLTISLIAVLIPLLFMGDVVGRLFREFAITLAVSILISAFISLTLTPMLSARLLKYTPEAEQGRFYHVMGDFFDKLIGWYATALRWVLARQGLFLVVTIATFVFTVMLYVFIPKGFFPVQDTGQVIAITEADQTTSFQAMRVKQQQVANIILHDPAVDSISSFIGVDGSNSALNMGRILINLKDKSDRADIQTVIQDLQQRLNQAQGMTVYLQPAQDLTIDARQSRTQYQFTLQSTSADHLAKWVPTLMQALAQRPELNHLASDWQNKGLQVYVDINRDAAAQYGITTAGIDNILYDAFGQRLISTIFTQTNQYHVVLGLSGQDQNGLQALQNLYIPSSHGTPIRLSSIASIQPRSTLLEVNHLGQFPTATVSFDTAAGVSLQQAVQAVKDTEQQLKMPGSLMTQFQGAALAFQASLSSTVWLIVAAIVVMYIILGVLYESFIHPLTILSTLPSAGIGALLALVLSHNDLNIIAIIGIVLLIGIVKKNAIMMIDFALDAERHQGLTPIESIYQACLLRFRPILMTTMAALLGAVPLVIGSGIGSELRHPLGITMIGGLIVSQLLTLFTTPVVYLAFNHLAQKIRGTHRPDKSASDLAPYKHFKSQADEV

SEQ ID NO: 74416 - DNA, 3129 bp, Erwinia carotovora subsp. atroseptica SCRI1043
  CDS (1)..(3129)
atggctaagttttttatagatcgacccatttttgcatgggtactcgccatcatggtgatgctgacggggttgctggcaattgttaaattacccattgcccagtacccaacaatcgcgccacccgcgattgaaataacagcaaactatcctggggccgatgcatcaacactgcaagactctgttacgcaggttatcgaacagaatatgaacggtatcgataacctgatgtacatgtcatcaagcagtgactcctcaggtacggtccagattacgctgacctttgaggccagtaccgatccggacatcgcgcaggttcaggtgcagaacaagctgcaactggccatgccgttgctgccgcaggaagtacagcagcaaggggtgaacgttcagaaatcaagtagcagcttccttatggttgccgccttcattagtgaagacggtaaaatgtcacaggaagatatcgctgactacgtggccgctaacgttaaagaccctatcagtcgtacatccggcgtaggcgacgcgcagctatttggctcccagtacgccatgcgtatctggctagatccgaacaagctgaacaactatcagttaacttcaggtgacgtcagcgcagcaatccgtgttcaaaacaaccagatcgccgcaggacaattggggggcgctccaccggttcccggccagcagttgaacgcctcgatcattgcgcagacccgtctgaattcagcagaggagttttctaaaatactgctgaaggtcaacgccgatgggtctcaggttcgccttaaagatgtcgcacgcgttgagttgggcgcagaaggctacgacgttatagctcgtttcaatgggaaacccgctgccggtatcggtatcaaattggcaacaggtgcgaacgcgctggatacggcaaacgcagtaaaagatgcactgaccaaagcggaagagttctttccttcaggcctgaaagtcgtttacccgtacgatacaacgcccttcgttaagatctcgatcaacgaagtagtgaaaacgctggtggaagctatcgtactggtattcctggtgatgtacctgttcctgcagaacttccgtgccacgctgatcccaacaatcgcggtgccggtcgtcttgctggggacatttgctatcctctccgcgtttggttattccataaacaccttgacgatgttcgcgatggttctcgccatcgggcttctggtggatgacgccatcgtcgtcgtggaaaacgtggaacgagtaatggcggaagaaggtctgccgcctaaagaagcaaccaaacgatccatggagcagatccaaggcgcgttggtcggtattgcactggtgctgtccgccgtattcgtcccgatggcgtttaccggtggttcaacaggggcaatctaccgccagttctccatcacaatcgtttcggcgatggtgctgtcggttctggttgcgttgattttgacaccagcactttgtgcaacactgctgaaacccatcgccaaaggcgatcatggtgagaaaaaaggcttcttcggctggttcaaccggctgtttgagaagagcacgcagcactacaccgacagcgtggcgaatatcctgcgcagcactggccgttatctggtcatctatctgttgatagttgtgggtctggcactgttgttcttacgtttgccaacgtctttcctgccggacgaagaccagggggttctcctgaacattgttcagttaccttcaggtgcaacgcaggaaaacacccagaaaatcatggacagaatgacgcaatactatctcgacaatgagaaaggtaacgttaagtctgtgtttaccgtgacgggcttcgggttctctggtcgtgggcagaatgccggtttggctttcgccagcttgaatgactggagtgaacgaagcggcgcagaaaataaagttatggcgattgcaggccgagcaaacgcggcctttagccagtataaagaagctatggttttcgcagtcaaccttcctgcgattatcgaactgggtactgcaacaggtttcgacttccagttgattgaccaagctaaccttgggcacgcaaaactgacggaagcacgtaatcagttactgggcatggcagcacaacgccctgatacgctggtgcaagttcgtccgaacgggatggaagatacaccgcaattccgtcttgatatcgatcaggaaaaagcacaagcgcttggcgtgtcactgtcagatatcagctcaacgttggcaacaacgctgggtggttcttatgtgaatgactttatcgatcgcggtcgcgtgaagaaagtttacgttcaggccgacgcgcctttccgtatgctgccagatgacatcaaaaactggtacatccgcggtagtaacggacagatggtgccattctccgccttcacgcagagtcactgggaatacggttcaccgcgtctggagcgttataacggccagccatccatgcaaatacagggcgaagcggctccaggtaagagttccggtgacgccatggcgttgatggaagagttcgtcaccaaattaccgcaaggtatcggctaccaatggacgggaatgtcctatcaagagcggttatcaggcaaccaggctcctgcaatctatgccatttcattgattgtcgtgttcctgtgtctggcggcgctttatgagagctggtcaattccgttctccgtcatgctggttgttccattggggatcatcggtgcattgattgcagcgaatatgacgggtcttgaaaatgacgtttactttaaggtgggcctgctaacaaccatagggctatcggcgaagaacgccatattgatcgtcgaatttgctaaagatctgatggaaaaagaagggaaaggactgattgaagcaacgctggatgctgttcgtatgcgtttgcgtccaatcctgatgacatcactggcctttatcctcggtgtaatgccgctggtaattagtagtggtgcgggttccggtgcacagaacgccgttggtactggcgtaatgggcgggatgattacggcaaccgtgctggctatcttcttcgttccggtgttcttcgttgttgtccgccgtcgtttcagcaagaaagtggacgatacaacagctcactaa

SEQ ID NO: 74417 - protein, 1042 aa, Erwinia carotovora subsp. atroseptica SCRI1043
MAKFFIDRPIFAWVLAIMVMLTGLLAIVKLPIAQYPTIAPPAIEITANYPGADASTLQDSVTQVIEQNMNGIDNLMYMSSSSDSSGTVQITLTFEASTDPDIAQVQVQNKLQLAMPLLPQEVQQQGVNVQKSSSSFLMVAAFISEDGKMSQEDIADYVAANVKDPISRTSGVGDAQLFGSQYAMRIWLDPNKLNNYQLTSGDVSAAIRVQNNQIAAGQLGGAPPVPGQQLNASIIAQTRLNSAEEFSKILLKVNADGSQVRLKDVARVELGAEGYDVIARFNGKPAAGIGIKLATGANALDTANAVKDALTKAEEFFPSGLKVVYPYDTTPFVKISINEVVKTLVEAIVLVFLVMYLFLQNFRATLIPTIAVPVVLLGTFAILSAFGYSINTLTMFAMVLAIGLLVDDAIVVVENVERVMAEEGLPPKEATKRSMEQIQGALVGIALVLSAVFVPMAFTGGSTGAIYRQFSITIVSAMVLSVLVALILTPALCATLLKPIAKGDHGEKKGFFGWFNRLFEKSTQHYTDSVANILRSTGRYLVIYLLIVVGLALLFLRLPTSFLPDEDQGVLLNIVQLPSGATQENTQKIMDRMTQYYLDNEKGNVKSVFTVTGFGFSGRGQNAGLAFASLNDWSERSGAENKVMAIAGRANAAFSQYKEAMVFAVNLPAIIELGTATGFDFQLIDQANLGHAKLTEARNQLLGMAAQRPDTLVQVRPNGMEDTPQFRLDIDQEKAQALGVSLSDISSTLATTLGGSYVNDFIDRGRVKKVYVQADAPFRMLPDDIKNWYIRGSNGQMVPFSAFTQSHWEYGSPRLERYNGQPSMQIQGEAAPGKSSGDAMALMEEFVTKLPQGIGYQWTGMSYQERLSGNQAPAIYAISLIVVFLCLAALYESWSIPFSVMLVVPLGIIGALIAANMTGLENDVYFKVGLLTTIGLSAKNAILIVEFAKDLMEKEGKGLIEATLDAVRMRLRPILMTSLAFILGVMPLVISSGAGSGAQNAVGTGVMGGMITATVLAIFFVPVFFVVVRRRFSKKVDDTTAH

SEQ ID NO: 74418 - DNA, 3144 bp, Erwinia carotovora subsp. atroseptica SCRI1043
  CDS (1)..(3144)
atgcctaacttttttattcacagacccaactttgcctgggttgtggctatcttcatcgcgatggcggggttgcttgccatttcgtcgttgcccgtctcgcagtacccagcggttgctccgccacaaattgtggtgacggcaacttatcccggtgcttccgctgaagtcatcaatagcggtgtcacaagcctgatagaggaagagcttaatggcgcaaaagggctgctctattatgaatctcagagtaacagtgcgggctcgggagagataaccattacctttcagccgggtaccaaccccgatctcgctcaggttgacgtacagaaccgtattaaaaaagtcgaatcccgtcttcctgcctcggtaacccaacagggattacaggtcgaacaggcgagtaccaacttcctgatgatctttgctctgacagcaaaagataagaattctgatgaagtaaaccttgctgactacgcggcgcgaaacattaacaacgaaattcgccgagtcacaggcgtaggccgtgtgcaaatgttttccgcagagcgcgctttacgtgtatggatagatccgacgaagctgattagctatgggttgtccattaatgatgtagataatgccatcaaagcgcaaaacgcgcaggtatccggtgggagcctgggagagcagcccagtccacctgatcaagaaatctctgcaaacatactggttcaggggcagctgtcctctattgaggaattttctcgcattgtgcttaaggctgatgcagacggatctactgtccgtttgagtgatgttggccgagtagaaatggggaggcaggattatcgtttatcatcacggctcaatggtgaacctgcggtagggatcggtgtgcaactttctcctggggccaatgcacttgagacagcaaaagccgtcaaatctcgactggctgaattgtcgatgaatttcccagagaatatcagttatagcgttcctcatgacacatcgaaatttgttgaagtggccattaagaaagtcctgatgacgctgcttgaagccgttgtactcgtctttctagtcatgctgctgtttctgcaaaatattcgctacacccttatcccgacgattgttgttcctatctgtttgcttggcacgctggcggtgatgttgccgttagggttttccgtcaacatgatgaccatgtttggcatggttttagccatcggtattctggtggatgatgccattgtggtcgtggaaaatgtcgaacgcatcatggccgaagaagggctgtctcctaaagaggcgacgatcaaagcgatgacccaaatcagtggggcgatcgtggggattaccctcgtgctcgttgcggtgttcctgccgcttgcattcatgagtggttctgttggagtgatatatcgtcagttctctgtttctctggcaatttcgattcttttctccggcttccttgccctaacgctgacgcctgcgctttgcgccaccttgattaagcctattgctaaaggtcaccatgccgagaaaaaagggttattcggctggttcaaccgtaaattcagcagcttgacggagcgttactcttctaccacatcaacattgctgtcacgctcaggcagagtgatgttggtgtatgtcgccattcttggtgtgcttgcggtggcctatacccggctaccctcggcgtttcttccgtcagaagatcagggttatgtcatgacggatattcagcttcctccgggggcgacatatcagcggctgatgacatcaaccaaggaaatggaaaactactttcttgaacgtcctgcggttgcggatgtactgacgcttcagggattcagcttttccggtatggggcagaatgccggcatgggctttgtcatgctcaaagactggtcagaacgctccagtgaggaatctgtacaaaatgaagcggatcaatccagcggtgttttccagagcataaaagacggcacgctattttctatcgttccgccttcgattgaaggcatgggtaactcaagtggctttgcgctacgtcttcaggatcgtgcaggccttggtcgtgacgcgctgcttgccgcaagccaacagctaatgggcagggtgtatgaatccccgacttttgcttacatcatggtggaaggattggctgatgcaccacagcttgacctgcgtatcgatcgtgagaaagcagaagcaatgggggttccttttgatgccattaataatgctatctcgaccgcctacggttcggcgttagtcaatgagttcccaaatcaggggcgtatgcagcgcgttatcgtccaggcagcacctgaaagtcgggctacgccggaaacgctgcgtaaactgaatattctcaaccgcaatggggaattggttcctctggaggcgtttagcgaaatcgcgtggaagcatggccctgtgcaagtagtccgctacaacggttatccgagcctcaaactttccggtgatgtggttcccggcatgagctctggtgagggaatgaaagagattgagcggttggctgcacaattatcaccgggaattgggtatgagtggaccggtttgtcctatcaggaaaaagccgccggttctcaggctccgctgctattagctttagcacttgtcgtggtctttctggttctggttgctttgtacgaaagctggaagatcccgttctcggtcctcctgattgttcctgtcggggcgttgggtgctgttgcggccgtaatggctgcgggtatgtctaatgacgtgtatttcaaggtgggtctgatcactatcattgggcttgcggcgaaaaatgcaattctcatcatcgagtttgcaaaggatctccacgcacaagggaaatccttcaggcagtccgctattgaagccgcacgcttgcgttttcgtcctatcgtgatgacctcgcttgcctttattcttggcgtggtaccgcttgctattgcaacgggagcgggtgcactcagccagcgtgctatcggtacgggtgtcatgggggggatgttgagcgcgaccttactgggtgtgctgtttgtgccagtcttctatgtctgggtcatgtctttgatgaacaaaagcaaagaaaagacaccgcctgatagccagacagatacccgagaggtgggaaaatga

SEQ ID NO: 74419 - protein, 1047 aa, Erwinia carotovora subsp. atroseptica SCRI1043
MPNFFIHRPNFAWVVAIFIAMAGLLAISSLPVSQYPAVAPPQIVVTATYPGASAEVINSGVTSLIEEELNGAKGLLYYESQSNSAGSGEITITFQPGTNPDLAQVDVQNRIKKVESRLPASVTQQGLQVEQASTNFLMIFALTAKDKNSDEVNLADYAARNINNEIRRVTGVGRVQMFSAERALRVWIDPTKLISYGLSINDVDNAIKAQNAQVSGGSLGEQPSPPDQEISANILVQGQLSSIEEFSRIVLKADADGSTVRLSDVGRVEMGRQDYRLSSRLNGEPAVGIGVQLSPGANALETAKAVKSRLAELSMNFPENISYSVPHDTSKFVEVAIKKVLMTLLEAVVLVFLVMLLFLQNIRYTLIPTIVVPICLLGTLAVMLPLGFSVNMMTMFGMVLAIGILVDDAIVVVENVERIMAEEGLSPKEATIKAMTQISGAIVGITLVLVAVFLPLAFMSGSVGVIYRQFSVSLAISILFSGFLALTLTPALCATLIKPIAKGHHAEKKGLFGWFNRKFSSLTERYSSTTSTLLSRSGRVMLVYVAILGVLAVAYTRLPSAFLPSEDQGYVMTDIQLPPGATYQRLMTSTKEMENYFLERPAVADVLTLQGFSFSGMGQNAGMGFVMLKDWSERSSEESVQNEADQSSGVFQSIKDGTLFSIVPPSIEGMGNSSGFALRLQDRAGLGRDALLAASQQLMGRVYESPTFAYIMVEGLADAPQLDLRIDREKAEAMGVPFDAINNAISTAYGSALVNEFPNQGRMQRVIVQAAPESRATPETLRKLNILNRNGELVPLEAFSEIAWKHGPVQVVRYNGYPSLKLSGDVVPGMSSGEGMKEIERLAAQLSPGIGYEWTGLSYQEKAAGSQAPLLLALALVVVFLVLVALYESWKIPFSVLLIVPVGALGAVAAVMAAGMSNDVYFKVGLITIIGLAAKNAILIIEFAKDLHAQGKSFRQSAIEAARLRFRPIVMTSLAFILGVVPLAIATGAGALSQRAIGTGVMGGMLSATLLGVLFVPVFYVWVMSLMNKSKEKTPPDSQTDTREVGK

SEQ ID NO: 74420 - DNA, 3123 bp, Erwinia carotovora subsp. atroseptica SCRI1043
  CDS (1)..(3123)
atggcgaacttttttgtcgaccgtcctatttttgcgtgggtgctggctatccttctcagcctgtgcggtatgttggcgatcaagtcattaccgctagaacaataccccgatctggctccgcctagcgtaaggatcacggctagctatcctggtgcgtcggcacagacgctggaaaatactgtgacgcaggttatcgagcagagcatgaccgggctggataacctgatgtacatgtcctcggacagcagcaataccgggcaggcccgaatcatgctgaccttcgaagcaggcaccgaccccgatgaagcccgtcagcaggtgcaaaaccaacttcaatccgctacccgcaagctgccgcaggacgtgcagcagcagggcgtcaccgtcagtaaaaccggcgacaccaatatcctgatggtcgcgtttgtctctactgatggcagcatggacaaacaggatatctccgattatgtcgcgacgaatattcaggagccgatcagccgcatcagtggggtgggcgaggtcgattcctatgggtcgcagtatgcgatgcgcatctggttggacccagcgaaactgatggattattcgctgacgaccagcgacgtcgtgcgggctatcgaatcgcaaaatagtcaggtttcggtagggcaagttggcggtgtaccgtcggtggataatcaggcgcttaacgccacgatcaatgcacaatctctgctacagacgccgcaacagttccgtgatatcacgctgcgcgtcaatcaagatgggtctgccgtcacgctggccaatgttgcggaagtggaactcggtgccgaacgctatgattttctcagccgctttaacggtcaggctgcatctgggctgggcgttaagttagcgtctggcgctaacgaactggaaactgataagcgcgtcagagaacgcatcgaagaactgtcgcattacttcccccacgggctggaagccaaaattgccttcgaaacgtccccttttgtgaaagcctcgattactgatgtggtgaaaacgctgtttgaagcggtgctgctggtctttctggtgatgtacctgttcttgcagaatttccgcgccacgctgattcccacgattgcagtgccggtggtgttgctcggtacgtttgccgtgctgtatgccttcggttttagcctgaatacgctgacgatgttcgcgatggtgctggcgattggcctgctggtggacgacgccatcgtggtggttgaaaacgtagagcgggtgatgagcgaagaggggctctcgccacgggaagcgacgcgaaaatcgatggggcaggtgcaaggggcgctggtcgggattgcgctggtgctgtccgccgtgtttgtgccgatggctttctttggcggtaccacgggggcgatttatcgtcagttctccatcaccattgtgacgtcaatgattctgtcggtgctggtggcgatgattctgacacccgcgctgtgtgcgacgctgctcaagccgctcgccaaaggccagcaccacggccgtaaaggtttcttcggctggtttaaccggagctttacccgcacgtcgctgggctatgagcgtggcgtcggcaagatattggtaaacagcggacgctggctgctgctttatatgggtattatcgggattatggctttcctgtttttccggctgccaacctcgtttttgccacaggaagatcggggcgtgttcacgactcaggtacagcttccacctggggcgacgcaacagcagaccttacaggtggtcaacaaaatcgagcagtattaccttacgcaggaaaaagacacggtgacatccgtgttttccaccatcggctcagggccgggcggaaatgggcagaacgtggcgcggctgtttgtgagccttaaagactggaacgaacgcaccacgccggagagcagttcgtttgccgtcatcgaacgcgccactaaagaatttcgcaagatcaaggaagctcgcgtgttcgccagcagcccaccgtctatcaacggtttgggcagcgctgcgggcttcgctatgcggttacaggatcgcggtgggttggggcacgatgcgctgatggccgcgcgggatcaactgctgaatatggctgacagtaaccgtgaactgacgcgtgtgcgccataacggtctggatgacagttcgcaactgcggattcatatcgatcagcgcaaagcacaggcgctgggcgtatcggtagacgacattaacagcacgctgaaaacgggctgggggtcgacctatgtgaatgacttccttgatcgtggccgcgtgaagaaagtctacgtgcaggcggcagcgaaattccgcatgctgccggacgatatcagtaaatggtatgtgcgtaataacagcggcggcatggtgccgttcagcgcgtttgcacagactgtctgggaaacgggatcgccgcgccttgaacgctacaacggctattcgtcgctggaaattgtcggcgaggccacgccgggcgtcagtaccggtacggcgatgaatattatggaatcgctggtggagaagctgccggaaggctttggggtggagtggacggggatgtctttgcaggagcgcctaagcggggcgcaggctccggcgctgtatgcgatttcgctgctggtggtgttcttgtgtctggctgcgttgtatgaaagctggactgtgccgttctccgtcatgctggtggtgccgatgggcgtactcggggcgctggtggcgacctgggcgcgcggtctggaaaacgatgtctattttcaggttgggctactgacggtggtcgggctatcggcgaagaacgccatcctgattgtggaattcgccaacgagatgaaccagaaaggaaaggatctggttgaggccacgctggaggcttcccgccagcggttgcggcctatcttgatgacgtcactggcgtttatcttcggtgtgttaccgatggcgaccagcagcggtgcgggttctgccagccagcatgcggtgggaacgggcgtgatcggcggcatgctagccgccaccttcctcgccatcttctttgtaccgctgttctttgtcgtcgtgcgccgtcgctttccgctaaaggagaaggtgacggagcaggattag

SEQ ID NO: 74421 - protein, 1040 aa, Erwinia carotovora subsp. atroseptica SCRI1043
MANFFVDRPIFAWVLAILLSLCGMLAIKSLPLEQYPDLAPPSVRITASYPGASAQTLENTVTQVIEQSMTGLDNLMYMSSDSSNTGQARIMLTFEAGTDPDEARQQVQNQLQSATRKLPQDVQQQGVTVSKTGDTNILMVAFVSTDGSMDKQDISDYVATNIQEPISRISGVGEVDSYGSQYAMRIWLDPAKLMDYSLTTSDVVRAIESQNSQVSVGQVGGVPSVDNQALNATINAQSLLQTPQQFRDITLRVNQDGSAVTLANVAEVELGAERYDFLSRFNGQAASGLGVKLASGANELETDKRVRERIEELSHYFPHGLEAKIAFETSPFVKASITDVVKTLFEAVLLVFLVMYLFLQNFRATLIPTIAVPVVLLGTFAVLYAFGFSLNTLTMFAMVLAIGLLVDDAIVVVENVERVMSEEGLSPREATRKSMGQVQGALVGIALVLSAVFVPMAFFGGTTGAIYRQFSITIVTSMILSVLVAMILTPALCATLLKPLAKGQHHGRKGFFGWFNRSFTRTSLGYERGVGKILVNSGRWLLLYMGIIGIMAFLFFRLPTSFLPQEDRGVFTTQVQLPPGATQQQTLQVVNKIEQYYLTQEKDTVTSVFSTIGSGPGGNGQNVARLFVSLKDWNERTTPESSSFAVIERATKEFRKIKEARVFASSPPSINGLGSAAGFAMRLQDRGGLGHDALMAARDQLLNMADSNRELTRVRHNGLDDSSQLRIHIDQRKAQALGVSVDDINSTLKTGWGSTYVNDFLDRGRVKKVYVQAAAKFRMLPDDISKWYVRNNSGGMVPFSAFAQTVWETGSPRLERYNGYSSLEIVGEATPGVSTGTAMNIMESLVEKLPEGFGVEWTGMSLQERLSGAQAPALYAISLLVVFLCLAALYESWTVPFSVMLVVPMGVLGALVATWARGLENDVYFQVGLLTVVGLSAKNAILIVEFANEMNQKGKDLVEATLEASRQRLRPILMTSLAFIFGVLPMATSSGAGSASQHAVGTGVIGGMLAATFLAIFFVPLFFVVVRRRFPLKEKVTEQD

SEQ ID NO: 74422 - DNA, 3144 bp, Desulfotalea psychrophila LSv54
  CDS (1)..(3144): transl_table=11
atgtctcgtttttttattgatcgtccagtttttgcctgggtcatcgccctactcatcatgctggcgggtgtccttgccatcatcggcatgccagtagagcaatatcctactatcgctcctcctcaggtctccatctcggccttttaccctggtgcctctgcggaaactctgcaaaacagtgttacccaggttatagaacaggaactgaccggaattgataatatacgttatttcagttccaccagtgagtcagcaggtatggtaaccattacagttaccctggagccgggaactgaccctgatatcgctcaggttcaagtacagaataaagtacaaacggcaatgccacagctaccacaggcggtgcaatcacagggggttactgttgaaaaatcctccacaagttatctttttgtaaccagcttttactctaacaacccagatatcgaccagatctaccttgccgatcttatctcatcccaaataagtgaccctatttcaaggattagcggagtcggtacggtaacggcctttggtgacccatacgccatgcgtatatggctcgatccacaaaaaatgtacagttttcaactctcaacaaatgaagtactgacggcgatctctgaacaaaatatcgatgtctccgcaggacagttgggcggcctgcctgctgtgcagggacaacagatcaacgcaacggtacttgcccagtcacgtttaaagaccgttgatgaatttgaagatattatcctgcgggtaaacacagatggatctcaggtacgcttaagcgacattgcctccgttgaacttggtgctgaaacctacggcaccatcattaaacgaatgggaaagccctgtgccgcctttggtataagtctagcaacgggagccaacgccctggataccgcagctcgggtaaaaacaaaactggcagaactggccgaatacctaccggttggagttgagtacagctttccctatgacacaacgccatttgtaaaaatttccatcagagaagttgtaaagaccctgtttgaggctatcttcctcgtctttcttgttatgtttctctttctgcaaaatttcagggcaacactgatccctacccttgccgtaccggttgttctcctcggtacctttgctattttacatgtctgcggctttaccatcaacaccctcaccatgtttgccatggtacttgccatcggtctgctagtggatgatgccattgttgtggtagaaaacgttgaaagggtcatgagcgaagagggactctcgcccaaagaggccacccgtaaatccatggatcaaatcaccggcgccctcgtcggtatcgctttagtgctctctgctgtttttgttcccatggccttctttagtggttctaccggtgctatctatcgccaattttccattaccattgtctcagcaatgacactttctgtgctcgtcgccctgatcctgaccccaaccctctgtgccacatttttaaaaccggttccaaaggggcatggcgagaaaacgactggtttttttggttggttcaaccgaaccttcaaccgggcacggagtgggaccaaaaaagcctccggctacattgccaaacgcagcttccgttttcttatcatctacgccctactcgttgttacccttggctttttattcatgaaaatgccaacgggatttttaccagacgaagatcagggtgttctcatggtaatggcctcgacccctgccggggcatcagcacaacgaacagaagctgcaatgaaacaacttgatcactacctgcaaacagaacaaaccaagaacatcgagcaatatatgaccatcgtcggttttagctttgccggtcatggccaaaataccgctttaggcttcctcaatatgaaggattggtcagagagaaagggaaaagaccagagcgttatggccattgcaaatcaaattatgcgagccatgtccgaggtgaaagatgcaatgatctttgctttttatcctcctcccatcatcgaccttggtaccgcatcgggttttgacttccagctcatcgactatgtaggccttggccatgacaaactgatgcaggcacgtaaccaattactgggcatggccagaaaaaaccccaaattggtcggcgttcgccccaatggtctcaacgatgtccctcaatttaagatagagatagatttccaaaaagctcgagcacttggccttgctatcgccgatatcaatgacaccctgcaaacagcgtggggttcgagttacgtcaatgactttatggacaaaaacagagtaaaaaaagtctatgtccagggaattaccaaatcacgaatgcaaccaactgatatcgaagagtggtatgtcaaaaattcctcggggaaaatggttccttttaccgcctttaccaagacctcttggaactacggttctcctcgtcttgaacgatttaacggctatgcctccatcaacatcctgggagccaatgcaccaggagtcagttccggtgaggcgatgacagagatggaagagatgtccaaaaagctccctgagggtattggttatgaatggtcagggctttcctacgaagagcgtgcttcaggatcccaagctccggccctctacgccatctctattctcattgtcttcctcagtctagcagccctctatgagagttggtccatccccttctccgtactatttgtcctgcctctgggtattattggagcagttatcgccacctcggcctttggcatggacaatgatatttatttccaagtagccctgctcaccacccttgggctctgcgctaagaatgcaattttaatcgttgagttcgcaaaagaactctacgaagacggccatacccttatggatgcggccctcaccgcctttgaactgcgctacagaccaatcatcatgacctccatggcctttatccttggcgtactaccacttgccacatccagtggtgccggtgccgcaagtcaaaatgcgattggcatagctgttataggtggaatgtttgcggcgacatttctcgcaatcttttttgtaccacttttctttgtaatcgttgaaaaaatgtcccttagcaaaaaaccggaagagataatcgtcgaaaaagacagcgaggtagaataa

SEQ ID NO: 74423 - protein, 1047 aa, Desulfotalea psychrophila LSv54
MSRFFIDRPVFAWVIALLIMLAGVLAIIGMPVEQYPTIAPPQVSISAFYPGASAETLQNSVTQVIEQELTGIDNIRYFSSTSESAGMVTITVTLEPGTDPDIAQVQVQNKVQTAMPQLPQAVQSQGVTVEKSSTSYLFVTSFYSNNPDIDQIYLADLISSQISDPISRISGVGTVTAFGDPYAMRIWLDPQKMYSFQLSTNEVLTAISEQNIDVSAGQLGGLPAVQGQQINATVLAQSRLKTVDEFEDIILRVNTDGSQVRLSDIASVELGAETYGTIIKRMGKPCAAFGISLATGANALDTAARVKTKLAELAEYLPVGVEYSFPYDTTPFVKISIREVVKTLFEAIFLVFLVMFLFLQNFRATLIPTLAVPVVLLGTFAILHVCGFTINTLTMFAMVLAIGLLVDDAIVVVENVERVMSEEGLSPKEATRKSMDQITGALVGIALVLSAVFVPMAFFSGSTGAIYRQFSITIVSAMTLSVLVALILTPTLCATFLKPVPKGHGEKTTGFFGWFNRTFNRARSGTKKASGYIAKRSFRFLIIYALLVVTLGFLFMKMPTGFLPDEDQGVLMVMASTPAGASAQRTEAAMKQLDHYLQTEQTKNIEQYMTIVGFSFAGHGQNTALGFLNMKDWSERKGKDQSVMAIANQIMRAMSEVKDAMIFAFYPPPIIDLGTASGFDFQLIDYVGLGHDKLMQARNQLLGMARKNPKLVGVRPNGLNDVPQFKIEIDFQKARALGLAIADINDTLQTAWGSSYVNDFMDKNRVKKVYVQGITKSRMQPTDIEEWYVKNSSGKMVPFTAFTKTSWNYGSPRLERFNGYASINILGANAPGVSSGEAMTEMEEMSKKLPEGIGYEWSGLSYEERASGSQAPALYAISILIVFLSLAALYESWSIPFSVLFVLPLGIIGAVIATSAFGMDNDIYFQVALLTTLGLCAKNAILIVEFAKELYEDGHTLMDAALTAFELRYRPIIMTSMAFILGVLPLATSSGAGAASQNAIGIAVIGGMFAATFLAIFFVPLFFVIVEKMSLSKKPEEIIVEKDSEVE

SEQ ID NO: 74424 - DNA, 3054 bp, Desulfotalea psychrophila LSv54
  CDS (1)..(3054): transl_table=11
atgaaaatatcagaaataagtgtcagacgtccggtactggcgacggtgatgagtctgctgatcgtactgatcggcctggttgcctatgatcgtttgacggttcgtgagtaccctaatatcgacgagcctacggtttcggtggtgaccgtttatcaaggtgccagtccggagatcattgaaaccgagattaccaccatcattgaggatagcctctcgggaattgaggggatcaaaaccatctcttccgagagtcttcaggaacggagccagatcagtattgtctttaagatggagcgtaatgccgatgatgccgccgctgaggtgcgtgaccgggttgggcgggtgcgcgctgatctacccctcgatgtcgaggagccggtcattgccaaggttgaagccgatgccgatccgatcctctatatggccttttccagtgacaagcacagtaatgaagagattactgattacgttgatcgctatgtgaccgaccagattgaaatgatcgatggtgttgccgaagcgcaggtccttggtgctcgtaaatactccatgcgtatctggcttgatccggccctgctcactggccatggggtgacgccacaggatgttgaggaggcgatccgggcccagaatatagaggtgccgggtggtcgtctggaaagcagtacccgcgagtttactgtcctctccgataccagtctcaactcaacggaagagtttgaaaatattatcgttcgcaagtcgggtacaaccttagtccggttaaaagatattggtcgggccgagatcggtccccaatcggtgcgatcgagtctgcgttataacggggcccaggcagttgcccttggtctggtcaaacagtcggttgccaatccacttgatatctccattgccctccataagatgctgccagaactgaaggcatcactgccagaggggatgaaaactaaaatcgtctacgactcttccatttttattgagcgctccattgaaaacgtttttagctccatctttgaggcggttgccctggtgctgttgattatctttatctttctgcgttctgttcgttccaccctgattcctctggtcactattccggtctctctaatcggctcctttgtcctgatgtgggcctttggcttttccattaataccctgaccctattggcaatggttttggcggttggactggtggtcgatgatgctattgttgtcctggaaaatgttcaccgccatgttgaaaaaggcctcaaaccagccgaagctgccattaagggaatgcgggagatcggttttgccgtcgtcttaatgaccatgaccctggccgctgtttttgttccggtggcaatgatggagggaaggaccggtaagctcttcaccgaatttgccctgactctggccggtgcggtaattgtctccggcttcgtggctctgactctgaccccaatgatgtgtgcaaaaatgctccgtcatcaggacaagcatatgaagatcttcaccattatggagaatattttcatcgcaatcgagcaaggctataaaagggttcttgcctggtccttgaaaaccgtcatatttggattgaccattgccgttttagccggagccggttcctactatctgttgcagcaactcccttcagagatgtcgccactggaggacagaggggtctttatgacctttgccattgctcccgacggcgccaatttgaaatattcggatcactatctgcgccaaactgaaaaattgctccagccaattccggaaagtaatggtgttttttccgtggcaggaatgggtggtaaggtgaccgaggcaatttcctttgttcagttgaaagactgggctgaccgccaacgttcttcgctacagatcgcaggagaactggcgcccagcctattcggaatccccggagtcctctgctttcccatcacaccgccttctcttggtcagccatttatggatcagccggtccagtttgttattaagaccagcgagagctatgtggaattaaataagcaaatcaatcagctgatggctgaagtacgtaaaaatccaaaaattattgccgccagaaccgacctgaagctcaactcgcccgaactgcgcctgcagattgatcgtgataaggctgccgatttaggcgttaatattgccgtcattggccggaccattgaaaccatgatgggtggacgggaggtaacccgttttaaaatggacggagaacagtacgacgttattgttaaaattgaggataaactgcgggtagtcccggaggatcttaaccagattcatgtgcggagcgccagtgggataatgattccgctagccaatctggtaagcattgaagaaggtgttaccgcccagtcacttaatcactttaaccgcagtcgggcagcggtgctgagtgccaatctggcccccggttattcgcagggtgaagccttggcttttctatctgatgcagcaaagcgaattttgcctaaaaccgcccgaattgattataaggggcagtcacgtgaatttatggagagcaactccggtctgattatgacctttgccctggccctgatcatgatttatctgatgatggccgcccaattcgaatcatttgttgatcccctgatcatcctctttaccgtacctctctccatggttggtgccctattggccctttactgtacaggtaatagtctcagcatctatagtcaggtggggctgattaccctggttgggctcattactaaacatggtatcctcatcgtcgagtttgccaaccagcttcaggaacagggaaagagtaagctggaggcggtactcgaagcagccaccctccgtcttcgcccgattctgatgaccaccggagccatggtgctgggcagtgtaccgctggctctagccagtggagcaggggccgaaagtcgttcacagatcggctgggttatcgtcggcggtttaacactcggaaccgcccttaccctcttcgttgtgccatcggtctatatgttactggccaaaaagcgacaaccactagagcccgaggctgaaaaatag

SEQ ID NO: 74425 - protein, 1017 aa, Desulfotalea psychrophila LSv54
MKISEISVRRPVLATVMSLLIVLIGLVAYDRLTVREYPNIDEPTVSVVTVYQGASPEIIETEITTIIEDSLSGIEGIKTISSESLQERSQISIVFKMERNADDAAAEVRDRVGRVRADLPLDVEEPVIAKVEADADPILYMAFSSDKHSNEEITDYVDRYVTDQIEMIDGVAEAQVLGARKYSMRIWLDPALLTGHGVTPQDVEEAIRAQNIEVPGGRLESSTREFTVLSDTSLNSTEEFENIIVRKSGTTLVRLKDIGRAEIGPQSVRSSLRYNGAQAVALGLVKQSVANPLDISIALHKMLPELKASLPEGMKTKIVYDSSIFIERSIENVFSSIFEAVALVLLIIFIFLRSVRSTLIPLVTIPVSLIGSFVLMWAFGFSINTLTLLAMVLAVGLVVDDAIVVLENVHRHVEKGLKPAEAAIKGMREIGFAVVLMTMTLAAVFVPVAMMEGRTGKLFTEFALTLAGAVIVSGFVALTLTPMMCAKMLRHQDKHMKIFTIMENIFIAIEQGYKRVLAWSLKTVIFGLTIAVLAGAGSYYLLQQLPSEMSPLEDRGVFMTFAIAPDGANLKYSDHYLRQTEKLLQPIPESNGVFSVAGMGGKVTEAISFVQLKDWADRQRSSLQIAGELAPSLFGIPGVLCFPITPPSLGQPFMDQPVQFVIKTSESYVELNKQINQLMAEVRKNPKIIAARTDLKLNSPELRLQIDRDKAADLGVNIAVIGRTIETMMGGREVTRFKMDGEQYDVIVKIEDKLRVVPEDLNQIHVRSASGIMIPLANLVSIEEGVTAQSLNHFNRSRAAVLSANLAPGYSQGEALAFLSDAAKRILPKTARIDYKGQSREFMESNSGLIMTFALALIMIYLMMAAQFESFVDPLIILFTVPLSMVGALLALYCTGNSLSIYSQVGLITLVGLITKHGILIVEFANQLQEQGKSKLEAVLEAATLRLRPILMTTGAMVLGSVPLALASGAGAESRSQIGWVIVGGLTLGTALTLFVVPSVYMLLAKKRQPLEPEAEK

SEQ ID NO: 74426 - DNA, 3084 bp, Mannheimia succiniciproducens MBEL55E
  CDS (1)..(3084): transl_table=11
atgaaatttacagatatttttattaaacgtcctgttatggcgatagctatcagtatgttaatcgtaattctcggtttgcaggctatctctaaattggcagtacgtgagtacccgaaaatgacgacgacggtaattaccgtcagtacgacatacgcaggggcggatgccggattgattcaggcattcgtaacctctaaattggaagaggccattgcgcaggcggataatatcgattatttgtcttctaccagcgcaccgagttcttctaccattacggttaaaatgaaactgaatacggatccggcttcagctttggcggacgtattatccaaagttcaatccgtacgttcggaattaccgagcggtatcgaagacccgaccttaacttcttcaaccggtggttcggggattatgtatatcagtttccgttccgataaactgcacccgagccaagtaaccgactacattgagcgtgtggttaaaccgcagttgttcaccgttgaaggcgtggccaaagttcaggtttacggcgcggcggaatatgcaatgcgtatttggttggatccgcaaaagcttgccggtcaaaacctttcagcaacacaagtaacgactgcgttatcgaataacaacgtgcaaacggcggcgggtagtgataaaggttatttcaatatttatcgtaataaagtggaaaccactactaataccgtggaagatttaggcaatcttattgtttattccgatggtgataaattagtccgtttacgtgatgtagctgatgttgaattgaataaagaaagcgatgacacccgtgccgcggcaaacggttcggatgccgtcgtattaagtatcgaaccgacttcaagcgccaacccgctgactgttgcggataatattaaaccgctttatgaaactattaagaaaaatttaccggacagtattgaatccaacattctttatgaccgtacggttgctattaacagctcaattaacgacgtaatccataccattattgaagcggtagtgattgtattggtagtaatcatgatgtttattggttcattgcgtgcgatttttattccgattgtgacaattcctatttcattaatcggggtaattttcatgctgcaaatgtttgatttctccattaacctgatgaccctgctggcattgatcctcgctatcgggctggtggtggacgatgctatcgtggtgcttgaaaacgttgaccgtcatattaaagaaggggaaaccccgttccgcgctgcgattatcggtacccgtgaaattgcggtacccgtaatttccatgaccatcgctttggtggcggtatattcaccaatggcgttaatggggggaatcaccgggacgttatttaaagagttcgctttaacccttgccggtgcggtatttatttcagggattatcgcgttaacgctttccccgatgatgtcggctaaaattctgaaacatgaaagttcgaaatttgaggaaaaagttaaccgcactttaagtaagttaactaccggctatacctatattcttggtttggttatgcaggcgcgtaaagcaattttgctgtttgccgttattatttttgctaccttgccgatattattttcctccttatccagcgagttaacaccggccgaagataaaggcggtttcttaggtatggtaaccgcaccgtccaacgtgaacgtggactatgtccaacaggcgactaaaccttatgaagaaattctgaacaatacgcctgaaaaacaatattcacaggttattgctggtgcgccgaatactaatcaggcgttggtaattactaccttgaaagactgggcggaacgtagccgtagccaagcggaagtcatggcggaattaacgaaaaaagccgctgccattccggaagtttctatttcagccttcgctttcccggaaattgaaaccggggaacaagggccgcctgtcgtatttgtactaagttctcctggcagcacgaaggaattagcacaaaccgcggaaacatttttggataaaatccgtaaatcgggcaaatttgtctattcaaatttaactctgaaatacgatgtagcgcaaatgcgtatccaagtagataaagaaaaagccgggacttacggtattactatgcaacaaatagcaagcaccctaggcagttacttgtctgaagccactattacccgggtggatattgacggccgtgcttataaagttatttcgcaggtaaaacgtgagaaccgtttatcgccggaaagtctgaaaaattactatatcagcgcaagtaacggacaaagcgttccgttaagtagtctgcttacggttgaacttgaaccgcaaccttactcattaccgcgtttcagccagttaaactctgctgaaattcaattggtgccgtcgccgaccaccacaaccggtgatgcgattgcctggttgaaagatgcggcacaggatttaccgcaaggttattcttacgactggaaaggtgaggcgcgtcagttggtacaggaagggaactcactggcaaccacctttattttagcggtgttgattatcttcttagtgttggcgattcagtttgaatcaattcgtgatccgtttgttattttggtttccgtaccattggctatttccggagctttattaacgctgaatttacttagcttcttaggtgtaacaggagtaactcttaacatctattccgaagtcgggttgattactctggtcggtttgattactaaacacggtattttaatgtgtgaagtggcaaaagaagagcaattaaatcacggtaaaactaaaatggaagcaattatgacggcggcgcaattacgtttacgcccaatcttaatgaccacggcagcgatgattgccggtcttattccattgctttatgcctccggcgccggtgcggtaatgcgctttagtatgggcgttgtagttgtagctggtcttgctataggtacattatttaccttattcgtattacctgttatttatacctacatcggttcgaatcacaagccgttaccggaatttgatgagaacgcaccgagaatcggttcaagccattaa

SEQ ID NO: 74427 - protein, 1027 aa, Mannheimia succiniciproducens MBEL55E
MKFTDIFIKRPVMAIAISMLIVILGLQAISKLAVREYPKMTTTVITVSTTYAGADAGLIQAFVTSKLEEAIAQADNIDYLSSTSAPSSSTITVKMKLNTDPASALADVLSKVQSVRSELPSGIEDPTLTSSTGGSGIMYISFRSDKLHPSQVTDYIERVVKPQLFTVEGVAKVQVYGAAEYAMRIWLDPQKLAGQNLSATQVTTALSNNNVQTAAGSDKGYFNIYRNKVETTTNTVEDLGNLIVYSDGDKLVRLRDVADVELNKESDDTRAAANGSDAVVLSIEPTSSANPLTVADNIKPLYETIKKNLPDSIESNILYDRTVAINSSINDVIHTIIEAVVIVLVVIMMFIGSLRAIFIPIVTIPISLIGVIFMLQMFDFSINLMTLLALILAIGLVVDDAIVVLENVDRHIKEGETPFRAAIIGTREIAVPVISMTIALVAVYSPMALMGGITGTLFKEFALTLAGAVFISGIIALTLSPMMSAKILKHESSKFEEKVNRTLSKLTTGYTYILGLVMQARKAILLFAVIIFATLPILFSSLSSELTPAEDKGGFLGMVTAPSNVNVDYVQQATKPYEEILNNTPEKQYSQVIAGAPNTNQALVITTLKDWAERSRSQAEVMAELTKKAAAIPEVSISAFAFPEIETGEQGPPVVFVLSSPGSTKELAQTAETFLDKIRKSGKFVYSNLTLKYDVAQMRIQVDKEKAGTYGITMQQIASTLGSYLSEATITRVDIDGRAYKVISQVKRENRLSPESLKNYYISASNGQSVPLSSLLTVELEPQPYSLPRFSQLNSAEIQLVPSPTTTTGDAIAWLKDAAQDLPQGYSYDWKGEARQLVQEGNSLATTFILAVLIIFLVLAIQFESIRDPFVILVSVPLAISGALLTLNLLSFLGVTGVTLNIYSEVGLITLVGLITKHGILMCEVAKEEQLNHGKTKMEAIMTAAQLRLRPILMTTAAMIAGLIPLLYASGAGAVMRFSMGVVVVAGLAIGTLFTLFVLPVIYTYIGSNHKPLPEFDENAPRIGSSH

SEQ ID NO: 74428 - DNA, 3048 bp, Legionella pneumophila subsp. pneumophila str. Philadelphia 1
  CDS (1)..(3048): transl_table=11
atgaaattcacagatctattcatcaagcgcccggtactctccatagtggtcagtatgttgatttttctattcgggataaactccatctataaaatgcaaattcgccaataccctaaaatggagaatacagtcataaccataatgaccggttatcctggcgctgatgctgaactcatagcaggatttatcactactcctcttgaaagtgctgttgccagtgctgaaggaatagattatatgacttcatccagtcagcaaggccttagcacaattaccttaaacatcaagttgaatttcgaccctcaaattgcttttactgatgtcatgagtaaagtgcagcaaacactcaatcagttacctaaagagtcacaacaaccggttatcttgaaaaaatcagactcatcaaccgcattgatgtacattagtctcgacagtaaggatatgacccctcagcaaatcactgactatgctacccgagtcgttcaaccccagttgcaaacagtggatggagtagccaaggctgatattttaggtggtcaaacttattccatgcgaatattcatgaatccaattaaaatggctgcgcttaacgtcactccggctgatgtgtcagctgttttggccagtaacaacttccttactgcagccggaagcactaaaagtgaatacgttgccatcaatgtcacggctaaaaccgatttgaataatgttgaggaattcgaaagactgatcgtaaaaagcgataaggggtcaataatcagactcagggatatcgctaaagtggaactgggttcacaaaattatgatagctcagtgactttcaacagtaaaaaagccgtctttatatcgatcactccaacaccaactgctaaccccctcacagtaattaatgatgctagaaaactgtttccttcaatagtaagggaattcccgccatcattaactggcacaatagtatacgatgccacagcattcattcgggcatctatccatgaggtaatggaaactatcattgaagccgcagtcatcgtgattatcgttatctttttatttttaggctctgttcgttcagttcttattcccgttgtcactattccgctgtcattggttggtgtctgtactttgatgctcatactgggttacagcatcaacttgcttacccttcttgcctttgtgttagcaataggattggtagtggatgatgccattgtagtggtagaaaatgtacatcgccatttggaagaaggaaaaaccccctttgaatccgcaattataggcgccagagaaattgctaccccggttattgcgatgacaatcaccctggcagctgtttatgcaccaatagggtttatgagtggactgactggcgctttgttcaaggaatttgcttttacactggcaagtgcggttattatttcaggggttattgccttaacgctgtcccccatgatgtgttcaaaaattctatccgaagaagccactagtggaaaatttgctatttttctggatgagttttttaacaaactgaaacgcgtttaccagaatgcacttcatagcttattggatacccgagaaatgatgttgctgttagcaggggtagtgattttaatgttgccctatttgtattctaacacggctgctgaaactgcgcctgatgaagatcaaggcttcttttttgtaatggctactgctccacaatatgcaaccttagactacatagaagcctatacaaagccctttgatgccatttataaaagttttcctgaaacagaaaactattttacggttaacatgagccaacctatttcaggaatggtattgaaaccatgggatcaaaggaaaaaaagtcagtttgctctaaaacaacctttacaaaacaagttatccaaaattgctggacttaatgctttcgctattgtcccccctcccctgccaggcggcggtggcggtcctgccgtacaatttgtggttaagacaacgaatgatttccagagcttaatggatgtgtcgaataagttaactgaaaaagccaggaatagcgggttattcatttacatagacaattcccttaaatttaaccaaccacaagtggagtttagcatcaatcgagcaaaagcttccgaaatgggcttggatatgagagcgcttggaagcagcctgacaagtgctctatccggcaactacatcaattacttcaatctggaaggtcgaagctaccaggtaatcccacaactggcgcgcaaattccgtcttactatagaacaattaggccaaatttatgttaaaacgctaaacgggactatggttccattatccactgtgataaccccaaccgaaaaaactcaacctaatgcagctacccattttcaacaactcaattctgcaacgattcaggctgtgatgatgccaggtaaaacattaggccaaggtttggagtttttacaaaaagcagcccaggaagtcttgcccaagggatttacttatgattatggaggagaatccaggcaatttatgcaagaaggaagtgctctcatctttgcattcctttttgctattgttgttatctttttagtgctggcagcgcagtatgagagttttcgggatccattaatcgttctcatcagcgtacccatgtccatctgtggcgcgcttatcccgcttaaccttggagtagcgactattaatatctacactcaagtgggtttgattactttaattgggctcatcagtaaacatggaatattgatagtggatttcgctaatcatttgcaacgtgaaaaaaatcttgataaacgtgctgctgttgaggaatctgctggaattagattacgacccatattaatgactacagctgccatggtgtttggagtaatacctcttcttattgccagcggtgctggagcagcaagtcgattcgacataggactcgttatctccacaggtttattaataggtacctgtttcacactgttcgtagtacctactttatatacctacttagctgaagatcatcgacataagccaaacgaacctgcggagatccaataa

SEQ ID NO: 74429 - protein, 1015 aa, Legionella pneumophila subsp. pneumophila str. Philadelphia 1
MKFTDLFIKRPVLSIVVSMLIFLFGINSIYKMQIRQYPKMENTVITIMTGYPGADAELIAGFITTPLESAVASAEGIDYMTSSSQQGLSTITLNIKLNFDPQIAFTDVMSKVQQTLNQLPKESQQPVILKKSDSSTALMYISLDSKDMTPQQITDYATRVVQPQLQTVDGVAKADILGGQTYSMRIFMNPIKMAALNVTPADVSAVLASNNFLTAAGSTKSEYVAINVTAKTDLNNVEEFERLIVKSDKGSIIRLRDIAKVELGSQNYDSSVTFNSKKAVFISITPTPTANPLTVINDARKLFPSIVREFPPSLTGTIVYDATAFIRASIHEVMETIIEAAVIVIIVIFLFLGSVRSVLIPVVTIPLSLVGVCTLMLILGYSINLLTLLAFVLAIGLVVDDAIVVVENVHRHLEEGKTPFESAIIGAREIATPVIAMTITLAAVYAPIGFMSGLTGALFKEFAFTLASAVIISGVIALTLSPMMCSKILSEEATSGKFAIFLDEFFNKLKRVYQNALHSLLDTREMMLLLAGVVILMLPYLYSNTAAETAPDEDQGFFFVMATAPQYATLDYIEAYTKPFDAIYKSFPETENYFTVNMSQPISGMVLKPWDQRKKSQFALKQPLQNKLSKIAGLNAFAIVPPPLPGGGGGPAVQFVVKTTNDFQSLMDVSNKLTEKARNSGLFIYIDNSLKFNQPQVEFSINRAKASEMGLDMRALGSSLTSALSGNYINYFNLEGRSYQVIPQLARKFRLTIEQLGQIYVKTLNGTMVPLSTVITPTEKTQPNAATHFQQLNSATIQAVMMPGKTLGQGLEFLQKAAQEVLPKGFTYDYGGESRQFMQEGSALIFAFLFAIVVIFLVLAAQYESFRDPLIVLISVPMSICGALIPLNLGVATINIYTQVGLITLIGLISKHGILIVDFANHLQREKNLDKRAAVEESAGIRLRPILMTTAAMVFGVIPLLIASGAGAASRFDIGLVISTGLLIGTCFTLFVVPTLYTYLAEDHRHKPNEPAEIQ

SEQ ID NO: 74430 - DNA, 3156 bp, Legionella pneumophila subsp. pneumophila str. Philadelphia 1
  CDS (1)..(3156): transl_table=11
atgaaaatagctcttttctttattgatagaccagtatttgcaacagtgatctccatcatcattgttatggtgggggtattgtcctatttcaacttaccagtagaacaatacccacaagtagttcctcctacgattcaggtatacgcctcttatcctggagccaatgcaaaaacagtagctgaaactgttgcaacaccgattgaacaggaagttaatggtgtggaaaacatgttgtatatggattcccaatccactgatgatggacaaatgcgtctgactattacttttaagcttggaacagatctggatcaggcgcaggtgctggtgcaaaacagggtggcagttgtggaacccaaattacctgaagaagtccgccgcttaggaatcactactaacaaaaattcacctgatttgatgttggtagtgaatatgtactcccctaatggtcaatatgatcaaacctacatcggaaattacgctatcttgcatatacgcgataaaatcagacgaattgaaggtgtaggcaatgtactcgtatttggggccagtgaatatgccatgcgtctttggctgaatcccgatttaatgaatacttttaatttaacggcaaatgatgttttagcagctgttcgtgctcaaaacgtgcaagtcgccagcggcaagcttaatttgcagccacagaaaaaacaatacggtttcgagtaccatattgaaaccaaaggacgcctggttaaaaaagaagaatttgagaatattattgtcaaatcaggtgaaagcgggcgtatcgttcgcctgaaagacattggtcgcgtcgagttaggtacgcaaaattacctgacgaaaggttatttagataaataccctgctgttgcattacctatttatcaacgcccaggaaccaatgcattagccactgcacaagaaatcattaaaaccatgaaaacaattgccaaggatttcccgccgggcattacctatgacatggcctataatcctactctatttgttcaacagtcgatcgatgcggtatttcataccatttatgaagcgattgctctggttgtactcgtcattttgatttttctacaaacatggagagcctctgccattccagtagtagctattcctgtatcattgataggaacttttgccgtgatgcaggctattggattttcgttgaattacttgaccttgtttggacttgttcttgctattggtattgtggttgatgatgccattgtcgttgtcgaaaatatggagcgtaatatccaggcaggcatgaatccccgcgatgccgccagaaaaaccatgacagaggtaggatcagcattggttgctatgggtttggtgttgattgccgtctttttacctaccgtttttctggaaggaatttccgggcgtttttatcaacaattcggtacaacgcttgctgtcgcaactgccatttctgtttttgtctcgttaaccctgactccaaccatggcggtattattgcttcgtgctcatcacggaactataaaacaagaagggttagcctggtggaaaaaaccaatatatggatttttgcatggatttaaccgactaatggaaggattttcccggcaatatgggaaattggttgctaccctcacacgtaaaacggctttaatgattattgcttatggtatttttatttccatcacactacttctatttgtctacgtaccacgcggctttatcccgagacaagaccaaggttattttatcgttgcagttcaattgccgcctggagcctctttgagccgtaccgatgctgtcatcaacaaagcagtcaacaaaatattggcgattcctggtattgcccataccgttagttttaccggcttttctggcgctacatttactaattcatcgaatgccggagcaatttttacccccctattgtcatttcaagaaaggcaacgtatggggataaattataacgatattcttaagcgtctaaggcaggaattaagtaccatcaaggaagccctcatcgtggttatccctcctcccccagttcgaggtattggaaatgcaggtggttttaaaatgatgcttcaagacaggggtggtcgaggtcttgatgtattaatggaagcggcagcaacaatggttaatgcagcgaatcaggaaaaagccaccacatcagtatttactttttttgaaaattcaacaccacgacttcacttgaaacttgacagagaaaaggtggaacggcttaacgtgccttacgccaatgtcgtggaagcactggaagtttaccttggctctgtttttattaacgaattcaattacctgggacgtacttttcgtgttattgcgcaagctgattcagaatatcggcatactgaagatgatattttacgaatcaaagtcaaaagcaacagtggagacatggttcctataggatcagttgcgcaaatagaaaatacggttgctccctcgcgtatgcctcgtttcaatctgtatcccgctattgatttgcagggtgatgttgctcccggatacagttctgatgaagcactggtgactatggaaaaactggctcagaacaatcttccagacgggattggttatgagtggacagaaatagcctatcaacagaaaatggtaggtaatactgctttgatggcttttactctgggtgttattttcattttccttgtccttgccgctcaatatgaaagctggtctttacctttagccgtcatattaattgtaccgatgtgtctcttttcttccatgctgggagttaaaattctcgggatggaaaataatattatgactcaaattggttttctggttttgattggacttgcatcgaaaaatgccatcctcattgtggaatttgcgagacaacttgaaaatcggggctataacctctggaaagccgccattcaggcagcaaaacttcgtctgcgcccgattttgatgacctcatttgcatttattctcggtgtttttcccttgattatctcaacaggcgcaggcgctgaaatgcgccgagcgctcggtgtcgctgtattcagcgggatgttgggagtgactttttttggtctggtctttacgcctttattttatgttttaattagtcgcttgagtagatataaaaggaaattaaaagaccttaactaa

SEQ ID NO: 74431 - protein, 1051 aa, Legionella pneumophila subsp. pneumophila str. Philadelphia 1
MKIALFFIDRPVFATVISIIIVMVGVLSYFNLPVEQYPQVVPPTIQVYASYPGANAKTVAETVATPIEQEVNGVENMLYMDSQSTDDGQMRLTITFKLGTDLDQAQVLVQNRVAVVEPKLPEEVRRLGITTNKNSPDLMLVVNMYSPNGQYDQTYIGNYAILHIRDKIRRIEGVGNVLVFGASEYAMRLWLNPDLMNTFNLTANDVLAAVRAQNVQVASGKLNLQPQKKQYGFEYHIETKGRLVKKEEFENIIVKSGESGRIVRLKDIGRVELGTQNYLTKGYLDKYPAVALPIYQRPGTNALATAQEIIKTMKTIAKDFPPGITYDMAYNPTLFVQQSIDAVFHTIYEAIALVVLVILIFLQTWRASAIPVVAIPVSLIGTFAVMQAIGFSLNYLTLFGLVLAIGIVVDDAIVVVENMERNIQAGMNPRDAARKTMTEVGSALVAMGLVLIAVFLPTVFLEGISGRFYQQFGTTLAVATAISVFVSLTLTPTMAVLLLRAHHGTIKQEGLAWWKKPIYGFLHGFNRLMEGFSRQYGKLVATLTRKTALMIIAYGIFISITLLLFVYVPRGFIPRQDQGYFIVAVQLPPGASLSRTDAVINKAVNKILAIPGIAHTVSFTGFSGATFTNSSNAGAIFTPLLSFQERQRMGINYNDILKRLRQELSTIKEALIVVIPPPPVRGIGNAGGFKMMLQDRGGRGLDVLMEAAATMVNAANQEKATTSVFTFFENSTPRLHLKLDREKVERLNVPYANVVEALEVYLGSVFINEFNYLGRTFRVIAQADSEYRHTEDDILRIKVKSNSGDMVPIGSVAQIENTVAPSRMPRFNLYPAIDLQGDVAPGYSSDEALVTMEKLAQNNLPDGIGYEWTEIAYQQKMVGNTALMAFTLGVIFIFLVLAAQYESWSLPLAVILIVPMCLFSSMLGVKILGMENNIMTQIGFLVLIGLASKNAILIVEFARQLENRGYNLWKAAIQAAKLRLRPILMTSFAFILGVFPLIISTGAGAEMRRALGVAVFSGMLGVTFFGLVFTPLFYVLISRLSRYKRKLKDLN

SEQ ID NO: 74432 - DNA, 3153 bp, Legionella pneumophila subsp. pneumophila str. Philadelphia 1
  CDS (1)..(3153): transl_table=11
atgatttccaaattttttattgaaagacccgttctggccaatgtcattgccttgtttattgtatttatagggataatagcgattgctgttttgcctgtgtctcaataccctgccattgttcctcctactatccaggttactacgacctatcctggcgctgatgcaaaaactttgattaataccgtcgctttgccaattgagcaacaagtcaatggggttgaggacatgctgtacatgcaatcgacaagtactagtggaggcacctatactttaattgtcacgtttgctataggcacggatctgaactatgcgcaggttctggtgcaaaatcgagtacaagcggcgatggctcaactccccgaatcagtacaaaagcaaggtgttatcgttcaacaaaaatcgactgctattcttcaatttattactttgacttcaaaaaataatgaatacgacggcgtatttcttgacagctatgcgaccatcaatatgcaagatgaattatcccgtttacccggagtagggaatgtggtggtttttggttcaggaagttatgcgatgcgtgtttggctcgatcctaaaaagatgcttgctttttctttgaacccaagtgatgttttaaatgccatcagctaccaaaacaaagaggtatcagctggacaactgggtgctcctcctactgttggcaaacaagcctatcaatttacagtgaatgtgcctggacaactctctgatcccaaagagtttgaaaacattattattaaaacgattgataccccacccgatcaaaattcctctgccagtagctctgctcaggtagtacgtattcgtgatgtagggcgagttgagttgggatccgagagctataatcagctcgctaatcttaatggtaaacctacagcagcaataggtatctttcaacttcctggtgccaatgcgttggatgttgcgcaagaagttcggaaagccgtggcgaaaatggcaaaacagtttcctccgggtcttgaatattctattccatttgataccaccgttttcgtcaaagcttcaattgaagaagtatataaaacactttttgaagcaggaattttggttttaatagtgattgttgtatttttacaaaattttcgcgcttcattagtacccgcgacaacggttcctgtgactatcattgggacattttttgccatgcttttattgggctatagcattaatttgctgactttatttgctttggtattagcaattggaattgtggttgatgatgccattgttattgttgagggtgtgactcaacatattgaaaaaggcttgtcacctaaagaatcagccatacttgcaatgaaagaattatttggcccgattattggtatcactttggtattaatggctgtttttgtaccggccggttttatgcctgggttaacggggtcaatgtatgcacagtttgctttagttattgctgcaactgcctttataagcgcaattaatgccatgacgttaaagccgactcaatgtgctttatggttaaaggctcccgatacgagtaaaccaaagaatatattctttcaggcctttgatcgaatttataatcccattgaatcggcttacgtaaagtttattgatcggcttgtacatcgtagtggtaaagtttgtttgattggaatcattttagtggcttgtgccatttatggcctgacgcgtattccaactggctttattcccatggaagatcaaggctatttgatgttaagtattcagctgccggatggcgccagtttaggacgtactgatgaagtagtgagtagattagctaaaaaagcatctgaagttgggggtgtagataatgtgattgctattgatggtatttcattattggataacaattctctgctttctaatgccggtgtcatctatgttatattcaaagattggagtgtcagaggaaaatctgaaaatttacgagctctttataccaaattcaatgcaatagccaaagaaacccttgatgcaaaagtgttggtggttgtgccccctcccattcaaggtttagggatgtcggggggatttcaaatgcaagttgaattacaagacggtacttttgattacaggaaattacagcaagctactgatcaaatgatcaatacagggcgtcaatacccacagttgcaaaaccttatgacgacatttcgtgcgagtgttcctcaagttgcagcacctattaacagaaccaaagccgaatctttaggagtgcgcgttgctgatgcctttgatactttacaaacttatttaggttcttcttatgtcaatctgttcacgaaatttggtcaagtatttccagtctatgttcaggcggatgcatcctcgagggttagcagcgaagatttaaggaattactatgtaagaaatcaatccggctccatggtgcccttaggtactcttacagacgtggggcctgcggtaggaccctcaattatttctttatataacctttatccatcaagtaacataaatggggttgccgcaagaggctatagctcggggcagggaatccaggttatggagaaattggcaaaggaacaattacccccagggatatcttatgaatggacaagtacagcttaccaggaaaaggtggctggtaacctcagttactttatttttgccttgtctttggttttggtttatttaattttatctggccagtatgaaaattggcttattccatctgcgattatcctgagtgttcctttgactttggttggaacagtattagctctcggcagtttgggtatggataataatatgtacactcaaattggcttgttacttcttattgcattggctacaaaaaatgctattttgattgttgaggtagcgcgtgaacaacgtgaaattcataataaatcagttcttgaggcagcggtcattggcgccaaaacacgttttcgtcctattctgatgacatcttttgcatttatcatgggggttatgcccttggtttttgcaacgggagcaggtgccaattctcgtcgctcaattggtatagcggtgagcagtggtatgcttgcctcaacttgccttgcagttgtttttgtgcctgttttttatgtattgttgcaaacctggcaggacaagaggaaggcaaaacattaa

SEQ ID NO: 74433 - protein, 1050 aa, Legionella pneumophila subsp. pneumophila str. Philadelphia 1
MISKFFIERPVLANVIALFIVFIGIIAIAVLPVSQYPAIVPPTIQVTTTYPGADAKTLINTVALPIEQQVNGVEDMLYMQSTSTSGGTYTLIVTFAIGTDLNYAQVLVQNRVQAAMAQLPESVQKQGVIVQQKSTAILQFITLTSKNNEYDGVFLDSYATINMQDELSRLPGVGNVVVFGSGSYAMRVWLDPKKMLAFSLNPSDVLNAISYQNKEVSAGQLGAPPTVGKQAYQFTVNVPGQLSDPKEFENIIIKTIDTPPDQNSSASSSAQVVRIRDVGRVELGSESYNQLANLNGKPTAAIGIFQLPGANALDVAQEVRKAVAKMAKQFPPGLEYSIPFDTTVFVKASIEEVYKTLFEAGILVLIVIVVFLQNFRASLVPATTVPVTIIGTFFAMLLLGYSINLLTLFALVLAIGIVVDDAIVIVEGVTQHIEKGLSPKESAILAMKELFGPIIGITLVLMAVFVPAGFMPGLTGSMYAQFALVIAATAFISAINAMTLKPTQCALWLKAPDTSKPKNIFFQAFDRIYNPIESAYVKFIDRLVHRSGKVCLIGIILVACAIYGLTRIPTGFIPMEDQGYLMLSIQLPDGASLGRTDEVVSRLAKKASEVGGVDNVIAIDGISLLDNNSLLSNAGVIYVIFKDWSVRGKSENLRALYTKFNAIAKETLDAKVLVVVPPPIQGLGMSGGFQMQVELQDGTFDYRKLQQATDQMINTGRQYPQLQNLMTTFRASVPQVAAPINRTKAESLGVRVADAFDTLQTYLGSSYVNLFTKFGQVFPVYVQADASSRVSSEDLRNYYVRNQSGSMVPLGTLTDVGPAVGPSIISLYNLYPSSNINGVAARGYSSGQGIQVMEKLAKEQLPPGISYEWTSTAYQEKVAGNLSYFIFALSLVLVYLILSGQYENWLIPSAIILSVPLTLVGTVLALGSLGMDNNMYTQIGLLLLIALATKNAILIVEVAREQREIHNKSVLEAAVIGAKTRFRPILMTSFAFIMGVMPLVFATGAGANSRRSIGIAVSSGMLASTCLAVVFVPVFYVLLQTWQDKRKAKH

SEQ ID NO: 74434 - DNA, 3036 bp, Bacteroides fragilis YCH46
  CDS (1)..(3036): transl_table=11
atgaatatatccgaattaagtatacgacggccggtactctcaacggtactgaccatcatcattttgctctttggactgatcgggtacaactacctgggtgtccgggagtatccatccgtagataaccctattatttcggtgtcctgctcctatccgggtgcaaatgccgatgtcatcgagaatcagatcaccgaacccctggaacagaacatcaatggtattccgggcatccgctcactctccagtgtcagtcagcagggacaaagccgtatcacggtagagtttgagctttccgtcgacctggaaacagctgccaatgacgtgcgtgacaaggtatcacgcgcccaacgttatctcccgcgcgactgtgaccctcctaccgtatcgaaagccgacgccgatgccacccctatccttatggtggctttgcaaagcgacaaacgttctttgctggaactcagtgaaattgccgacctgactgtaaaagaacagttgcaaacgatctctgacgtaagtagtgtctccatttggggagagaaacgatactccatgcgtttatggctcgaccccatcaagatgtccggttacgggatcactcccatcgatgtgaagaatgcggtagacaaagagaacgtggaactcccttcaggtagtatcgaaggaaatacaacagaacttaccatccgtactttgggactgatgcacactgcagaagagttcaacaacctgatcgtcaaagaagagaacgaccgcatcatccgtttcagtgatatcggacgagccgaactgggccctgccgacatcaaaagctacatgaagatgaatggtgtacccatggtgggaatcgttgtaatcccccagccgggtgccaaccatataaagatagccgatgcggtatatgaacgcatggagaagatgcagaaggacctcccggaagacgtgaagtattcttacggattcgataacaccaaattcatccgtgcctctatcagcgaagtgaaagaaaccgtttacgtagctttcatcctggttatcattattatcttcctttttctgcgcgactggcgtgttacgctggttccctgcatcgtgattccggtatcgttgatcggtgctttcttcgttatgtatctggcggacttctccatcaacgtgctctccatgctggctgttgtgctggcagtgggtctggtggtggacgacgctatcgtaatgacggaaaacatctatgtccgcattgagaaaggtatgcctccgaaagaggccggcatcgaaggggctaaagagattttcttcgctgtcatctctaccaccattacgctggttgccgtattcttccccatcgtctttatggaggggatgacaggacgactgttccgtgaatttagtattgttatttccggttcggttatcatctcctcttttgcggctctgacctttactccgatgctagccaccaagttactggtaaaacgggagaaacagaactggttctatctgaaaacagaacctttcttcgaaggaatgaaccgcctctacagtcgttcactggctgttttcctccataaacgttggattgccctgccttttgtagcaattaccattggcatcattgccttcttgtggaattacatcccggcagaaatggctccgttggaagaccgttcacaaatcagtatcaatacccgtggagccgaaggtgtgacctatgaatacatccgggactatacggaagacatcaatgacctcgtagactcgattgtaccggatgccgaatcggtaaccgcccgtgtatcgagtggtagcggtaatgtgcgcatcacgctgaaagacatgaaagaccgtgactacacccagatggatgtggctgaaaaactgtcggcagcagtacaaaaaaagacgatggcgcgttcattcgtccagcagtcatcttcttttggcggacggcgtggcggtatgcccgtccaatacgtattgcaggccactaatatcgaaaagctacaggaagtactgcccaagttcatggcgaaggtttacgagaacccggtattccagatggcagacgtagacctgaagttcagcaagccggaggcacgtatcaatatcaatcgcgacaaagccagcatcatgggggtaagtacacgtaacatcgcacagaccctgcaatacggtctgagcggacagcgaatgggctacttctatatgaacggcaagcaatatgagatcttaggagaaatcaaccgccagcaacgtaacacacctgccaatctgaaatcgatctacattcgtagtgacaaaggagatatggtgcaattggacaacctgattgaactgaccggtggcatcgcgcctccgaaactgtatcgttacaatcgtttcgtttcggccactgtttccgccggattggccgaaggaaaaaccatcggacaaggattggacgaaatggacaagatagccaaagagacgctggacgacacgttccgcacagcattgaccggtgattcgaaagaatatcgcgagagttcttcaagtctgatgtttgcttttattctggccattgtactgatttacctgatcctggcagcacagttcgagagtttcaaagacccgctgatcattatgctgaccgtccccctggctattgcaggcgcattggtattcatgtattttggaggtatcacaatgaacatcttcagccagatcggcattattatgctgattggactggtggctaaaaacggtatcctgatcgtagagtttgccaacctgaaacaagaaacgggtgaggataagatgacagccatcaaagatgcggcgttacaacgcctgcgtcctatcctgatgacaagtgcttctaccatcctgggattaatcccgctggctttcgcctcgggtgaaggttgcaaccaacgtatcgcaatgggtacggctgtagtgggaggtatgttggtatctaccctgctgaccatgtacatcgtacctgccatttacagttatatttcgacgaaccgaagtaataaattaaagcaagaatga

SEQ ID NO: 74435 - protein, 1011 aa, Bacteroides fragilis YCH46
MNISELSIRRPVLSTVLTIIILLFGLIGYNYLGVREYPSVDNPIISVSCSYPGANADVIENQITEPLEQNINGIPGIRSLSSVSQQGQSRITVEFELSVDLETAANDVRDKVSRAQRYLPRDCDPPTVSKADADATPILMVALQSDKRSLLELSEIADLTVKEQLQTISDVSSVSIWGEKRYSMRLWLDPIKMSGYGITPIDVKNAVDKENVELPSGSIEGNTTELTIRTLGLMHTAEEFNNLIVKEENDRIIRFSDIGRAELGPADIKSYMKMNGVPMVGIVVIPQPGANHIKIADAVYERMEKMQKDLPEDVKYSYGFDNTKFIRASISEVKETVYVAFILVIIIIFLFLRDWRVTLVPCIVIPVSLIGAFFVMYLADFSINVLSMLAVVLAVGLVVDDAIVMTENIYVRIEKGMPPKEAGIEGAKEIFFAVISTTITLVAVFFPIVFMEGMTGRLFREFSIVISGSVIISSFAALTFTPMLATKLLVKREKQNWFYLKTEPFFEGMNRLYSRSLAVFLHKRWIALPFVAITIGIIAFLWNYIPAEMAPLEDRSQISINTRGAEGVTYEYIRDYTEDINDLVDSIVPDAESVTARVSSGSGNVRITLKDMKDRDYTQMDVAEKLSAAVQKKTMARSFVQQSSSFGGRRGGMPVQYVLQATNIEKLQEVLPKFMAKVYENPVFQMADVDLKFSKPEARININRDKASIMGVSTRNIAQTLQYGLSGQRMGYFYMNGKQYEILGEINRQQRNTPANLKSIYIRSDKGDMVQLDNLIELTGGIAPPKLYRYNRFVSATVSAGLAEGKTIGQGLDEMDKIAKETLDDTFRTALTGDSKEYRESSSSLMFAFILAIVLIYLILAAQFESFKDPLIIMLTVPLAIAGALVFMYFGGITMNIFSQIGIIMLIGLVAKNGILIVEFANLKQETGEDKMTAIKDAALQRLRPILMTSASTILGLIPLAFASGEGCNQRIAMGTAVVGGMLVSTLLTMYIVPAIYSYISTNRSNKLKQE

SEQ ID NO: 74436 - DNA, 3147 bp, Bacteroides fragilis YCH46
  CDS (1)..(3147): transl_table=11
atgaaagttagtttttttatagatagacctgttttctcgatcgttatctcgatactgatagtcatcatcggcatcatcggactgaccatgttgcctgtcgaccagtatccgcagatcactcctccggtagtgaagatcagtgcctcttatccgggagccagtgcgcttacggtttcgcaggctgtagcaactcccatcgaacaggagattaacggaacaccgggtatgctttatatggagtcgaacagttccaattccggaggcttctcggcaacggttacttttgatgtttctgccgatccggacctggccgctgtagaaattcagaaccgggtgaagctggcggaaagccgtttgccggctgaagttattcaaaacggaatttcagttgaaaagcaggcgcccagccagttgatgacccttacattgatgtcgtccgatccgaaatttgacgaaatctatttgagtaattttgcgacgattaatgtacttgatgtaatccgccgtattccgggagtaggacgtgtgtcgaatatcggtagccgttattatgccatgcaaatctgggcagaaccggataaattggctaacttcgggctgactgtgcaggatttgcagaatgctttgaaggatcagaatcgtgaatcggctgccggtgtacttgggcagcaaccggtgaaggggctcgatgtgacaatccctatcactacgcagggacgtctttctactgtagaacaattcgaaaatattgtgattcgtgccaatacaaatggctctatcattcgtctgcgcgatgtggcacgagtttcactggaagcctcatcatatagtacagagagtggcatcaatggtaagaatgctgccgttctgggaatttatatgcttccgggcgctaacgcaatggaagtagcgaaaagtgtaaaagaggcgatggatgaaatcagtaaaaacttccctgaagggctgagctatgaggttccgttcgatatgacgacttatatttccgagtctattcatgaagtttataagaccttgtttgaagcattgatcctggtagtactcgtcgtttatctttctttgcagagttggcgggctacgttgattccgattgttgccgttcctatttcactgatcggtacatttggtttcatgctgattttcggtttctcgctgaacatattgacattgctcgggttgattcttgccatcggtattgtggtggatgatgctattgtagtggtggaaaatgtagagcgtattatggaggaagagaagttgccgccatatgaagctaccaagaaagccatgaatggattggcaggtgcgttgattgctacctcgctggtactttgtgccgtatttgtgccggtgagcttcctcagcggaattacgggccaactttaccgccagtttactattaccatcgctgtatccgtactgatttcgactgttgtggcgctgactctgagtccggtcatgtgttcgctgattctgaaaccggacaatggcaaaaagaagaacattgttttccgtaaaatcaaccattggttgaacgtgggcaatcataaatatgtaatcgctatccgtagggtaatcggtaatccgcgtcgtgtattggccggtttcggagtggtgcttattggtattttgttgattcaccggctgattccgacaagtttccttccggtggaagaccaagggtacttcaagatagagttggaattgccagaaggtgctacgctggaacgtacccgggaggtgacggatcgtgccatcacttatctggaaaagaatccgtatatagcctatgtacagaatgttaccggaagcagtccccgtgtaggtagcaatcaggctcgtagtgaattgactgttatcttgaagccgtgggaagaccgcaaggatacatcgattgatgagattatgtcaaacgtccgtcacgacctgagtgagtatccggagtgtaaagtctatctttctactcctcctgttattcccggtttgggaacctcgggtggttttgagatgcaactggaggctcgtggcgaggctactttcgaaaatttggtgcaggcggcggatacgctgatgtattatgcctctcagcgcaaagagttgacgggactttcttcttcacttcagtcggatattccacagctttatttcgatgtggaccgtgataaggtgaagatgctaggtgtgcctttggcggatgttttttcaacgatgaaagcttataccggttcggtttatgtaaatgacttcaatatgttcaaccgtatctataaagtatacattcaggctgaggcaccctatcgggaacataaggacaatattaacttgttctttgtgaaggcttccaacggggctatgattccgctgacttctttgggaaacgcatcatatactacgggtcccggcagcattaaacgtttcaatatgtttactactgctgtattccgcggtgaggcggcacaggggtatagttccggacaggctatggagattatggagcagattgcccggtatcatttgcccgataatatcggactggagtggagtgggctttcctatcaggagaaaaaggcgggaggacagaccggattggtattggcgctggtgttcctatttgtattccttttcctggcagcacagtacgaaagttggacggtaccgattgctgtgttactctctttgccggtggctgccttgggggcttatctgggagtatgggtttgcggattggaaaacgatgtatatttccagatcggactggtgatgcttgtcgggttggcagcaaaaaatgccatcctgattgtagagtttgccaaagtgcaggtagaccgtggaggtgatttaatacagtctgccatccatgccgcccaattgcgttttcgccccatcttgatgacttccctcgcctttgtgctgggtatgcttccgatggtgctggcaactggtcccggttcggcaagccgtgctgctattggtacaggagtctttttcggaatgatctttgccattgtagtgggcattattctggttccattcttctttgtgctggtttataagacaaaggcaaaactgaaaaatgtaccgaatgtgaacgtgaaattaccgttcaagtctaaaaagaaaactgattga

SEQ ID NO: 74437 - protein, 1048 aa, Bacteroides fragilis YCH46
MKVSFFIDRPVFSIVISILIVIIGIIGLTMLPVDQYPQITPPVVKISASYPGASALTVSQAVATPIEQEINGTPGMLYMESNSSNSGGFSATVTFDVSADPDLAAVEIQNRVKLAESRLPAEVIQNGISVEKQAPSQLMTLTLMSSDPKFDEIYLSNFATINVLDVIRRIPGVGRVSNIGSRYYAMQIWAEPDKLANFGLTVQDLQNALKDQNRESAAGVLGQQPVKGLDVTIPITTQGRLSTVEQFENIVIRANTNGSIIRLRDVARVSLEASSYSTESGINGKNAAVLGIYMLPGANAMEVAKSVKEAMDEISKNFPEGLSYEVPFDMTTYISESIHEVYKTLFEALILVVLVVYLSLQSWRATLIPIVAVPISLIGTFGFMLIFGFSLNILTLLGLILAIGIVVDDAIVVVENVERIMEEEKLPPYEATKKAMNGLAGALIATSLVLCAVFVPVSFLSGITGQLYRQFTITIAVSVLISTVVALTLSPVMCSLILKPDNGKKKNIVFRKINHWLNVGNHKYVIAIRRVIGNPRRVLAGFGVVLIGILLIHRLIPTSFLPVEDQGYFKIELELPEGATLERTREVTDRAITYLEKNPYIAYVQNVTGSSPRVGSNQARSELTVILKPWEDRKDTSIDEIMSNVRHDLSEYPECKVYLSTPPVIPGLGTSGGFEMQLEARGEATFENLVQAADTLMYYASQRKELTGLSSSLQSDIPQLYFDVDRDKVKMLGVPLADVFSTMKAYTGSVYVNDFNMFNRIYKVYIQAEAPYREHKDNINLFFVKASNGAMIPLTSLGNASYTTGPGSIKRFNMFTTAVFRGEAAQGYSSGQAMEIMEQIARYHLPDNIGLEWSGLSYQEKKAGGQTGLVLALVFLFVFLFLAAQYESWTVPIAVLLSLPVAALGAYLGVWVCGLENDVYFQIGLVMLVGLAAKNAILIVEFAKVQVDRGGDLIQSAIHAAQLRFRPILMTSLAFVLGMLPMVLATGPGSASRAAIGTGVFFGMIFAIVVGIILVPFFFVLVYKTKAKLKNVPNVNVKLPFKSKKKTD

SEQ ID NO: 74438 - DNA, 3201 bp, Burkholderia pseudomallei K96243
  CDS (1)..(3201): transl_table=11
atggcaaagttttttatcgatcgcccgatcttcgcgtgggtgatcgccatcatcctgatgctggccggcgtcgcggcgatcttcacgctgccgatcgcccagtatccgacgatcgcgccgccgtcgatccagatcaccgcgaactacccgggcgcttcggcgaagaccgtcgaagacaccgtcacgcaggtgatcgagcagcagatgagcggcctcgacaacttcctgtacatgtcgtcgacgagtgacgactcgggcaacgcgacgatcacgatcacattcgcgccgggcacgaacccggacatcgcgcaggttcaggtgcagaacaagctgtcgctcgcgacgccgatcctgccgcaggtggtgcagcagctcggcctgtcggtgacgaagtcgagcagcagcttcctgctcgtgctcgccttcaactccgaagacggcagcatgaacaagtacgacctggcgaactacgtcgcgtcgcacgtgaaggacccgatcagccggatcaacggcgtcggcactgtcacgctgttcggctcgcagtacgcgatgcggatctggctcgacccgaccaagctcacgaactacgggctcacgccggtcgacgtgacgagcgcgatctccgcgcagaacgtgcagatcgcgggcggccagctgggcggcacgccggccgtgccgggcaccgtgctgcaggcgacgatcaccgaggcgacgctgctgcagacgcccgagcagttcggcaacatcctgctgaaggtgaatcaggacggctcgcaggtgcggctgaaggacgtcgcgcagatcggcctcggcggcgagacgtacaacttcgacacgaagtacaacggccagccgaccgccgcgctcggcatccagctcgcgaccaacgcgaacgcgctcgcgaccgcgaaggcggtgcgcgcgaagatcgacgagatgtcggcgtacttcccgcacggcctcgtcgtcaagtacccgtacgacacgacgccgttcgtgcgcctgtcgatcgaggaagtggtgaagacgctgctcgagggtatcgtcctcgtgttcctcgtgatgtatctgttcctgcagaacctgcgggcgacgatcatcccgacgatcgcggtgcccgtcgtgctgctcggcacgttcgcgatcatgtcgatggtgggcttctcgatcaacgtgctgtcgatgttcggcctcgtgctcgcgatcggcctgctcgtcgacgatgcgatcgtcgtcgtcgagaacgtcgagcgggtgatggccgaagagggcttgccgccgaaggaggcgacgcgcaaggcgatgggccagatcacgggcgcgctcgtgggcgtggcgctcgtgctgtcggcggtgttcgtgccggtggcgttctcgggcggctcggtcggcgcgatctatcggcagttctcgctgacgatcgtctcggcgatggtgctttccgtgctcgtcgcgttgattctgacgccggcgctgtgcgcgacgatcctcaagccgatcccgcaagggcatcacgaggagaagaagggcttcttcggctggttcaaccgcaccttcaactcgagccgcgacaagtatcacgtcggcgtccaccacgtgatcaagcgctcgggccgctggctcatcatctatctcgcggtgatcgtcgccgtcggcctgctgttcgtgcgcctgccgaaatcgttcctgcccgacgaggaccagggcctgatgttcgtgatcgtccagacgccgtcgggctcgacgcaggagacgaccgcgcgcacgctcgcgaacatttccgactacctgctcacgcaggagaaggacatcgtcgaatccgcgttcacggtcaacggcttcagcttcgcgggccgcggccagaactcgggccttgtgttcgtcaagctgaaggactactcgcagcggcagagctcggaccagaaggtgcaggcgctgatcggccggatgttcggacgctacgcgggctacaaggacgcgctcgtgattccgttcaacccgccgtcgattcccgaactcggcacggcggccggcttcgacttcgagctgaccgacaacgcgggcctcggccacgatgcgctgatggccgcgcgcaaccagttgctcgggatggccgcgaaggatccgacgctgcggggcgtgcgtccgaacgggctgaacgacacgccgcagtacaaggtcgacatcgatcgcgagaaggcgaacgcgctcggcgtgaccgcggatgcgatcgaccagacgttctcgatcgcgtgggcgtcgaagtacgtgaacaacttcctcgacaccgacggccggatcaagaaggtgtacgtgcagtccgacgcgccgttccggatgacgccggaggacatgaacatctggtacgtgcgcaacggctcgggcgggatggtgccgttctccgcgttcgcgacgggccactggacctacggctcgccgaagctcgagcgctacaacggcatctcggcgatggaaatccagggccaggccgcgccgggcaagtcgaccggccaggcgatgacggcgatggagacgctcgcgaagaagctgccgacgggcatcggctattcgtggacggggctgtcgttccaggaaatccagtcgggctcgcaggcgccgatcctgtacgcgatctcgatcctcgtcgtgttcctgtgtctcgccgcgctgtatgaaagctggtcgatcccgttctcggtgatcatggtcgtgccgctcggcgtgatcggcgcgctgctcgccgcgacgctgcgcgggctcgagaacgacgtgttcttccaggtcggcctgctgacgacggtggggctgtcggcgaagaacgcgatcctgatcgtcgagttcgcgcgcgagctgcagcaaacggagaacatggggccgatcgaggcggcgctcgaggcggcgcggctgcggctgcgtccgattctgatgacgtcgctcgcgttcattctcggcgtgatgccgctcgcgatcagcaacggcgcaggctcggcgagccagcacgcgatcggcaccggcgtgatcggcgggatgatcaccgcgacgttcctcgcgatcttcatgatcccgatgttcttcgtgaaggtgcgggcagtgttcagcggcgagaaggaagacgccgacgaagcgctgcgcctcgcgcacgagcacatgcaccgtgacgacaagccggagcacggcgacgacgctggcaagaaggactaa

SEQ ID NO: 74439 - protein, 1066 aa, Burkholderia pseudomallei K96243
MAKFFIDRPIFAWVIAIILMLAGVAAIFTLPIAQYPTIAPPSIQITANYPGASAKTVEDTVTQVIEQQMSGLDNFLYMSSTSDDSGNATITITFAPGTNPDIAQVQVQNKLSLATPILPQVVQQLGLSVTKSSSSFLLVLAFNSEDGSMNKYDLANYVASHVKDPISRINGVGTVTLFGSQYAMRIWLDPTKLTNYGLTPVDVTSAISAQNVQIAGGQLGGTPAVPGTVLQATITEATLLQTPEQFGNILLKVNQDGSQVRLKDVAQIGLGGETYNFDTKYNGQPTAALGIQLATNANALATAKAVRAKIDEMSAYFPHGLVVKYPYDTTPFVRLSIEEVVKTLLEGIVLVFLVMYLFLQNLRATIIPTIAVPVVLLGTFAIMSMVGFSINVLSMFGLVLAIGLLVDDAIVVVENVERVMAEEGLPPKEATRKAMGQITGALVGVALVLSAVFVPVAFSGGSVGAIYRQFSLTIVSAMVLSVLVALILTPALCATILKPIPQGHHEEKKGFFGWFNRTFNSSRDKYHVGVHHVIKRSGRWLIIYLAVIVAVGLLFVRLPKSFLPDEDQGLMFVIVQTPSGSTQETTARTLANISDYLLTQEKDIVESAFTVNGFSFAGRGQNSGLVFVKLKDYSQRQSSDQKVQALIGRMFGRYAGYKDALVIPFNPPSIPELGTAAGFDFELTDNAGLGHDALMAARNQLLGMAAKDPTLRGVRPNGLNDTPQYKVDIDREKANALGVTADAIDQTFSIAWASKYVNNFLDTDGRIKKVYVQSDAPFRMTPEDMNIWYVRNGSGGMVPFSAFATGHWTYGSPKLERYNGISAMEIQGQAAPGKSTGQAMTAMETLAKKLPTGIGYSWTGLSFQEIQSGSQAPILYAISILVVFLCLAALYESWSIPFSVIMVVPLGVIGALLAATLRGLENDVFFQVGLLTTVGLSAKNAILIVEFARELQQTENMGPIEAALEAARLRLRPILMTSLAFILGVMPLAISNGAGSASQHAIGTGVIGGMITATFLAIFMIPMFFVKVRAVFSGEKEDADEALRLAHEHMHRDDKPEHGDDAGKKD

SEQ ID NO: 74440 - DNA, 3165 bp, Methylococcus capsulatus str. Bath
  CDS (1)..(3165): transl_table=11
atgatctccaagttcttcatcgaacggccgatcttcgccaacgtcatcgcgatcgtcacgatcattctgggcgccgtcagcctcatcaatttgccggtcgcccagtatcccgacatcgtgccccccaccatccaggtaaccacccgctatcccggggccagcgccgagatcatcgccaatacggtcggcataccgatcgaacaggcggtcaacggcgtggagaactcgctgtacctgtcctcgaccagcggcagcgacggctcctataccttgaccgtgactttccgggtcggcagcgatctcaacaccggcctggccctggtgcagaacatggtcaacggggccttggcccagctgccggatgcggtgcagaaacagggcgtcaccgtcaagaaagtgtcgaccgacatgctgcaggtcatcagcctgtattcggacgacgaccgcttcgacgaaacctatctttccaattacgccgtcatcaacctgcagtatccgttggcccgcatccatggcgtcggacagatcaaggtcgtcggcgccggctcctacagcatgcgggtatggctgaatccggagaggctgcgctactacggcctcaccgccaaggatgtcgccgacgcgatacagcagcagaacgtcgaggtcgtggcgggccaactcggcggccccccggtgcccgaggaccaaccctaccagttcaccatcaacgccctgggccgtttgtccgatgtctcggaattcgagaacatcatcatcaagacgagccggggaaaaccgcagcagtcggtcacgaacgaagatgcagcccggatcgtgcgcgtgaaggacctcgcccgagtcgaactgagccaacagacgtacaccaactacgccgaggtcaacggccacaaatcgacccagatcgtggtctacaccctgcccggagccaacgccatcgacgtcggcgaaagaatcaaacagtcgatggaggaaatgagccaggacttcccccaagggctcaaatacgcgatcttctacgacaccaccaaattcatcgaccagtcgatccacgcggtctacgagaccctgttcgaagccggcgtgctggtgctgatcgtcatcatggtgttcctgcagaactggcgggcgaccctggtgccggccacgaccgtcccggtgaccatcatcggcgccttcgccgcgatggcgatgctcggcttctcggtcaacctgatgacattgttcgccttgatcctggcgatcggcatcgtcgtggacgatgccatcatgatcgtcgagaacgcctggcactacatcgagaagggactgacgccgaaggaggcgtcgatcaaggccatgagcgagatgaccggcccggtcatcggcatcaccctggtgctgactgcggtattcctgccttcggccttcctgcccggcattaccggccagatgttccggcaattcgcccttgtgatcgcctctaccgcgatcatcagcgccatcaacgccttgaccctcaaaccggctcagtgcgccctctacctcaaggcacggccggccgatcaccgtccgaacgcattctaccgcggcttcaacgaagtctatgccgcaatcgaggcagcctatacccgagtggtccgctggatggtgaaaagggccggaacgatggccgtggttttcttcgccttcatcgccatgggcggctggctgttcagcatccacccgacaggcttcctgcccagcgaggatcagggctacgccataatcatgacacgcctgccggacggcgccgcccagcccagactccgggaagccagccgtaggctcgacgaagtcctgaaaaaaacgcccggcgtgcatgcctgggtcgtgatcggggggttgtcgatcctcgataccgccaacctctcgaacgcttccaccaccttcgtcatttatgacgactgggacaagcgcggcgaagcgctcgatcagcgccatattctcggcagcctgaaaaagcagctcgacgccattccggaagcccagttcgccatcatgattccgccgcccatccgcggcctcggccaggccggcggcttccagatgatggtcgaagacaggcgcagcctcggcctgcccgaattgcagaagggcgtgcaggaactgacccgcgccgggtccacgcaatccggtctcggcttcgtgggttcgaccttcagcaaccgcagccctcagctttacctcgacatcgaccgcaccaaggcgcagtcgcaggaagttccgctgagcaacgtattcgccaccctgcaagcgtatctcggatccgcttacgtcaatctgttcaataaattcaatcagtcgttccaggtttacgtgcaggccgacgcaccctaccggctgcggccggaggacatcgagaatctctacgtgaagaacgtccgggaggaaatggtcccgctgggctccctcctgaccgtgaagcacatgctgggttccgaactggtcacccgttacaacctctatccggcagcgccggtgttcggatccgcggcgccggggtccagttccggtgaagcgatccagctgatggagcggatcgccaagaacaccttgccgcaaggcatgagcttcgaatggaccgccaccgcattccaggaaaagcagctcggcaaccaggcgtactacatctatcttctgtccatcgttctggttttcctggtgctggccgctcaatacgaaagctgggccagccccgccgcggtgatcctggtcgtacccatggctctggtgggcgtcatcgtcgccctcatcatccgccacttcgacaacaacctgtacacccaggtcggcctggtactgatgatcgcgctggccagcaagaacgccatcctggtggtggaattcgcccgggaactgcgcaccgaaggcatggccatcgccgacgccgcggtggaagccacccggcgccggttccggcccatcatcatgacctcgttcgctttcatcctgggtgtcgtcccgctgatgaaggccggcggcgccggcgcggccagccagcaggcgatcggcaccgtggtgttcggcggcatgctggcctcgaccatcctggccatccccttcgtaccggtgttctatgtcatcacccagcgctggagcgagcggaacaagggaggcaaaccggaatctccggcgaccggctga

SEQ ID NO: 74441 - protein, 1054 aa, Methylococcus capsulatus str. Bath
MISKFFIERPIFANVIAIVTIILGAVSLINLPVAQYPDIVPPTIQVTTRYPGASAEIIANTVGIPIEQAVNGVENSLYLSSTSGSDGSYTLTVTFRVGSDLNTGLALVQNMVNGALAQLPDAVQKQGVTVKKVSTDMLQVISLYSDDDRFDETYLSNYAVINLQYPLARIHGVGQIKVVGAGSYSMRVWLNPERLRYYGLTAKDVADAIQQQNVEVVAGQLGGPPVPEDQPYQFTINALGRLSDVSEFENIIIKTSRGKPQQSVTNEDAARIVRVKDLARVELSQQTYTNYAEVNGHKSTQIVVYTLPGANAIDVGERIKQSMEEMSQDFPQGLKYAIFYDTTKFIDQSIHAVYETLFEAGVLVLIVIMVFLQNWRATLVPATTVPVTIIGAFAAMAMLGFSVNLMTLFALILAIGIVVDDAIMIVENAWHYIEKGLTPKEASIKAMSEMTGPVIGITLVLTAVFLPSAFLPGITGQMFRQFALVIASTAIISAINALTLKPAQCALYLKARPADHRPNAFYRGFNEVYAAIEAAYTRVVRWMVKRAGTMAVVFFAFIAMGGWLFSIHPTGFLPSEDQGYAIIMTRLPDGAAQPRLREASRRLDEVLKKTPGVHAWVVIGGLSILDTANLSNASTTFVIYDDWDKRGEALDQRHILGSLKKQLDAIPEAQFAIMIPPPIRGLGQAGGFQMMVEDRRSLGLPELQKGVQELTRAGSTQSGLGFVGSTFSNRSPQLYLDIDRTKAQSQEVPLSNVFATLQAYLGSAYVNLFNKFNQSFQVYVQADAPYRLRPEDIENLYVKNVREEMVPLGSLLTVKHMLGSELVTRYNLYPAAPVFGSAAPGSSSGEAIQLMERIAKNTLPQGMSFEWTATAFQEKQLGNQAYYIYLLSIVLVFLVLAAQYESWASPAAVILVVPMALVGVIVALIIRHFDNNLYTQVGLVLMIALASKNAILVVEFARELRTEGMAIADAAVEATRRRFRPIIMTSFAFILGVVPLMKAGGAGAASQQAIGTVVFGGMLASTILAIPFVPVFYVITQRWSERNKGGKPESPATG

SEQ ID NO: 74442 - DNA, 3168 bp, Methylococcus capsulatus str. Bath
  CDS (1)..(3168): transl_table=11
atgaaattcgcccatttcttcatcgaccggccgcgcttcgccatcgtcctctccgtcatcacggtgctgatcggcgggatcgcgatgttcgcactgccgatcgcgcaatatccagaagtggtgccgcctaccatcgtggtatcgaccacctatccgggcgccaatcccaaggtgatcgccgaaaccgtggcggcgccgatcgagcaggaagtcaacggcgtcgagcgcatgctgtacatgtcctcgcagtcgaccagcgacggccagatgcagctcacgatcaccttcgagatcggcaccgacatggacatcgcccagatgcaggtgcagaaccgggtctccaatgccctaccgaagctgccggaggacgtccgcaggcagggcgtgacgaccaagaaatcttcgcccgacatcctgctggtcatccatctggtctcgccgaaccagcgctacgaccagctttatctctccaactacgccctgctcaacatccgcgaccagatcctgcggctcccgggggtgggcgatgtccgaaccttcggcgccggcgattacagtatgcgggtctggctcgacccgacccggatcgcggctttgaacatgaccgccggcgatgtggtgcgcgccatccgcgaacagaacatccaggtgccggccggcgtgatcgggcagccgccgctggacggcagcccggacttccagctcaacgtcaacaccatgggtcgcctcgccagcgtcgagcagttcggcgcgatcatcgtcaagtacggcgaaggcggcagcctggtgcgtctgcgcgacgtcgccaggatcgagctgggcgccaaccgctactccctgcgcagccagctgaacaacgaagacgccgtcgccatgccgatttcgctgcggccgggcgccaacgccctggatacggcccggcgaatcaagagcaagatgcagaccctgaaacagcggtttccggaaggagtggattaccggatcgtctacgacaccacgatcttcgtcgagcaatcactggacgccgtcacccgcacctttttcgaggcgttggccctggtggtgctggtggtgctggtgtttctgcagacctggcgcgccgcgctcatcccgctgctggcggtgccggtgtccatcgtggggaccttcgcggtcatggcggcgctgggctattcgctgaacaatctgtcgctgttcgggctggtactcgccatcggcatcgtcgtcgacgacgccatcgtggtggtggagaacgtcgagcgccacatcggcctcgggctttcggtcaaggaagcggcgcgccaggccatgcgggaggtgacgggaccgatcatcgccatctcggtggtgctgggtgcggtgttcattccggcggccttcgtctccggcatcaacggacagttctaccgccagttcgccgtcaccatcgccgcttccaccctgatctcggcgttcaactctctgaccttgagccccgcgctcgccgcggtcctgctcgagccccaccatgcccgcaaggaccgtttgagcctttggatcgaccggttgttcggctggctgttccgtgggttcaaccggggtttcgatgcctgctccaacggctacgccggcctggtcaaacgcctgctgaggctgtccggcgtcgtgctggcgctgtatggagggctgctcgccttcaccggctacgaattcgagcgggtgcctggcgggttcattccactgcaggacaagggctatctggtggtatttgcccagttgccggaggccgcctctctggaacgaaccgatgccgtgctgcacagggcatcggaaatcatcctggcccagccgggcgtgcagggaacggtggcgtttcccggtttttcggtcgtcagcggcgccaatacctcgaatgccggcaccatcttcgtgcctctcaagccgttcgaggagcgggtggccaagggcctgtcggcccagcggatattgggcgaattgcagcccaagctcggcggcgtgaaggaggctttcatcggcatctttcctccgccgccgatcctgggtctgggcagccttggcggcttcaagctgcagatccaggaccggggcaacgagggcttcgacgcgctgaacggcgcactgcaagccgccctcgacgcaggccggcagacaccgggactggcgggactgttcaccagtttccaaaacaacgttccgcagctctatgtcgacatcgaccgggtcaaagccaagtcgcagggcatcccgctctcggaaatcttcgacaccatgcagatttatctcggatcgctctatgtcaacgacctcaacctgttcggccgcacctaccaggtcacggcccaggccgacggcgagtaccgccgcgaacccgaggacatcggccggctcaaaacccgcaacgccgcgggggccatggtaccgctggcggcgctaatgacagtgagggaaatcagcgggccggagcgggtgcttcgctacaatatgtaccctgcggccgagatcaacggctctcccgcgcccggtgtcagttcggggcaggcgatcgctctgatggaggagctgttgaggaggaccctgccgctgtccatggatttcgaatggaccgagttgacctaccagcagatcctggcgggcgacacggccgtctatgtgttcgccctctcgagcctgctggtgttcctggtcctggtggctttgtacgaaagctggatactgccgctcgccatcgtcctcatcgtgcccatgaccctgatgtgcgctctgggcggggtatggctgcggagcggagacaacaacatcttcacccagatcgccttgctggtgctggtcggcctggcggccaagaacgccatcctgatcgtcgaattcgccaagacccggcgggaagaaggggtggacgcgatggcggcagccctcgaagcctgccggctgaggttccgaccgatcctcatgacttcgttcgcgtttatcatgggcgttttgcccctcatgttcgccaccggggcaggcgccgagatgcggcaggccttgggggtgccggtgttcttcggcatgttgggcgtgacggtgttcggcctgctgttcaccccggtgttttatcatgtcttgcaaaggcttgccgaccggagccgtggccatgccgttccagcggccggcgggtccggatga

SEQ ID NO: 74443 - protein, 1055 aa, Methylococcus capsulatus str. Bath
MKFAHFFIDRPRFAIVLSVITVLIGGIAMFALPIAQYPEVVPPTIVVSTTYPGANPKVIAETVAAPIEQEVNGVERMLYMSSQSTSDGQMQLTITFEIGTDMDIAQMQVQNRVSNALPKLPEDVRRQGVTTKKSSPDILLVIHLVSPNQRYDQLYLSNYALLNIRDQILRLPGVGDVRTFGAGDYSMRVWLDPTRIAALNMTAGDVVRAIREQNIQVPAGVIGQPPLDGSPDFQLNVNTMGRLASVEQFGAIIVKYGEGGSLVRLRDVARIELGANRYSLRSQLNNEDAVAMPISLRPGANALDTARRIKSKMQTLKQRFPEGVDYRIVYDTTIFVEQSLDAVTRTFFEALALVVLVVLVFLQTWRAALIPLLAVPVSIVGTFAVMAALGYSLNNLSLFGLVLAIGIVVDDAIVVVENVERHIGLGLSVKEAARQAMREVTGPIIAISVVLGAVFIPAAFVSGINGQFYRQFAVTIAASTLISAFNSLTLSPALAAVLLEPHHARKDRLSLWIDRLFGWLFRGFNRGFDACSNGYAGLVKRLLRLSGVVLALYGGLLAFTGYEFERVPGGFIPLQDKGYLVVFAQLPEAASLERTDAVLHRASEIILAQPGVQGTVAFPGFSVVSGANTSNAGTIFVPLKPFEERVAKGLSAQRILGELQPKLGGVKEAFIGIFPPPPILGLGSLGGFKLQIQDRGNEGFDALNGALQAALDAGRQTPGLAGLFTSFQNNVPQLYVDIDRVKAKSQGIPLSEIFDTMQIYLGSLYVNDLNLFGRTYQVTAQADGEYRREPEDIGRLKTRNAAGAMVPLAALMTVREISGPERVLRYNMYPAAEINGSPAPGVSSGQAIALMEELLRRTLPLSMDFEWTELTYQQILAGDTAVYVFALSSLLVFLVLVALYESWILPLAIVLIVPMTLMCALGGVWLRSGDNNIFTQIALLVLVGLAAKNAILIVEFAKTRREEGVDAMAAALEACRLRFRPILMTSFAFIMGVLPLMFATGAGAEMRQALGVPVFFGMLGVTVFGLLFTPVFYHVLQRLADRSRGHAVPAAGGSG

SEQ ID NO: 74444 - DNA, 3075 bp, Methylococcus capsulatus str. Bath
  CDS (1)..(3075): transl_table=11
atgacactgagcgacatttccatccgccggccggtgctggcgacggtgatgagcctcgctttggtgctggtcgggctgatgtgtttccagcgcctgccggtgcgggagtatcccaacatcgatgcacccgtagtctcggtccgcagcgtctacaagggcgccagttcggaggtgatcgagagccaggtgacgcggccgctggaggactcgctgtccggcatcgaaggcatccggaccatgaagtcggtcagccgcgaagaagtcagccagatcaccctcgagttcaacgtcagccgcgaccaggattcggcggcggccgatgtgcgcgaccgggtgtcgcgggtcagggcccggctgccgcgcgagatggacgaacccgtcatcagcaagatcgaagccgacgcccagcccatcctgtggcttgctttttccagcgatcgccatagtcccctggaaatcaccgatttcgccgatcgttacgtgcaggaccggctgcagactctgccgggcgtcgccagtgtgatcatcggcggtgaacgccgctatgcgatgcggctgtggctcaaccgcgagcggatggctgcccacggggtgacggtgcaggatgtcgaggcggcgctgcagaagcgcaacgtcgaactgccaggcggacgcatcgaaagtgcacagcgcgagttcaccgtattcagcgagaccgacctgaaaacggtcgaagaattcaacgctctgatcgtccgggaggtgaacggttttctggtgcggctgtcggacatcggtcgggccgagctgggggcggcggatgagcgcaacatcgtgcgggtgaacggcaatccggcggtggcgctgggggtggtcaagcaggccacggccaacaccctggaggtggcccggtcggtgcgggcggagctgccgaaaatcctgcaaaccctgccggacgggatgacgctggaagtgtccttcgacacctcccagttcatcgacgagtccatccattccgtctacaagaccctggccgagtccctggggttggtcacgctggttacctggtcgtttctgcgttcggcgcgcgctaccctcatcccgttcgtgaccatcccggtctctctgatcggcgccttcatcttcatttatgcgctggggttttcggtcaacattctgaccctgctggcgttggtgctcgccatcggcctggtggtggatgacgccatcgtgatgatggagaacatctaccggcgcatcgaaggcggtacgccccctttgagggcggcggtcgagggcagccgggaaatcgccttcgcggtgattgccatgacgttgacgctggcttcggtcttcgcgccgctggcgttcatgagcggcaataccggccggctgttctctgaattcgctctggcggtgtcctgcgcagtgctggtctccggcttcgtggcgctgacgctgaccccgatgatgtgctcacgcctgttgaagccgggcgctaccgtcaggacggggcgggccgaaagcggccaggcctccggtttcacggcgctctaccgaaaggggctcgaggccgccttgcggcaccggtgggccgtgatcggggtgatgctgggtatagccgtcggcgcggtagggctgttccgtgcgctcaacgcggaactgtcgccgctggaggaccgcggcaacatcatcatcatgatcgcggcccccgaaggtgcgaccgtagagtacaccgaccgttatgcccgcgaagtcgaggcgatggtccagccgatcccggaagtccggagttatttcatggtggtggcgccggggttggaccggcccaacccggtgaattccgcgatcggtttcgtgcgcctgaagccatggcagcagcgccaccgctcgcagcaggagatcgcggcgaccttgttgccgaagctgatggccttgccgggggtgatggctttcgccatcaatcctccttccctggggcagagcttccgcagcccgcccgtgcagttcgtgatccaggggccgacctacgaaaagctcgatggtgtggcggcgcaattggtcgaccgggcccggcagtacgccggcttggtcaacgccgataccgacctcaagctcgataagccgcagatcagtgtgcaggtgaaccgggaaaaggccgctgacgtcggggtcgacgtcgacgagatcggccggacgctgcagacgctgctgggcggccgtcaggtgacgcgtttcaagaaaggcggtgaacagtacgacgtgatcgtcgaactggaggatgccgagcggatgaccgtgaacgacgtgggctcgatctacctgcgcggtgccggcggccggctggtccagctcgccaatctggtcgagacccgggaaaaaggcgcggccaaggaactcaaccatttcaaccggctgcgttcggcggtgctgtctgccagcgtcacccccggcttcacattgggtgaggccctgtcctacctcggcgcagcggcgaaggagattctgccggccgatttcaagaccgatctcgatggccagtcgcgcgagttcgtcgaatccagtcgcacgctctacctcaccttcgtgttcgcgctgctgttcatttatctggtgctcgcggcgcagttcgagagcttctccgatccgttcatcatcatgctcactgtgccactggccgtgaccggtgcgctgctttcactgaaatggaccggtggcaccctcaatgtctatagccagatcggcatgatcatgctgatcggcctggtgaccaagaacggcattctgatcgtggagtttgccaaccagctccaacgggcggggcgcggtctcgtggaggctgtggtcgaggcctccgtgctgcgcttccggccgatcctgatgacctcgctgaccatgattctgggcgccctgccgctggccttgtcgtcgggcgccggggccgagagccggcagcagatcggctgggtcatcgtcggtggactgctcatcgggaccgtattcacagtgttcgtcattccggccgtatataccctgctggccaagcctccgaggacgcaggacgaagggaacgaaagggcggccggcgtggtctag

SEQ ID NO: 74445 - protein, 1024 aa, Methylococcus capsulatus str. Bath
MTLSDISIRRPVLATVMSLALVLVGLMCFQRLPVREYPNIDAPVVSVRSVYKGASSEVIESQVTRPLEDSLSGIEGIRTMKSVSREEVSQITLEFNVSRDQDSAAADVRDRVSRVRARLPREMDEPVISKIEADAQPILWLAFSSDRHSPLEITDFADRYVQDRLQTLPGVASVIIGGERRYAMRLWLNRERMAAHGVTVQDVEAALQKRNVELPGGRIESAQREFTVFSETDLKTVEEFNALIVREVNGFLVRLSDIGRAELGAADERNIVRVNGNPAVALGVVKQATANTLEVARSVRAELPKILQTLPDGMTLEVSFDTSQFIDESIHSVYKTLAESLGLVTLVTWSFLRSARATLIPFVTIPVSLIGAFIFIYALGFSVNILTLLALVLAIGLVVDDAIVMMENIYRRIEGGTPPLRAAVEGSREIAFAVIAMTLTLASVFAPLAFMSGNTGRLFSEFALAVSCAVLVSGFVALTLTPMMCSRLLKPGATVRTGRAESGQASGFTALYRKGLEAALRHRWAVIGVMLGIAVGAVGLFRALNAELSPLEDRGNIIIMIAAPEGATVEYTDRYAREVEAMVQPIPEVRSYFMVVAPGLDRPNPVNSAIGFVRLKPWQQRHRSQQEIAATLLPKLMALPGVMAFAINPPSLGQSFRSPPVQFVIQGPTYEKLDGVAAQLVDRARQYAGLVNADTDLKLDKPQISVQVNREKAADVGVDVDEIGRTLQTLLGGRQVTRFKKGGEQYDVIVELEDAERMTVNDVGSIYLRGAGGRLVQLANLVETREKGAAKELNHFNRLRSAVLSASVTPGFTLGEALSYLGAAAKEILPADFKTDLDGQSREFVESSRTLYLTFVFALLFIYLVLAAQFESFSDPFIIMLTVPLAVTGALLSLKWTGGTLNVYSQIGMIMLIGLVTKNGILIVEFANQLQRAGRGLVEAVVEASVLRFRPILMTSLTMILGALPLALSSGAGAESRQQIGWVIVGGLLIGTVFTVFVIPAVYTLLAKPPRTQDEGNERAAGVV

SEQ ID NO: 74446 - DNA, 3114 bp, Methylococcus capsulatus str. Bath
  CDS (1)..(3114): transl_table=11
atggggtttctgtcgatcaaatcattgccggtatcacagtttccggacattgcccctccccgcgtaaccgtaactctgtcattcccaggagcgagtgcggacgtattggtgaaatcgtccatcatcacaatcgaacgtgcgatcaatggcgttcccggcatgaaatacatggtttccgccgcgacgagcgctggggaggctacgatccagatcctgttcgatctgggaatcgatccactgcaagccatgatcgacgtcaagactcggctggatacgaccatgagccggctcccccagctggtgacgctcgaaggcgtctgggtccagcgcatccagccaagcatgctgatgtatatcaatctgttcagcaaagacaagaacgcagatcaaaaattccttttcaattacgcctacgtcaacgtcgttccagagatccaacgtgtaaacggcatagcacaggctcggatattgggcagccgccaatatgccatgcgaatatggctgaatccggacaggatgagagcctataaggtttcaacagaggaagtactcaaagcgatcgaagagcaaagcattatcggccggcctggtagattgggacagagcacgggcgtcactgcccaatcgaaagaatatgttctggtgtatgaaggctggtacaacaagccggagcaatatgaggatatcatcataagggccaactcggaaggcgaactgttgcgtataaaggatatcggcaccgtcgatctgaacagtgaattctggaatatctattcggataaggatggccttccttccgcctcgatcgtcctcaatcaaaactacggaaccaatgccagcaaagtaatcgaggacgtaaagaagaaactgaaagagttgaaggagacatttcctgaaggaatggattatgaaatcaattacgacgtctcccggtttctggatgcatccatccacaaggttctccatacgttgatggaagccttcgtgctagtcgcactggttacgtttgttttcctgggtgactggcgctcgacgttgataccgatcctttcgattccagtctcgttgatcggtacgtttgcagtcatacaggctttcgaactatcgatcaacctgatcactctattcgctctggtgctcgccatcggcattgtggtcgacgatgctatcgtggtagtcgaagccgtacatgccaagatggaggccgaacacctctccccctatcaggcatccaagaaggttttgggcgaaatcggtggcgccatcattgccatcaccttgatcatgatatcggttttcgtgcccatttccttcatgagcggacctgtcggtgtgttctatcggcagtttggcattactatggcgtccgcgattctcatttccgcactggtcgcgctgtcacttgcacctgtactctgcggcatgatcttgaaaaatactcacggacaaccaaaaaagcgaaccccagtccgcatctttattgatacattcaattatttttttgaaaagatcaccggcagatacgtcacgattctagaaaagatcattactcgccgcctggtgaccattcttgcctttgcgggtttctctattggtatttatgcggtcaatcttgaactaccggcgggcttcattcctggcgaagatcaaggaatgatatacgcgatcattcaaacccctccgggatcgacaatagaaaccaccaacaaggtcgctcgtgaactcgaggaactggctaaaggaatcgaaggagtcaagtccgtttcgtcacttgccggatatgaggttctgaccgagggacgaggatctaacgctggcacctgcatcatcaacctgaaagattgggaagagcgcaagaataccgtgcaggatatcatcaaggagctagaggagaagtccaaggattttggggcgattattgaatttttcgaacctcctcccgtacccggttacggcgcgtcatcaggtctagcgttacgattgcttgacaagtctgacgtcaccgattatcagcaatttgacaagatcacccaagattttctcatgcaattgaaaaagcgcaaggaattaaccggcttgtttactttctatgcagccaattttccccaatatgagcttgtaatagacaacaagcttgcgatgcaaaaacatgtatcgatagccaaagccatggaaaatcttgacatcatgatcgggagcacctatgaacaagggtttattcggttcaacaactttttcaaggtatacgcacaggcacttccagaataccgcagatacccttcagatattctaaattattttgtcaaaaacgaagaaggagaaatggttccttactcgtcattcatgacgatgaaaaaaacccaggggccgaatgaaataacccgttacaatctctacaactctgcggtaattcgggctgctccggcaaaaggatatacttcgggagacgccattgaagccgtcaaagaggtcgcagcagcgactcttccacgtggttacgacatcgcgtgggaaggattgtcgttcgacgaagcggcccgaggcaatgaagcggtcgtcgttttcattgtcgtcatcgtgttcgtttatctcgttctcgcaggccaatatgagagtttcatcttgccattggctgtgctgtgttcgctgcctgcaggcatctttggctcctatttcttactgaaattgttcggactcgccaacgatgtgtattcacaaatagccttgatcatgcttatcgggctattaggaaaaaacgccgtactgatcgtagagtttgccgttcaacggcacggtcaggggttgaccgtcaaggatgccgcaatcgaaggagcaaaagcgcgcttccgtcccattctgatgacttcgtttgcttttatagcaggtctgataccattggttaaagccacgggcgcaggcgctataggaaaccgcaccatcggaaccgcctcaatgggcggaatggtgttcggaaccgtcgtaggcgtcgttttgataccagggctctattacctattcggcaaaatgatcgaaggtaaatccctgatcagaaacgaagataaagaaccttttaccgaaacttaccagtacagcagggacgaccttgatgactaa

SEQ ID NO: 74447 - protein, 1037 aa, Methylococcus capsulatus str. Bath
MGFLSIKSLPVSQFPDIAPPRVTVTLSFPGASADVLVKSSIITIERAINGVPGMKYMVSAATSAGEATIQILFDLGIDPLQAMIDVKTRLDTTMSRLPQLVTLEGVWVQRIQPSMLMYINLFSKDKNADQKFLFNYAYVNVVPEIQRVNGIAQARILGSRQYAMRIWLNPDRMRAYKVSTEEVLKAIEEQSIIGRPGRLGQSTGVTAQSKEYVLVYEGWYNKPEQYEDIIIRANSEGELLRIKDIGTVDLNSEFWNIYSDKDGLPSASIVLNQNYGTNASKVIEDVKKKLKELKETFPEGMDYEINYDVSRFLDASIHKVLHTLMEAFVLVALVTFVFLGDWRSTLIPILSIPVSLIGTFAVIQAFELSINLITLFALVLAIGIVVDDAIVVVEAVHAKMEAEHLSPYQASKKVLGEIGGAIIAITLIMISVFVPISFMSGPVGVFYRQFGITMASAILISALVALSLAPVLCGMILKNTHGQPKKRTPVRIFIDTFNYFFEKITGRYVTILEKIITRRLVTILAFAGFSIGIYAVNLELPAGFIPGEDQGMIYAIIQTPPGSTIETTNKVARELEELAKGIEGVKSVSSLAGYEVLTEGRGSNAGTCIINLKDWEERKNTVQDIIKELEEKSKDFGAIIEFFEPPPVPGYGASSGLALRLLDKSDVTDYQQFDKITQDFLMQLKKRKELTGLFTFYAANFPQYELVIDNKLAMQKHVSIAKAMENLDIMIGSTYEQGFIRFNNFFKVYAQALPEYRRYPSDILNYFVKNEEGEMVPYSSFMTMKKTQGPNEITRYNLYNSAVIRAAPAKGYTSGDAIEAVKEVAAATLPRGYDIAWEGLSFDEAARGNEAVVVFIVVIVFVYLVLAGQYESFILPLAVLCSLPAGIFGSYFLLKLFGLANDVYSQIALIMLIGLLGKNAVLIVEFAVQRHGQGLTVKDAAIEGAKARFRPILMTSFAFIAGLIPLVKATGAGAIGNRTIGTASMGGMVFGTVVGVVLIPGLYYLFGKMIEGKSLIRNEDKEPFTETYQYSRDDLDD

SEQ ID NO: 74448 - DNA, 3117 bp, Photobacterium profundum SS9
  CDS (1)..(3117): transl_table=11
atgcgctttacagatgtttttattaagcgtcctgttctggcggtatcaatcagctttttgattgctttacttggcctgcaagctattttcaaaatgcaggttcgagaataccccgacatgaccaataccgtagtaacggtaacaaccagttactacggtgcaagtgccaaccttattcagggctttattactcagcctttagagcaagcaatagcacaagccgataatatcgactacatgacatcatcctcagtgttaggttcttcaaccatcactgtcacgatgaagttaaacaccgatccaaatggtgcactggctgatattctggcaaaaaccaactcggtacgatctcagttaccaaaagagtctgaagatcccactgtaaccatgtcaactggctctacaactgcggttatgtacatcggttttactagtgatgagttagtatcaagccagattaccgattacttagagcgcgtggtgactccacaactatttaccgtgaatggtgtctcgaaagtagatctgtacggtggtctaaaatatgcgttacgtgtatggctagatccacctaaaatggccgcttacaacctaactgcaactgatgtaatgagcgtattaaatgcgaacaactatcagtctgcgacgggtcaagccgttggtgaattcgttctgtataacggtactgccgatacgcaggtatctaatactgatgaactggctaaattagttgtttcaacgaaaaatggtcaagttattcgcctaggcgatatcgcaaaagtttcattagaaaagagccacgatatttatcgtgcttctgctaatggtgaagaagcggttgttgctgcaatcaacgcagcacctagtgctaatccaatcaatatcgcagcagatgtactgacattattgcctgaattaaaacgcaatatgccaagtaacatcaaaatgaatgtgatgtatgactccaccattgcaatcaatgaatcaattcaagaagtcatcaaaactatcgttgaagcggcattgatcgtactcgtggtcattaccttattcttgggttcattccgcgctgttttgatcccaattatcacgattccactgtcactgattggtgttgctttagtaatgcagatgtttggtttctcatggaacctaatgacactgctcgcaatggtattagcaatcgggctggtcgtagatgatgcgattgttgttctagaaaacgtcgaccgccacataaagttgggtgagccaccgttccgagctgcaatcattggtacgcgtgaaatcgcagtaccggttatcgccatgacgctgacgctgggtgcggtatatgctccgattgcaatgatgggtggtatcactggttcattgtttaaagagttcgccttaacactcgctggtgctgtatttgtctctggtattatcgcacttacattatcgccaatgatgtgttcgaaaatgctaaaagccaatgaaaagccaagtaaattcgaatcaactgtccatagcttcttggaccgtatgactaaccgctatgagaaaatgcttggcggtgtaatgacaatgcgtcctgtggttatcgtatttgcagcgattgtactagtaagtctaccgttattatttaaatttattccaagtgagcttgcaccttctgaagataaaggtgtattgatgatgatgggtaccgccccatcaaacgcaaacttggattacattgaaaataccatgcaagaagttaacaaaatgctgagtgatcagcctgaagttgcttatgcccaagtattttctggtgtaccaagttcaaaccaagcctttggtattgcatcaatggtaccgtggagtgaacgagaagcgagccaagcagaagttgttaagcgcgttactgatttggtgaaagacgttcctgaaatggcagtaacagccttccaaatgcctgaactaccaggagctggttctggcttaccgattcagttcgtaatcacaacaccaaaccagtttgaaagcttatttcaggtaaccactgatattttaactgcagttaaaaacaatccaatgttcgtgtattcggatctggatttgaactatgactctgcaaccatgaaaatcagcattgataaagataaagccggtgcttatggcgtcaccatgcaagatattggtataacgttaagtactatgatggcagacggttatgtaaaccgtattgacctgaatggtcgttcttatgaggtaattcctcaagttgaacgtaaataccgcctaaaccctgaatcaatcaatggctactacgtccgtactgcggatggaaaagcgattcctcttggtagcttaatcacgattgatgttgtggcggaacctcgtgcactgcctcacttcaatcagcttaactctgcaactattggtgctgtacctgcaccaggaacggcaatgggtgatgcgattaactggttccaaacagaagctgtagataaattaccgtcaggctatcagtatgactttatgggtgaagcgcgtcagtacgtaactgaaggtagcgccttatacatgacgtttgcactggcactcgccattatctacttagtactcgcgattcaatttgaatcgttgcgtgatccgctggttattctagtatctgttccacttgcgatttgtggcgcattaatcgccctctcgtggggtgctgcatcaatgaacatctactctcaggtcggattaattaccctcataggtttgattaccaagcacggtattcttatctgtgaagtcgccaaagaagagcagttgctgcatcagaaaaatcgcatggaagcggttacggaagcagcgaaggttcgtcttcgcccaatcctaatgactaccgctgcgatgatcgcaggtcttatcccactgctttatgcttcgggtgcaggtgctgcacaacgctttagtattggtatcgtaattgtttcaggtctagcaatcggtacaatctttaccttgttcgtactacctgtgatttatacttacttagcaagtgttcacaagcctttacctatctttatggaggataaggatttggaaaagttaaagcgggctgacgaagcgagaaacgctttgaaagctcgtgattgctaa

SEQ ID NO: 74449 - protein, 1038 aa, Photobacterium profundum SS9
MRFTDVFIKRPVLAVSISFLIALLGLQAIFKMQVREYPDMTNTVVTVTTSYYGASANLIQGFITQPLEQAIAQADNIDYMTSSSVLGSSTITVTMKLNTDPNGALADILAKTNSVRSQLPKESEDPTVTMSTGSTTAVMYIGFTSDELVSSQITDYLERVVTPQLFTVNGVSKVDLYGGLKYALRVWLDPPKMAAYNLTATDVMSVLNANNYQSATGQAVGEFVLYNGTADTQVSNTDELAKLVVSTKNGQVIRLGDIAKVSLEKSHDIYRASANGEEAVVAAINAAPSANPINIAADVLTLLPELKRNMPSNIKMNVMYDSTIAINESIQEVIKTIVEAALIVLVVITLFLGSFRAVLIPIITIPLSLIGVALVMQMFGFSWNLMTLLAMVLAIGLVVDDAIVVLENVDRHIKLGEPPFRAAIIGTREIAVPVIAMTLTLGAVYAPIAMMGGITGSLFKEFALTLAGAVFVSGIIALTLSPMMCSKMLKANEKPSKFESTVHSFLDRMTNRYEKMLGGVMTMRPVVIVFAAIVLVSLPLLFKFIPSELAPSEDKGVLMMMGTAPSNANLDYIENTMQEVNKMLSDQPEVAYAQVFSGVPSSNQAFGIASMVPWSEREASQAEVVKRVTDLVKDVPEMAVTAFQMPELPGAGSGLPIQFVITTPNQFESLFQVTTDILTAVKNNPMFVYSDLDLNYDSATMKISIDKDKAGAYGVTMQDIGITLSTMMADGYVNRIDLNGRSYEVIPQVERKYRLNPESINGYYVRTADGKAIPLGSLITIDVVAEPRALPHFNQLNSATIGAVPAPGTAMGDAINWFQTEAVDKLPSGYQYDFMGEARQYVTEGSALYMTFALALAIIYLVLAIQFESLRDPLVILVSVPLAICGALIALSWGAASMNIYSQVGLITLIGLITKHGILICEVAKEEQLLHQKNRMEAVTEAAKVRLRPILMTTAAMIAGLIPLLYASGAGAAQRFSIGIVIVSGLAIGTIFTLFVLPVIYTYLASVHKPLPIFMEDKDLEKLKRADEARNALKARDC

SEQ ID NO: 74450 - DNA, 3132 bp, Photobacterium profundum SS9
  CDS (1)..(3132): transl_table=11
atgtggttatctgatgtctctgttaaacgacctgtggtcgcaatagtactgagcttactattatgtgtttttggtatggtttctttttctaagctagctgtacgtgaaatgcctgatgtggaaaaccctgttgttacggtaatgacgaattacagtggggcatcggcgacggtcatggaaagccaagtgaccagcccaattgaagatgaactgtctggtattagtggcattgataatattacgtcggtaacccgaaatggtatgtctcgtattactgttgaattttcaatggactgggatttaactgaaggggtaagtgatatccgtgatgcggtagcacgtgctaatcgtcgtctaccggatgaagctgatgatcctgttgtgtcgaaagataatggttcgggtgagcccgcgatctatatcaacctgacatcttcagagatggatcggactcaactgaccgattacgctcaacgggtattggaagatcgctttagcttaattaatggtgtgagttcggtaagcttatcgggggctttatacaaagtcatgtacgttaagttaaaaccagcattaatggcggggcgtggggttaccaccaaagatattgtcgatacacttcaagatgaaaacattgaactgccaggaggtgaagtccgtaacgatgcgacagttatgtcggttagaacggcgcgtttatatctttcacctgaagattttgattacttggtggtgcgaacagcggatgacggtacccctgtctatttgaaagatgtcgctgatattgatgttggcgctgaaaatgaaaattccacctttaaaagtaatggtgttgcgaacttaagtttaggtatcgtgaccatgtctgatgcgaatcctttgaatgtcgccaaagatgtgcatgcggaagtggatcggatgcagcaattcattcctgccggtacgacattagccgtcgattatgatgcaacagtatttatcgatcgctctatttcagaagtctatagcactctattgatcactggggcattggtgatcttggtcttgtacatctttatcggccaagcaagagcgacgttgatccctgcggtaaccgtacctgtctctttgatttcagcttttattgcagcgtactttttgggtttttcgatcaatctattaaccttgatggcattgattctatcgattggtttggtggtcgatgatgccatcgtggtggttgaaaatatgttccatcatctcgaaaaaggggaatcgccattactcgcggcttataaagggacacgtgaagttggctttgctgtcgtcgcgaccactgcggtattggtgatggttttcttacctatttcctttatggaaggcatggttgggcgtctgtttactgagttctctgtgttgctagcgatgtcggttattttctcatccattatcgcgttaacgctgacccctgtattgggcagtaaaatgctaaaagtcaacgtgaaacccggtaaattcaacctgtggattgatagccagtttagcaaactggaaaatggttaccgcaacgtggtcgcaatgtcggtaaagcgccgttactttgccccgtttattgttgttgggtgtatggctgcgagttatggcttaatgcaaattgtacccgcgcaattagcaccacaagaagatcgcggtgtgctgttcgcctttgttaaaggggctgaaggcaccagttataaccgtatgattggtaatatggacgaagttgaacaacgtttattacccatgctaggtcaaggcatgctgaaatcggtgagtatacaaactccggcttttggtgggcgagcgggcgatcagactggctttgttatcatgcagcttgaagattgggctgatcgtgatgttacagctcagcaagcgctgggtcagatcagtaaagcattacaaggtattcccgatgtttgggtacgccctatgatgccgggtttccgtggtggttcttctgagcctatccagtttgtattgggaggctctgattatgaagaacttttccaatgggccacaaaactgcaaaccattgccgaagatagcccaataatggatggtatcgatcttgattacgcagaaaccacgccagaattggtggtgactgtgaaccgtcaacgagctgctgaattgggtattccggcggcagatattgctgaaaccttagaaatcatgctgggagggcgtagcgaaaccacctacgttgatcgtggcgaggaatatgatgtttatcttcgtggcgatgaaaatagttttaatagctctgccgatcttagccaaatttatctgcgctcaaagactggtcagttagttacgctcgatacagtgactaaaattgaggaaatagcgtcacctcaacgactcagtcataccgataagcaaaagtcgatcacgctgaaaggtaacctgaatgatggttatactttgggaaatgctctcgattttcttgatcaacaagcgattgatattttaccgagtgatatcacgattaactattcaggtgaatcgaaagatttccgtgaaaaccaaagtgatatctttatggtctttggtttggcattactgattgcgtatttggtattggcagcccagtttgaaagctttattaatcctcttgttgtgatgttaacggtgccaatggggatctttggcggcatggcagggttatggataatggggcaagggcttaatatatatagccagataggcatgatcatgctgattggcatggtaaccaaaaacggtattttgattgtcgaatttgctaaccagttacgtgataaaggcattgaatttgagcaagcgatagtggatgcatcagtacgacgtttacgtcctattttgatgacggcattcactactttgtttggtgctattccacttatcatgtcgaccggtgctggttcagaaagccgaatggctgtgggtactgtggtgttctttggtatggcatttgccacactggtcacgctattggttatccctgcgatgtaccgtttgttatgtgctaaaacaacctcaccgggtcatattgccgctcagctggaaaaagcgatgcagcaagattatgttggccgaagtacgcatggtgaattgccgcctagctcatag

SEQ ID NO: 74451 - protein, 1043 aa, Photobacterium profundum SS9
MWLSDVSVKRPVVAIVLSLLLCVFGMVSFSKLAVREMPDVENPVVTVMTNYSGASATVMESQVTSPIEDELSGISGIDNITSVTRNGMSRITVEFSMDWDLTEGVSDIRDAVARANRRLPDEADDPVVSKDNGSGEPAIYINLTSSEMDRTQLTDYAQRVLEDRFSLINGVSSVSLSGALYKVMYVKLKPALMAGRGVTTKDIVDTLQDENIELPGGEVRNDATVMSVRTARLYLSPEDFDYLVVRTADDGTPVYLKDVADIDVGAENENSTFKSNGVANLSLGIVTMSDANPLNVAKDVHAEVDRMQQFIPAGTTLAVDYDATVFIDRSISEVYSTLLITGALVILVLYIFIGQARATLIPAVTVPVSLISAFIAAYFLGFSINLLTLMALILSIGLVVDDAIVVVENMFHHLEKGESPLLAAYKGTREVGFAVVATTAVLVMVFLPISFMEGMVGRLFTEFSVLLAMSVIFSSIIALTLTPVLGSKMLKVNVKPGKFNLWIDSQFSKLENGYRNVVAMSVKRRYFAPFIVVGCMAASYGLMQIVPAQLAPQEDRGVLFAFVKGAEGTSYNRMIGNMDEVEQRLLPMLGQGMLKSVSIQTPAFGGRAGDQTGFVIMQLEDWADRDVTAQQALGQISKALQGIPDVWVRPMMPGFRGGSSEPIQFVLGGSDYEELFQWATKLQTIAEDSPIMDGIDLDYAETTPELVVTVNRQRAAELGIPAADIAETLEIMLGGRSETTYVDRGEEYDVYLRGDENSFNSSADLSQIYLRSKTGQLVTLDTVTKIEEIASPQRLSHTDKQKSITLKGNLNDGYTLGNALDFLDQQAIDILPSDITINYSGESKDFRENQSDIFMVFGLALLIAYLVLAAQFESFINPLVVMLTVPMGIFGGMAGLWIMGQGLNIYSQIGMIMLIGMVTKNGILIVEFANQLRDKGIEFEQAIVDASVRRLRPILMTAFTTLFGAIPLIMSTGAGSESRMAVGTVVFFGMAFATLVTLLVIPAMYRLLCAKTTSPGHIAAQLEKAMQQDYVGRSTHGELPPSS

SEQ ID NO: 74452 - DNA, 3156 bp, Photobacterium profundum SS9
  CDS (1)..(3156): transl_table=11
atgctaagtcgtttttttatccaacgtccaaaatttgcgttggtgatatctattattctaacgcttgcaggggcaattgcggctttaaacctgccagttgccgaatacccgaaaatcagtccaccttcggttggtgtgactgcttattattcaggtgcaagtgctgaggttgttgaagaggcaattgcagacccgattgaagcatcggtgaatggcgtagaaaacatgatttacatgtcttctaaaagtgctaacgatggttcatacagtctgaatgtgacttttgatatcggtactgatccagatatggctcaggttaacgtacaaaaccgtatttcccagattgaatctaagcttccggctgaagttcgtatggtgggtgtaacggttaagaaacgttctcctgatctgttgatggtgctgaacttctattcacctgatggtaagtatgacgacaaattcttaaataactacattaacttaaatgtaaaagatcagcttgctcgtgtgaaagggatcagtgaggtcaatgttctcggtggtggcgaatatgcgatgcgtgtttggcttaaccctgagaagatggcaaaccttgggctaacaactgccgatgtgaatgcagcattgactgaacaaaatgttcaggttgctgcgggtcaggtaggcgcaccgccatataataatgcacaagaagtccagtttaaccttgtaacaaaaggacggttagagacggttgaagaattcgaagacgttgtgcttcgtgctaataacgatggttcgattgtattcttaaaagacgttgcgcgcgtagagctaggtaagaaattctacaccgttaatggcatgttccgtgaccaacctgctgccattgttacgctaaacctacagtctgatgcaaacgcattggaaagtggtgacgcggtaatgagtttactggatggaatgaataaaaactttcctgaaggtatggcatacgaaacaagttatgacacaactttatttgttgctgaatcgattaaaggggtagttgttactctgattcaagccattatattggttatcgctgttacttatatgttcttaggtagtatgcgatcgacattaatccctgttgtggctataccggtatcgttgattggtacgtttgccattatgttagcagctgggtttacgataaataccgtcacgctatttggcttaatccttgccattggtattgtggtcgatgatgccatcttggttattgagaatgttgataccaatatggcccgagacccaagtctgtcacctcgtcaagcaaccttgattgcgatgaaagaggtaacgggtccaattattacctccacaatggttctgttggctgtatttataccggttgcaatgcttcctggtattaccggtattatgtaccgtcagttcgcattaaccatttgtatttctgttgtaatctcgtcaattaacgcattaacgctttcacctgccctatgttctttagtgctgaaacaaggtgatggtaataagtcgcgttggtttcaaacgttcaacaaaggtcttgataaagttacgttgaaatatggttcgattgcaggctacctcgttcgcaaatctgtactgttagtcacattctttattttggctgtgggggcggtaacctacttatcaaagacgacatcaaccgcgtttgttccgactgaagataagggcattttgcttgttaacgttcagttgccagattctgcctcgctgtctcgtaccgaagaagcaacgattaaacttcaggatattcttgcagaagagccgggtattgaaggtattaccgttgcgaatggttatgcgttcttaacgggtgccgctgcatcaaatggtgcatctctatttattaagttaaaagaatggggcgtacgaaatgaaatggaaggtgaacattcatcttttgctatctcaaatcgtattaatgctcgctctgcgacagagctacctgaagcgatagtattcgcgatgggagccccagcagtgccaggaatgggggctgcatcaggttttgagtttgttcttgaagatactttaggtcgaagccgtaccgatttggcgaatgtcatgggtgagatgattcagaaagcgaatcagcaacctgaaatccaatttaccttcagtactttccgtgcaaatgtacctcacttctatgttgatatagatcgtgtgaaagcgaagcaactaggtataccgctaactgatatttttcagacgctacagggtaacttaggttccatgtatgtgaatgactttactttatacggtaaaaacttccgtgtaacggtacaggcagacagtgaataccgagataacctcgatacacttgagcgttttcatgtgcgttcagcctctggcgatatgattccattgagtacactcacttctattgagcaggtgttcgaaccggatgtcgcgtggcgttataacatgtatcgttcggctgtcattcaaggtagtcctgcaccgggctactcaagtggtgatgcgattgctgcgatggaacgtgtagcggcagacgttttaccacaaggctatcagtatgaatggacaggtatggcctaccaagaagtgaaagcgggtaaccaagcgatctatgcatttgcacttgctctaatcttcatttacttgttcctggttgcgcagtacgaaagctggagtatacctcttgctatcattttggttgttcctgttgcgacattggggtcattcttggctcttgccatgacgggtacaccgttgaacctgtatgctcagattggtttggttctcttgatagcactcgctgcgaagaatgcgatattgattgtagaattcgccaaaattgagcgtgaagaaaatgagctggatatcgaaaaggcagcggtgcgtggtggtaaattacgtttccgtgcggtgaacatgacatcgtggtcgtttatcttgggtattttgccattaatctttgcatctggtgcgggccatattagtcagaactcgttaggtatttccttaacaggtggtctactttgtgtgctacttgccggtactattttgatcccaggcttcttttctctggttcaaaaacgccgagagaaattccatggtggttcaacgaagcttattgtactagaagatgaaaaatag

SEQ ID NO: 74453 - protein, 1051 aa, Photobacterium profundum SS9
MLSRFFIQRPKFALVISIILTLAGAIAALNLPVAEYPKISPPSVGVTAYYSGASAEVVEEAIADPIEASVNGVENMIYMSSKSANDGSYSLNVTFDIGTDPDMAQVNVQNRISQIESKLPAEVRMVGVTVKKRSPDLLMVLNFYSPDGKYDDKFLNNYINLNVKDQLARVKGISEVNVLGGGEYAMRVWLNPEKMANLGLTTADVNAALTEQNVQVAAGQVGAPPYNNAQEVQFNLVTKGRLETVEEFEDVVLRANNDGSIVFLKDVARVELGKKFYTVNGMFRDQPAAIVTLNLQSDANALESGDAVMSLLDGMNKNFPEGMAYETSYDTTLFVAESIKGVVVTLIQAIILVIAVTYMFLGSMRSTLIPVVAIPVSLIGTFAIMLAAGFTINTVTLFGLILAIGIVVDDAILVIENVDTNMARDPSLSPRQATLIAMKEVTGPIITSTMVLLAVFIPVAMLPGITGIMYRQFALTICISVVISSINALTLSPALCSLVLKQGDGNKSRWFQTFNKGLDKVTLKYGSIAGYLVRKSVLLVTFFILAVGAVTYLSKTTSTAFVPTEDKGILLVNVQLPDSASLSRTEEATIKLQDILAEEPGIEGITVANGYAFLTGAAASNGASLFIKLKEWGVRNEMEGEHSSFAISNRINARSATELPEAIVFAMGAPAVPGMGAASGFEFVLEDTLGRSRTDLANVMGEMIQKANQQPEIQFTFSTFRANVPHFYVDIDRVKAKQLGIPLTDIFQTLQGNLGSMYVNDFTLYGKNFRVTVQADSEYRDNLDTLERFHVRSASGDMIPLSTLTSIEQVFEPDVAWRYNMYRSAVIQGSPAPGYSSGDAIAAMERVAADVLPQGYQYEWTGMAYQEVKAGNQAIYAFALALIFIYLFLVAQYESWSIPLAIILVVPVATLGSFLALAMTGTPLNLYAQIGLVLLIALAAKNAILIVEFAKIEREENELDIEKAAVRGGKLRFRAVNMTSWSFILGILPLIFASGAGHISQNSLGISLTGGLLCVLLAGTILIPGFFSLVQKRREKFHGGSTKLIVLEDEK

SEQ ID NO: 74454 - DNA, 3135 bp, Photobacterium profundum SS9
  CDS (1)..(3135): transl_table=11
atgaaatttagccacttttttattactcgacctatttttgcctccgtgctgtcaattcttatattgattgcaggtggtttgtctttgcctaatctacctataagtgaatacccagaagtcgttccgcctactgttgttgtgcgtactgcctaccctggcgcaaacccaaaagtaatagccgaaacggtttctgctccacttgaggaagagatcaatggcgtcgaagacatgctttacatgttttctcaaggcacgtccgatggccgaatgactctgaccattacgtttgccttaggcaccgaccttgataaagcccaagtacaggttcagaaccgcgtaagtagtgccctgccacgcctgccgcaagaagttcagcgcttgggggtgaccactgagaaagcgtctccagacctaaccatggttgtgcatttattttcatccgatggacaaagaacgagtcaatatttagcaaactatgctgatatttacgttaaaaatcagctcttacgcctcggtggcgtgggggatgttcagctgtttggtggtgataaatactcgattcgtgtttggctaaatccggatgaaattgcatcacgcaacttaagtacgcaagacgtattaaatgctattcgacaacagaatactcaggtctcagcggggtcacttggtgcccaaccagcaagctcagacaatgaatttgagtaccttctcaatgtcaaaggccgcttaggcagcctagaagagtttgagcagatcattgtaagagtgacaccagaaggtcaaatcactcgcttgaaagaccttgctcgtgtcgaactcggccaagagagctacgcattaagagcaacgctaaatggcaaggaagcggtcgccattcccgtattccagcgccctggagcgaatgcacttgagctgtctagtcaagtgcgagacctaatggcagggctttctaataacttccctgacggtgttgaatataaaatcgcctatgatccgaccgtattcgttgacagttcgattgatgccgttattcacacattagtcgaagcgattggtttggtggtgattgtcgtgattttgtttttgcaaacatggcgcgcttctttgatcccacttatcgctgtacccgtttcattaatcggtaccttcgctgtcatgcagctactgggcgtatcgatcaatacgctatctctattcggaatggtgcttgcgatcggtattgtcgtggacgacgctatcgtggtggttgaaaatgttgaacgtaatattgccaatggtctcagccctgtagatgcgacgcgtcaagccatgaacgaagtaactggccctatcattgccatcgcacttgttttgtgtgctgttttcataccaacggctttcatcagcggtctatccgggcaattctataaacagtttgctttaaccattacgatatcaacgattatttcagcgtttaactcactgacattgtctcctgccctttccgctttattattaaaaggacacgacgaaaagccggatctctttacacgtctgcttaatcgactgtttggccgatggctgtttacgccatttaacaaagtctttgataaaggtgcatctggctacgaaaaagtcgtcaaaaaattgattcgattttcggttatcgtcggtgtgatttatcttggtcttcttgttgcaacaggtaagatatacagctctgttcctggtggttttattcctgctcaagacaaacagtatctagttgctattgctcaactacccgatgcttcgagccttgatagaacggctgatgtcatcaaggagatggagaatatcgcattagaaacagaaggtgttcaaaataccatcgccttcccaggcctttctgttaatggatttgtaaatgcctctaacagcggtatcgtcttcattaacctggatgattttgaaaatcgtttatcgcctgaattatcagcgtctcaagttgccaacactttgaacggaaagttcagcgtgattggggaaggctttgttgctgtatttccacctccaccggtacaaggtttaggtacaacaggcggattcaagctgtatgtggaagatcgtgagaacgcagggtttgaacgcttatttagcaatctacaaactgttgttatggcagcgaaccaacgtcctgaacttgcgggtgtctattctagctttagaattcaagtacctcagtacgacattgatatagaccgcgagcaagtattgttaaaacaagtaccgatcaatagcgtatttgacactttgcaaactttcttgggctcaacctacgtcaatgatacgaatatgtttggtaaaacatatcaggtcaatgcacaagcagcacctgagtaccgtgtaaattctgaacaaatattgtcactcaaagtgaaaaacatacatggtgatatggtccctcttagtacgttcgtctcaatcgaacctactactggccccgatagagtgatgcgttacaacagctatgtgagtgccgatgttaatggtgctgcagctccaggatacagttctgatcaagcgcaagccgctatgatcgaagttctaaagacacaccttcaggacgggatgcactacgaatggactgacgtggtatatcagcaaatcatcgcaggaaacacgatgatttatatattccctctggtcattattttggtgtttctagtgctcgctgcgcaatatgaaagtttgaagctgccaatggctatcatcctaattgttccaatgacaatcttttcggctgtaggcggagtttggttgacgaacggtgacaataatatctttaccaagattgctctcatcgtgttaatagcattagcaacaaaaaatgccattttaatggtagagtttgcccgagagaaaaccaatgaaggaattagccacttagatgcaattttgatcgcttgtagattacgattacgtccgatcttgatgacatctatcgcctttactgctggagttgtccctctcgtcgtcgcgactggggctggttcagaaatgcgtcaagccatgggtgttgccgttatgtatggcatggtgggggttactttctttggcttattgttgactccggtcttttatatggcaatgacatataagaagaaaaaatcgtga

SEQ ID NO: 74455 - protein, 1044 aa, Photobacterium profundum SS9
MKFSHFFITRPIFASVLSILILIAGGLSLPNLPISEYPEVVPPTVVVRTAYPGANPKVIAETVSAPLEEEINGVEDMLYMFSQGTSDGRMTLTITFALGTDLDKAQVQVQNRVSSALPRLPQEVQRLGVTTEKASPDLTMVVHLFSSDGQRTSQYLANYADIYVKNQLLRLGGVGDVQLFGGDKYSIRVWLNPDEIASRNLSTQDVLNAIRQQNTQVSAGSLGAQPASSDNEFEYLLNVKGRLGSLEEFEQIIVRVTPEGQITRLKDLARVELGQESYALRATLNGKEAVAIPVFQRPGANALELSSQVRDLMAGLSNNFPDGVEYKIAYDPTVFVDSSIDAVIHTLVEAIGLVVIVVILFLQTWRASLIPLIAVPVSLIGTFAVMQLLGVSINTLSLFGMVLAIGIVVDDAIVVVENVERNIANGLSPVDATRQAMNEVTGPIIAIALVLCAVFIPTAFISGLSGQFYKQFALTITISTIISAFNSLTLSPALSALLLKGHDEKPDLFTRLLNRLFGRWLFTPFNKVFDKGASGYEKVVKKLIRFSVIVGVIYLGLLVATGKIYSSVPGGFIPAQDKQYLVAIAQLPDASSLDRTADVIKEMENIALETEGVQNTIAFPGLSVNGFVNASNSGIVFINLDDFENRLSPELSASQVANTLNGKFSVIGEGFVAVFPPPPVQGLGTTGGFKLYVEDRENAGFERLFSNLQTVVMAANQRPELAGVYSSFRIQVPQYDIDIDREQVLLKQVPINSVFDTLQTFLGSTYVNDTNMFGKTYQVNAQAAPEYRVNSEQILSLKVKNIHGDMVPLSTFVSIEPTTGPDRVMRYNSYVSADVNGAAAPGYSSDQAQAAMIEVLKTHLQDGMHYEWTDVVYQQIIAGNTMIYIFPLVIILVFLVLAAQYESLKLPMAIILIVPMTIFSAVGGVWLTNGDNNIFTKIALIVLIALATKNAILMVEFAREKTNEGISHLDAILIACRLRLRPILMTSIAFTAGVVPLVVATGAGSEMRQAMGVAVMYGMVGVTFFGLLLTPVFYMAMTYKKKKS

SEQ ID NO: 74456 - DNA, 3081 bp, Salmonella enterica subsp. enterica serovar Paratypi A str. ATCC
  CDS (1)..(3081): transl_table=11
atgcgctttttcgcccttttcatctaccgcccggtcgccaccattttgattgccgccgccattacgctgtgcggcattctgggctttcgtctgctgccggtcgccccgctgccgcaggtcgatttcccggtgattatggttagcgcctcgctgccgggcgcctcgccggaaaccatggcttcgtcggtggcgacgccgttggaacgttctttgggacgcattgcaggcgtcaatgaaatgacttccagcagctcgctcggcagtacgcgcattattctcgaatttaatttcgatcgtgatattaacggcgcggcgcgcgatgtgcaggccgccattaacgccgcgcaaagcttgttgccaggcggaatgcccagccgcccgacttatcgcaaggccaacccgtccgacgcgccgattatgattttaacgctcacctcggagagctggtcacaaggcaaactgtatgatttcgcctctactcaactggcgcaaaccatcgcgcaaattgacggcgtcggcgatgttgacgtcggcggcagctccctgcccgcagtacgtgtaggcttaaacccgcaggcgctctttaaccagggcgtctcgctggatgaggtccgcgaagcgatcgacagcgccaacgtacgccgaccgcaaggcgcaattgaagatagcgtccaccgctggcaaatccagaccaacgacgaactgaaaaccgccgccgaataccagccgctgattattcactataacaacggcgcggcggtacgcctgggcgacgtcgccagcgtcaccgactcggtgcaggatgtccgtaacgccgggatgacgaacgctaaacccgctattttgttgatgatccgcaagttgccggaggccaacattattcagacggtcgacggcatccgggcaaaactgccggaactgcgggcaatgatccccgccgctatcgatttacaaatcgcccaggatcgttcgccgacaattcgcgcatcgctgcaagaggtagaagagacgctggctatctctgtcgcgctggtgatcctggtggtgtttttattcctgcgttccgggcgcgccacgctaatccccgccgtcgccgttcccgtttcgctcatcggcaccttcgccgccatgtatctgtgcggcttcagcctcaacaatctgtcgctgatggcgctgactatcgcgaccggatttgtcgttgatgatgccattgtggtgctggaaaatatcgcccgccatctggaggcgggaatgaaacctttgcaggcggcattacagggtacgcgggaagtcgggtttacggtcatctccatgagtctgtcgctggtggcggtatttctgccgctgctgttaatgggcggcctgccaggacgattattacgggaattcgccgttaccctctcggtggcgattggcatttcgctggtggtctcgctcacactgacgccgatgatgtgcggctggatgcttaaatcaagcaaaccgcgcacccaaccgcgtaaacggggcgttggccgtttgctggtcgccttgcaacagggttacggcacgtcgttaaaatgggtgcttaaccatacgcgtcttgtcggtgtggtttttcttggcaccgttgcgctgaacatctggctttatatcgccatccctaaaacattctttccggagcaggacactggcgtgttgatgggcggtattcaggctgaccagagcatctctttccaggccatgcgcggcaagctgcaggattttatgaaaattattcgcgacgatccggcggtgaataatgtcactggttttaccggcggctcgcgggtgaatagcggcatgatgtttattacgctgaagccgcgcggcgaacgcaaagagacggcgcagcaaatcattgatcgactgcgggtcaaactggcaaaagaacccggcgccaggctgtttctgatggcggtacaggatattcgcgtcggcgggcggcaggctaacgccagttaccaatatacattgctgtctgactccctgccggcgctgcgcgagtgggagccgaaaatacgcaaagcgctctcggccctgccgcaactggcggacgtaaactccgaccagcaggataacggcgcggagatgaaccttatctacgaccgcgacaccatgtcacggctgggcattgatgttcaggccgcaaacagtctgttaaataatactttcggccagcggcaaatttccaccatttatcagccgatgaaccagtataaagtggtgatggaagtcgatccgcgctatacccaggatatcagcgcgctggagaaaatgttcgttatcaaccgtgacggaaaagcgatccccctctcttatttcgcccaatggcggcccgccaatgcgccgctgtcggtgaaccatcagggactttccgcggcgtccacgattgcctttaacctgccgaccggcacatcgttatcgcaggcgacggaggccattaatcgcaccatgacgcagcttggcgtcccctcgacggtacgcggcagtttttccggaacggcgcaagtcttccagcagaccatgaattcacagcttattttgatagtggcggcgatcgctaccgtctacattgtgctggagatactgtacgaaagctacgtccatccgctgaccattctctctactctgccatcggcgagcgttggggcgcttctggcgctggaactcttcaatgcccctttcagcctaatcgccctgatagggatcatgctattaattggcattgtgaagaaaaacgccattatgatggtcgattttgcgcttgaagcgcaacgaagcggcggcctgacgccggaacaagccattttccaggcctgcttgttacgcttccgtccaataatgatgaccacgctggcggcgctgttcggcgcactgccattggtgttatctggcggagacggttcggaattacggcagccgctggggataaccattgtcggcggtttggtcatgagccagctcctgacgctctataccacgccggtggtgtacctctttttcgaccgcctgcggctgcgtttttcgcgtaaaaatagcaaaccggtagtagagatatga

SEQ ID NO: 74457 - protein, 1026 aa, Salmonella enterica subsp. enterica serovar Paratypi A str. ATCC
MRFFALFIYRPVATILIAAAITLCGILGFRLLPVAPLPQVDFPVIMVSASLPGASPETMASSVATPLERSLGRIAGVNEMTSSSSLGSTRIILEFNFDRDINGAARDVQAAINAAQSLLPGGMPSRPTYRKANPSDAPIMILTLTSESWSQGKLYDFASTQLAQTIAQIDGVGDVDVGGSSLPAVRVGLNPQALFNQGVSLDEVREAIDSANVRRPQGAIEDSVHRWQIQTNDELKTAAEYQPLIIHYNNGAAVRLGDVASVTDSVQDVRNAGMTNAKPAILLMIRKLPEANIIQTVDGIRAKLPELRAMIPAAIDLQIAQDRSPTIRASLQEVEETLAISVALVILVVFLFLRSGRATLIPAVAVPVSLIGTFAAMYLCGFSLNNLSLMALTIATGFVVDDAIVVLENIARHLEAGMKPLQAALQGTREVGFTVISMSLSLVAVFLPLLLMGGLPGRLLREFAVTLSVAIGISLVVSLTLTPMMCGWMLKSSKPRTQPRKRGVGRLLVALQQGYGTSLKWVLNHTRLVGVVFLGTVALNIWLYIAIPKTFFPEQDTGVLMGGIQADQSISFQAMRGKLQDFMKIIRDDPAVNNVTGFTGGSRVNSGMMFITLKPRGERKETAQQIIDRLRVKLAKEPGARLFLMAVQDIRVGGRQANASYQYTLLSDSLPALREWEPKIRKALSALPQLADVNSDQQDNGAEMNLIYDRDTMSRLGIDVQAANSLLNNTFGQRQISTIYQPMNQYKVVMEVDPRYTQDISALEKMFVINRDGKAIPLSYFAQWRPANAPLSVNHQGLSAASTIAFNLPTGTSLSQATEAINRTMTQLGVPSTVRGSFSGTAQVFQQTMNSQLILIVAAIATVYIVLEILYESYVHPLTILSTLPSASVGALLALELFNAPFSLIALIGIMLLIGIVKKNAIMMVDFALEAQRSGGLTPEQAIFQACLLRFRPIMMTTLAALFGALPLVLSGGDGSELRQPLGITIVGGLVMSQLLTLYTTPVVYLFFDRLRLRFSRKNSKPVVEI

SEQ ID NO: 74458 - DNA, 3108 bp, Idiomarina loihiensis L2TR
  CDS (1)..(3108): transl_table=11
atgtcagatcaacaactgaataatcatccggattctaacgatttaccttcggtatcaattcgccgcccggtactgattgttgtcctgaatgttcttatcgccattgccggtttggccgcgttaatgggcgtagaagtacgggagttaccggatgtcgaccggcctgttgtcggcgttagcgcaacacttccaggcggtgcaccagaaacggtggacgcagaagtaaccagtattctggaaggtgcggcggctcgtgtttctggcgtggaatctatccagtcttcgagtgaagaaaatagcgcgcgtatttcaattgaattccgtcccggagttgacttagatgtggtggccgcggaggttcgtgaggcggttaatcaggtgcgtcgggaattacccgatgacgtcgaacaaattaacgtgcaaaaagctgacagcgatgcgcgttcggtgttggatattgccgttagcagcgacagtttgactcaggaagagctgactcgccgactggaaactgatttgtcgcctgaatttctggcaattaacggagtagcggatgtccggttaaatggtgaccgggaacgagtattacgcgttgacctggaccctcttaaattggtgagctttggcttatctgtaacggacgtagctgacgcgctgcgtttagcgccttttgatgtgcctgccggtagtttgcgttcaaccgatcagcggctaattgtccgggccgatgccactgcgattaccgaagatcaggttgagaatattatagtcagtggcgatacccgtattggagatgttgcacaagcttattttgcgcctgcagacgcaaacagctttgttcgcctggacggcaaaccggttgttggtcttggtgttatacgccaggctggttccaatactatagagatttctgatcaggcgttagcggtacttgaacgcctgcgtgagcgttttcctgatatggaaatgcgtattaccaatgacgatgcgcagtttattcgcaagtcagtagctgaagtggtgacgacccttgccattaccattgttttggttgtcgcaaccttgtgggtattcattggttcattccgtgcgactattattccggcattctctattcctgttgcattgttcggtgctattgctgctatttggttgatgggcttttccattaatattctgaccttgctggctctggtgttggcaacaggcctgatagttgatgatgccattgtggttaccgagaatattcaacgacgccgtagcatggggcttggtagccgtgctgctgccgtattagccacccgcgaagtgttttttgcggtagtggcaacgacggccgtgttggttgcagtgtttgtaccaattgcgtttttaccttcaacagccgggcgtttattccgcgagtttggcggtgtgcttgcggctgcagtggtcatttcttcttttgttgctttgtctctggtaccggcttttactgctcgtctgccgaaatcagccgggcagaataaccgatttgcgggaatcggcaacgcctttaagcggttctataaacgaacgttgcacaaagccctcgattttagctgggttgtggtggttttgtctttgttatctgctggcggcggcgcgctgctttacaatgaaattgacagcgagcttatgcccaatgaagaccgtggggcggtccgggtattttcgcgcgggcctgacggggttggccttaaatttatggatcgtcaggctcgtaagcttgaagaagtgctgctggagtataaagaaagcggtgacatagagtcgatttatactgttgttggtcagtgggacccgaacctggttttcattacggcaaacctcaaaccctgggaagaacgagatattagccaacaggaaattattaataatattcgggaaccgttgagtcaggttccaggcgcaccgggacaggcctttggtgacaacagcctgaacttgcgaggccaggggggcggcctggaaatggctattaccggcgaaaattatgacgagatctttaaggttgctcgtgaatttaccgccattattaaagaacgtatgcctgatttgggtaacattaatgtctcctatcaaccgacgcagccgcagttgagggtcaaaattgaccgtcgtcgagccgcggagctgggggtatcattaaatgatatatccgcaactttacgtgctgccattaacggcgatgacgtagccgacttaaacgtgggagaccagcaaattccggttatgctgcgcacccgtaataatttaattcagtcgccgcaggacatgcagaacctttatgtatcgtcaagcagcggtgatctggttcctatttccagtgtttccgaaattattgaagaaggcgtgtcagcagagcttgagcgtcaagcacagcggcgagcgatagaagtagatgtacaattgcctgatgacatgcctatgtcagacgttgttgaccagttgcgtactatagccggagaagttttgcctgatagtatggggttggtctttttaggggaagccgcaacatttgaagacacctcgcaggaaattgctatgacttatattctggcgttcctgattgttctgctggtcctcgccgctcagtttgagtcattaaacagtgcagtggtcgttatgctgaccgtgccttttggcattgccgcagctatttacgccttattcctgaccggcacttcactgaacatttattctcaaattggattggtgatgctgataggtctgctggcgaaaaactctgtattgctggttgaatttgctgaccagttgcgggaccggggattagaggttcgtgaggcgatagaagaggcgtcattgatacgtttacggcctattatgatgacactggtatccacggttctgggtggcttaccgcttattctgtcttctggtgcgggcgctgaagcacgtaattcaattggttgggttgtatttggtggtctaggactggcaactctgtttacgctttacctgaccccagtactctatttgtggttagcgcgtttcaccaagccgcgtgccgatgaagccgctcgtcttgaaagtgaaatggaagcggcgagagaaagcggccattaa

SEQ ID NO: 74459 - protein, 1035 aa, Idiomarina loihiensis L2TR
MSDQQLNNHPDSNDLPSVSIRRPVLIVVLNVLIAIAGLAALMGVEVRELPDVDRPVVGVSATLPGGAPETVDAEVTSILEGAAARVSGVESIQSSSEENSARISIEFRPGVDLDVVAAEVREAVNQVRRELPDDVEQINVQKADSDARSVLDIAVSSDSLTQEELTRRLETDLSPEFLAINGVADVRLNGDRERVLRVDLDPLKLVSFGLSVTDVADALRLAPFDVPAGSLRSTDQRLIVRADATAITEDQVENIIVSGDTRIGDVAQAYFAPADANSFVRLDGKPVVGLGVIRQAGSNTIEISDQALAVLERLRERFPDMEMRITNDDAQFIRKSVAEVVTTLAITIVLVVATLWVFIGSFRATIIPAFSIPVALFGAIAAIWLMGFSINILTLLALVLATGLIVDDAIVVTENIQRRRSMGLGSRAAAVLATREVFFAVVATTAVLVAVFVPIAFLPSTAGRLFREFGGVLAAAVVISSFVALSLVPAFTARLPKSAGQNNRFAGIGNAFKRFYKRTLHKALDFSWVVVVLSLLSAGGGALLYNEIDSELMPNEDRGAVRVFSRGPDGVGLKFMDRQARKLEEVLLEYKESGDIESIYTVVGQWDPNLVFITANLKPWEERDISQQEIINNIREPLSQVPGAPGQAFGDNSLNLRGQGGGLEMAITGENYDEIFKVAREFTAIIKERMPDLGNINVSYQPTQPQLRVKIDRRRAAELGVSLNDISATLRAAINGDDVADLNVGDQQIPVMLRTRNNLIQSPQDMQNLYVSSSSGDLVPISSVSEIIEEGVSAELERQAQRRAIEVDVQLPDDMPMSDVVDQLRTIAGEVLPDSMGLVFLGEAATFEDTSQEIAMTYILAFLIVLLVLAAQFESLNSAVVVMLTVPFGIAAAIYALFLTGTSLNIYSQIGLVMLIGLLAKNSVLLVEFADQLRDRGLEVREAIEEASLIRLRPIMMTLVSTVLGGLPLILSSGAGAEARNSIGWVVFGGLGLATLFTLYLTPVLYLWLARFTKPRADEAARLESEMEAARESGH

SEQ ID NO: 74460 - DNA, 3099 bp, Idiomarina loihiensis L2TR
  CDS (1)..(3099): transl_table=11
atgttgttgtcagacctttctgtaaaacgtccggtttttgcaaccgtactgaatattctgctggtggtcttcggtattgtggcttttaccatgctgccattgcgagaatatccggatattgatcgtcccatagttactattgatacagactaccccggtgcctctgccgaagttgtagaaactcaggtcacgcagttagtcgaagaccgtattagtggcatagaaggcattaaaaacattagctctagcagccgcaacgggcgctccagtatcagtatagagtttaatctgactcgcgacattgatgccgcttctaacgacgttcgtgagcgggtgtcccgggtacttgataacctgccggaagaagctgacccccctgaagtttcaaaggcctcaagcgatgagagtaccattgtctggtataaccttcgcagcgagagcatgtcgatactagagctaactgactacgcggagcgatacatcgtagaccgtctgtcagttgccgacggtgtcgcacgggtagtcattggtggtgaccgccgttacgccatgcgtgtatggctggaccgtgatgctatggcggcacggcaggtgacggtaaccgatattgttagccgtttgcgagaagaaaacgttgagcttccggcaggtgaagttgagtcaaccgacagagaattctcggttcgtatggcacgcgcgtatttatcgccggaagactttaaaaacctggtgatacgacagggcgacgacggttacttagtccggttaggtgaagtggcccgggtagaactgggtgccgaagatgacaaaaccgacttccggggtaatggcgttaacatggttggtgtcggtgtcattaaacagtcgaagggcaacaccctggatgtggtgaagaacgttcaccgggaaatgaaaaaaattcaggaaaccctgcctgaaaccatgtatctggcacccagctatgactcgtcgatatttattcagggctcagttgacgaagtttataatactctggctgtggcgatggcactggttattgtcgttatttacctgtttttaggaaatataagggcaactattgttcctgcgctgacggtgcctgtggcgattattgcgtcctacatggtgctattcgcactgggcttttccataaacttgttaaccttgctggcgctggtactggctattggactggtggttgatgactctattgtcgtgctggaaaacatataccgccgtatagaagagggagagcctccggttctggctgcttatcgtggagccagagaagtgggctttgcggttattgcgacaactctggtactgatttcggtatttgtaccgctggctttcttagacggaaatatcggtaagctttttacggagtttgcccttgccatagccgctgctgttgctttctccagtattgcagcactgacgttaacgccaatgctgagctctaaaatactgagtaaaaaagagcgtaccagtaaatttggtaaggcttttgatgcgactttcaactggctggaacaaggttaccgtggcgtgcttgagaaaagcgtgaagcggcctatgatggcaatcgtgttggtggttatgtcgggcgttgttgcgtttggtttattcagctttattccacaagagttcgcaccacctgaagaccgcggtactttttacattcaggtgcgcagtgccgaaggcgcaagtttcgagtccagctccagacatatggacgaaatagaacagattcttttgccttatattgatgaaggcaagattgaccgtttgattgttcgtgctcccggttggggtggtagcgccggtattgccatcgtcggtgccgttccttttgacgagcgtgactggtcaagttttgatcttatggaagaaatgcgctctcagttggattcggttgtcggcgttcaggcgttcgcttttatgcggagtggtattagcggcggaggcgggcgtccggtcgaattcgtgttgcaggggaatacctacgagcgcttagctgaatttcgtgacattgttattgaggaagcttctaccaacccgggtttacaggatctggacagtgactataaagaaactttgccacaattactgattcaggtggatgaagccagcgcggctgatttaggagtttcagtgcaggatataggtatcaccctgcagtctgtattaggccaaagacgagtgacaacctaccttgatcgcggtgaagagtatgacgtgatgctggagggcgaaaaagccgattaccgtagccccagcgccatagataatatctatgtacgttcgcgtaaaagtgacgaattgattccgctttctaacctcgtaaccattactgagcaggccacttcagcccgacttaaccgatacaaccgtatgcgcagtgtcaccattgaagcgaatctggctgagggatattcactgggtgaagcgttgagttatttggaaggcgtggtgcaggaaaaactgccggaagatgtttcaattgactataaaggcgagtctcaactgtacaaagagagtggtagttcaattgtctttgtttttgggttggcattggtcattaccttcctggttctggctgcgcagtttgaaagctttattcatccgttggtcattatgctggcggtacctatggctatagttggggctttaatggcgctgtatctggccggaatgagcatcaatatatacagtcagataggcatagtaatgctcattggtctggcagcgaaaaatggtattcttattgttgaatttgcgaatcagttgcgtgattcaggagtggagttcaaagaagctgtgcttaaagctgcgcaacagcgtttacgaccgattgtgatgacggcgttcacaactctaatgagttccgtgccacttatcctcggttctgggccgggagctgaaagccgtatggtcattggtacggttatttttgccggggttgcagtgtcagcatttttgacgttatttgttattcctgctctgtatatcgctctggcgaagaataccagctcaccaatggctatcacgcgtaaactggaatctttacaggaagagtatccagaccatcatagttga

SEQ ID NO: 74461 - protein, 1032 aa, Idiomarina loihiensis L2TR
MLLSDLSVKRPVFATVLNILLVVFGIVAFTMLPLREYPDIDRPIVTIDTDYPGASAEVVETQVTQLVEDRISGIEGIKNISSSSRNGRSSISIEFNLTRDIDAASNDVRERVSRVLDNLPEEADPPEVSKASSDESTIVWYNLRSESMSILELTDYAERYIVDRLSVADGVARVVIGGDRRYAMRVWLDRDAMAARQVTVTDIVSRLREENVELPAGEVESTDREFSVRMARAYLSPEDFKNLVIRQGDDGYLVRLGEVARVELGAEDDKTDFRGNGVNMVGVGVIKQSKGNTLDVVKNVHREMKKIQETLPETMYLAPSYDSSIFIQGSVDEVYNTLAVAMALVIVVIYLFLGNIRATIVPALTVPVAIIASYMVLFALGFSINLLTLLALVLAIGLVVDDSIVVLENIYRRIEEGEPPVLAAYRGAREVGFAVIATTLVLISVFVPLAFLDGNIGKLFTEFALAIAAAVAFSSIAALTLTPMLSSKILSKKERTSKFGKAFDATFNWLEQGYRGVLEKSVKRPMMAIVLVVMSGVVAFGLFSFIPQEFAPPEDRGTFYIQVRSAEGASFESSSRHMDEIEQILLPYIDEGKIDRLIVRAPGWGGSAGIAIVGAVPFDERDWSSFDLMEEMRSQLDSVVGVQAFAFMRSGISGGGGRPVEFVLQGNTYERLAEFRDIVIEEASTNPGLQDLDSDYKETLPQLLIQVDEASAADLGVSVQDIGITLQSVLGQRRVTTYLDRGEEYDVMLEGEKADYRSPSAIDNIYVRSRKSDELIPLSNLVTITEQATSARLNRYNRMRSVTIEANLAEGYSLGEALSYLEGVVQEKLPEDVSIDYKGESQLYKESGSSIVFVFGLALVITFLVLAAQFESFIHPLVIMLAVPMAIVGALMALYLAGMSINIYSQIGIVMLIGLAAKNGILIVEFANQLRDSGVEFKEAVLKAAQQRLRPIVMTAFTTLMSSVPLILGSGPGAESRMVIGTVIFAGVAVSAFLTLFVIPALYIALAKNTSSPMAITRKLESLQEEYPDHHS

SEQ ID NO: 74462 - DNA, 3162 bp, Azoarcus sp. EbN1
  CDS (1)..(3162): transl_table=11
atggcacgctttttcatcgaccgaccgatcttcgcgtgggtcatcgcgatcgtcatcatgctcgccggcgcgctgtcgatcctgacgctgccggtgtcgcagtatccgtcgatcgcccctccgacggtcgtcatcaacgccagctatcccggagcatcggcgaaagccgtggaggattcggtcactcaaatcatcgaacagaagatgaccggtctcgacggcctgctgtacatgaagtcgtcgtcggattcttatggccgcgcctcgctgacgctgactttcgacgccggcaccaaccccgacatcgcgcaggtgcaggtacagaacaagctgcaactggcactgccgctgctgccgcaggcggtgcagcagcaaggcgtgcaggtcgccaaatcgactgccaacttcctgatggtcgtcggtttcgtgtcgcaggacggcagcctcaagcaggtcgacctggccgacttcctcgtgtcgacggtgcaggatccgctgtcgcgcgtcaccggcgtcggcgaagtccaggtgttcggctcccagtacgcgatgcgggtgtggctcgacccggcgaagctggtgaagttcggcctcacgccaggggacgtccaggcggcgatccgtgcccagaacaacgaagtttccgccggccagctcggcggtacgcccgcggtggagggacagggttttaccgcgtcgatcacggcacagagccggctggagacagtcgggcagttcgaggacatcctgctgcgcagctcggcccaaggcggcgaagtgcggctcgaggacgttgcgcggatcgagatcggtgccgagaactacggcaccgtcggccgctacaacggtcagcccgcggccgcgatcggcatcaagcttgccgccggcgcgaacgcgctcgacaccgcgacggcggtgcgggcacagctcgaccggatggccccgtactttcccgccggcgtggaggtggtggtgccttacgacaccacgcctttcgtcgcgatctcgatccagggcgtcgtcaagacgctgctcgaagcgatcgcgctggtgttcctcgtgatgtacctgttcctgcagaacatccgcgcgacgctgatcccgacgatcgcggtgccggtagtgctgctcggcactttcggcgtgatggcggcgttcggcttcacgatcaacacgctgacgatgttcggcctggtgctcgcgatcggcctgctcgtcgatgacgcgatcgtcgtcgtcgagaacgtcgagcgcgtcatgagcgaggaaggcctgtcgccgaaggaggcgacgaagcgctcgatggaccagatcaccggtgcgctggtgggcatcggcctcgtgctgtcggcagtgttcatcccgatggcgttcttcggcggctcgaccggcgtcatctaccggcagttctcgatcaccgtcgccgcggcgatggcgctgtcggtgctggtcgcgatcatcttcacgccggcgctgtgcgcgacgatgctcaagccggtggagaaaggccacgaacacggcgaaggcggctggttctcgggcttcttccgctggttcaacgggatgttcgcgcgcaacacgaggcgctacgagtcgacggtcggccgcatcctgcaccgcagcctgcgcttcctcgcgatctatctggcgatcattgccgtgctcgcgctgctgttcctgcgcatgccgacctcgttcctgccggaagaggaccagggcgtgatgttcagccaggtcacgctgccggccggcgcaacccaggaccgcacgctggcggtgctgaagaaagtcgaggaccatttcctcgagaacgaaaaggacacggtgcgctcgatcttcaccgtggccggtttcagcttcggcggcagcgggcagaacatgggactcgcgttcatcaacctgcaggactgggacgagcgcggtgaacccggaatggacgtcaagtcggtggccgggcgcgcgatggacgcgttcgcgcagatccgcgaagcgatggtgttcgcgttcgtgccgccggccgtgctcgagctcggcaccgcgagcggcttcaacattttcctgcaggatcgctccggcctcggccacgatgcgctcgtcgccgcgcgcaaccagttcctcggcctcgctgcgcaggacaagcggctcgtcggggtgcggccgaacggccaggacgacatggctgaattccgcctcgacatcgaccacgccaaggccggcgcgctcggcgtctcggtcgcggacatcaacgagacgctggcaacggcgtggggcggcacgtacgtgaacgacttcctcgatcgcggccgcatcaagaaagtctatctgcaggccgacgccgacgcgcgcatgaagcctgaagaccttgccaagtggtacgtacgcaaccgtcagggggagatggtgccgctgtcggcgttcgccaccgcgcactggagctacggctcgcctcgcctcgaacgctacaacggccagccggcagtcgaaatcctcggccaggcggcgccaggcctgtcgtcgggcgacgcgatggccgcggtcgaggagatcatggcgaagctgcctgccggcatcggctacgaatggaccggcacctcgtacgaggagcgccgttccggagcgcaggccccggcactgtacgcgctgtcgctgctggtcgtgttcctgtgcctggcggcgctgtacgagagctggtcggtgccgttcgcggtgatgctggtcgtgccgctcggcgtgctcggggcgctgctcgcggcgaccgggcgaggcctgtcgaacgacgtctatttccaggtcggcctgctcgcgacgatcggcctgtcggcgaagaacgcgatcctgatcgtcgagttcgcgaaagcgcagatggaagaggaaggcaaggagctcgtcgccgcgacgctcgacgcggtgcgcatgcggctgcgcccgatcctgatgacttcgctcgcgttcggcctcggcgtgctgccgctggcgatctcgaccggcgccggctccggcagccagaacgcgatcggcaccggggtgctcggcggcacgattgccgcgaccgtgctgggcattttcttcattcctttgttctatgtcgtgatcatccgcgtcttccgcaaaaaacccgctccgcccgcaaccatcgcgcctgtcgccgaggaggccaagtga

SEQ ID NO: 74463 - protein, 1053 aa, Azoarcus sp. EbN1
MARFFIDRPIFAWVIAIVIMLAGALSILTLPVSQYPSIAPPTVVINASYPGASAKAVEDSVTQIIEQKMTGLDGLLYMKSSSDSYGRASLTLTFDAGTNPDIAQVQVQNKLQLALPLLPQAVQQQGVQVAKSTANFLMVVGFVSQDGSLKQVDLADFLVSTVQDPLSRVTGVGEVQVFGSQYAMRVWLDPAKLVKFGLTPGDVQAAIRAQNNEVSAGQLGGTPAVEGQGFTASITAQSRLETVGQFEDILLRSSAQGGEVRLEDVARIEIGAENYGTVGRYNGQPAAAIGIKLAAGANALDTATAVRAQLDRMAPYFPAGVEVVVPYDTTPFVAISIQGVVKTLLEAIALVFLVMYLFLQNIRATLIPTIAVPVVLLGTFGVMAAFGFTINTLTMFGLVLAIGLLVDDAIVVVENVERVMSEEGLSPKEATKRSMDQITGALVGIGLVLSAVFIPMAFFGGSTGVIYRQFSITVAAAMALSVLVAIIFTPALCATMLKPVEKGHEHGEGGWFSGFFRWFNGMFARNTRRYESTVGRILHRSLRFLAIYLAIIAVLALLFLRMPTSFLPEEDQGVMFSQVTLPAGATQDRTLAVLKKVEDHFLENEKDTVRSIFTVAGFSFGGSGQNMGLAFINLQDWDERGEPGMDVKSVAGRAMDAFAQIREAMVFAFVPPAVLELGTASGFNIFLQDRSGLGHDALVAARNQFLGLAAQDKRLVGVRPNGQDDMAEFRLDIDHAKAGALGVSVADINETLATAWGGTYVNDFLDRGRIKKVYLQADADARMKPEDLAKWYVRNRQGEMVPLSAFATAHWSYGSPRLERYNGQPAVEILGQAAPGLSSGDAMAAVEEIMAKLPAGIGYEWTGTSYEERRSGAQAPALYALSLLVVFLCLAALYESWSVPFAVMLVVPLGVLGALLAATGRGLSNDVYFQVGLLATIGLSAKNAILIVEFAKAQMEEEGKELVAATLDAVRMRLRPILMTSLAFGLGVLPLAISTGAGSGSQNAIGTGVLGGTIAATVLGIFFIPLFYVVIIRVFRKKPAPPATIAPVAEEAK

SEQ ID NO: 74464 - DNA, 3075 bp, Azoarcus sp. EbN1
  CDS (1)..(3075): transl_table=11
atgatcctgtccgaggtctgtatcaagcgtccggtgttcgcgacagtgctgtcgctgctggtgctgctcgtcgggctgatgtcgtattcgcgcctgacggtgcgcgagtacccgaacatcgacgaaccggtcgtcaccgtcgatacgacctacaccggcgcgagcgccgagatcgtcgagtcgcaggtcacgaaaccgctcgaggattcgctcgccgggatcgaaggcgtcgacgtgatccagtcgatcagccgccaggagcgcagccagatcacgatccgtttccgcatcgagcgcgacgccgacagcgccgcggccgacgtgcgcgaccgcgtgtcgcgcgcgcgccgccagctgcccgacgacatcgacgagccggtgatcgcgaaagtcgaggccgacgcgagcccgatcatctggatcgcgttctcgtcggatcgccactcgtcgctagaactgagcgacatcgccagccgcatcgtcaagccacggctgcagacgctctccggcgccgccgacgcgcgcgtgttcggcgagcgccgctattcgatgcgcatctggctcgaccgcgaccggcttgcggcgttcaacctcacgccgcaggacgtcgaggacgcgatccggcgccagaacgtcgagctgccggccgggcgcatcgaaagccgcgagcgcgagttcgccgtcgtcgcgcagaccgatctcgacgaaccgcaggagttcgaggcggtcgtcgtgcgcgaacccgggacggccgacgggcgcccggtgcgcatccgcgacgttggccgcgtcgaggtcgccgcgcagagcgagcgcacgctggtgcgtttcatgggcaagccggcggtgtcgctcggcctgatcaagcagtcggtcgcgaacccgctcgacctcaagcgcggcctcgccgagatgatgccggtgctcgaggcggaactgcccgaaggcatgacgatgagcatcgcgaacgacacgaccgtgttcatcgaacgctcgatcgcatcggtgttcgcgacgatctgggaggcggtgctgctggtcgcggtgatctgcttcttcttcctgcgcaactggcgcgcgatgctggtgccgctggtgacgatccccgtgtcgctcgtcggcgcgttcacgctgatgctggtgttcggcttctcgatcaacacgctgacgctgctcgcgctggtgctcgcgatcggcctcgtcgtcgacgacgcgatcgtcgtgctcgagaacatctaccggcatgtcgaggacggtatggagccggtccaggcggcttttcgcggcgcgcgcgagatcggcttcgccgtcgttgcgatgacgatcacgctcgccgcggtctatgcgccggtcgcgttcatgaccgggcgcaccggcaagcttttcaccgagttcgcgctgacgctcgccggcgcggtgatcgtgtcgggcttcgtcgcgctgacgctgtcgccgatgatgtgctcgaagctgctgcgccacgagcagcggcatgggcgtttctacaacgcgatcgagcggttcctcggcgggctgaccaacggctaccgccgcgcgctgatcgtcgcgctgcaaatgcgctgggccgtggtgctcgcgttcgtcgtcgtcgccggctcgtcgctcgtgctgctcaagacgctgaagacggaactcgcgccggtcgaagaccgtggtcgcgtcgtcggcatcttttccggaccggaaggggcgacgatcgacttcatggggcgctacgccgaacaggtcgaggcgatcttcgcccagacaccggaagtcgaccgctacctcgtcatctccggcaacccgacggtgtcccagggaatctcgttcgccggcttcacggactgggccgagcgcgagcgcagcgccgccgagatcgccggcgagctgcggccgaagctctcggcggtgccggggctgctcgcgttcccggtactgccggcggcgttcgggcagagttcgcgctcgcgcccggtcagcttcgtcatcacgacgtcggagtcgtacgacgaactcgcgcgctacaccgaacggatgctcgacgagctgggcggccatccgggcttcgtgtcgccagacaccgacctgaagctgacgaagccggaactcgctgtcgacgtcgatcgcgaccgcgcggccgacctcggcattcccgtcgacgtaatcggccgcacgctcgagacgatgctcggcgggcggcaggtcacgcgctacaagaaggacgccgaacagtacgacgtgatcgtgcaggtcgaagcggcaagccgcgccattgcccgcgatatccgcgagatctacgtgcgtggcaagagcggcgcgatggtgccgctcgcgaacctcgtgcaggtgcgcgagacggtcagcccgcgcgagctcaatcatttcggtcagcggcgttcggtgacgatctcggcgaacctcgggccggatcttgcgctcggcgaagcgctggcgtttctcgaacagacggccgcgcgcgtgctgccggccggctatgcgatcgactacgacggccagtcacgcgaattcaagaccagctcggcgagcctcgcgctgactttcgtgctcgcgctggcgttcatctatctcgttctcgcggcgcagttcgagagcttccgcgacccgttcatcatcatgctgacggtgccgttgtcgatgaccggcgcgctcgcggcgctgtatttcaccggcggcacgctgaacgtctacagccagatcggtctcgtcacgctggtcggcctgatcaccaagcacggcatcctgatcgtcgagttcgcgaaccagttgcgcgacgacggcgccgcgctgacggaggcggtcatcgacgcgtcggtgctgcggctgcggccgatcctgatgacgacgggagcgatggtgctcggctcgattccgctcgcgctcgcgaccggcgccggcgccgagagccgccagcagatcggctgggtcatcgtcggcggcctgctgctcggcacggtgttcacgctgttcgtcgtgccgaccgtctatacgctcctcgcccgccgcgagcgcacccgcatcgaggccgagcagccggtcgtggcgactgaataa

SEQ ID NO: 74465 - protein, 1024 aa, Azoarcus sp. EbN1
MILSEVCIKRPVFATVLSLLVLLVGLMSYSRLTVREYPNIDEPVVTVDTTYTGASAEIVESQVTKPLEDSLAGIEGVDVIQSISRQERSQITIRFRIERDADSAAADVRDRVSRARRQLPDDIDEPVIAKVEADASPIIWIAFSSDRHSSLELSDIASRIVKPRLQTLSGAADARVFGERRYSMRIWLDRDRLAAFNLTPQDVEDAIRRQNVELPAGRIESREREFAVVAQTDLDEPQEFEAVVVREPGTADGRPVRIRDVGRVEVAAQSERTLVRFMGKPAVSLGLIKQSVANPLDLKRGLAEMMPVLEAELPEGMTMSIANDTTVFIERSIASVFATIWEAVLLVAVICFFFLRNWRAMLVPLVTIPVSLVGAFTLMLVFGFSINTLTLLALVLAIGLVVDDAIVVLENIYRHVEDGMEPVQAAFRGAREIGFAVVAMTITLAAVYAPVAFMTGRTGKLFTEFALTLAGAVIVSGFVALTLSPMMCSKLLRHEQRHGRFYNAIERFLGGLTNGYRRALIVALQMRWAVVLAFVVVAGSSLVLLKTLKTELAPVEDRGRVVGIFSGPEGATIDFMGRYAEQVEAIFAQTPEVDRYLVISGNPTVSQGISFAGFTDWAERERSAAEIAGELRPKLSAVPGLLAFPVLPAAFGQSSRSRPVSFVITTSESYDELARYTERMLDELGGHPGFVSPDTDLKLTKPELAVDVDRDRAADLGIPVDVIGRTLETMLGGRQVTRYKKDAEQYDVIVQVEAASRAIARDIREIYVRGKSGAMVPLANLVQVRETVSPRELNHFGQRRSVTISANLGPDLALGEALAFLEQTAARVLPAGYAIDYDGQSREFKTSSASLALTFVLALAFIYLVLAAQFESFRDPFIIMLTVPLSMTGALAALYFTGGTLNVYSQIGLVTLVGLITKHGILIVEFANQLRDDGAALTEAVIDASVLRLRPILMTTGAMVLGSIPLALATGAGAESRQQIGWVIVGGLLLGTVFTLFVVPTVYTLLARRERTRIEAEQPVVATE

SEQ ID NO: 74466 - DNA, 3144 bp, Zymomonas mobilis subsp. mobilis ZM4
  CDS (1)..(3144): transl_table=11
atggctcgctattttattgaccgccctgtttttgcttgggttatcggtcttatcatcatgttattgggtgccttggcaattgttaaaatgcctattgcccaatatccgaatgttgcccctccgcagattgagatcagtgtgtcttatccgggggcgtcggctgaaacgatcaataataccgttgttcggcctatcttacagcagatgcatggcatcgataatctggaatatatttcggcttcttcctttgcatcaggtcagatgacgattgatttgacctttgcacaaggtaccgatgccgatatcgcacaggtgcaagtccagaataaattacaattagcgcagcctcgtttgccgtcggatgtggtcaatcagggtattacggttaaccgttctgccaaaagttttatgatgattatgtccttcatctcgaccgatggcagtatgtcctatcaggacatcaacgattatgtggcatcgaatattgctgatccgttgagccgtgtttccggtgtcggcgattacactctgttcggttttgaatatgcaatgcgggtctggttagatccagcaaagctctacaaatataatttgactgtagcggatgtccaatcagctatttctacccagaatattcagctttcatccggtgaattgggcggattgcctgcggttcagggtattcgtttggatgcgaccattattggcccgacccgtttgacctcgcctgaagaatttaaaaatattctggtcaaggctttgccggatggcgcccaaatcaaattgggtgacatcgctaaagtagagttgggcgcgcaaagctataactttgacgtgcgctataataaccagccggcttcgggtattgcgatcaaattggcaccgggggcgaaccagcttcaaactgaaaagttgatccgtcagcgtttggccgatttggaacctttcttccctcatggtttgaaggtcgaatatccggttgataccaagccatttgtgacggcttctatccatgaggttattgaaaccttggtggaagctattgcgcttgttttcttggtgatgctgatcttcttgcagaatttccgtgctaccttgatcccgacgattgctgtgccagtggtgttgttaggcacctttggtgtgctttctgttcttggtttttcaatcaatactctgacgatgttggcaatggtcttggctgttggcttgttggtcgatgatgccatcgtcgttgttgaaaatgtcgaacgtttgatgcgagatgaaaagctgcccccgaaagaggcggcgaagcgctcgatggatgaaatttctggtgctttgatcggtatcgtcttggtcttgtcggccgtgttcttgcctatggcggccttttcagggtcaacgggcgttatctatcgccaattctcgattacgattgtggtggcgatggggctgtctgtccttgtggcgatgattatgacgccagccctttgcgcaacgatgttaaagccgattgaccatgaccaagccgataaaaagccgggtatctttggtcgcttggcgaatggctttaaccgtgcttttgaccgattgaataatggttatttgggtggtgtgtcttggttgttaggacgttccgtcaaaggcggcattgcctttttgatcattgttttcgccgttggttatttattcactcgcttgccaaccggatttttgccggatgaagatcagggtgaatttattggtcaggtgaccttaccgccgggggcgacccaagaacaaacgtcggaagcggtgcgcaaggttaatgattatcttctgtccgcagagaaagacagtgtcatatctgtgatgacggttagcggttttaactttggtggtcagggacaaaatgccggttctttcttcgttcgtttgaaaccttgggatcagcgtccgaaagcctcgcaaagtgcttcggccttggcaatgcggacgatgatgcatttttggggtgatccgtcatcgatgacttttgcctttaatatgcctgctgtccgcgacttgggtaatgccaccggttttgaccttgaactggaagatcgcggtcatatcggtcatgcaaaattccttgaagcccgtaacatgttattggctttggcctcgaaagatccccgcttaagtggtgtccgtccgaatggtatggaagatgcccctcaatatcatttgaccgttgattacggcaaagctgttatgatgggattgaccccaaatgatgtgaatgtggccttgcaggggtctttggggtcgatttacgtcaatcagtttatgcgggatgaccgtgtgaagcaggtctatttaatgggggcaccggaagcgcgtatgctgccttccgatttttccaaatggtatctgcggaataatgtcggcacgatggttccctttagcgcctttatgacaggaacatggcaaacgggccctcagaaagtcgaaaattataacggctataattctttcgaaattatgggcgcgcctgcaccgggacatagttcgggtgaagccattcaggcgatgaccgagatcgttcataaattgccagctggtgttgggcatgaatggacagggttatcttttgaagagcaggcggccggttcgtccaccatgtctctttatgcgatttccgcgattgtggttctgttctgtcttgccgcactttatgaaagctgggccgtgccgttatcggttattttggttctgcctttgggtgtcttgggtgccgttgtagcaaccttgatgcgtggattgtcgaatgacgtctatttccagatcggtttgctgacgaccgttggtttgaccgttaaaaacgctattttgattgtcgaatttgcaaaagcctttttcgataatggcgtgccacttttgcaatcggtggttcaagcaggccgtgagcggttacggcctattttgatgacctctattgcttttgtgttgggggttattccattgagcatcgcaacaggggcttcttcggcagcacgtatcgctatcggaacggccgttgtcggcgggatggtgacggctaccttgttgacgattttctttgtgcctcttttctttgtggtggttttgaagctgtttcgggtgaaaccgaacaagctgaatgcggaggaagcagcctga

SEQ ID NO: 74467 - protein, 1047 aa, Zymomonas mobilis subsp. mobilis ZM4
MARYFIDRPVFAWVIGLIIMLLGALAIVKMPIAQYPNVAPPQIEISVSYPGASAETINNTVVRPILQQMHGIDNLEYISASSFASGQMTIDLTFAQGTDADIAQVQVQNKLQLAQPRLPSDVVNQGITVNRSAKSFMMIMSFISTDGSMSYQDINDYVASNIADPLSRVSGVGDYTLFGFEYAMRVWLDPAKLYKYNLTVADVQSAISTQNIQLSSGELGGLPAVQGIRLDATIIGPTRLTSPEEFKNILVKALPDGAQIKLGDIAKVELGAQSYNFDVRYNNQPASGIAIKLAPGANQLQTEKLIRQRLADLEPFFPHGLKVEYPVDTKPFVTASIHEVIETLVEAIALVFLVMLIFLQNFRATLIPTIAVPVVLLGTFGVLSVLGFSINTLTMLAMVLAVGLLVDDAIVVVENVERLMRDEKLPPKEAAKRSMDEISGALIGIVLVLSAVFLPMAAFSGSTGVIYRQFSITIVVAMGLSVLVAMIMTPALCATMLKPIDHDQADKKPGIFGRLANGFNRAFDRLNNGYLGGVSWLLGRSVKGGIAFLIIVFAVGYLFTRLPTGFLPDEDQGEFIGQVTLPPGATQEQTSEAVRKVNDYLLSAEKDSVISVMTVSGFNFGGQGQNAGSFFVRLKPWDQRPKASQSASALAMRTMMHFWGDPSSMTFAFNMPAVRDLGNATGFDLELEDRGHIGHAKFLEARNMLLALASKDPRLSGVRPNGMEDAPQYHLTVDYGKAVMMGLTPNDVNVALQGSLGSIYVNQFMRDDRVKQVYLMGAPEARMLPSDFSKWYLRNNVGTMVPFSAFMTGTWQTGPQKVENYNGYNSFEIMGAPAPGHSSGEAIQAMTEIVHKLPAGVGHEWTGLSFEEQAAGSSTMSLYAISAIVVLFCLAALYESWAVPLSVILVLPLGVLGAVVATLMRGLSNDVYFQIGLLTTVGLTVKNAILIVEFAKAFFDNGVPLLQSVVQAGRERLRPILMTSIAFVLGVIPLSIATGASSAARIAIGTAVVGGMVTATLLTIFFVPLFFVVVLKLFRVKPNKLNAEEAA

SEQ ID NO: 74468 - DNA, 3099 bp, Zymomonas mobilis subsp. mobilis ZM4
  CDS (1)..(3099): transl_table=11
atgaacccttcacgtctttttatcttgcggcctgtcgcaacctcgctgatcgtcattgcgattgtgctagctggcctgctcggctttcactatatgtcgctttcggctttgcccgaggtcgattatccgactattcaggtttcaaccctctatccgggggcttcacctgaagttatcagccaaacggtttccgcgcctttggaacggcaattcgggcagatgtctggcctttcccgtatgaccaccaaaagtgcggctggggcatcggttatcaccttgcaatttggccttaatgaagccttggatgttgcagagcaggaagtgcaggcggccatcaatgccgcgaacgccctgttacctgcggatcttcccgcgcctcctgtctatgccaaggtcaatccggcagattctccggttctcaccttggcggcaacctctgatacgatgccactgacggatgtccaaaatctggttcaaacccgtctggcgcaaaagatttcacaggtttccggtgtcggcttggtcgaattatccggcggccaacggccagccatgcggatacaagccgatacgcaagccttggccagctatggcatttcgctttcaacgcttcgaacggcgattgataatgccaatgctaattctgcgaaaggtagcttcgacgggcccacgcgttcatggcaaatcaacgccaatgaccagcttttgacggttgaagattataaaaatctgatcatcgctatgcgtaataaccgtccggttcggatgagcgatgtggcacaggtcgtcgcaggggctgaaaacaatcatcttggtgcttattataatattacacctgcggttatcatcaatgtccggcggcaaccgggcgcaaatgtgattgccacggtcgataatattaaaaaacagcttcccgaattagaggccggattaccggctggtctcaaagtatcagtcgtcgctgaccggacaacgggtatccgcgcctctattgaacatgtcgaggttgagcttgtcttggccgtcgtcatggtcattctggttattttcttctttcttcattctatacgggcaacgcttattgcggcggtcgcggtgccgatctcgctgatcggcagctttgctgcgatgtatatgatgaattacagcctgaataacctctccttgatggcacttaccattgcctctggttttgtggttgatgacgcgattgtgatgatcgaaaatatcgaacgccatatcgaggccggcgtggcgccttttcaggcggcgctaaagggggcgcaagaaatcggttttacgattatctcgctgactatctcgctgattgccgttttaatcccgcttttgtttatgagcgatgtcgtcgggcggcttttccgtgaatttgcgatgaccttggctatcactatcctgatttctgcggttgtctcgctgacattgaccccgatgctatcggctcgccttttggtcgcccatcgtcataaaaatcctatcggtgatcgtattcaaaaaggctttgaacggctcgaatatcattacgaacatggccttagatgggtgctgggacatcaaacattaacgcttgtcttaacgattgttaccttcatcggaacggctctattctatgttgccattccaaaaggtctgttcccgttacaggcgaccggacagcttcggatacagaccgataccagccccgatgtgtcctacagccggatggccgaattgcaaaaacaggcagcggccaaaatattacaagacccagcggttgaaaatttatcggtgatgagcggtgttgatggtgtcaccaatagcgctcttaaccaaggggttatgctagttaatttgaaagagggcatttcagatgaacagccggttatcaaacgcctttatcaggcggttggtgctgtcgcaggcatccgcgcgcatatccaaccggtgcaggatttaacggtcgataccgatacggggcccacccgttttcgtttgtcagtcgaaggtgccgatactgacagcgtgcataaagcggcgcgcgctatcgctgatagcttgggtcaaagcaaaaagctgacagatgtctatactgatgccgatgccaaaggggatgcggtttacgtcaatattgaccgcgaaacagccagccggttatcggtaaccgttgccgatattgatgacacgctttattccgcttttggtcagcgtattatctcaacgattttcactgaaaccaaccaatatcgcgttattctcgaagcccgtcccaatcttttaaatagtattgaatctttgggacatctcaatctcgcgggcagtggaacattaccgacgcctttaaatggcttctcaactctaaaaataggccaagccccgctgcaaattatgcatgtggcgcaattcccagctgcaacggtcggctttgacttggcctccaataccgctttgggtgatggggtaaaggctgtccgcgctcaaattgccagacttgatctcccctctggtattacgacgaccttgcttggcgcagccagcgcttatgaaaaagccctcggcaaccagatactccttatctttgcggctttggtttgcgtctatattgtcctcggtgttctgtatgaaagctatattcacccgctgactattctttcaacgctaccttctgccagtgtcggtgccattctcgctttatgggtctctggacacgatctcgatatcatcgggattatcggcatcattttgttgatcggtatcgtcaagaaaaacgctatcatgatgatcgactttgcgattgccgccgaaagggaggaaaagaaatcccccgaagaagcgatctttaatgcggcaaccttgcgtttcagacctatcctgatgaccactttggccgccctttttgcagccattcctctgatgatcggtcatggcagcggggcggaattgcgccgtcctcttggtcttgcgattttcggagggctcttggcctcgcaaatgctgaccgtctttacaacgccggtgatctatctgttctttgaccgtctgggacagaaaatagcgcatctccgccgtcacaaagattctgaaaacgaggtaacatcggcgtga

SEQ ID NO: 74469 - protein, 1032 aa, Zymomonas mobilis subsp. mobilis ZM4
MNPSRLFILRPVATSLIVIAIVLAGLLGFHYMSLSALPEVDYPTIQVSTLYPGASPEVISQTVSAPLERQFGQMSGLSRMTTKSAAGASVITLQFGLNEALDVAEQEVQAAINAANALLPADLPAPPVYAKVNPADSPVLTLAATSDTMPLTDVQNLVQTRLAQKISQVSGVGLVELSGGQRPAMRIQADTQALASYGISLSTLRTAIDNANANSAKGSFDGPTRSWQINANDQLLTVEDYKNLIIAMRNNRPVRMSDVAQVVAGAENNHLGAYYNITPAVIINVRRQPGANVIATVDNIKKQLPELEAGLPAGLKVSVVADRTTGIRASIEHVEVELVLAVVMVILVIFFFLHSIRATLIAAVAVPISLIGSFAAMYMMNYSLNNLSLMALTIASGFVVDDAIVMIENIERHIEAGVAPFQAALKGAQEIGFTIISLTISLIAVLIPLLFMSDVVGRLFREFAMTLAITILISAVVSLTLTPMLSARLLVAHRHKNPIGDRIQKGFERLEYHYEHGLRWVLGHQTLTLVLTIVTFIGTALFYVAIPKGLFPLQATGQLRIQTDTSPDVSYSRMAELQKQAAAKILQDPAVENLSVMSGVDGVTNSALNQGVMLVNLKEGISDEQPVIKRLYQAVGAVAGIRAHIQPVQDLTVDTDTGPTRFRLSVEGADTDSVHKAARAIADSLGQSKKLTDVYTDADAKGDAVYVNIDRETASRLSVTVADIDDTLYSAFGQRIISTIFTETNQYRVILEARPNLLNSIESLGHLNLAGSGTLPTPLNGFSTLKIGQAPLQIMHVAQFPAATVGFDLASNTALGDGVKAVRAQIARLDLPSGITTTLLGAASAYEKALGNQILLIFAALVCVYIVLGVLYESYIHPLTILSTLPSASVGAILALWVSGHDLDIIGIIGIILLIGIVKKNAIMMIDFAIAAEREEKKSPEEAIFNAATLRFRPILMTTLAALFAAIPLMIGHGSGAELRRPLGLAIFGGLLASQMLTVFTTPVIYLFFDRLGQKIAHLRRHKDSENEVTSA

SEQ ID NO: 74470 - DNA, 3129 bp, Silicibacter pomeroyi DSS-3
  CDS (1)..(3129): transl_table=11
atgttctcggctcttttcatcagccggccaaagctggcctttgtcatctcgctggtcctgaccatcctgggcggcatcggttacctggtgctgccggtggcgcagttccccgatatcacgccgccggtggtcagcgtttcggccaactataccggcgccaatgccgagacggtggaaaacgccgtcgccgccccgatcgaggcgcaggtgaacggcgtcgacgacatgctctacatgacgtcgacctcggccgacaacggctcctattcgctgagcgtcaccttcgaggtgggcaccgatcccgacattgcctcggtcaacgtgcagaaccgggtggcgcaggcgctgtcctcgttgcccagcgaagtgaccaattccggcgtggtgacgcagaaatcctcgaccaacatgctgatggtggtcacgctcacctcgcccaatgacacctatgacagcgtgtttttgtccaactatgcctcgatcaacctcaaggacgcgctggcccgggtacagggggtgggcaaggccgatgtgctgaccgatctgcaatatgccatgcggatgtggatggaccccgacaagatggcggccctgtcgatcacgccgggtgacctgattgccgccgtgcgcgagcagaaccttgaggtgtcggcgggccagatcggcgcgccgcccgcacccgaggggcagacattccagtacacgatcaagtccaagggccggctgagcacggttgaagagttcgagaacatcgtgatccgcaccggcgccgccggcgccgtggtgcgggtgcgcgatatcgcccgggtcgagctgggggcgcaattctatagtgcctcgggctattaccagggcaagcctgccactgtgctgggcatctatcaggcgccgggcgccaatgcgctggcggtgtccgagcgggtcaccgccgagctggagcggctgtcgcgcgcctttcccgaggatgtggactacgagatccccttcaacaccaccgatttcgtggaacagtcgctcaatgacgtggtgacgaccctgatgctgacctttgtgctggtggtctcggtggtgtttgtgttcctgggcaactggcgggccacgctcgttccggcggtggcgatcccggtctcactgatcggcacattcgcgtttctgctggcctttggcatgtcgctgaacaccatctcgctgtttgcgctggtgctggccatcggcatcgtggtggatgatgccatcgtggtggtggaaaacgtcgaacgcatcatcgccgaagaggggctgagcccgcccgaggcaacccgcaaggcgatgggccagatcaccgggccggtgatcgcgaccacgctggtgctgctggcggtgttcgtgccggtcaccttcatgcccggcatcaccgggcggctctattcgcaattcgccgtcaccatctcggtcgcggtcgcgatctcctcaatcaacgcgctgaccctgtcgccggcactatgtggcctggtgctgcgggcccgctcgggcccgcccaagggggtgctggccctgttcgaacgcggcatcggcggggtgcgcgacggctatgtagcgctggtgcgcaagctgttgatcctgccggtgatctcgctggccatcgtggcggcgatcggcgccggggctggcggcatcttctccaacacctccaaggggttcctgccgcttgaggataacggatacctgtttgtagatgtgcaactgcccgatgccgccacgctgggccgcaccgaaaccgtgacccaacggctgaacgacaagctgcaacagcttgacggcgtggccaatacggttctggtgaacgggttctcgatgctgaacgggctcagccccaacggtgccatgatcatcgtcaacctcaccaactgggaccagcgacaggacccggagctgagcgccgatgcactgctcaaacgcatcctcaacatcgcctggggcgaaagcgcggcctcgatcgtggccttcaacccgccaccgatccagggcctgggcatgtcggcgggcatcgagatggaggtgcagcagaccggtggcggttcggcccaggatctggccgcggcggtcggctcgctggtctatgccgccaaccagcgccccgagatcgggcagagctataccaccttccgcgcaaacgtgccgcagctgttcgtcgatctggaccgggaaaaggccaagacgctgcaagtgtcggtggccgaggtgttccagaccatgcaggcgcatctggggtcctattacatcaacgacttcaacctgtttggccgcgtctaccgggtgatgatccaggccgagggcagctatcgcgacaaggtcgaggatatcggcaacctctatgtgcgctcgcaacagggccagatggtgccgctgggcacgctgatcgacgtcgagaacgtgctggggccggtgctgctgaaacggcataacctgttccgctcggccacggtgacggcggtgccggcgccgggcctgtccaccggcgacgcgatccaggtgatgaccgaggaaagcgccaatgccctgccgcccggctatgcctttgaatggaccggcagcgcccagcaacagctgagctcgggcgggctggtcgcggtgatcctggggctggcggtgctgtttgcctatctgttcctggtgggccagtatgaaagctggtcgatgccggtttcgatcctgctttcggtgatcgtggcgctgttcggggcggtggcggcggtggccgtggtcggctcggatatcaacctctatacccagatcggcatgatcatgctggtgggcatggcctccaagaacggcatcctgatcgtcgaattcgcaatggagcagcgcgccaaggggctgagcatccgcgaggctgccgccgaggccgcgcatcaacgctttcgcgcggtgatgatgactgcgctgtccttcctgctgggcgtggtgccgctgttgaccgccaatggcgccggcgccgccagccagaaggcgatcggcgtggcggtgttcggcggcatgctggcggccacggtgatcggcgtggtgctggtgccggtgctttacgcggtgatgcagggcgcgcgcgagcggatcaagggcagttccgacgccccggcccccgctgaatga

SEQ ID NO: 74471 - protein, 1042 aa, Silicibacter pomeroyi DSS-3
MFSALFISRPKLAFVISLVLTILGGIGYLVLPVAQFPDITPPVVSVSANYTGANAETVENAVAAPIEAQVNGVDDMLYMTSTSADNGSYSLSVTFEVGTDPDIASVNVQNRVAQALSSLPSEVTNSGVVTQKSSTNMLMVVTLTSPNDTYDSVFLSNYASINLKDALARVQGVGKADVLTDLQYAMRMWMDPDKMAALSITPGDLIAAVREQNLEVSAGQIGAPPAPEGQTFQYTIKSKGRLSTVEEFENIVIRTGAAGAVVRVRDIARVELGAQFYSASGYYQGKPATVLGIYQAPGANALAVSERVTAELERLSRAFPEDVDYEIPFNTTDFVEQSLNDVVTTLMLTFVLVVSVVFVFLGNWRATLVPAVAIPVSLIGTFAFLLAFGMSLNTISLFALVLAIGIVVDDAIVVVENVERIIAEEGLSPPEATRKAMGQITGPVIATTLVLLAVFVPVTFMPGITGRLYSQFAVTISVAVAISSINALTLSPALCGLVLRARSGPPKGVLALFERGIGGVRDGYVALVRKLLILPVISLAIVAAIGAGAGGIFSNTSKGFLPLEDNGYLFVDVQLPDAATLGRTETVTQRLNDKLQQLDGVANTVLVNGFSMLNGLSPNGAMIIVNLTNWDQRQDPELSADALLKRILNIAWGESAASIVAFNPPPIQGLGMSAGIEMEVQQTGGGSAQDLAAAVGSLVYAANQRPEIGQSYTTFRANVPQLFVDLDREKAKTLQVSVAEVFQTMQAHLGSYYINDFNLFGRVYRVMIQAEGSYRDKVEDIGNLYVRSQQGQMVPLGTLIDVENVLGPVLLKRHNLFRSATVTAVPAPGLSTGDAIQVMTEESANALPPGYAFEWTGSAQQQLSSGGLVAVILGLAVLFAYLFLVGQYESWSMPVSILLSVIVALFGAVAAVAVVGSDINLYTQIGMIMLVGMASKNGILIVEFAMEQRAKGLSIREAAAEAAHQRFRAVMMTALSFLLGVVPLLTANGAGAASQKAIGVAVFGGMLAATVIGVVLVPVLYAVMQGARERIKGSSDAPAPAE

SEQ ID NO: 74472 - DNA, 3114 bp, Francisella tularensis subsp. tularensis Schu 4
  CDS (1)..(3114): transl_table=11
atgcgtcttattgatctttttatcagaaggccagtattatccctttcaataagctttatgattattgtcgttggggttggttcattttttaaacttcaggttagacagtatccgtacatagatagcgcgacaattacagtcacaacatcatatccaggagcaaatccagccactattcaagcatttgttactagacctttagaagctgcagttggctcatcaaaaggtatcgattatatgacttctgaatcagcactaggaactagtacaatcactgtatatgtaaagcttggatataatacaaacgatgtactctcagaagtagtacaaaatgttaactctatacttaatcagttaccacaagatgcctactctcctgctatcaaacttaatcctgcggataacttcccttctttgattttagcttttactagtaaaacaatgaatacttcagagatatcggcatatataaactctgagctgactccaaaactacttgctgagggtggtttatcagaaattaatgtctggggtaatatgccatatgcaatgcgtatttacccaaataaaactcgtatggccgagtatggtataacaccaacagaactagcaacagctattggttcaaatagtttagtttcagcaggtggtcaaatccaaggtccatacctaaactatacgcttaatcctgaaaccagcatgtctacagctcaagaatatagaaatctgattatcaagaaaagcgataatcaaatagttcgccttagcgatgtagctagagtagagctaggtgcacaaaactataactcctcagtatattttgatggtaaaaatgccgtgcttgcaggtgctgttgtatcgcctgaagagaatccattagatgttgtcaaccgattagtcaaacagcttccaaatatcaaagcttctctacctaatggcttaaatgttgatgttgcttataacagtaccttatatatagagagttctattgatgaagtattacatactttactagaagccgtaattattgtatctatagtaatgttcctatttttaggctcattacgagctattattgtaccaataattgctattcccttatcgattataggatcatttttccttatgagtattatgggattctcgattaacttacttacattattagcgatgattttagctataggattagtagttgatgatgcaattgttgtgctagagaatatttatcgtcatattgaagaaggtatggagccttttgctgctgcgatcaaaggtgcccgagaaattgctaatcccgtgatactaatgactctaacgcttatagttgtttatgctcctatcggtatgatgggtggatttactggacaacttttcacagaatttgcttactcacttgccggtgctgtgcttatctctggtatagttgcttatactctctcgccaatgatgtgctcaaaggttcttaaccgtgaaatgatgagctcaaagctagtcaaatttattgataatgtttttagtaaactagcagcaaagtacaaagccttactaatgtttgttttagatatcaaacctgccatagcaattgttggaattatagttttagcaagctgttttatcatggggaaaggtattaaatctgaattagctccaaatgaagatatgggcttcttaggagttatgggacaagctccgtcatcagcaaatattaactatctagagacctttggcaaaaagctagcaaacacacttgatgaaattccaggtaaacaaaatgtctttattcttaatggtataatgagctctaatgtgatttttggcggttttattatgcaaccttgggatgaacgaaaaatatcccagcaacaagctgcaaacattgctcaagccaaagtcactgaattacctggtgttcaaacatatacataccaaacgcctgctttaccagggattccacgcggagctccactttcattagttattcaaagtgtcaatgactatgaagctatcgatgagatcactaataaaatcattgcaaaaatgatgagcaatggattatttgtatttgctcagagtgaccttaagtttgataatcctattgttgatattaatattgatcgtgataaggctggaattttaggtattacaatgtctgatattgctaaaactctaggttattcatacgccggtggttatattaattatttctttttaaaaggctatagtttccaagttattccacagttagctagaaatgagatgcttactcaggaacaacttggtaatatttatatccgttctgatgaaatgaataaactatttgactctgaggtaccattatcagctttagtaaccttcaaaacagaaggacaacctcttacgctaaatactttccaacagttaaatgcatcaacaatttcagctgttatggcaccagggataacccaaggacaagctatagaatatgtccaaagtgttgtcaaaagcatgcttcctgaaggcttttcatataacttctccggttcagcacgtcaatatatcgaaaatggtaatacaatgatggttgcatttgcatttgcgattgtattgatattcttagcattatcagcacagtttgaaagttttagagactcgcttgtaattttagttactattccaatggcaatctctggagcattgattccactctatgttgggcagtacttaggagctagttgggcatctttgaatatttatactcagctaggcttagttactctaataggcttaatatctaaacaaggtattatggttgttgagtttgccaatcacttacaaaaacataatggcatgaacaaatatgatgcgattgttacatcttcgtctcaacgtctaagaccaatattaatgactgtatcagcaatggttgttggcgtaatacctcttgtaacctcatctggagctggtgcaattagtagaaactgtatcggtgtagttatatcaagtggtttagttattggtgcaatattctcactatttgtactacctgtagtatatatgtatatagccagtgacaaatctaaattagtcaaaactgatgctgaacaacaacaaataatagatcaaataaagtaa

SEQ ID NO: 74473 - protein, 1037 aa, Francisella tularensis subsp. tularensis Schu 4
MRLIDLFIRRPVLSLSISFMIIVVGVGSFFKLQVRQYPYIDSATITVTTSYPGANPATIQAFVTRPLEAAVGSSKGIDYMTSESALGTSTITVYVKLGYNTNDVLSEVVQNVNSILNQLPQDAYSPAIKLNPADNFPSLILAFTSKTMNTSEISAYINSELTPKLLAEGGLSEINVWGNMPYAMRIYPNKTRMAEYGITPTELATAIGSNSLVSAGGQIQGPYLNYTLNPETSMSTAQEYRNLIIKKSDNQIVRLSDVARVELGAQNYNSSVYFDGKNAVLAGAVVSPEENPLDVVNRLVKQLPNIKASLPNGLNVDVAYNSTLYIESSIDEVLHTLLEAVIIVSIVMFLFLGSLRAIIVPIIAIPLSIIGSFFLMSIMGFSINLLTLLAMILAIGLVVDDAIVVLENIYRHIEEGMEPFAAAIKGAREIANPVILMTLTLIVVYAPIGMMGGFTGQLFTEFAYSLAGAVLISGIVAYTLSPMMCSKVLNREMMSSKLVKFIDNVFSKLAAKYKALLMFVLDIKPAIAIVGIIVLASCFIMGKGIKSELAPNEDMGFLGVMGQAPSSANINYLETFGKKLANTLDEIPGKQNVFILNGIMSSNVIFGGFIMQPWDERKISQQQAANIAQAKVTELPGVQTYTYQTPALPGIPRGAPLSLVIQSVNDYEAIDEITNKIIAKMMSNGLFVFAQSDLKFDNPIVDINIDRDKAGILGITMSDIAKTLGYSYAGGYINYFFLKGYSFQVIPQLARNEMLTQEQLGNIYIRSDEMNKLFDSEVPLSALVTFKTEGQPLTLNTFQQLNASTISAVMAPGITQGQAIEYVQSVVKSMLPEGFSYNFSGSARQYIENGNTMMVAFAFAIVLIFLALSAQFESFRDSLVILVTIPMAISGALIPLYVGQYLGASWASLNIYTQLGLVTLIGLISKQGIMVVEFANHLQKHNGMNKYDAIVTSSSQRLRPILMTVSAMVVGVIPLVTSSGAGAISRNCIGVVISSGLVIGAIFSLFVLPVVYMYIASDKSKLVKTDAEQQQIIDQIK

SEQ ID NO: 74474 - DNA, 3171 bp, Synechococcus elongatus PCC 6301
  CDS (1)..(3171): transl_table=11
atgttgctttcgatcgcaaatatctttatcaagcggccagtgttaacaacggtctgctcgattctgattactctgggcggccttgtttgcttacccattttgcctattgagcaactcccagatattgccccaccccaaatccaagtctcagcaacctatgttggggccgatgctgaaacagttgaaaacactgtcacttcaatccttgagaaccaaatcaacggggttgaggggatggaatacatcacctcaacgagtgcgatcggtcaaagctccatccaagtctattttgatccgacgcgatcgcctgacctcgctcaggtcgacgttaataacttagtcagtgttgcgatcccacaactgccccaagcagtacaacagcaggggattgcagtcacgcagtcatccccttcaattctccagttctatacgttttcttcgcctacaggcgaatttgatgcccagtttattagtaactatctcagtctctatgttcagccagcactcgcccgtgtaaaaggggttggtcaagcaaacctgtttggtaacttagagtactctatgcgactctggctcgacccaaatcgcttggcgagctatggcttgaccgcagaagatgtcgccagtgctttacagagccaaaaccaaatcattccggttgggcaagttggcggtccgccagtcaatagcgatcaggcttacacattcattttgcgactgcaggggcaagggcaactctctacggttgagcaattcaataacgtcgttttaaaaaccggtgaggacggcactctcgttcgagtcaaggatgtcggtcgagccgaggaaggtgcccaaagctattccgtgactctggctgcagatggtcgcccgggcgtcggtctcggtatttatcagctgccaggcagtaacgctattgatgtcgccaacggcattcgtgagcagcttgccattctagagcagcagttcccaccaggcttggaagggaagctagtcttcgacgtcactgacttcgttaacgcttcactgtcggaagtgctgatcaccctggttcaggcgatcgcactggttattctcgtcatctttatctttttgcaagactggcgcaccacgctcattccagcgatcgcaattcctgtctcgctggttggtaccttggcttttattcaagcctttgggttttcgatcaacttgctgaccctctttggcttggtgttggccacgggcttggtggtggacgacgcgatcgtggtggttgaagcaatcacagaaaaaatagaagagggcaaaacaccgttgcaggcctccattgaggccatggatatcctctttggtgccgtcattgccacgtcagtcgttctgtttgctgtcttcattcctgtggcttttttcccgggggcaactggacggatctatcagcagttcgcactgacgctcacgtttacgatcctgatttcaaccttcaacgccctgaccttctcgcccgcgatgagcgctttgctgctccggccggccaaacagcagcagggttggttgggtaagtttttcaacctattcaatgcaggctttgatcgggtgcgaatcggttactccaaagccttggctattatcgatcgcctcaaatttctggtcatcggcctattcgccgctggtctggccctgacgggatggttgtttacgacaacccccaccggctttgttcccacagaagaccagggttacttcctcggtttgatcattggccccgaaggagccccccttaactacacccagaaagtcggccaaaaaattcaaagcattctggagactgagccttctgtcacctcaacggctgtgatcagcggctttagcttcattggacagggcaataacctcggaatctatttcgcatcgctcaagccctgggatgagcgcaaggctgccgatcaatctgcagaagcgatcgtgggtcgaatcaaccaaaagttatttgaagggatttctgaagctcaagttcggactctgttgccacctgcaattcccggctttgcagcctacggcggggtgcagttcctcatcacagaccaaacgggcggcgcgctctctgtcagccagtttttagagtctgtcaacaaaatcattggactcgctcgcgagaatccgatcacccgccaaacctttacacccttcacggccaactcgccccagatcgaaattgacgtcgatcgcgacagactggcagccctcaacatcgacttcggtgaagcgctccagaccttgggcagctacatgggcggtcagtatgtcaaccagatcacccagttcggccgctcctatcaggtctatatccaagcggataacggcttccgagcaacacctcaagccctgactcagatttatgtgaagtcgcgagatggagccacagttcccctctctgaatttctgacgattcggcagcaggttgggccactgtacatcactcactacaaccttttccgttcgatcgaagtcgatagctttgcggctcccggcaccagtaccggtcaggtcattgaaggtctgaaagatgccttccagaaagcaaacttccagcggtttggaaacggcctggttggtctggcccgcgaagaagtctctgcaggaacgttggcacccctgatctttggccttggggtggtggtcgtcttcctcgtcttggcggcgctctacgagagctacgtcgacccactgatcattctgctgaccgttcccttggcaatcttgggcgccctcgtcttcctcaacctgcggggcatccccttggacgtctatgctcaggtcggcttggtgatgctgattggcttggcttctaagaacgcgattttgattgttgactacgccaatgaggcggttgccaagggtatgggctataccgaagcggcgctggaagcggcgaagctacggttccgcccgattgtaatgacagctatttccagcttgattggcttctttcccttggtcattgcccagggggcaggcgccgctagtcgttggtcgctggggaccgtcgtctttggtgggctcttggttgcaacagttctcagcttgctgatcgtgccggcgaactatgtgattctgaagtcgatcacccgacgtttctttagcaagaagcggcatgacccggagactggtcagcctgaattgacctcttag

SEQ ID NO: 74475 - protein, 1056 aa, Synechococcus elongatus PCC 6301
MLLSIANIFIKRPVLTTVCSILITLGGLVCLPILPIEQLPDIAPPQIQVSATYVGADAETVENTVTSILENQINGVEGMEYITSTSAIGQSSIQVYFDPTRSPDLAQVDVNNLVSVAIPQLPQAVQQQGIAVTQSSPSILQFYTFSSPTGEFDAQFISNYLSLYVQPALARVKGVGQANLFGNLEYSMRLWLDPNRLASYGLTAEDVASALQSQNQIIPVGQVGGPPVNSDQAYTFILRLQGQGQLSTVEQFNNVVLKTGEDGTLVRVKDVGRAEEGAQSYSVTLAADGRPGVGLGIYQLPGSNAIDVANGIREQLAILEQQFPPGLEGKLVFDVTDFVNASLSEVLITLVQAIALVILVIFIFLQDWRTTLIPAIAIPVSLVGTLAFIQAFGFSINLLTLFGLVLATGLVVDDAIVVVEAITEKIEEGKTPLQASIEAMDILFGAVIATSVVLFAVFIPVAFFPGATGRIYQQFALTLTFTILISTFNALTFSPAMSALLLRPAKQQQGWLGKFFNLFNAGFDRVRIGYSKALAIIDRLKFLVIGLFAAGLALTGWLFTTTPTGFVPTEDQGYFLGLIIGPEGAPLNYTQKVGQKIQSILETEPSVTSTAVISGFSFIGQGNNLGIYFASLKPWDERKAADQSAEAIVGRINQKLFEGISEAQVRTLLPPAIPGFAAYGGVQFLITDQTGGALSVSQFLESVNKIIGLARENPITRQTFTPFTANSPQIEIDVDRDRLAALNIDFGEALQTLGSYMGGQYVNQITQFGRSYQVYIQADNGFRATPQALTQIYVKSRDGATVPLSEFLTIRQQVGPLYITHYNLFRSIEVDSFAAPGTSTGQVIEGLKDAFQKANFQRFGNGLVGLAREEVSAGTLAPLIFGLGVVVVFLVLAALYESYVDPLIILLTVPLAILGALVFLNLRGIPLDVYAQVGLVMLIGLASKNAILIVDYANEAVAKGMGYTEAALEAAKLRFRPIVMTAISSLIGFFPLVIAQGAGAASRWSLGTVVFGGLLVATVLSLLIVPANYVILKSITRRFFSKKRHDPETGQPELTS

SEQ ID NO: 74476 - DNA, 3177 bp, Gluconobacter oxydans 621H
  CDS (1)..(3177): transl_table=11
atgtcattgtcccgcttcttcattgaccgacccatctttgcatgggtcatcggtctgatcatcatgcttgtcggcgctgtcgcgatcacgcgcatgccgatcgcgcagtatcccagcatcgcaccgccgcagatcgccatttcggtcatgtatccgggtgcatctgccgagacggtgaacaacacggttgtgcgcccgatcctgcagcagatgtatggtctggatcatctcgaatatctgtccgcttcgtcttatgcgagcggccagatggagattgacctgaccttcgagcagggcacggatcctgacattgcgcaggttcaagtccagaacaagctgcagctcgcccagccgcgtctgccgtcggaagtgacggcccaggggctgagcatcacgaaggccaccaagaacttcatgatggttctggccttcatttccgaagacggcagcatgtccggtcaggacattgcggactatgtggcgtccaacatttccgatccgctgtcgcgtgtgtcgggcgtgggcgatcacacgctgttcggctccgaatatgcgatgcgtgtctggctggacccgtccaagctgtacaatttcggcctgacggtcggggatgtgcagacggcgatttcggcccagaacattcaggtctcgtctggtgagctgggtggtctgccggccaagaagggtatcggtttcgatgccacgatcattggtccgacccgtctgagtacgccggagcagttcaaggaaatcctgctcaaggtgcagcaggatggcagtcaggtgcgcctgaaggatgtggcgcgcgtcgagcttggagcgcagagctacgcactcgggtctgtctataacaaccatcccgcttccgcgatggcgctcaagctggcgccgggtgcgaaccagctcaagaccgaagcagctgtccgcgcgcgtctgaacgagctgagccgctatttcccgcaggggctgaagctcgtctatccgctggataccgagccgtttatcacgctgtcgatccatgaagtggtccagacgctgatcgaggccattgtcctcgtgttcatcgtgatgctgatcttcctgcagaacttccgcgcgacgctgatcccgacgatcgcggtgccggtggtgctgctgggaacgttcgggctgatgtccattctgggctacagcatcaatacgctgaccatgctggccatggttctggcggtcggtctgctggtcgatgacgcgatcgtggtggttgagaacgtcgagcgtgtcatgacggacaaggggctgtctcccaaagaagcggcccgcgtctccatggacgagatctcgggcgcgcttgtcggtatcgtgctggtgctgacggcggtgttcctgccgatggcggcctttggcggctcgacgggtgtgatctatcgccagttctccatcaccatcgtcgcggccatgtggctgtcggttctggtggcgatggtcatgacaccggcgctgtgcgcgtccatgctcaagccgacgcataaaggccatgaacgtggtcccgcggcgtggttcaaccggacgttcgatcgtctgacgaacgggtatatcggcggcgtgaaatggctgatccgcgtgccggtcgtcagcatgatcgggttcgccctgctgaccggtctggttgcgttcctgttcatgcgggtgccgggcgggttcctgccggatgaggatcaggggatcatcttcggccaggttaccatgcgcaacggggcaacccaggagcagacggccgccgtcaaccgcaagatcaccgattacgttctcaagacctacggccagtatgttgaatccgtcttcaccatgacgggcttcagcttcgcgggtcaggggcaaagtgcgggtgcattcttcatccgcatgaagccctgggatcagcggccaggttccgcgcatacgaccatgacggtgtcgcgtgaaatcatgatgcatttctggatggatccggaagcgcagatcttcgcagtcaatccgccggccgtgatggagctgggtaatgcgaccggctttgaccttgagctggaagacaccggacatctgggtcatgacgctctgctggcagcgcgaaaccagatcctgagtgaagcagcacagaatccgctgcttcaggcggtccgcccgctgggtatggaagatgcgccgcagttcagtctggacattaaccgcgagcgcgccaacgcgcttggcctgaccaatgcggatatcaacacgacgctcgaaggggctctgggctccatctacgtcaaccagttcatgcgcaacgaccgtgtcaaacaggtctatatccagggcgaaccctgggcgcgtatgacgccggaggatctgaaccgctggtatgtccgcaatgcgatcgggacgatggtgccgttcaacgccttcgcctcggggcactgggtcaatggtccgcagaaggtcgaggactataacggtctgaacgcctatgaaatccaggggcagccggccgtgggcgcaagctcgggtcaggccatggcggaaatggagaagctgctggccaagctgccgcgcggtatcggttacgaatggacgggtctgtccttcgagcagttggcgtcgggtggatcgacggcaccgctttatgcgctggccacggtggtcatcctgttctgtctggcggcgctgtatgaaagctgggccattccgttcgcggtgctgctggtgctgccgctgggtgtgcttggtgcgatcgtagcgacgctgggccgcgggctttccaatgacgtctatttccaggtgggtctgctgacgacggtgggtctgtcggtgaagaacgcgatcctgattgtggaatttgccaaggccttctttgaaagcggcgaaactctggaagattcggttctggaagccgggcgcgagcgtctgcgtccgatccttatgacctcgatcgctttcgtctgcggtgtgtttccgctggcgattgcgacgggtgcgggatcggcggcgcgtgtggcgatcggcacctgcgtggtgggcggcatgctctccgcgacgctgctggcgatctacttcgtgccggtcttcttcgtggtggtgctgcgtctgttccgcgtcacgcgtgtgcgtgaccgcaaggacccgtatgcccatctggacaacaaggcggcacctgtcgccgaaggggagcacggcgcatga

SEQ ID NO: 74477 - protein, 1058 aa, Gluconobacter oxydans 621H
MSLSRFFIDRPIFAWVIGLIIMLVGAVAITRMPIAQYPSIAPPQIAISVMYPGASAETVNNTVVRPILQQMYGLDHLEYLSASSYASGQMEIDLTFEQGTDPDIAQVQVQNKLQLAQPRLPSEVTAQGLSITKATKNFMMVLAFISEDGSMSGQDIADYVASNISDPLSRVSGVGDHTLFGSEYAMRVWLDPSKLYNFGLTVGDVQTAISAQNIQVSSGELGGLPAKKGIGFDATIIGPTRLSTPEQFKEILLKVQQDGSQVRLKDVARVELGAQSYALGSVYNNHPASAMALKLAPGANQLKTEAAVRARLNELSRYFPQGLKLVYPLDTEPFITLSIHEVVQTLIEAIVLVFIVMLIFLQNFRATLIPTIAVPVVLLGTFGLMSILGYSINTLTMLAMVLAVGLLVDDAIVVVENVERVMTDKGLSPKEAARVSMDEISGALVGIVLVLTAVFLPMAAFGGSTGVIYRQFSITIVAAMWLSVLVAMVMTPALCASMLKPTHKGHERGPAAWFNRTFDRLTNGYIGGVKWLIRVPVVSMIGFALLTGLVAFLFMRVPGGFLPDEDQGIIFGQVTMRNGATQEQTAAVNRKITDYVLKTYGQYVESVFTMTGFSFAGQGQSAGAFFIRMKPWDQRPGSAHTTMTVSREIMMHFWMDPEAQIFAVNPPAVMELGNATGFDLELEDTGHLGHDALLAARNQILSEAAQNPLLQAVRPLGMEDAPQFSLDINRERANALGLTNADINTTLEGALGSIYVNQFMRNDRVKQVYIQGEPWARMTPEDLNRWYVRNAIGTMVPFNAFASGHWVNGPQKVEDYNGLNAYEIQGQPAVGASSGQAMAEMEKLLAKLPRGIGYEWTGLSFEQLASGGSTAPLYALATVVILFCLAALYESWAIPFAVLLVLPLGVLGAIVATLGRGLSNDVYFQVGLLTTVGLSVKNAILIVEFAKAFFESGETLEDSVLEAGRERLRPILMTSIAFVCGVFPLAIATGAGSAARVAIGTCVVGGMLSATLLAIYFVPVFFVVVLRLFRVTRVRDRKDPYAHLDNKAAPVAEGEHGA

SEQ ID NO: 74478 - DNA, 3171 bp, Xanthomonas oryzae pv. oryzae KACC10331
  CDS (1)..(3171): transl_table=11
atgcctaagttttttatcgaacacccggtctttgcgtgggtggtggcgatcctgatctcgcttgcgggcgtgatctcgatcctgaatctgggtatcgagtcgtacccgacgatcgccccgccgcaggtcaccgtcaccgccaacttccccggcgccagcgccgacaccgccgaaaaggaggtgacccaggtcatcgagcagcagctcaccggtatcgaccacctgctgtacttcaactcgtcctcggccgccaacggccgcgtgaccatcaccctgaccttcgaaaccggcaccgacgcggatattgcgcaggtgcaggtgcagaacaaggtgtcgttggccgcaccgcgtctgccgtcggaagtgacccagcaaggtgtggtggtggccaaggccaacgccggcttcctgatggtggccgcgctgcgctcggataatccgtcgatcaaccgcgacgcgctcaacgacatcgtcggctcgcgcttgctcgagcagatttcgcgcgtgcctggcgtgggcagcaccaaccagttcggcgccgagtatgcgatgaacatctggttgaacccggagaagctgcagggctacaacctgtcggccacccaggtgctgaccgcggtgcgtaaccagaacgtgcagttcgctgccggttcggtgggcgccgacccgaccccggaaggcatcagcttcaccgccacggtgtcggcggaaggccgcttcagctcgcccgagcagttcgaaaacatcatcctgcgcaccgataacaacggtgccaccgtgcgcttgaaggacgttgcacgcgtgaccgtggggccgagcagctacggcttcgacacccagtacaacggcaagcccaccggcgccttcggtatccagctgttgccgggcgccaacgcgttgaatgtgtccgacgcggtcagcgccaagctcgacgaactgcagccaaccttcccgcaaggcgtgacctggtttgcgccgtacgaatcgaccaccttcgtgcgcatctccatcgaggaagtgatccacacgctggtggaagccatcgtgctggtgttcctggtgatgctgttgttcctgcagaacttccgcgccaccgtgattcccacgctggtgattccggtcgcgttgctgggcacgttcttcggcatgtacgtgatcggcttcaccatcaaccaactgacgctgtttgcgatggtgctggcgatcggcatcgtggtggacgatgcgatcgtggtgatcgagaacgtcgaacgcatcatgagcgaagagcatctggagccgaaggcggccacccagaaggcgatgacccagatcaccggcgcagtggtggccatcaccgtggtgctggcggcggtgttcatcccctcctcgctgcagcctggcgcctcgggtgcgatctacaagcagttcgcgttgaccatcgccatgtcgatgggcttctccgccttcctcgcgttgagcttcaccccggcgctgtgcggcgcgttcctcaagtcgacccactccaccaagaagaactgggtctaccgcaccttcgacaagtactacgacaagctggcgcatcgctatgtcggcgtggtcggtcacaccctcaagcgctcgccgccgtggatgatcgcgttcgtggcgctgatggtgctgtgcggcttcctgtttacgcggatgccgggcagcttcctgccggatgaagaccagggctttgcggtggccatcgtgcagctgccgccgggcgcgaccaagatccgcaccaacgaggcgttcgcgcagatgcgtgcggtactggagaagcagccggcggtggaaggcctgctgcagatcgccggcttcagcttcctgggctcgggcgaaaacgtcggcatgggcttcatccggctcaagccgtgggacgagcgtgacgtcacggccgggcagttgatccagcaactcaatggcgccttccacagcatcaagggcgcgcagatcttcgtggtcaacctgcctaccgtgcagggtctgggccagttcggcggcttcgacatgtggctgcaggaccgttccggtgccggccaggaagcactgatcaatgcgcgcaacatcgtgctcggcaaggccgcggagaagcaggacaccctggtgggcgtgcgcccgaacggtctggaaaacgcgccgcagctgcagttgcatgtggaccgcgtgcaggcgcaatcgatgggcctgaatgtcagcgacatctacagctcgatccagctgatgctggcgccggtgtacgtcaacgactacttcgccgagggccgcatcaagcgcgtcaacatgcgcgccgacgatcagttccgcgccggccccgagtcgctacgcaacttcttcactcccagcaccaccgccaccggtaccgacggccagccggcaatgattccgctgagcaacgtggtcaaggccgagtggaactacgcctcgccggcgttgaatcgctacaacggctattccgccgtgaacatcgtcggcaacccggccccgggccgcagttcgggccaggcgatgagcgcgatggaagagatcgtcaacaacgatctgccacctggcttcggcttcgactggagcggcatgtcgtaccaggaaatcatcgccggtaatgctgccacgctgttgctggcgttgtcggtggtggtggtcttcctgtgcctggccgcgctttatgaaagctggtcgattccggtggcggtgctgatggtggtgccgatcggcgtgttgggggcgatcaccttctcgatgctgcgcggcttgccgaacgatctgtacttcaagatcggcatgatcacggtgattggtctggccgcgaagaacgcgatcttgatcgtggaattcgccgtggagcagcgtgcggcgggcaagagcctgcgcgaggccaccctggaagcggcgcatctgcggttccgtccgatcctgatgacctcgttcgcgttcatcctcggcgtgctgccgctggccatctccaccggtgccggcgccaacgcgcgccattccatcggtaccggcgtgatcggcggcatggtgttcgccaccgtgctcggcttgatcttcatcccgctgttcttcgtggtggtgcgccgcatgctgggcgagaagctggatgagcagtccaaggactatctggttgcgcagaacgatggtggcacccaccacccggatcgctga

SEQ ID NO: 74479 - protein, 1056 aa, Xanthomonas oryzae pv. oryzae KACC10331
MPKFFIEHPVFAWVVAILISLAGVISILNLGIESYPTIAPPQVTVTANFPGASADTAEKEVTQVIEQQLTGIDHLLYFNSSSAANGRVTITLTFETGTDADIAQVQVQNKVSLAAPRLPSEVTQQGVVVAKANAGFLMVAALRSDNPSINRDALNDIVGSRLLEQISRVPGVGSTNQFGAEYAMNIWLNPEKLQGYNLSATQVLTAVRNQNVQFAAGSVGADPTPEGISFTATVSAEGRFSSPEQFENIILRTDNNGATVRLKDVARVTVGPSSYGFDTQYNGKPTGAFGIQLLPGANALNVSDAVSAKLDELQPTFPQGVTWFAPYESTTFVRISIEEVIHTLVEAIVLVFLVMLLFLQNFRATVIPTLVIPVALLGTFFGMYVIGFTINQLTLFAMVLAIGIVVDDAIVVIENVERIMSEEHLEPKAATQKAMTQITGAVVAITVVLAAVFIPSSLQPGASGAIYKQFALTIAMSMGFSAFLALSFTPALCGAFLKSTHSTKKNWVYRTFDKYYDKLAHRYVGVVGHTLKRSPPWMIAFVALMVLCGFLFTRMPGSFLPDEDQGFAVAIVQLPPGATKIRTNEAFAQMRAVLEKQPAVEGLLQIAGFSFLGSGENVGMGFIRLKPWDERDVTAGQLIQQLNGAFHSIKGAQIFVVNLPTVQGLGQFGGFDMWLQDRSGAGQEALINARNIVLGKAAEKQDTLVGVRPNGLENAPQLQLHVDRVQAQSMGLNVSDIYSSIQLMLAPVYVNDYFAEGRIKRVNMRADDQFRAGPESLRNFFTPSTTATGTDGQPAMIPLSNVVKAEWNYASPALNRYNGYSAVNIVGNPAPGRSSGQAMSAMEEIVNNDLPPGFGFDWSGMSYQEIIAGNAATLLLALSVVVVFLCLAALYESWSIPVAVLMVVPIGVLGAITFSMLRGLPNDLYFKIGMITVIGLAAKNAILIVEFAVEQRAAGKSLREATLEAAHLRFRPILMTSFAFILGVLPLAISTGAGANARHSIGTGVIGGMVFATVLGLIFIPLFFVVVRRMLGEKLDEQSKDYLVAQNDGGTHHPDR

SEQ ID NO: 74480 - DNA, 3126 bp, Xanthomonas oryzae pv. oryzae KACC10331
  CDS (1)..(3126): transl_table=11
atgaaactctccgacctgtcgatcacccgcccggtgatggcggtggtgatgagtttgctgctgatcgtgctgggggtgatgtcgttcacccgcctcaccctgcgcgagttgccggcgatcgacccgcccatcgtctcggtgaatgtggaatacaccggtgcctcggcggcagtggtggaaagccgcatcacccaggtactggaagacgggctggccggcatcgagggcatttccaccattgaagcgcacagccgcaatggctcctccgatatcagcatcgaattcgtgcaatcgcgcgatgtggaagcggccgccaacgatgtgcgcgacgcggtcagccgcgtgtccgaccgcatgcccgaccaggcgcgcgcgccggagatttccaaggtcgaagccgacgccgaccccatcctgtggctcaacatgagctccagcaccatggacacgctgcagctgtccgactatgccgagcgctatgtcgtcgaccgcttttccagcctggatggcgtggcgcaggtgcggatcggcggacgccagcgctatgcaatgcgcatctggctggaccgcgaccaactggccgcacgcgacctcactgtcgccgatgtggaagcggcgctgcagaacgaaaatgtggaagtgcctgccggcagtatcgaatcggcgcagcgcgatttcaccttgcgcgtggagcgcagttatctcaagcccgaagacttcgccaagctgcccttgaacaagggcgagggcggttacgtggtgcgtctgggcgacgtggccagggtcgagctgagctcggccgagcggcgcgcgtatttccagagtaacggcgtgccgaatgtgggcctgggcatcgtgcgtaactccaccgccaacgcgctggatgtggcccgcaaagcacgcgcgcgcgctatagaagtgcagaagtcgctgccgcagggcacgaatattttcgtcgccttcgacaccaccaccttcatcgacgccgcggtggagcgcgtttatcacacgctggtggaagcggtggtcctggtgctggtggtgatctgggtgtttctgggtagcgcgcgcgccgcattgatccccgcggtgacggtgccggtgtgcctgatcgcctcctttatcgcgctgtatgcgttcgatttttcgatcaacctgctcaccttgctggcgttggtgctgtgtatcggcttggtggtggacgacgccatcgtggtggtggaaaacatccagcgccgcatcgatctgggcgagccgccgctggtggccgccaagcgtggtaccgggcaggtggcgtttgcggtgattgcgaccaccgcggtgctggtggcggtctttgtgccggtcggttttctgcaaggcaataccgggcggctgttccgtgagctggcggtggcgctggcggcggcggtggcgatctcggccttcgtggcgctgacgttgacgcctatgatgtcgtccaagttgttgcgcgcgcatgggcaggccaaacccaatcgctttcaccaatggttcgatgggcgcatgcaggcggtgtccggtgcgtatgggcgctcgctggagcggcatgtgcaccgcacctgggtctttgcgctgctgatgctgttggcgctgggcgccagcgcatggctgatgggccgcattccttccgaagtggcgccggccgaggaccgcggcaatttccagatcatgatcgacggcccggaaggtgccggcttcgattacacggtggggcagatgcatcaggtggaagacatcctgcgccccttcgtgggcccggacaaacccatcgtgcgcgccaacccgcgcgtgcccggcagcttcggcagcagcgaggaaatgcacaccggccgggtcagcgtgttcttgcaggattgggaaaagcgcacccgccccactaccgaagtggccgatgaggtgcagcagaaactcaatgtgctcagcggcgtgcgtgcacgcacgcaggtgagcggaggcctggtgcgtcgccgtgggcaaccgttccagctggtgctgggcgggccggattacgcggagattgcgcagtggcgcgatcgcatcctgcagcgcatggaagccaaccccggcctggtcggccccgactccgattacaaggaaacccgcccgcagatgcgcgtcaatattgatcgcgtgcgcgcggccgatctcggcgtgccggtaactgcgattggcggcgcgctggaagcattgatgggctcacgccgcgtcaccaccttcgtcgacaacggcgaggagtacgacgtgatgctgcaggccgggcgcgaaggccgcatgtcgccggaagatctcaccgcgatccgcgtgcgctccaaccgtggcgagctgattccgctttccaatctggtgactttgagcgaagtcgccgaagccggcaccttgaaccgcttcaatcgcctgcgtgcaatcacgatcacggcgggcctggcaccaggttatccactcggcgatgccatcgcctgggcgcagcaggcggcgcaggaagaactacccgaatacgcgcaagtggactggaagggcgaatcgcgcgaataccagcaatccggcagtgcggtgttgttgaccttcggcatggcgctgctggtggtgtatctggtgctggccgcgcagttcgaaagttttgcgcacccgttggtgatcatgctcacggtgccgttggcggtgctgggcgcgctggtgggcttgtggctgaccggtggcacgctcaacctgttcagtcagatcggcatcgtgatgctggtgggcctggcagccaagaacggcattctgattgtggaattcgccaaccaattgcgcgacgagggccgcagcgtgcatgcggcgatcgtggcgtcggcctcggtgcgtttgcgcccgatcctgatgacctcgattgccacggtggtcggcgcgattccgctggtggtggccggcgggcccggctcggccagccgcgccacgattggcgtggtggtgatcttcggcgtctcgctgtccacggtgttgtcgctgtacgtggtgccggcgttttacagcctgatcgccccgtacaccaggtcgcctgaagcggtggcacgccagctggaaaccctggacgcgcagacaccctcagtgggcggacatgcgtga

SEQ ID NO: 74481 - protein, 1041 aa, Xanthomonas oryzae pv. oryzae KACC10331
MKLSDLSITRPVMAVVMSLLLIVLGVMSFTRLTLRELPAIDPPIVSVNVEYTGASAAVVESRITQVLEDGLAGIEGISTIEAHSRNGSSDISIEFVQSRDVEAAANDVRDAVSRVSDRMPDQARAPEISKVEADADPILWLNMSSSTMDTLQLSDYAERYVVDRFSSLDGVAQVRIGGRQRYAMRIWLDRDQLAARDLTVADVEAALQNENVEVPAGSIESAQRDFTLRVERSYLKPEDFAKLPLNKGEGGYVVRLGDVARVELSSAERRAYFQSNGVPNVGLGIVRNSTANALDVARKARARAIEVQKSLPQGTNIFVAFDTTTFIDAAVERVYHTLVEAVVLVLVVIWVFLGSARAALIPAVTVPVCLIASFIALYAFDFSINLLTLLALVLCIGLVVDDAIVVVENIQRRIDLGEPPLVAAKRGTGQVAFAVIATTAVLVAVFVPVGFLQGNTGRLFRELAVALAAAVAISAFVALTLTPMMSSKLLRAHGQAKPNRFHQWFDGRMQAVSGAYGRSLERHVHRTWVFALLMLLALGASAWLMGRIPSEVAPAEDRGNFQIMIDGPEGAGFDYTVGQMHQVEDILRPFVGPDKPIVRANPRVPGSFGSSEEMHTGRVSVFLQDWEKRTRPTTEVADEVQQKLNVLSGVRARTQVSGGLVRRRGQPFQLVLGGPDYAEIAQWRDRILQRMEANPGLVGPDSDYKETRPQMRVNIDRVRAADLGVPVTAIGGALEALMGSRRVTTFVDNGEEYDVMLQAGREGRMSPEDLTAIRVRSNRGELIPLSNLVTLSEVAEAGTLNRFNRLRAITITAGLAPGYPLGDAIAWAQQAAQEELPEYAQVDWKGESREYQQSGSAVLLTFGMALLVVYLVLAAQFESFAHPLVIMLTVPLAVLGALVGLWLTGGTLNLFSQIGIVMLVGLAAKNGILIVEFANQLRDEGRSVHAAIVASASVRLRPILMTSIATVVGAIPLVVAGGPGSASRATIGVVVIFGVSLSTVLSLYVVPAFYSLIAPYTRSPEAVARQLETLDAQTPSVGGHA

SEQ ID NO: 74482 - DNA, 3072 bp, Vibrio fischeri ES114
  CDS (1)..(3072): transl_table=11
atgcgctttactgatgtttttattaaacgtccagttttagcggtatcgatcagctttttgattgctttgcttggtatccaagcgattttcaaaatgcaggttcgcgaataccctgaaatgacaaataccgttgtaacggtaacaacaagctactatggtgcgagtgctgacttgattcaaggcttcatcactcaacccttagagcaagcggtcgcacaagccgataatattgatttcatgacctctcaatcagtaatgggtcaatcgactattactgtaactatgaaattaaatacggatcctaacgccgcactttctgacatattggcaaaaaccaactctgttcgctctcagctacctaaagaagctgaagatccaaccgtaacgatgtcgacaggctctactacggcggttctttatattggttttactagtgatgagctagtatcaagccagatcaccgattatcttgaacgagtggttaatccacaattgttcaccgttaatggtgtatcaaaagttgacctttatggtggtatgaaatacgcactacgtatctggttagatcctgcacgtatggcggctatcaatatgactgctactgatgttatgggcgtacttaatgccaataacttccaatcagcagctggtcaagctacaggtgaatttgttctttataatggtagcgctaatacacaggtttctgatgttgaagaactagaaaaccttgttgttagaaccaatgatggcgaagtggttcgtttaagtgatatcgcaaaggtatcattagataagagtcatgacgtatatcgtgcaagtgctaacggacaagaagcggttgttgctgcaattaatgctgcaccaagtgcgaacccaattaacatcgctgccgatgtacttgagttgcttcctcaattagagaagaacttaccaagtaacatcaaaatgaacgtgatgtacgattcaacgattgctatcaatgaatcgattcatgaggttatcaagacaattcttgaagcagctttaatcgtactggttgttatcactctgttcttaggttcattccgagcggttattattcctattgtaaccattccactatcacttattggtgtggcaatggtaatgcaagcgatgggattctcttggaacttaatgaccctacttgcaatggtactcgccatcggtctggttgttgatgatgctatcgttgttttagaaaacgttgaccgtcatatcaagttgggagaaacgcctttccgagcagctattattggtactcgtgaaatcgctgttccagttattgcaatgacattaacgctaggtgcggtatatgctccaattgcgatgatgggcggtattacaggctctctatttaaagagtttgcattaacactagcaggttcggtattcgtatctggtatcgtcgcactaacactatctccaatgatgtgttcaaaaatgctagttgcaaatgaagaacctaatcgtttcgagaaaaaagttcatcatattttagataatatgagtgaacgttatgaacgtatgcttaatgtgatcatgactcgtcgtcctgtcattattgcttttgctgttattgtttttgcaagtctaccgctgttattcaagttcatccctagtgagcttgctccatcggaagataaaggggttattatgttgatgggtacagcaccatcaaacgctaaccttgattacatgcaaaatacaatgaatgatgttaataccattctttcaaatcaacctgaagtgtcatttgcacaggtatttaccggtgtaccaaatgcaaaccaagcttttggtattgcctcaatggttccttggagccagcgtgaagcaagccaagcagaggtgacaaaaagagttggtactctagtacaagacgttccaggtatggcggttacagccttccaaatgccagaacttcctggtgctggttctggtctaccaattcaatttgttattacaacacctaacagctttgaaagcttattccaaatagctaccgaagtattaactggtgttaaaggtagtccactatttgtttattcagatctagatttgaacttcgattctgcaacaatgaagatcaacattgataagaataaagcaggtgcttacggtgttacgatgcaggatatcggtatcacactaagtacaatgatggctgatggctatgtaaaccgaattgacttaaatggtcgctcgtacgaagtaatccctcaagttgaacgtaaataccgtttaaaccctgagtcaatgaacaattactatgtacgttcggcgagtggtgaagcggttcctcttggtagcttaatttcgattgatgtaattgcagagccacgttcattaccgcactttaaccaattaaactcagcaactgttggcgcagttccaacgcctggtgttgcaatgggtgacgcaattaattggtttgaagatgttgcaaataataagcttccaagtggttacaatcacgactacatgggtgaggctcgtcaatatgtaacggaaggcagtgcattatatgctactttcggtttggctctagctatcatcttcttggttcttgcgattcaatttgaatcaatccgagacccattagtaatcatggtatctgttccattggctatttgtggtgcgttaattgcccttgcttggggagctgcatcaatgaacatctactcacaagtaggtcttattaccttagttggtttgattactaaacacggtatccttatctgtgaagtagcaaaagaagaacaactgcaccatcaaaaaagtaagatggctgcggtaacagaagccgctaaagttcgtctacgtccaatcttaatgacaacagcagcaatgatcgcaggtctaatcccgctattatatgcaactggtgctggtgctgctcagcgcttcagtattggtattgtaattgttgcaggtctagcgattggtacattgtttacgctatttgtacttcctgttatatacagttacttagcaagtgaacataagccgttacctgtcttcgaagaaggcaaagagattaaagaatcttaa

SEQ ID NO: 74483 - protein, 1023 aa, Vibrio fischeri ES114
MRFTDVFIKRPVLAVSISFLIALLGIQAIFKMQVREYPEMTNTVVTVTTSYYGASADLIQGFITQPLEQAVAQADNIDFMTSQSVMGQSTITVTMKLNTDPNAALSDILAKTNSVRSQLPKEAEDPTVTMSTGSTTAVLYIGFTSDELVSSQITDYLERVVNPQLFTVNGVSKVDLYGGMKYALRIWLDPARMAAINMTATDVMGVLNANNFQSAAGQATGEFVLYNGSANTQVSDVEELENLVVRTNDGEVVRLSDIAKVSLDKSHDVYRASANGQEAVVAAINAAPSANPINIAADVLELLPQLEKNLPSNIKMNVMYDSTIAINESIHEVIKTILEAALIVLVVITLFLGSFRAVIIPIVTIPLSLIGVAMVMQAMGFSWNLMTLLAMVLAIGLVVDDAIVVLENVDRHIKLGETPFRAAIIGTREIAVPVIAMTLTLGAVYAPIAMMGGITGSLFKEFALTLAGSVFVSGIVALTLSPMMCSKMLVANEEPNRFEKKVHHILDNMSERYERMLNVIMTRRPVIIAFAVIVFASLPLLFKFIPSELAPSEDKGVIMLMGTAPSNANLDYMQNTMNDVNTILSNQPEVSFAQVFTGVPNANQAFGIASMVPWSQREASQAEVTKRVGTLVQDVPGMAVTAFQMPELPGAGSGLPIQFVITTPNSFESLFQIATEVLTGVKGSPLFVYSDLDLNFDSATMKINIDKNKAGAYGVTMQDIGITLSTMMADGYVNRIDLNGRSYEVIPQVERKYRLNPESMNNYYVRSASGEAVPLGSLISIDVIAEPRSLPHFNQLNSATVGAVPTPGVAMGDAINWFEDVANNKLPSGYNHDYMGEARQYVTEGSALYATFGLALAIIFLVLAIQFESIRDPLVIMVSVPLAICGALIALAWGAASMNIYSQVGLITLVGLITKHGILICEVAKEEQLHHQKSKMAAVTEAAKVRLRPILMTTAAMIAGLIPLLYATGAGAAQRFSIGIVIVAGLAIGTLFTLFVLPVIYSYLASEHKPLPVFEEGKEIKES

SEQ ID NO: 74484 - DNA, 3153 bp, Vibrio fischeri ES114
  CDS (1)..(3153): transl_table=11
atgctaagtcgattttttatacagcgtcctaaatttgctctggttatttctattatcctcactcttgccggagccattgcattagcagtattacctgttgctgaatacccaaaaatcagtccgccatcggttagtgtaagtgcttactacacgggggcaagtgctgaggtggttgaacaggcgattgctgaccctatagaaacctccgtcaatggcgtagagaacatgatttacatgtcttcaaaaagtgccaacgacggttcatattcattaaatgtcacctttgatgtgggcaccgatcctgacatggcacaggttaacgttcagaaccgtgtggcgcagattgaatctaaattgccacaagaagtgcgtatggtgggggtgactgttaagaagcgttctccagaccttttaatggtattgaacttctactcgcctgatgggaaatatgacgatcaattcttaattaactacgtaaatctgaatatcaaagatcagttggctcgtgttactggcatcagtgaagttggtgtgcttggtggtggtgaatacgccatgcgtgtttggcttgatccagataaaatgaccaacttaggtttaaccacatccgatgttcatgccgcgttagctgaacaaaacgtacaagttgcagcgggtaaaattggtgctgcaccttatgcgagtgcgcaagatgtgcagtttaacctcgtaacgaaaggacgtttagagtcggttgaagagtttgaaaatgtcgttcttcgagcaaataacgatggatcttctgtttatttaaaagacattgcccgtgttgagttaggcaagaaattctatgacggtaatggtcaattcagaggaaaagacgcctctatcgtaacgctttctttgcaatctgatgcgaacgcattggagagtggaaaggcggtaatggagatgcttgaaaagctaagtgcgactttccctgaaggtctggcgtatgaaaccagttatgacactacgctgtttgtttcagaatccattaaaggggtagtaaaaaccttaattgaagcgattctattggttattgctgtaacgtatctgttcttaggcagtgctcgtgcgacgttaattccagttgtagctattccagtatccttaattggtacctttgctgtcatgcttatgacagggtttaccattaataccgtgacgttatttggtcttattcttgccattggtattgtggtggatgatgccattttggttattgaaaacgtcgatactattatgaagcgtgatccttcattaagcccaagaaaagccactctaattgcgatgaaagaagtaacaggcccaatcattacttctactcttgtactgcttgcggtatttattcctgttgccatgcttccgggtattactggcatcatgtatcgtcagttcgcattaaccatctgtattgcggtaattatttcatccattaatgcactgacactgtcgccagcattgtgttctctggttctaaaacggggaggggataatacggctcgttggtttaaagcctttaaccgtggtttagataaagtaacggataaatacggtgagattgctggtttctttgtacgaaaaaccatgatcctgatgacattctttgtgattgctttaggtgcagtaaccttctttgcaaagaccacatcaacggcgtttgtaccacaagaagataagggtattttactggttaacgttcaactacctgattcagcgtcactttctcgtactgaagaggtatctgccaaagtgcttgaaatcatagagcaagagcaaggtgttgatggggttaccgtcgccaatggttatgcgtttttaacaggtgcggcagcatcaaatggtgcgtcactgtttgtgaaattaaagccttggggtgagcgtaatgacatggatggagataactcttcatttgcaattaccaaccgcattaacgggcgtgcagcgatggagttaccagaagccgttatttttgcaatgggtgcaccagcggttccgggaatgggggcagcgtctggttttgaatttgttcttgaagataccttaggtcgtagtcgtactgatttggctaatgttatgaatcaagtgattcaaaccgccaatcaacagcctgaaattcaatatacattcagtacgttccgtgccaatgttccacactactatgtggatattgaccgtgaaaaagcaaaacaattaggcgtgtcattaggctctattttccaaacactgcaaggtaacttaggttcaatgtacgtgaatgactttactatgtttggtaagaacttccgagttacgatgcaagcagatgggcagtatcgtagcagcatggatgatttggataaattccacgttcgtgcaagctcggggcaaatggtgccattaagtacattagtcacttatgacacggtatttgaacctgatgtagcgtggcgttacaacatgtatcgttcagctgtgatccaaggacagccagcggctgggtattcaagtggtgatgccattgcagcgatggaacgtgttgcagctgaagtgcttccacatggttaccaatatgaatggactggtatggcgtatcaagaagtgaaagcgggtaaccaagcgatttatgcgtttgcgctagcgctgatctttatctatctattcatggtggcacaatacgagagttggagtattcctcttgcgattattcttgtggtgccagtggcaacctttggctccttccttgcgcttaatttaacggggatgccgttgaatttatacgcacaaattggtttggttcttttaatcgcattggccgccaaaaatgccattttgattgttgaatttgcgaaaaatgagcgtgaagagaaagaagtgggcttagatgatgcgtcagtaaacggtggtcgattacgattccgtgcggtaaacatgacatcgtggtcgtttatcttgggtatcttaccgcttgtgtttgcatcgggtgcaggctacatcagccaaaactcattgggtgtgtcgttgattggtggcctactgtgtgtgttattagtgggtacgctacttatccctggcttctatgcaatggtacaacgtcgtcgtgaaaagctgcacggcggaagcaccaaacttattcctttagacgatgagtaa

SEQ ID NO: 74485 - protein, 1050 aa, Vibrio fischeri ES114
MLSRFFIQRPKFALVISIILTLAGAIALAVLPVAEYPKISPPSVSVSAYYTGASAEVVEQAIADPIETSVNGVENMIYMSSKSANDGSYSLNVTFDVGTDPDMAQVNVQNRVAQIESKLPQEVRMVGVTVKKRSPDLLMVLNFYSPDGKYDDQFLINYVNLNIKDQLARVTGISEVGVLGGGEYAMRVWLDPDKMTNLGLTTSDVHAALAEQNVQVAAGKIGAAPYASAQDVQFNLVTKGRLESVEEFENVVLRANNDGSSVYLKDIARVELGKKFYDGNGQFRGKDASIVTLSLQSDANALESGKAVMEMLEKLSATFPEGLAYETSYDTTLFVSESIKGVVKTLIEAILLVIAVTYLFLGSARATLIPVVAIPVSLIGTFAVMLMTGFTINTVTLFGLILAIGIVVDDAILVIENVDTIMKRDPSLSPRKATLIAMKEVTGPIITSTLVLLAVFIPVAMLPGITGIMYRQFALTICIAVIISSINALTLSPALCSLVLKRGGDNTARWFKAFNRGLDKVTDKYGEIAGFFVRKTMILMTFFVIALGAVTFFAKTTSTAFVPQEDKGILLVNVQLPDSASLSRTEEVSAKVLEIIEQEQGVDGVTVANGYAFLTGAAASNGASLFVKLKPWGERNDMDGDNSSFAITNRINGRAAMELPEAVIFAMGAPAVPGMGAASGFEFVLEDTLGRSRTDLANVMNQVIQTANQQPEIQYTFSTFRANVPHYYVDIDREKAKQLGVSLGSIFQTLQGNLGSMYVNDFTMFGKNFRVTMQADGQYRSSMDDLDKFHVRASSGQMVPLSTLVTYDTVFEPDVAWRYNMYRSAVIQGQPAAGYSSGDAIAAMERVAAEVLPHGYQYEWTGMAYQEVKAGNQAIYAFALALIFIYLFMVAQYESWSIPLAIILVVPVATFGSFLALNLTGMPLNLYAQIGLVLLIALAAKNAILIVEFAKNEREEKEVGLDDASVNGGRLRFRAVNMTSWSFILGILPLVFASGAGYISQNSLGVSLIGGLLCVLLVGTLLIPGFYAMVQRRREKLHGGSTKLIPLDDE

SEQ ID NO: 74486 - DNA, 3081 bp, Rhodobacter sphaeroides 2.4.1
  CDS (1)..(3081)
atgaacatctcggaaatcttcatccgccgccctgtcgcctcgacggtgctggcgagcttcatcctgctgatcgggctctattccatcttcaacctgccggtccggcaatatcccgaggtggaggagacggtcgtcaccatcaccaccacctatccgggggcctcgcccgacctgatccagggcttcatcacggcccccatcgcccgcgccgtcgcgacgaccgagaacatcgactatgtgaccagccagagccggccttcggcctcggtcgtctcggtgcagatgaagctcggcgcgaattcggacgtggcgctgaccgaggtgctggccaaggtccagcaggtgcggggcgaactgccctcggaggccgaggatccggtgatcgtgaagggcacgggcgacaatttcgcgctcatgtatcttgcggcgctgaaccccaacatgtccgccgagcagatgacggaatatctcgagcgggtgatccggccgcggatgtccaccatcgagggcgtggccgagatccagatcatcggcgcggccgaatatgcgatgcgggtctggatcgatccgatgaagctcgccgcgcgcaacgtgaccgcctcggaagtgctgacggcgatccgggcctcgaacttcctgtcggcgccggggcgcaccgagggcgaatatttcgcccggtcgatcaagctgcaatcgacgctgcagacccccgaggccttcggggcgctgccgatccgttcgcagggtgacgaggtcgtgcgcctgcgcgacgtggccgatgtggagctggcctcggccgagcccgacagcatcgtgaccttcaacggccagcccggcaccttcatcgggatcttcccgacaccggccgcgaacccgctgaccaccgaggccgcagtgaatcgaggaactgcccgcgaatcaatgccaccctgccgagggggatggagatcaacctcgtctacgactcgaccgagaacgatcaccgactcgatctacgaggtgttcaagacgctcgccgaggacgtggacatcgtggtggtcgtgatcctcctgttcctcggctcgttccgctcggtgctgatgcccatcgtgacgatcccgctctcgctgatcggggtctgcgcggtgctgctggcgctcggctattcgatcaaccttctgtcgcttctggccatggtgctcgccatcgggctcgtggtggacgatgcgatcgtggtggtcgagaacatccaccggcacatcgacgaggggatgagcccctatcacgcggcgttgaaggggatgcgcgagatcaccggccccgtcatcgccatgacgatcacgctggccgccgtgctggcgccgctcggcttctcgggcgggctcaccgggtcactgttcgcggaattcgccttcgcgctggcgggatcggtcatcatctcgggggtggtcgcgctgacgatcacgccgatgatgtcggcgcgtctgctgaaggcgggcaccggcagccgcttccagcgcatcgtcgatcacacgctcgaaggcaccgccaactggtacgagcgccgggtctcctcgtcgctcgactaccggccggtgacgcttctcatggtggcggcgctcgtcgcggtcacgggcttcatgttcatgaacacgacgagcgagctggcgcccgaggaggatcagggcgcgatgttcgcgatcctgaacgggccgcggtacgccaccaaggactataccacgctctacaccgaccggatctcggacgtgaccaaggacattcccgaggtgcgcaccgaattctccatcgcgggcttcggcgggcaggccaatcagggcatctacatctgggcgctgaaggactgggccgaccgcgaccggagccaggccgaggtgcagcaggaggtgcaggcgcggctcgatccggtgccgggggtgcagggcttcgtcttctcgccgccgagcctgccgggcacgggcggcgggttgccgatctcgatggtgctgcagtcgatccagtcgcccgaccgcgtgttcgagatctcggaggagatccgccgtcgcgccgaggcctcgggccgcttcatcgcggtgcagaactcgctcgccttcgatgcgccggaggtggtggccaccatcgaccgggaccgggcagcgacgctgaacgtgccgatctcggacatcggcaacacgctgggacttctggtgggcggggcctcggtcgcgcagttcgaccgcgagtcgaacagctacgacatcatcccgcaggtgccgcgcgactggcgcaacaatccggaacggctgagccagttcttcgtgcgcgccgcctcgggggcgatggtgccgctgacctcggtggtgaatttcgagaccggcgcctcggcggcctcgatcgaacagttcaatcagctcaactccgccacgatctcggccctgccgatgatcggcatctcgaccggcgacggtctggccgagctgcagcagatcgccaacgaggtgatgcccgacggcttcttcctcgactattccggccagtcgcggctcgaggtcgagcagggcaacacgatccttctggccttcgcggcggcggtggtggtgatctacctcgtgctcgccgcgcagttcgagagcttccgcgatccgttcatcatcatgatgtcggtgccgctctcgatcttcggggcgatcctgccgctgaacctcgggcttggcacgctgaacatctacacgcaggtgggcctcatcacgctgatcggcctcatcaccaagcacgggatcctgatggtggaattcgccaaccagcagcgcgaggagcacgggctgaaccggcggcaggccatcgtggcggcggccaaggtgcggctgcggccgatcctgatgacgacggcggccatggcgctggcggtggtgccgctcatcatcgcggaaggtgcgggcgccgaggcgcggcaggcgatggggatcgtgatcttcacgggcctgctgatcggcacctgcttcacgctcttcgtggtgccgatgttctacaccttcatctcgaagccggacaaggaatggcaggcccatcgtgcgatgctggaggcgcgcgaggcctcggcctga

SEQ ID NO: 74487 - protein, 1026 aa, Rhodobacter sphaeroides 2.4.1
MNISEIFIRRPVASTVLASFILLIGLYSIFNLPVRQYPEVEETVVTITTTYPGASPDLIQGFITAPIARAVATTENIDYVTSQSRPSASVVSVQMKLGANSDVALTEVLAKVQQVRGELPSEAEDPVIVKGTGDNFALMYLAALNPNMSAEQMTEYLERVIRPRMSTIEGVAEIQIIGAAEYAMRVWIDPMKLAARNVTASEVLTAIRASNFLSAPGRTEGEYFARSIKLQSTLQTPEAFGALPIRSQGDEVVRLRDVADVELASAEPDSIVTFNGQPGTFIGIFPTPAANPLTTEAAVNRGTARESMPPCRGGWRSTSSTTRPRTITDSIYEVFKTLAEDVDIVVVVILLFLGSFRSVLMPIVTIPLSLIGVCAVLLALGYSINLLSLLAMVLAIGLVVDDAIVVVENIHRHIDEGMSPYHAALKGMREITGPVIAMTITLAAVLAPLGFSGGLTGSLFAEFAFALAGSVIISGVVALTITPMMSARLLKAGTGSRFQRIVDHTLEGTANWYERRVSSSLDYRPVTLLMVAALVAVTGFMFMNTTSELAPEEDQGAMFAILNGPRYATKDYTTLYTDRISDVTKDIPEVRTEFSIAGFGGQANQGIYIWALKDWADRDRSQAEVQQEVQARLDPVPGVQGFVFSPPSLPGTGGGLPISMVLQSIQSPDRVFEISEEIRRRAEASGRFIAVQNSLAFDAPEVVATIDRDRAATLNVPISDIGNTLGLLVGGASVAQFDRESNSYDIIPQVPRDWRNNPERLSQFFVRAASGAMVPLTSVVNFETGASAASIEQFNQLNSATISALPMIGISTGDGLAELQQIANEVMPDGFFLDYSGQSRLEVEQGNTILLAFAAAVVVIYLVLAAQFESFRDPFIIMMSVPLSIFGAILPLNLGLGTLNIYTQVGLITLIGLITKHGILMVEFANQQREEHGLNRRQAIVAAAKVRLRPILMTTAAMALAVVPLIIAEGAGAEARQAMGIVIFTGLLIGTCFTLFVVPMFYTFISKPDKEWQAHRAMLEAREASA

SEQ ID NO: 74488 - DNA, 2979 bp, Magnetospirillum magnetotacticum MS-1
  CDS (1)..(2979)
ttgccggtctcggctctgccccaggtggactttcccaccatccaggtgaccacccaactgccgggcgccagcgccgagaccgtcgccaccctgatcaccacgccgctcgagcgtcagttcggcctgattccgggccttgccgtgatgacctccacctcgtcccagggcaccagcgcgctgaccctgcaattcgatctttccaaaagcatcgacgtggcgtcggaagaagtgcaggcggccatcgacgcggccaggggcgttctgcccacccaactgccctatcccccggtctattccaaggtcaatcccgccgatccgcccatcatgaccctggcgctgacctcggacagcttgcccattacgcgcttgaacgacgtggccgacaccttgctggcccagaagctcagccagatcggcggcgtgggccgcgtgctgatcgagggcggccagcgcccagcggtgcgcgtgcgcatggatccggcccgccttgccgcctatggcctgtccctggaagacgtgcgctcggctttgtccaaggccaatgtggacatgcccaagggcagcttcgatggcgtggcccaggccctttccatcggcgccaacgaccagatttccgaccccctggcctatcccgcccaggtggtggcctggaagaacaatgctccggtgcgcatctccgatctgggcgatgtggtggaaggcgtcgagaattcccgcgtggcgggctggttcgacggcaagcccgcggtgatcctcaacatccagcgccaaccgggcgccaatatcgtcgccacggtggatcgcctgcaggccaagctgcccgagttgaagcggggcgtgccgacgggcatcaagctttcggttctggccgatcgcaccgagaccatccgcgcctcggtggccgatgtggaattcaccctggtgctgaccgttatcttggtgatcggggtgatctgggcctttctgcggtcggtgcgcgccacgctcattcccgccgtcgccctgcctttgtccctgattggcactttcggcgtgatggccctggccgggttcagcctggacaacctgtccctgatggcgctgaccatctcggccggtttcgtggtcgacgacgccatcgtgatgatcgagaacatcgtgcgctatatcgagaagggcatgaagcccttcgaggccgccctggctggtgcccaggaaatcggcttcaccatcgtgtcgctgaccgtttcgctggtggcggtgttcattcccttgctgttcatgaccggcatcgtcgggcggctgttccgcgaattcgccctgacgctggccgtggcggtggtggtctcggcggtggtgtcgctgacgctcactcccatgatgtgcgcccatctgctgaagggcggccacgaagaggccaagtcgggccgctttttcgatgcccttcgtgatgcctatgcccggtcgctggactgggtgctgggccgacaggtggcgaccctgtgggtggccttcgccaccctggtcctgaccatcgggctttacgtcttcatgcccaagggctttttgcccacccaggataccggggtgatcgtggcgaccaccgatgcccgcgccgatgtgtcgtttgccaccatgatggacatgcagcgccgggtgtccgatctggtgcgcaccgaccccgatgtgacggcggtggcctccttcatcggggcgggacccatcaatcccaccgccaataccggccagatgaccatcgtcttgaagcccaggaagcaacgttcggcttccgccgagcaggtgatcgcccggctggccgagctggtggcgccggtggccgggatggagacgcatttccgccctgcccaggatatccagatcagccaccgcaccagccgcacccagtatcagtatacgctgaccgatatcgacgccgccgaactggcccaatgggtgccccagatggtggagcggctgaaagcttcgcccttgctgatggatgtggccaccgattcccaggaaggggggctacaggccgagatccgcatcgaccgcgacaaggcggcgcgcctgggcgtgctgccccaggccatcgacgacatcttgtacgattcttacggccaacgtcagatctccaccatctattcccaggtcaaccagtacaaggtggtgctggaagtgacgccggaataccagggcgggccggaggccctgggctcgctctatgtgcgctcgtccaacggcgccctggtgccgctatcggcggtctcctcggtgagccgggcacgggtgccgctggtcatcacccatcagggccagttcccggcggtgaccatcagcttcaatctggcaccgggtgtgtcgctgggcgccgccacggctgccatcgatggtctgcagcaggagatgggcctgcccgagaccatcaccggcgattattccggcgacgccgccgagttccgccgctcgctggaaagccagccctggctgatcgccgcagccatggtggtgatctacatcgttttgggcgtgctgtatgaaagcaccatccacccggtgaccatcatgtccaccctgccatcggcggggattggggcgctgctggccttggccgccagcgggcacgatctgtccctggtggggctgatcggcatcgtgctgttgatgggtatcgtcaagaagaacgccatcatgatgatcgactttgccatcgaggccgagcgccaccatggcaaaagccccagggaagccatcgtcagcgccagcctgctgcggttccgccccatcatgatgaccaccatggcggccctgctgggcgcccttccgctggccatcgacagcggaaccggggccgagctacggcgtccgctgggcatttccatcgtcggcggtctggtgctcagccagatgatcaccctttacaccaccccggtgatctatctcgccttcgaacggctgaagcggcgattcgcgcccaaggccctggagcaggcgccatga

SEQ ID NO: 74489 - protein, 992 aa, Magnetospirillum magnetotacticum MS-1
MPVSALPQVDFPTIQVTTQLPGASAETVATLITTPLERQFGLIPGLAVMTSTSSQGTSALTLQFDLSKSIDVASEEVQAAIDAARGVLPTQLPYPPVYSKVNPADPPIMTLALTSDSLPITRLNDVADTLLAQKLSQIGGVGRVLIEGGQRPAVRVRMDPARLAAYGLSLEDVRSALSKANVDMPKGSFDGVAQALSIGANDQISDPLAYPAQVVAWKNNAPVRISDLGDVVEGVENSRVAGWFDGKPAVILNIQRQPGANIVATVDRLQAKLPELKRGVPTGIKLSVLADRTETIRASVADVEFTLVLTVILVIGVIWAFLRSVRATLIPAVALPLSLIGTFGVMALAGFSLDNLSLMALTISAGFVVDDAIVMIENIVRYIEKGMKPFEAALAGAQEIGFTIVSLTVSLVAVFIPLLFMTGIVGRLFREFALTLAVAVVVSAVVSLTLTPMMCAHLLKGGHEEAKSGRFFDALRDAYARSLDWVLGRQVATLWVAFATLVLTIGLYVFMPKGFLPTQDTGVIVATTDARADVSFATMMDMQRRVSDLVRTDPDVTAVASFIGAGPINPTANTGQMTIVLKPRKQRSASAEQVIARLAELVAPVAGMETHFRPAQDIQISHRTSRTQYQYTLTDIDAAELAQWVPQMVERLKASPLLMDVATDSQEGGLQAEIRIDRDKAARLGVLPQAIDDILYDSYGQRQISTIYSQVNQYKVVLEVTPEYQGGPEALGSLYVRSSNGALVPLSAVSSVSRARVPLVITHQGQFPAVTISFNLAPGVSLGAATAAIDGLQQEMGLPETITGDYSGDAAEFRRSLESQPWLIAAAMVVIYIVLGVLYESTIHPVTIMSTLPSAGIGALLALAASGHDLSLVGLIGIVLLMGIVKKNAIMMIDFAIEAERHHGKSPREAIVSASLLRFRPIMMTTMAALLGALPLAIDSGTGAELRRPLGISIVGGLVLSQMITLYTTPVIYLAFERLKRRFAPKALEQAP

SEQ ID NO: 74490 - DNA, 3180 bp, Magnetospirillum magnetotacticum MS-1
  CDS (1)..(3180)
atgcgcctgtcccacttctttatcgaccgccccatcttcgccaccgtggtctcggtgctgatcaccatcatcggcgccatcacctatttcgctcttccggtggcgcagtatcccgagatcgcgccgccgaccatcgtggtcagcgcctcttatcccggcgcctcggcccaggtggtggccgacaccgtggcgacgccgctggaacagcagatcaacggcgtcgagaacatgctgtatctgaacagccaggccaccggcgacggcaatctgaagctgaccgtgaccttcgcactgggcaccaatctcgacaccgcccaggtgctggtgcagaaccgggtggcggtggccacggcgcggctgcccgacgacgtcaagcgcatcggcatcaccgtggccaagaactcgcccgacatgctgatggtggtgcatctcaactcgcccgacggctcgcgcgaacagctgtatctgtccaacttcgccacccttcagatgatcgacgtgctggcccgcctggatggcgtcggcgaagtgcgcatcttcggcgcgcgcgattacgccatgcgcgtctggatcgacccggacaaggcggcggcccgcaacctcacagcgggcgaggtggtcaaggcgctgcaggcccagaacgtccagatcgccgccggtgtgctggaccagccgcccatccccaatcagggcgctttccagttttccgtccagacccagggccgccttctcgaccccgcccagttcggcgatgtcatcgtcaaggccgatgccacgggccgcatggtgcgcctcaaggatgtggcgcgcatcgaactgggcgcccaggattacagcgtcaacggctatctcaacggcaagaatgccgtgccggtggcggtgttccagcgccccggctccaacgccctggccaccgccgaccgggtcatcgccaaggtggaggaactgtccaagaccttcccctcgggcgtctcctacaccatcgcctacaatcccacccagttcatcgcccagtcggtcaaggcggtgatcaagaccatcttcgaggcggtcttgctggtggtcgtagtggtgatcttgttcctccagacctggcgggcctcgctgattccgctggccgccattccggtctcgctggtgggcaccttcgcggtgctgggcgcgctcggctattcgctgaacaacctatcgctgttcggcctggtcctggcggtgggcatcgtggtggacgacgccatcgtggtggtggaaaacgtcgagcgcaacatgaaggacggcatgaatgcccggtccgccgcccaccagaccatggacgaggtgggcagcgcgctgatctccatcgccctggtcctgtgcgcggtgttcatcccggctgccttcattccgggcatctcgggccagttcttccgtcagttcgcggtgaccatcgccgcctcgacggtgatttcgctgatcgtgtcgctgaccttgtcgcccgctttgtgcgccctgctgttcaggggccacggcccgctggaccatcatgacgagaccggctggcgcaaggtggtggcccgattcttcgcctggttcaaccacaatttcgaccgcctggccgggggctatggctccctgacccgcacggtggtgcgcaaatcggctctgatgctggtcatttatggcgggctgatcggcgcggcgggggtggagttcttccagacccccaagggcttcatccccgagatggaccagggctatctgatcaccgtggtccagttgccgcccggttcatcactgtcgcgcaccgatgcggtggtcaagaaggtcgcggacgtcatggccgagacccccggcgtcgcccataccctggccttcgccggtctggacggcgccactttcaccaatgcctccaacggcgccgccatcttcacgcccctaaagcccttcgaggaacgctacgcccagggcctgtcggccaatgtgatcctggccgatcttagaaagcgcctgagttccgttcaggacgcctttatcatcaccatccagcctcccccggtgcgcggtatcggcacggcgggcggcttcaagatgatgctgcaggacaagggcgggcgtggctccaaggcgctggaggacgtggccctggacatggcggccgaggccaacaagattcccggactgcaaggtatcttcaccctgttcaacacccgcacgcccaatgtctacgccgatatcgaccgagtgcgcgcccagatgctgggcgtgcccaccgaccgggtgtccgaggcgttgcaggtctatctgggctcggccttcgtcaacgaattcaactatctgggccgcaccttccgggtcaccgcccaggccgacgcgcccttccgccaggaggtggaggacatcgccaatatcaaggtgagaaacgacaagggccagatggtgcccattggcgccgtagcctcgttccgcttcgacaccgggccctatcgcgtgccccgctacaacctgttcccggccgccgaggtgcagggctcggccgcgccgggctatgccagcggctatgcgctcgagcagatgcgcgccctggccgccgagcgcctgcccgagggcttcggcttcgaatggaccgaactggcgctgcaggaattgctggcgggtaataacggattgttcgtgttcgcggcttcggtgctgttcgtcttcctgctgctggctgcccagtatgaaagctggtccctgcccgccgccgtggtgctgatcgtacccatgtgcctgctggccgccgtcaccggactgatcatccggggactgcccatcaatatcctggcccagatcggcttcatcgtgctgatcggactggccgccaagaacgccatcctgatcgtggaattcgccagacagggcgaatccgaaggcctcgaccgcatcgaggccgccgtccatgcgggacggacccgcctgcggcccattctgatgacctccctggccttcatcctgggcgtgctgcccttggtggcggggaccggagcgggcgccgaaatgcgccagagcttaggcacaaccgtgttctacggcatgctgggcgtcaccggttttgggttggtcttcacgcccatcttctatgtggtgatccgaaagatggtggccgggcatcacgcccgcgccgccgccgcccatgcggccgaggaagcgcgggggcgctaa

SEQ ID NO: 74491 - protein, 1059 aa, Magnetospirillum magnetotacticum MS-1
MRLSHFFIDRPIFATVVSVLITIIGAITYFALPVAQYPEIAPPTIVVSASYPGASAQVVADTVATPLEQQINGVENMLYLNSQATGDGNLKLTVTFALGTNLDTAQVLVQNRVAVATARLPDDVKRIGITVAKNSPDMLMVVHLNSPDGSREQLYLSNFATLQMIDVLARLDGVGEVRIFGARDYAMRVWIDPDKAAARNLTAGEVVKALQAQNVQIAAGVLDQPPIPNQGAFQFSVQTQGRLLDPAQFGDVIVKADATGRMVRLKDVARIELGAQDYSVNGYLNGKNAVPVAVFQRPGSNALATADRVIAKVEELSKTFPSGVSYTIAYNPTQFIAQSVKAVIKTIFEAVLLVVVVVILFLQTWRASLIPLAAIPVSLVGTFAVLGALGYSLNNLSLFGLVLAVGIVVDDAIVVVENVERNMKDGMNARSAAHQTMDEVGSALISIALVLCAVFIPAAFIPGISGQFFRQFAVTIAASTVISLIVSLTLSPALCALLFRGHGPLDHHDETGWRKVVARFFAWFNHNFDRLAGGYGSLTRTVVRKSALMLVIYGGLIGAAGVEFFQTPKGFIPEMDQGYLITVVQLPPGSSLSRTDAVVKKVADVMAETPGVAHTLAFAGLDGATFTNASNGAAIFTPLKPFEERYAQGLSANVILADLRKRLSSVQDAFIITIQPPPVRGIGTAGGFKMMLQDKGGRGSKALEDVALDMAAEANKIPGLQGIFTLFNTRTPNVYADIDRVRAQMLGVPTDRVSEALQVYLGSAFVNEFNYLGRTFRVTAQADAPFRQEVEDIANIKVRNDKGQMVPIGAVASFRFDTGPYRVPRYNLFPAAEVQGSAAPGYASGYALEQMRALAAERLPEGFGFEWTELALQELLAGNNGLFVFAASVLFVFLLLAAQYESWSLPAAVVLIVPMCLLAAVTGLIIRGLPINILAQIGFIVLIGLAAKNAILIVEFARQGESEGLDRIEAAVHAGRTRLRPILMTSLAFILGVLPLVAGTGAGAEMRQSLGTTVFYGMLGVTGFGLVFTPIFYVVIRKMVAGHHARAAAAHAAEEARGR

SEQ ID NO: 74492 - DNA, 3015 bp, Azotobacter vinelandii
  CDS (1)..(3015)
atgagcatttccgtgacctatccgggcgcttcggcacagaccgttcaggatacggtagtgcaagtgatcgagcagcagctcaacggtatcgacaacctgcgctacatcacttcggacagcaattcggatggcaacatgaccatcactgccaccttcgaacccggtaccgatgcggacattgcccaggttcaggttcagaacaaactgcaactggccaccccgctgttgccacaggaggttcagcagcagggcatccgagtgaccaagtcggtgcgaaactttctcttgatcgttggcttcgtttccgaagatggcagtatggaccgcaacgatctggccaactatatcgtttccaatattcaggatcccctttcccgggccaagggcgtgggtgatttccaggtcttcggctcgcaatatgccatgcgcatctggctggacccggcccgcctgaacaacttccagttgactccggtggatgtgcgcaacgcggtcgagagccagaatgtccaggtttcctccggccagttcggcggtcttccggccgtacccgaccagcaactcagtgccacgatcatcggcaagacccgtctgcagacagccgagcagtttcgcgacatcctgcttaaagtcaatggcgacggctcgcaggtgcgcctggacgatgtcgccgaggtgggactgggtggtgagaattacagcatcacttcgacctacaacgggcggcccgccgcgggaatggcgatcaggctcgcgaccgatgccaacgcactggaaacggcccaggcggtgcgggataccctcgccgaactggagccttttttcccgccgggggtgaaagtcgtctacccctatgacactacgccggtgatctcggcctccatcgaggaggtggtgaaaaccctcggcgaggcgatcgtcctggtctttctggtgatgtacctgtttctgcagaacgtccgggccacgctgattccgaccctggcggtcccggtggtgctgctcggcacctttggtgtgctcgccgcattcggtttcaccatcaataccctgaccatgttcgccatggtgctggccatcggtctgctggtcgatgacgccatcgtggtagtcgagaacgtcgagcgggtcatggtcgaggatggcttgccaccgcgggaggccacacgcaagtcgatgggacagatccagggtgctttggtcggcattgccttggtgctgtccgcagtgttcgtacccatggcctttttcggtggctcgaccggggtaatctatcgacagttctccatcaccatcgtcgctgccatggcgctatcggtactggtcgcgctgatcttcaccccggcgctctgtgcgactctgctcaagcccgtgagcagaggcgagcatcaccggaagcgtggtttcttcggctggttcaaccgcagcttcgagcgcagtgtccgaggttacgagcgtggcgtcaggcaggtgctcggccgcaagctaccttatctgttgctctacttggcaatagtcgcgctcatggtttggttgttcagccgtataccgaccgctttcctgcccgacgaggatcaaggcgtgctctacgcgcaagtgcagaccccctcggggtccagcgctgagcgaacccaactggtggtggacgaaatgcgcaattacctgctgacggaggagggtcatctggtcaactcggttttcaccgtcaccggcttcaatttcgcaggccgggggcagagttccggcttggcattcatctcattgaagccttgggccgagcggaccggtgaagaagatgatgtgtttgccctcgcccagcgtgcccagcagcgctttgccgggtttcgcgacgccctggccttcgcttatgctccaccggcggtgatggagttgggcaatgccagtggcttcgatgtctttttgcaggaccgcgccggcgtcggccacgaagcgttgagcgcagcccgcgaccagtttctcgcccgcgctgcgaagaatcccgtgctcagccgggtacgtgccaatggtctgcgcgacgagccgcagtatcgcctgttgatcgatgacgaactggcccgtgcctatggtgtccccctggcggacatcaacagcagcatctccatcgcctggggtgccagctacgtcaacgatttcatcgatcggggacgggtgaagaaggtctatctgcagggcgagccgaaggcacgcatgactcccgaagacctcggcaagtggttcgtgcgcaatgcggccggcaccatggtgcccttcagtgctttcgccaacggcgagtggacctacggtccgccgaaactggcccgttacaatggcgtctcggcgatggagattctcggcgagccggcacccggttacagctccggggaggccatggccgaggtggaacggatcgccgaggaattgccgccgggtatcggttacgcctggaccggcctgtcctacgaagagcgtctttccggatcccaggcgccagcgctctacgcactctcgctgctggtggtgttcctttgcctggcggccctctacgaaagctggtcgattcctttctcggtgatgctggtcgtgccgctgggagtcataggcgcgctctgcttcaccagcctgcgcggactctccaatgatgtttacttccaggtgggcctgctcaccaccgtcggcttgtcggcgaagaatgcgatcctcatcgtcgagtttgccaaggacctgcacgagcagggtatggcgctcccggaggcagcagtggaggcctgccgcatgcgcctgcggccgatcatcatgacttctctggcattcatcctcggtgtcgtgccgctggccgtctccagcggtgccggtgccggtgccggcagccagcatgccatcggtacgggagtgatcggcggcatgctcaccgccacggtgctggcgatcttctgggtgccgctattctacgtattggtgtcatccctgttcggggatcgtcgccccgaggctgccgaccgcggtgaggtgccatga

SEQ ID NO: 74493 - protein, 1004 aa, Azotobacter vinelandii
MSISVTYPGASAQTVQDTVVQVIEQQLNGIDNLRYITSDSNSDGNMTITATFEPGTDADIAQVQVQNKLQLATPLLPQEVQQQGIRVTKSVRNFLLIVGFVSEDGSMDRNDLANYIVSNIQDPLSRAKGVGDFQVFGSQYAMRIWLDPARLNNFQLTPVDVRNAVESQNVQVSSGQFGGLPAVPDQQLSATIIGKTRLQTAEQFRDILLKVNGDGSQVRLDDVAEVGLGGENYSITSTYNGRPAAGMAIRLATDANALETAQAVRDTLAELEPFFPPGVKVVYPYDTTPVISASIEEVVKTLGEAIVLVFLVMYLFLQNVRATLIPTLAVPVVLLGTFGVLAAFGFTINTLTMFAMVLAIGLLVDDAIVVVENVERVMVEDGLPPREATRKSMGQIQGALVGIALVLSAVFVPMAFFGGSTGVIYRQFSITIVAAMALSVLVALIFTPALCATLLKPVSRGEHHRKRGFFGWFNRSFERSVRGYERGVRQVLGRKLPYLLLYLAIVALMVWLFSRIPTAFLPDEDQGVLYAQVQTPSGSSAERTQLVVDEMRNYLLTEEGHLVNSVFTVTGFNFAGRGQSSGLAFISLKPWAERTGEEDDVFALAQRAQQRFAGFRDALAFAYAPPAVMELGNASGFDVFLQDRAGVGHEALSAARDQFLARAAKNPVLSRVRANGLRDEPQYRLLIDDELARAYGVPLADINSSISIAWGASYVNDFIDRGRVKKVYLQGEPKARMTPEDLGKWFVRNAAGTMVPFSAFANGEWTYGPPKLARYNGVSAMEILGEPAPGYSSGEAMAEVERIAEELPPGIGYAWTGLSYEERLSGSQAPALYALSLLVVFLCLAALYESWSIPFSVMLVVPLGVIGALCFTSLRGLSNDVYFQVGLLTTVGLSAKNAILIVEFAKDLHEQGMALPEAAVEACRMRLRPIIMTSLAFILGVVPLAVSSGAGAGAGSQHAIGTGVIGGMLTATVLAIFWVPLFYVLVSSLFGDRRPEAADRGEVP

SEQ ID NO: 74494 - DNA, 3174 bp, Azotobacter vinelandii
  CDS (1)..(3174)
atgaacttctcgcaattcttcatccaccggccgatcttcgccgccgtgctctcgctgctgaccctgatcggcggcgccatcgcactgttccagttgccgatcagcgaatacccggaagtggtgccgcccaccgtggtggtgcgcgccaacttcccgggcgccaaccccaaggtgatcggtgaaacggtcgcctcgccgctggaacaggccatcgtcggcgtcgagggaatgctctacatgtcgtcccaggccacctccgacggcaagttgaccctgaccatcaccttcgccctcggcaccgatctggacaacgcccaggtgcaggtgcagaaccgcgtgacccgcaccatgccgaccctgcccaccgaagtgcagcgcctcggcgtgaccgtcgacaaggcctcgccggacctgaccatggtggttcacctgacctcgccggacgaacgctacgacatgctctacctgtccaactacgccacgctcaacgtcaaggacgagctggcgcgtctcgacggcgtgggcgacgtgcaactgttcggcctcggcaactactccctgcgcgtctggctcgatccgcaccgggtggcctcgcgcggcctcaccgccatggacgtggtcgacgccatccgcgagcagaaccgccaggtcgccgccggctccctcggcgcaccgccggcaccgggcgacaccggcttccagctgtcgatcaacacccagggccgcctggtcagcgaggaggagttcgaaaacatcatcgtccgtgcaggtgaggacggtgagatcacccgcctgaaggacatcgcccgcatcgaactgggctccagccagtacgccctgcgctcgcaactgaacaaccggccggccgtggccatgccggtcttccagcgccccggctccaacgccatcgatatctccgacgcggtgcgcgcgcgcatggccgagctgaagcagagctttccgcagggcgtcgactactccatcgtctacgacccgaccgtgttcgtgcgcggctccatcgaggcggtggtgcacaccctgttcgaggcgatcgtcctggtggtgctggtggtgatcctgttcctgcagacctggcgcgcctcgatcattcccctggcggcggtaccggtgtcgctgatcggtaccttcgcggtgatgcacctgttcggcttctcgctcaacgccctgtcgctgttcggcctggtgctggccatcggcatcgtggtggacgacgcgatcgtggtggtggagaacgtcgagcgcaacatcgccctcggcaagccgcccctggaggcgacccgccaggccatgcaggaggtgaccggccccatcgtcgccacggccctggtgctttgcgcggtgttcgtgccgacggcgttcatctccggcctgaccggacagttctaccagcagttcgccctgaccatcgccatctccacggtgatctcggcattcaattcgctgaccctgtcgccggccctggccgccgtgctgctcaaggaccaccacgcgcccaaggaccgtttctcccgggtgctcgacaggctgctcggcggctggctgttcgggcccttcaaccgcctgttcgagcgcgccagccacggctatgtcgctaccgtgcgccacgtgctgcgcggcagtgccatcgccctgctggtctacggcgggctgatgggcctgacctggctgggcttctccagcaccccgacaggcttcgtaccgccgcaggacaagcagtacctggtcgccttcgcccagttgccggacgccgccaccctcgaccgcaccgatgcggtgatccagcgcatgtcggagatcgccggccggcatccgggggtagccgacaccgtggccttccccggcctgtcgatcaacggcttcaccaacagcccgaacagcggcatcgtcttcacccccctcaagtccttcgaggaacgccaggacccgtcgctgtcggcggatgccatcgccgccgagctgaaccgccggttcgccgagatccaggacgcctacatcgccatcttcccgccgccgccggtgcagggcctcggcaccatcggcggcttccgcgtgcaggtccaggaccgtggcggcctcggctacgaggagctgtatcggcaggtgcagaacgtcatcgccaagagccgcacggtgccggagctggccggcctgttcaccagctaccaggtgaacgtgccgcaggtcgacgccgacatcgaccgggaaaaggccaagacccacggcgtggccatcagcgacattttcgacaccctgcaggtgtatctgggatcgctgtacgccaacgacttcaaccgcttcggccgtacctatcaagtcaatgtccaggccgagcagcggtttcgcctggaaccggcacagatcggccagctcaaggtgcgcaacaaccgtggcgagatggtgccgctgtcgaccttcgtcaggatcgaaggcagcgccggtcccgatcgagtgatgcactacaacggcttcctcaccgccgagatcaacggcgccgccgcccccggctacagctccggccaggccgaggcggcgatggagcggctgctgcgcgaggaactgccgggcggcatgaccttcgagtggaccgagctgacctaccagcagatcctcgccggcaacaccgccatcttcgtgttcccgctctgcgtgctgctggcgttcctggtcctggccgcccagtacgagagctggggcctgccgctggcggtgatcctgatcgtgcccatgaccctgctgtcggccatcgtcggcgtcaggatcgcgggcggagacaacaacgtcttcacccagatcggcctgatcgtgctggtggggctggcctgcaagaacgccatcctcatcgtcgagttcgccaaggatcggcaggcggagggcctggaccgcatcgccgccgtgctggaggcctgccgcctgcgcctgcggccgatcctgatgacctccatcgccttcatcatgggcgtggtgccgctggtgctgtcctccggggccggcgccgagatgcgccatgccatgggggtggcagtgttctccgggatgatcggcgtgacgctcttcggcctgctgttgaccccggtattcttcgtgctggtacgggctttcgtcgaacgacgcgaagcccgtcggaaccggcaggcactcgaagcgcagggatga

SEQ ID NO: 74495 - protein, 1057 aa, Azotobacter vinelandii
MNFSQFFIHRPIFAAVLSLLTLIGGAIALFQLPISEYPEVVPPTVVVRANFPGANPKVIGETVASPLEQAIVGVEGMLYMSSQATSDGKLTLTITFALGTDLDNAQVQVQNRVTRTMPTLPTEVQRLGVTVDKASPDLTMVVHLTSPDERYDMLYLSNYATLNVKDELARLDGVGDVQLFGLGNYSLRVWLDPHRVASRGLTAMDVVDAIREQNRQVAAGSLGAPPAPGDTGFQLSINTQGRLVSEEEFENIIVRAGEDGEITRLKDIARIELGSSQYALRSQLNNRPAVAMPVFQRPGSNAIDISDAVRARMAELKQSFPQGVDYSIVYDPTVFVRGSIEAVVHTLFEAIVLVVLVVILFLQTWRASIIPLAAVPVSLIGTFAVMHLFGFSLNALSLFGLVLAIGIVVDDAIVVVENVERNIALGKPPLEATRQAMQEVTGPIVATALVLCAVFVPTAFISGLTGQFYQQFALTIAISTVISAFNSLTLSPALAAVLLKDHHAPKDRFSRVLDRLLGGWLFGPFNRLFERASHGYVATVRHVLRGSAIALLVYGGLMGLTWLGFSSTPTGFVPPQDKQYLVAFAQLPDAATLDRTDAVIQRMSEIAGRHPGVADTVAFPGLSINGFTNSPNSGIVFTPLKSFEERQDPSLSADAIAAELNRRFAEIQDAYIAIFPPPPVQGLGTIGGFRVQVQDRGGLGYEELYRQVQNVIAKSRTVPELAGLFTSYQVNVPQVDADIDREKAKTHGVAISDIFDTLQVYLGSLYANDFNRFGRTYQVNVQAEQRFRLEPAQIGQLKVRNNRGEMVPLSTFVRIEGSAGPDRVMHYNGFLTAEINGAAAPGYSSGQAEAAMERLLREELPGGMTFEWTELTYQQILAGNTAIFVFPLCVLLAFLVLAAQYESWGLPLAVILIVPMTLLSAIVGVRIAGGDNNVFTQIGLIVLVGLACKNAILIVEFAKDRQAEGLDRIAAVLEACRLRLRPILMTSIAFIMGVVPLVLSSGAGAEMRHAMGVAVFSGMIGVTLFGLLLTPVFFVLVRAFVERREARRNRQALEAQG

SEQ ID NO: 74496 - DNA, 3141 bp, Azotobacter vinelandii
  CDS (1)..(3141)
atgtcgcgctttttcatcgaccggccgatcttcgcctgggtgatcgccctggtgctcatgctcggcggcggcctggccatcctcaagctctccgtcacccagtacccgaacatttccccgccggccgtgcagatcagcgtcacctatcccggcgcctcggcgcagacggtgcaggacaccgtggtgcaggtgatcgagcagcagctcaacggcctcgacggcctgcgctatatttcctcggtcagcaacgccgacggcagcctgcagatcatcgtgaccttcgaacagggcaccaaccccgacatcgcccaggtgcaggtgcagaacaagctgcaactggccacgccgatgctgcccgaggaagtccagcgccaaggcatccgcgtggtgaaataccaggtcaacttcatgatgatcctcggcctggtgtccaccgacgggcgcatgaacggtttcgacatgggcaactacatcgcctccaacctccaagacccgatctcgcgggtctacggggtcggcgacttccaggtgttcggctcgcagtacgcgatgcgcatctggctcgacccggagaagctcaataactaccaactcaccccgcaggacgtgaccagcgcgatcagcgcgcagaacgtgcaggtgtcctccggccagctcggcggcctgccggccgccaggggcgtgcaactgaacgccacggtgatcggcaagacgcgcatgcgcaccgccgacgaattcaaggaaatcctcctcaaggtcaaccgcgacggctcgcaggtccgcctcaaacacgtcgccgaggtcggcctgagcgccgagaacttctccatcgcctccaagtacaacggcatgccggccgccggtatggccctgcgtctggcgcccggcgccaacctgctggagagcgtggcggcggtgcgcgccaagctggacgaactcaagccctacctgcccgagggcgtcgaggtggtctacccctacgagaccgcgccgatggtctccgcctccatcgaggcggtggtgcacaccctgttcgaggccatcgtgctggtcttcctggtgatgtacctgttcctgcagaacttccgcgccaccctgatccccaccctggcggtgccggtggtactgctggccactttcggcgtgctgttcgcctgcggcttcaccatcaacgtcatgaccatgttcgccatggtgctggccatcggcctgctggtggacgacgccatcgtggtggtggagaacgtcgagcggatcatggtcgaggaaggactgtcgccgaaggaggcgacgcgcaagtcgatgggccagatttccggcgcgctggtcggcatcgccctggtgatttccgcggtgttcctgccgatggccttcttcggcggctccgccggggtcatctaccggcagttctccatcaccatcatctcggcgatgtccttctcggtgctgatcgcgctgatcttcaccccggcgctctgcgccaccctgctcaagccggtggccaagggcgcgcaccacgagaagcgcggcttcttcggctggttcaaccgcaccttcgagcgcagcgccgacggctaccagcgcggcgtgggcggcatcaccaggcgccgctggagcttcatgctgatctacctgctgctggtcggcggcgtcgcctacctgttcctcagattgcccggctccttcctgcccaacgaggaccagggcaccatgttcgtgcagatacagttgccgccgaactccagcgccgagcgcaccgaggcggtgctcgccgagacgcgcgactacctgctcaaggacgagggcgataccgtggcctcggtgttcagtgtcaacggcttcaacttcgccggccgcgggcagagctcgggcctgctgttcatcaacctcaagcccttcagcgaacgacccaggcccgagcaggacatcttcgccctggcccagcgcgcggccgtgcgctacgcgcggatcaaggacgccaacgtgattccggtggtgccgccggcagtgcgcgagatgggcaacgccaccggcttcgacctcttcctgcaggactacggcggcctcggccacgaggcgctgatggcggcgcgcaaccagctcctcgggatggccgccaaggagccgacgctgaccatggtgcgtcccaacggcatgaacgacgaggcgcagtaccaggtgatcatcgacgacgagaaggcccgcgcgctgcaggtctccatcgaagacatcaacgaaaccatgtcggtggcctggggttcctcctatgtcaacgacttcatcgaccgcggccgggtcaagaaagtctacgtgcagggcaagcaggattcgcgggtgggtccggaagacttcgacaagtggtacgtgcgcaacgccgagggcggcatggtgcccttctcggccttcgccagcggccagtggatctacggctcgcccaagctggaacgctacaacggcatctcctcggtggaggttctcggccagccggcgcccggctacagcaccggcgacgccatggccgtgatgaaccgcctcgccgcccagttgccgtcgggcatcggcatcgcctacaccggcctgtcctacgaggaactggccgccggctcgcaggcgccggcactctacgcgctgtcgctgctgatcgtgttcctctgcctggcggcgctgtacgaaagctggtcgattcctttctcggtgatgctggtggtgccgctcggggtgctcggcgcggtcggcgccacgctcttgcgcgggctgtccaacgacgtgttcttccaggtcggcatgctcaccaccatgggcctggcggcgaagaacgcgatcctcatcgtcgagttcgccaaggatctgtacgagcaccagggccgcagcctgatgcaggccgccagcgaggccgcgcgcctgcgcctgcggccgatcatcatgacctcgatcgccttcgctctcggcgtgctgccgctggccaccgccaccggccccggcagcggcagccagcactcgatcggcaccggcgtgctcggcgggaccctggcggcaaccttcctggcgatcttcttcgtgccgctgttctacgtcgtggtggtcggattgttcgagcggcaaaaagacaaggcggccgaaaccgaaggagtgatggcatga

SEQ ID NO: 74497 - protein, 1046 aa, Azotobacter vinelandii
MSRFFIDRPIFAWVIALVLMLGGGLAILKLSVTQYPNISPPAVQISVTYPGASAQTVQDTVVQVIEQQLNGLDGLRYISSVSNADGSLQIIVTFEQGTNPDIAQVQVQNKLQLATPMLPEEVQRQGIRVVKYQVNFMMILGLVSTDGRMNGFDMGNYIASNLQDPISRVYGVGDFQVFGSQYAMRIWLDPEKLNNYQLTPQDVTSAISAQNVQVSSGQLGGLPAARGVQLNATVIGKTRMRTADEFKEILLKVNRDGSQVRLKHVAEVGLSAENFSIASKYNGMPAAGMALRLAPGANLLESVAAVRAKLDELKPYLPEGVEVVYPYETAPMVSASIEAVVHTLFEAIVLVFLVMYLFLQNFRATLIPTLAVPVVLLATFGVLFACGFTINVMTMFAMVLAIGLLVDDAIVVVENVERIMVEEGLSPKEATRKSMGQISGALVGIALVISAVFLPMAFFGGSAGVIYRQFSITIISAMSFSVLIALIFTPALCATLLKPVAKGAHHEKRGFFGWFNRTFERSADGYQRGVGGITRRRWSFMLIYLLLVGGVAYLFLRLPGSFLPNEDQGTMFVQIQLPPNSSAERTEAVLAETRDYLLKDEGDTVASVFSVNGFNFAGRGQSSGLLFINLKPFSERPRPEQDIFALAQRAAVRYARIKDANVIPVVPPAVREMGNATGFDLFLQDYGGLGHEALMAARNQLLGMAAKEPTLTMVRPNGMNDEAQYQVIIDDEKARALQVSIEDINETMSVAWGSSYVNDFIDRGRVKKVYVQGKQDSRVGPEDFDKWYVRNAEGGMVPFSAFASGQWIYGSPKLERYNGISSVEVLGQPAPGYSTGDAMAVMNRLAAQLPSGIGIAYTGLSYEELAAGSQAPALYALSLLIVFLCLAALYESWSIPFSVMLVVPLGVLGAVGATLLRGLSNDVFFQVGMLTTMGLAAKNAILIVEFAKDLYEHQGRSLMQAASEAARLRLRPIIMTSIAFALGVLPLATATGPGSGSQHSIGTGVLGGTLAATFLAIFFVPLFYVVVVGLFERQKDKAAETEGVMA

SEQ ID NO: 74498 - DNA, 3096 bp, Azotobacter vinelandii
  CDS (1)..(3096)
atgaatatttcgcgccccttcattctccgcccggtcgccacgacgctgatcatggtggcgatcttcctctgcgggctgatcgcctaccgcctgctgccggtttccgcgctgcccgaggtggactatccgaccatccgcgtgctgacgctctatcccggcgccagtccggaagtgatgaccagcgcggtgaccgccccgctggagcgccagttcggccagatgccgggcctgaatcagatgacctcgaccagttccggcggcgcctcggtgatcaccttgcgcttcagcctggacgtgaacctggaggtcgccgagcagtcggtgcaggcggcgatcaacgcggccagcaatctgttgcccgacgacctgccgacgccgccggtatacaacaaggtcaatccggccgacacaccggtgatgaccctggcggtcacctcggcgaccatgccgctgccggagatcaacgatctggtcgatacccgcatggcgcagaagctggcgcagatcagcggggtcggcatggtcagcctggccggcggccagcgcccggcggtgcgcatcaaggtcgatccgcaggcgctggccaactacggcctgaacctgtccgacgtgcgctcgttgatcaccgcctccaacgtcaaccagcccaagggtaacttcgacggtccgacccgggtgtcccagctcgacgccaacgaccagctcaagtccgccgacgaataccgcaacctgatcctcgcccacctgaacggcgccaccctgcgcctgaaggatgtggcgcagatcgccgacggcgccgagaacgagcgcctggccgcctgggccaaccgcaacgcggcggtgctggtgaacatccagcgccagccgggggccaacgtcatcgaagtggtcgagcgtgtccaggcgctgctgccgcagatcaccgcgaccctgccggccagcctcgaggtgattcccctcaccgaccgcacccagaccatccgcgccgcggtgcgcgacgtgcagttcgagctgctgctggcggtggggctggtggtgctggtgaccttcgtcttcctgcgccggctgtcggccacggtgatcccctcgatcgccgtccccttgtccttgatcggcaccttcggggtcatgtacctggccggcttctcgatcaacaacctgacgctgatggcgctgacagtggccgccggtttcgtggtggacgacgccattgtcatgctggagaacatcgcccgccacctggaagaaggcgcgacgccgctggaggccgcgctcaagggggcgcagcagatcggcttcacgctgatctcgctgaccttctcgctgatcgccgtgctgatcccattgttgttcatggccgatgtggtcggccggctgttccgcgaattcgccatcaccctctcggtgtcgatcctgatttccctgctggtctcgttgaccctgacaccgatgatgtgcgcgttgttcctcaagcaggaaggaccgccggagcatcagggccgtttctaccgcgccagcggcgtctggatcgaggttttgatcgcccgctacgacgccgccctgcattgggtgctgcgccaccaggtgctgaccctgctgatcgccgtggctactctaggcctcaccgtggtgctctacctggcggtgcccaagggcttcttcccggtccaggacaccggggtgatccagggcatttccgaggcgccgcagagcatttccttccgcgccatgagcgaacgccagcagcgcctggccgaggtcatcctgcaggacccggcggtggccagcctgtcttcctacatcggcgtggacggcgacaacgtcaccctgaacagcgggcgcctgctgatcaacctcaagccgcatgccgagcgcgaggtcaccgccagccaggtgatcgagcggctgcgcccgcgactggccgcggtgccggacatccaactgttcctccagccggtgcaggatctgaccatcgaggaccggatcagccgcacccagttccagttcagcctggagtcgccggacggtgccttgctggaggagtggacgccgaagctggtcgaggcgctgagcgtgctgccggagctgaccgacgtggccagcgatctgcagagccgcagcctgcaggtctacctgagcatcgaccgcgacaccgcctcgcgcctcggcgtgaccgtcgccgacatcgacgatgcactctacgacgccttcggccagcggcagatctccactatctatacccaggccagccagtaccgggtggtgctggagagccgggccgccgataccctcggtccggcggcgctggacgaggtgcacgtggccagcgccgagggcggccaggtgcgcctgtcgtccctggcgcgcatcgaggagcgggcggcgtcgctgctgatcaaccacatcggccagttcccggcggtgaccctgtcgttcaacctggcgccgggcgtctccctcggccaggcggtggcggcgatcgagcgggtgcagcaggagatcggcctgccgggcggcatcgagagccgcttccagggcgccgccgaggccttccgcgcctcgctgtcgagcaccctgctgctgatcctcgcggcggtggtcaccatgtacatcgtgctcggcgtgctctacgagagctacatccacccgatcaccatcctttccacgctgccctcggccgcggtgggcgccctgctggcgctgctgttttccggcaacgacctggggctgatcgcgatcatcggcatcatcctcctgatcggcatcgtcaagaagaacgcgatcatgatgatcgacttcgcgctggaggccgagcgtcaccagggcatggacccgcaggcggcgatccatcgcgcggcactgttgcgtttccggccgatcctgatgaccaccctggccgcgctgttcggcgccatcccgctgatgttcgcctcgggctcgggcgccgaactgcgccagccgctgggcctggtgctggtcggcggcctgctgctcagccagctcctgacgctgttcaccacgccggtgatctacctcgccttcgaccgcctgtcgcggcgcttcgcgggccgcagcgcggcgggggtggcggcatga

SEQ ID NO: 74499 - protein, 1031 aa, Azotobacter vinelandii
MNISRPFILRPVATTLIMVAIFLCGLIAYRLLPVSALPEVDYPTIRVLTLYPGASPEVMTSAVTAPLERQFGQMPGLNQMTSTSSGGASVITLRFSLDVNLEVAEQSVQAAINAASNLLPDDLPTPPVYNKVNPADTPVMTLAVTSATMPLPEINDLVDTRMAQKLAQISGVGMVSLAGGQRPAVRIKVDPQALANYGLNLSDVRSLITASNVNQPKGNFDGPTRVSQLDANDQLKSADEYRNLILAHLNGATLRLKDVAQIADGAENERLAAWANRNAAVLVNIQRQPGANVIEVVERVQALLPQITATLPASLEVIPLTDRTQTIRAAVRDVQFELLLAVGLVVLVTFVFLRRLSATVIPSIAVPLSLIGTFGVMYLAGFSINNLTLMALTVAAGFVVDDAIVMLENIARHLEEGATPLEAALKGAQQIGFTLISLTFSLIAVLIPLLFMADVVGRLFREFAITLSVSILISLLVSLTLTPMMCALFLKQEGPPEHQGRFYRASGVWIEVLIARYDAALHWVLRHQVLTLLIAVATLGLTVVLYLAVPKGFFPVQDTGVIQGISEAPQSISFRAMSERQQRLAEVILQDPAVASLSSYIGVDGDNVTLNSGRLLINLKPHAEREVTASQVIERLRPRLAAVPDIQLFLQPVQDLTIEDRISRTQFQFSLESPDGALLEEWTPKLVEALSVLPELTDVASDLQSRSLQVYLSIDRDTASRLGVTVADIDDALYDAFGQRQISTIYTQASQYRVVLESRAADTLGPAALDEVHVASAEGGQVRLSSLARIEERAASLLINHIGQFPAVTLSFNLAPGVSLGQAVAAIERVQQEIGLPGGIESRFQGAAEAFRASLSSTLLLILAAVVTMYIVLGVLYESYIHPITILSTLPSAAVGALLALLFSGNDLGLIAIIGIILLIGIVKKNAIMMIDFALEAERHQGMDPQAAIHRAALLRFRPILMTTLAALFGAIPLMFASGSGAELRQPLGLVLVGGLLLSQLLTLFTTPVIYLAFDRLSRRFAGRSAAGVAA

SEQ ID NO: 74500 - DNA, 3105 bp, Nostoc punctiforme PCC 73102
  CDS (1)..(3105)
atgaacctttcggaaccatttatccgtcgtccgatcatgacgactctggtgatgacggcaattttgattttcggttttatgagttatcgcttgctgccaatcagcgatttacccagtgtggattatcccacaattcaggtaagcgcctcccgaccgggagctagcccggaaacaatggcagcatcggttgctcgtcctttagagaagcaattttccagtattgctggactcgattcgctcaattcaactagcactctgggacagactcaaattacactgcaattcaacttgagtcgcaacattgatgatgcagcgcaggatgtagaagcagccatatcaggagcatcggggcaaattgccacggatttacccaatcctcccacctacagtaaggttaaccccgcagatcaaccgattctttacctttacttagactctcccacactgccgctttcccaggtagataattatgccgagacttatctggcgcaaaagttatctacaatcaatggggtagcacaggtagctgtctacggttcccaaaagtatgcggctcgaattcaactcgatccgcagcaattggcagcacggcaaattggactggatcaggtggcgacggcaattcaacagggtaacgtcaatttacctactggcagtctttcgggaaatcataagaattttacagttcagactaacgggcaacttgaagatgcggctgcttatcggcagttgattgtctcttataaagatggaatgcccatctatctcaatcaactgggcaggattattgacagtgtagaaaatgacaaagtagcaagctggtacaacaatacccgcgccattattctcaccattcaaagacagccaggaaccaatacggtacaagttgtagacacgattaagaatttgctgccaaagttacgagagcagattccggcatccgtggaaattgggattctctatgatgcgtctcagtcaattcgagattcagtggatgatgtcagatttaccttgattttgacgatcgctctagttatcttagtaattttcatctttttgcggaacctctcggccacagtgattcctagtttggcattacccgtttcgctgattggcacttttgcagtgatgtatttgctgcactactcactagataacctgtcgctgatggcgttgaccctttctgtgggtttcgtagtagatgatgcgatcgtcatgctagaaaatatcgtccgtcatatcgaaatgggggaacgtccgttagaagcggcgttgaatgggtcgagagaaattggtttcacaattctgtcaatgaccctttccttagttgcagtcttcatccccatgttgttcatgagtgaagtactagggcgattatttcatgaatttgctgtgacgatcgcagttgcaattctggtatctggttttgtgtctttgactctgactccgatgttatgcagccgttttctgcgtcctgtggatcatgctaatcaaagtcggttataccaagcttccgaatatgtcttcgatcgcttcctcggtttgtacgattggagtctcaaaaaagtcttaaaatatcaccgcaccacgatgattttatctgtctttttattggcggtgacagttgggttgttggtgatagttcccaagggctttattcctagcgaagataccggacaaattacaggtattacccaagcagccgaagatgcgtccttcgataatcttgtccaacatcagcagacagttgctaacctgattcgccaagacccaaatgtagatgcagtcaactccaatatcggggcgggagccagtgctagtggcggtggggcagcagttgcagccaattctgggagtttgtttattcggttaaaaccgcgatcgcagcgccaacttggtgctgacgaaattgtgcaaaatttgcgaaccaaactcgccactgttccaggcatccaagtattcttacaaaatcccccagcgattcccattggcgctcaacaaagcacaggactttatcaagttgcactccagagttctgatgtcaaactcttacaggagtatgttccccaacttgttaccaagatgaaggatatgacagaactccaggatgtcaacagcgatttacagtttgcttcccaaattcaaattgacattgaccgcgataaagcctcaacttatgggattaccgccgagcaaatcgaaaataccctcagaagtgcttacggttcctaccaagtgtcaaccatctatgcagcgaccaatgagtatcaagtgattttggaattagcaccgcagtatcaggaggatatcaacgcacttttgacattgtatattaactccagcacaggagtggcagttcctttgaagacattcgccaaactatctcagggagtcagcccgttaatggtcaatcataacggtcggatgaacgccgccaccatttcctttaacctcgcccccggtgtgtccttgggaaatgccaacgaagagattcaaaaactgatcgatcgggtaattcctgccagcattagcaccagctttcagggtgcaagccaggtatttcaaagttcactgccgagtttgggtttattgttagcgatcgccatcctcgtaatttatctgattttgggtattctctatgaggatttcattcacccaattacgattctttccggtttgccttcagcaggttttggggcattattaacgctgataatatttcatgtcgaactaaatgtttattcctttatcggcataattctcttagtgggcattgtgaagaaaaacggcatcatgatggtagattttgcaattgttgcccagcgagaagaattgaaaaaaccgtctgaggcaatctatcaagcctgcttagtgcgcttccgtccgattatgatgacgacgatggcagcattaatgggaaccttgcccatagcgatcggatttggggctggttccgaatcccgccgtcctctagggattgcagttgtgggcggactggtgttttctcagatattgaccttgtatttaacgcctgtgttctatatatatatggaatcatggcggaagaagcttaatcaagttaagttgcgacgggtattttcatag

SEQ ID NO: 74501 - protein, 1034 aa, Nostoc punctiforme PCC 73102
MNLSEPFIRRPIMTTLVMTAILIFGFMSYRLLPISDLPSVDYPTIQVSASRPGASPETMAASVARPLEKQFSSIAGLDSLNSTSTLGQTQITLQFNLSRNIDDAAQDVEAAISGASGQIATDLPNPPTYSKVNPADQPILYLYLDSPTLPLSQVDNYAETYLAQKLSTINGVAQVAVYGSQKYAARIQLDPQQLAARQIGLDQVATAIQQGNVNLPTGSLSGNHKNFTVQTNGQLEDAAAYRQLIVSYKDGMPIYLNQLGRIIDSVENDKVASWYNNTRAIILTIQRQPGTNTVQVVDTIKNLLPKLREQIPASVEIGILYDASQSIRDSVDDVRFTLILTIALVILVIFIFLRNLSATVIPSLALPVSLIGTFAVMYLLHYSLDNLSLMALTLSVGFVVDDAIVMLENIVRHIEMGERPLEAALNGSREIGFTILSMTLSLVAVFIPMLFMSEVLGRLFHEFAVTIAVAILVSGFVSLTLTPMLCSRFLRPVDHANQSRLYQASEYVFDRFLGLYDWSLKKVLKYHRTTMILSVFLLAVTVGLLVIVPKGFIPSEDTGQITGITQAAEDASFDNLVQHQQTVANLIRQDPNVDAVNSNIGAGASASGGGAAVAANSGSLFIRLKPRSQRQLGADEIVQNLRTKLATVPGIQVFLQNPPAIPIGAQQSTGLYQVALQSSDVKLLQEYVPQLVTKMKDMTELQDVNSDLQFASQIQIDIDRDKASTYGITAEQIENTLRSAYGSYQVSTIYAATNEYQVILELAPQYQEDINALLTLYINSSTGVAVPLKTFAKLSQGVSPLMVNHNGRMNAATISFNLAPGVSLGNANEEIQKLIDRVIPASISTSFQGASQVFQSSLPSLGLLLAIAILVIYLILGILYEDFIHPITILSGLPSAGFGALLTLIIFHVELNVYSFIGIILLVGIVKKNGIMMVDFAIVAQREELKKPSEAIYQACLVRFRPIMMTTMAALMGTLPIAIGFGAGSESRRPLGIAVVGGLVFSQILTLYLTPVFYIYMESWRKKLNQVKLRRVFS

SEQ ID NO: 74502 - DNA, 3126 bp, Nostoc punctiforme PCC 73102
  CDS (1)..(3126)
atgaacctttcagaactcttcatccgtcgtccagtcatgaccactttggtaatgatgggtatcctcatcttcggtctcatgagttatctgctattacccattagtgccctacccaatgttgaatatccttttatatctgtctccgctagtctccctggtgccaccccggaaacaatggcatcttcagtcgccgcacccctagaaagacagtttaccgaaattgccggactcaattcattcaattccaccagttccacaggcagcactaacatctccctacaatttgactttagccgccgagtggaagatgccgcaaaagatgtacaggcagccatctcagccgccgccggacaactaccagccggaatgcctcacccgcccacttaccgtaaagtcaacccctctgtctcaccagttctctacctctatatgtattcggagacacagccaatctcgacagtagatgaatacgcagaggtaacagttggtcagccaatttcgatgattaatggtgttgctcaggtacaggtttttggtcaacagcaatatgcagtccgcgtccagcttgacccgcgagagttggcatcgcggggaattggtctaactcaggtaaaaactgcaattcaacaaggaaatgtcaacttgccaaccggcagtctctctggcacttacaaaagttatacgattcaggcgaacggtcaactcaccgatgctgccagctatcgccagctaattgtaacttacaagaatggtgctaccgtgcggctccaagatttggggcagataattgacagcgaacaaaatgtcaaagtctcgaatttatatagcgatcgcaaggtgacaaaccgtcattctgttgttctcgctgtgcagccgcaaccaggtgctaacacggtaaatattgttgatgccatccaggaacttttacctacactccgcgaacaagttcccaaatccattgagatggggattatgtacgatcgctcccaaaccatccgagcctctgtcaacgatgtgaaatttaccttggttctttcggtttgtctagttgtcttggtgattttcttatttttacgtgatataacagctaccctaattcccagtttggcgctacctgtagcgattattggcacttttgctgtaatgtatctgtcgggtttctccctagacaacctttcactcatggcgttgaccctctccgtgggctttgtcgtggatgatgcgatcgttgtgttggaaaatatcgtccgttatcgagaaatgggcgaatctcccctaaatgcggcattgaagggatcgagggaaatcagcttcaccattttgtcaatgaccctttccctagtggcggtgttcatcccgattatgttcatgagtggaataatcgggaaattatttcatgaatttgccgtgacgatcgcagtggcaattttggtttcgggttttgtttccctcagtctcacccccatgttatgcagtcgtttcttaagttcatctcatcagcaaagaccaaatcggctgtatcgagtttcagaacgggcatttgatttactactgcggggatatgattggacgctcaagcctgtcttaaaataccgcttgatgacactgattggttctggcattctgctggtaatgaccgtctatttgttcgtcatcgttcccaaaggatttattcctacagaagacaccggacaactgatggcgaacaccaaaggagcgcaagatatttcttttgatgatatgcggcatcaccagcaaaaggttgttgatctcattcgtcaagaccctaacattgaagcagttgattccattgtgggtgcaagtggcccgaatgcgtcggtcaactctgggcgaattacaattcggctcaagccgcgttctcaacgtaaattgagcgccgacgaaattattcaagagttaacccccaagttgagacgtgtagttggggttaagacattcctccgttctccaccagctattcccatcggtggacaacaaaccaattctacttatcagttcaccttgcagagtttaaatctgcaagacttgcgccaatacgttcctaaacttgtagataaagtcaaaaccctaccaggactccagaacgttgacagtgatttacaactcagcactcctcaaatccaagtcaaatttgaccacaacaaagctgcaacccttggcattaccgctcaacaagttgaacaaaccctcagtaccgcttatggttccagtcaggtgtcaactatttataccccaaatgaccaattttatgtaatcttggaagtaaaaccggagtttcaacgagattctaccgccctatcgatgctctatgtgcaatcgagtactgggaaacttgttccgctaagtgcgatcgctaatatcactcaaaacgtcggtcctctaaccgttactcacgttgctcaactcccctctgcaactatctcttttgacaccctcgcaggaacgtctctaagtcaggctacagatgctatcaagcaagcagcgagtgaggtactaccctcaacaattaccaccagctttcagggttcagcccaaacctttcaacagtctttcaatgatttaggcgtgttgttgttggtgtctattttagtaatctatctgattctcggtattctctatgaggatttcattcacccgattaccattctttccggtttaccttcggcgggttttggcgcattattgacgctactgattttccaggtagatttaaacctttactctttcatcggcataattctcttggtgggtatcgtcaagaaaaatgggattatgttggtggattttgctattgaagcgcaaagaaaggaagggaaaaattcctttgatactatctatgccgcttgcttgattcgcttccgcccgattatgatgacgacgatggcagctttaattggcacacttcccattgctctggggacaggagtcggttcagaagcgcgtcgtcctttggggattgcgatcgttggtggattgctgttttctcagatattgactctctatctaactccagtgttttacatttacatggaggcattgcggaaaaagcttagtatacaacctaagaaagctgaaaaaaagcatctgccagcagttaaaagttaa

SEQ ID NO: 74503 - protein, 1041 aa, Nostoc punctiforme PCC 73102
MNLSELFIRRPVMTTLVMMGILIFGLMSYLLLPISALPNVEYPFISVSASLPGATPETMASSVAAPLERQFTEIAGLNSFNSTSSTGSTNISLQFDFSRRVEDAAKDVQAAISAAAGQLPAGMPHPPTYRKVNPSVSPVLYLYMYSETQPISTVDEYAEVTVGQPISMINGVAQVQVFGQQQYAVRVQLDPRELASRGIGLTQVKTAIQQGNVNLPTGSLSGTYKSYTIQANGQLTDAASYRQLIVTYKNGATVRLQDLGQIIDSEQNVKVSNLYSDRKVTNRHSVVLAVQPQPGANTVNIVDAIQELLPTLREQVPKSIEMGIMYDRSQTIRASVNDVKFTLVLSVCLVVLVIFLFLRDITATLIPSLALPVAIIGTFAVMYLSGFSLDNLSLMALTLSVGFVVDDAIVVLENIVRYREMGESPLNAALKGSREISFTILSMTLSLVAVFIPIMFMSGIIGKLFHEFAVTIAVAILVSGFVSLSLTPMLCSRFLSSSHQQRPNRLYRVSERAFDLLLRGYDWTLKPVLKYRLMTLIGSGILLVMTVYLFVIVPKGFIPTEDTGQLMANTKGAQDISFDDMRHHQQKVVDLIRQDPNIEAVDSIVGASGPNASVNSGRITIRLKPRSQRKLSADEIIQELTPKLRRVVGVKTFLRSPPAIPIGGQQTNSTYQFTLQSLNLQDLRQYVPKLVDKVKTLPGLQNVDSDLQLSTPQIQVKFDHNKAATLGITAQQVEQTLSTAYGSSQVSTIYTPNDQFYVILEVKPEFQRDSTALSMLYVQSSTGKLVPLSAIANITQNVGPLTVTHVAQLPSATISFDTLAGTSLSQATDAIKQAASEVLPSTITTSFQGSAQTFQQSFNDLGVLLLVSILVIYLILGILYEDFIHPITILSGLPSAGFGALLTLLIFQVDLNLYSFIGIILLVGIVKKNGIMLVDFAIEAQRKEGKNSFDTIYAACLIRFRPIMMTTMAALIGTLPIALGTGVGSEARRPLGIAIVGGLLFSQILTLYLTPVFYIYMEALRKKLSIQPKKAEKKHLPAVKS

SEQ ID NO: 74504 - DNA, 3318 bp, Nostoc punctiforme PCC 73102
  CDS (1)..(3318)
atgtttgtcaacacctttatcaaacgtccagtcttaactacagtctgtacgtttatcatcttgctgctgggaagcatttgtattcccatcctgccaatttctcagctaccggatctcgctccggtgcaaatcaccgttagctctaacaatattggtgcggatgctcaaacaacagaaaacactgtcaccaacattatcgagcgacaaattaatggtgttaaagatgtatcttatatatcttctaacacgggtaatgatggttctagcaatataactgtctccttcccaactaatgttaatagcgatattgctcaagtaaacgttcaaaataaagaagcacttgcttcacctcaattgccagatactgttcaaagaacaggtgtcaccgttgaaacggcatcaagcagtctccttctggtttatgggttttactcagaaaataatgagtatgacaacatttttatcagtaattatgtcgatctgtatattctcgatcagatcaaacgacttcctggtgtaggaagtgccagggtttttggggaacgcaaatatgccatgcgtctttggctcgatcccaacaagcttgcccaacatcaactaactcctcaagatgtgacaactgccctgcaacaacaaaatattcaggtgggtgcaggggcgattggtaaggaaccagcaccagataatcaaagctttgaatttgctttacgggcaaccagtcgatttaaagatgcggctgaatttgaagatatggtgctgaaggtgagtcaaggtggcactaatagtactagcaatagcgctacgaatagcaccctagttaaagtcagagatgtcggtcgagttgaactaggagcagaaaactatcttgctgatgccaaatttaccatcccaggaaatgctcccaaggcagccgtgggtttggggatatatcaacttccgggtagtaatgccttagacgttgctcatgctgttgaagagcggatcgtagcgctggagaagagttttccacctggactaaaagcacagttggcatttgataccacgccatttgtggaaatttctttagaagaagttctgcacactttggttgaggcgattatcctggtggtcttggtaattttcgtctttctgcaagattggcgtaccacgatcattcccactgtggcgattcccgtttcgctgattgggacatgcgcggctctcttggttttaggatttcagattaatacactgaccttatttggtttcgttttagcgatcgggatcgttgttgatgatgccattattgtagtggaggcagttgcagtcaaactggagcagggcatgaggccctttgaggcggctgtcgaagcgatgaaggagttgactggggcaatcattgccacttcacttgtactcatggcggtattcattcctgttgcattcattccaggcactacagggattgtctacaaacaatttgcgttaaccgttgcttgctccattgccatttccaccttcaatgctttaacattctctccaagtatggcagctatcctgatgcgccctgctcagactgcacggggccctttgggttggttctttacgcaatttaatcggggattttcttggttcacacggcgatatgttgggtttgttagctaccttacccatgtcaagccgattgtagttggagtcttcatcactggtttagtagcaacggttttaatgtacagagcagttcctactgggtttattccagaggaagatcagggttatttctttgtaattgtccaagggccagatggggtttctttgaagtacaccgaatctgttatggatcgggttgtcaaagaagtaacatcagctcccgaagttagagctagttttatgatcagtggctttggtttcgatggtaatgcttctaatttgggcattgcctttgctaacctgaaaccctggaaagaaagagctaaagaatctcaatctgtttatgggatacttcagaggctgaacaaaaagctctcagcaattacagaagctagagcgatcgcagtgaatgctcctccggttagagggttaagtagtacaggtggttttgagtttatcattcaagaccgaactggaagtgcgccaattgaaaccctagttgagactgctaaaaaatttattgcagccgcaaataaaaagcctgttttacaacgagttttcactcagttcaccgcagacactccccaatttgacattcaggtaaaccgcaaccaagccaaagctctcaatgtggagattaacgacatctttggagcgttgcaaacttacttggggtcgcaatatgtaaataactttgtccaaggacagcgacagtatcgagtatatgtccaagcagatggggttttccgctctaatccagatgatattggcaaactctatgttcgctctgcaaacggggcgatgattccgttgagcagtttggtgaaagttactccctttgtgggtccaaaaaccatctcccattacaacttgtaccgatcaatcaaagtccagggcgctcctgctcccggtgctagttcaggagaggcgattaaagcaatggagcaagtagcagcagaaatgttacctcaaggatttggttatgagtggacagggacttatctccaggagaagacatcagggggagctacaggcttaatttttgctttagcgatcgttattgtctttctggtgttggcggctcagtatgaaagctatgttgacccaatcattattttgctgacagttcccctagctgttttgggagcgatgacggcgatttggctacgttccaatatttttatggcaggtagtctcttccccaaagtagtggatgatatctattgccaagtgggtctagtaactttgattggtctagctgcaaaaaacgcgattttagttgtggaatttgctaatcagctgcatgagcaaggcatgagctacacacgcgcggcggtgaaagcgggacaagagcgtctgcgacccatcttaatgacttcttttgcagcgctgttaggatttttgcccttggtgatctctcaaggggctggagccagcagccgttggtctttaggaacagcgctctttggagggttgctgctttcaacattcttgagtttgttcttggtgccaattttgtatatcctagtcaagaccctagctcaggctatattttctcggaagcgatcgggtggctcaaaacctccagattatcctaataaagcttcgggatctgaacatggggctttacctgctggcttaactaagccagagacacaacttaggtctcagcaggacgggataacctga

SEQ ID NO: 74505 - protein, 1105 aa, Nostoc punctiforme PCC 73102
MFVNTFIKRPVLTTVCTFIILLLGSICIPILPISQLPDLAPVQITVSSNNIGADAQTTENTVTNIIERQINGVKDVSYISSNTGNDGSSNITVSFPTNVNSDIAQVNVQNKEALASPQLPDTVQRTGVTVETASSSLLLVYGFYSENNEYDNIFISNYVDLYILDQIKRLPGVGSARVFGERKYAMRLWLDPNKLAQHQLTPQDVTTALQQQNIQVGAGAIGKEPAPDNQSFEFALRATSRFKDAAEFEDMVLKVSQGGTNSTSNSATNSTLVKVRDVGRVELGAENYLADAKFTIPGNAPKAAVGLGIYQLPGSNALDVAHAVEERIVALEKSFPPGLKAQLAFDTTPFVEISLEEVLHTLVEAIILVVLVIFVFLQDWRTTIIPTVAIPVSLIGTCAALLVLGFQINTLTLFGFVLAIGIVVDDAIIVVEAVAVKLEQGMRPFEAAVEAMKELTGAIIATSLVLMAVFIPVAFIPGTTGIVYKQFALTVACSIAISTFNALTFSPSMAAILMRPAQTARGPLGWFFTQFNRGFSWFTRRYVGFVSYLTHVKPIVVGVFITGLVATVLMYRAVPTGFIPEEDQGYFFVIVQGPDGVSLKYTESVMDRVVKEVTSAPEVRASFMISGFGFDGNASNLGIAFANLKPWKERAKESQSVYGILQRLNKKLSAITEARAIAVNAPPVRGLSSTGGFEFIIQDRTGSAPIETLVETAKKFIAAANKKPVLQRVFTQFTADTPQFDIQVNRNQAKALNVEINDIFGALQTYLGSQYVNNFVQGQRQYRVYVQADGVFRSNPDDIGKLYVRSANGAMIPLSSLVKVTPFVGPKTISHYNLYRSIKVQGAPAPGASSGEAIKAMEQVAAEMLPQGFGYEWTGTYLQEKTSGGATGLIFALAIVIVFLVLAAQYESYVDPIIILLTVPLAVLGAMTAIWLRSNIFMAGSLFPKVVDDIYCQVGLVTLIGLAAKNAILVVEFANQLHEQGMSYTRAAVKAGQERLRPILMTSFAALLGFLPLVISQGAGASSRWSLGTALFGGLLLSTFLSLFLVPILYILVKTLAQAIFSRKRSGGSKPPDYPNKASGSEHGALPAGLTKPETQLRSQQDGIT

SEQ ID NO: 74506 - DNA, 3192 bp, Nostoc punctiforme PCC 73102
  CDS (1)..(3192)
atgtttgttgacttctttattaagcgaccaatctttgcgtcggtctgcgcgatcgtcatacttttaatcggattaatcagtattcccacactaccgatcgctagattcccagaaattagtcccacccaaatcactgtaacttccaactatagcggagctagtgcagaagttgtagaaagcggagtgacaaatatcttagaaaggcaaatcaacggggttgagggactaagatatctcacttccagcagcagtaatgatggtactagtactattacagccacctttgattcatcgcgggataaagatattgcggctgtggatgtgcaaaatcgtgtttctgttgcccaaccacaactaccagattctgtgcagcgcacaggagtgcgggtatcaaaagaatctagcaacattctcttggcgattggtttatacgctgaaaatagagagtacgacaatatattcttaagcaactatgccgacctttacttagcagatgccttaaaaagagtcaaaggcgtgagcaacgctcaaatttttggtgaacgtcgctatgcaatgcgtctgtggttagatcctagtcgccttgctaatcgggggctaacgaccaaggatgtagcgaatgctttatccgaacaaaacttgcaagttggtgcagggagaattggacaagaaccggctcctgaaggacaaaggtatcaacttgatgtgcgtgctgctagccgattagcagaaccagcagaatttgaagaaattgtcctcaaaactggagatgatggcacattagtcaagctcaaagatgtcgggagagcggaactgggtgcagaaaactatagttcatttctgcgatttcgtggtaatgatgctgtcggtttagggatttatcaagttcctggtagtaatgccttggatgtggcaaagggagtcaaagacgaactagtgcgattagctccgagttttcccccagggctgaaatatcaggtagcttttgacacgacatcctttgtagaagagtcgatgtcagaagttatcaagactctgattgaagcggtagtgctagttgtaattgtaatttttgtgttcttacaagactggcgaactactttaattccagcacttaccattccgctttccttaattgggacatttgccttcgtcaaagtttttaacttttccatcaatagtttgactttatttggtctgactttagcatcggggatggtggtcgatgatgcgatcgttgtggtggagcaaatcagccgctttattcaggataaaggaattaatcctcgtcgagccgctagtgaatcaatgagggaactatttggcgcggttattgccacttcattagtattgatggcggtgtttgtgccagtggcgttttttccgggaaccacaggcgcactttatcggcaatttgcgctaacgatcgctttctccattgcgatttcaacttttttggctttgaccttgacaccttccttatgtgcgctgctgctgcgtcaaggacaaaaaccttcaggctggctgggttggatttttggaaagattaatcggtttcttgactgggtacagaatggttataagcgatcgcttaccttcttaacacacatcaaaggtattgtgattgggttatttatcgtctctttgggaatgactgcttggttgtacaccacagtaccaacagcttttctacccgatgaagacgaaggctacttcatcaccattatccaagggccacaaggggtttcgctgcaatatactagcgatgtgattgcacaggtagaaaaagaaattctgcaaattccagaagtactggggacttttgcgatcggaggatttggttttagtggtaacacagctaacagtggcatcatatttaccactttaaaatcttgggacgagcgctcaaaacccggtcaatcagtacaggcgattattggcagcttgcaagggaagttgatggcaatcccagaagctagagttttccctgtgaatcctccaccaatccagggtttaggtaactttgggggcttcgtctttcaactgcaagaccgcagaggtaacagtggtttagaaaatctagtccagtcgatgggtaagttgctgggtcaggctaatcaaacaccaggattacaagctgtatttagcacctttgccgcagatacaccacaattgcttgtagaagtagaccgcaataaagccaaatcattgcaagtttctatagatgatgtcttcagtactttacaaactgctttgggatcgcaatatgtaaatgattttaatctccagcagcgtaattatcgggtgtatatccaggcagatcaacagtttcgttccaatccaaaagatattggcaaactatacgttcgttctcaaaagaatcaaatggttcctttgagtaacttagttaaagttactcagactgtgggagcgcaaacgataaatcactataatctgttccgctcgattgaaattaatggttccgccgctcctggctctagttcgggagacgcaattaaagcaatggaaaaagttgctaaagaagttttaccagccggctatggttatgaatggtcagggactgcattagaagaaatagattctggtggtttagcacccataatctttggattaggaataatttttgtatttttggtactagccgctcaatacgaaaactacgttgacccctttatcattctgttatcagttcctttagctatctttggagcgctgatagctcaatcaatgcggggttttgcaaatgatgtttactgtcaaattggtctagtaatgttgatcggtttagctagtaagaacgcaattttgattgtggaatttgctaatcaattacgagagcaagggctttcgattactaaagcagtaattgaggcttcgcaagagcggttacgcccaattttgatgactgctttttctacattattagggattttcccgttagctgttgccacaggtgccggtgcgggaagtcgtcaatctttgggaacagcagtttttggtgggatgttaattgcgactttcttgagtttgtttgtagtaccgattttgtatatcgtcattaagacgacaacagagcgctttatccaaccaaatcggcatcaagaactgcaaacagatgcagtttcattagatggtaaaagtgctgtatattcaacaaaaggagagaattag

SEQ ID NO: 74507 - protein, 1063 aa, Nostoc punctiforme PCC 73102
MFVDFFIKRPIFASVCAIVILLIGLISIPTLPIARFPEISPTQITVTSNYSGASAEVVESGVTNILERQINGVEGLRYLTSSSSNDGTSTITATFDSSRDKDIAAVDVQNRVSVAQPQLPDSVQRTGVRVSKESSNILLAIGLYAENREYDNIFLSNYADLYLADALKRVKGVSNAQIFGERRYAMRLWLDPSRLANRGLTTKDVANALSEQNLQVGAGRIGQEPAPEGQRYQLDVRAASRLAEPAEFEEIVLKTGDDGTLVKLKDVGRAELGAENYSSFLRFRGNDAVGLGIYQVPGSNALDVAKGVKDELVRLAPSFPPGLKYQVAFDTTSFVEESMSEVIKTLIEAVVLVVIVIFVFLQDWRTTLIPALTIPLSLIGTFAFVKVFNFSINSLTLFGLTLASGMVVDDAIVVVEQISRFIQDKGINPRRAASESMRELFGAVIATSLVLMAVFVPVAFFPGTTGALYRQFALTIAFSIAISTFLALTLTPSLCALLLRQGQKPSGWLGWIFGKINRFLDWVQNGYKRSLTFLTHIKGIVIGLFIVSLGMTAWLYTTVPTAFLPDEDEGYFITIIQGPQGVSLQYTSDVIAQVEKEILQIPEVLGTFAIGGFGFSGNTANSGIIFTTLKSWDERSKPGQSVQAIIGSLQGKLMAIPEARVFPVNPPPIQGLGNFGGFVFQLQDRRGNSGLENLVQSMGKLLGQANQTPGLQAVFSTFAADTPQLLVEVDRNKAKSLQVSIDDVFSTLQTALGSQYVNDFNLQQRNYRVYIQADQQFRSNPKDIGKLYVRSQKNQMVPLSNLVKVTQTVGAQTINHYNLFRSIEINGSAAPGSSSGDAIKAMEKVAKEVLPAGYGYEWSGTALEEIDSGGLAPIIFGLGIIFVFLVLAAQYENYVDPFIILLSVPLAIFGALIAQSMRGFANDVYCQIGLVMLIGLASKNAILIVEFANQLREQGLSITKAVIEASQERLRPILMTAFSTLLGIFPLAVATGAGAGSRQSLGTAVFGGMLIATFLSLFVVPILYIVIKTTTERFIQPNRHQELQTDAVSLDGKSAVYSTKGEN

SEQ ID NO: 74508 - DNA, 3168 bp, Desulfovibrio desulfuricans G20
  CDS (1)..(3168)
atgatcgccgaactgtttgtaagccgcccgcggctggcgatggtcatatcactggtcatcaccattgccggtctggtgaccatgttcaccattcccgtggcgcagtaccctcagatcaaccctccggaaatcgtggtttcggccgcgtatccgggtgccagcgcacaggttctggccgataccgtggcagcgcccatcgagtcgcaggtcaacggcgtcgaaggcatggtctacatgtcgtccagcagcgataacagcggcaactactcacttaccgtgaccttcgggcctgatgtggaccccgatatagcacaggtcaacgtgcagaaccgcgtcgcgctggcagaacctgttctgcccacggaagtcaagcagcagggggtttccatccgttcgaaatcctcaaacatgcttgctgtatactcgtttatatcccctcagggatcgcatgactcgctctatctgagcaactacgtcagcataaacatcaaagacgcgcttacccgcgtgaacggcgtcagcgacgtcacggtgttcggtgccaaagactacagcatgcgcatctggcttgatccggacagaatggccgcgctcaaggtaagccccgaggaagtcattgaagccgtcggctcgcagaacattcaggctgccgcgggcagtgtgggctccgccccgtcttcgcccgaccagcagctcacgtttaccgtacgcgccaaaggccgtctgaccacggtggaagagttccgcaacattgtcatccgcagcaacgacacaggcggcctgctgcgtctgggcgatgtggcgcgcgtggagctgggcgccaaggactatggcacagaggccacattcaacggacaccccgccattgcgctgggcgtgtaccagagccccacagccaacgctctggataccgttgaaaacctgaacaaagaactcgaccggctttccagattctttcccgaagacgtggaataccggctgatgtacgacaccacggactatgtgcgtgccgcgctgtgggaaataatcctcaccctgctcatcacctttgcactggtcatgggcgtgacatacatcttcctgcaggacctgcgggcgacgctcattcccacgctgaccatccctgtttcgctgctgggcacatttgcggtgctcatggcgctggggtacagcgcaaacacgttcaccctgtttgcgctcattctggccatcggcgtggtggtggacgatgccattgtggtggtggaaaacgtacagcgcatcatgtacgaggaaaaactgcccgcgcctcaggccaccatcaaggccatggaacaggtgaccgggccggtcatcgccaccacgctggtgctgctggccgtttttgtgcccattggcttcatctcgggcatcaccggcaacatattccggcagtttgcggtcaccatatccacgtcggtgctgctgtcttcggtcaacgcgctgacgctcagccccgcgctgtgcgccattctgctgcggccggtgcgcatgcatcagcacggacctctggccgtgttcaacacggtgctcaacaagtgccgcaacagctttgtttccggcacggcatggctcatccgcaagatggtcatctccggcgtgctctttctggcggtggccgcgggcacgtactacatgatgaacagcatccacaccagttttgttcccgatgaagatcagggcgctctgtttgtggatgtgcagttgcccgacggagccgcaaagcccagaacaggcaatgtgattgacgaaatcggcgcacagatggaaaccatggacggcatgcaggaagtgctgggcatcaacggcttcagctttctgagcggccgcggggcaaactccggtctgctcatcgccaacctgctcccgtgggacgaacgcagcgatgcttcgctgcacgcaacggccctgcaggccaaaatgaccgtggccttcaacgccatcccctacgccaacacccgcgtactgctgccgccggccattcccggtctgggcatggcgggcggcatagacttccgcgtgctggccactcaggggcaaagccctcaggaactggccgccgcagtgcgctccatgctcatcgcggccaacagcgaccccagaataatggccgcgttcagctcttattccgccaacgtgccgcaggtgttcatcaagctggacagggcaaaggcggaaagcatgggtgtggccgtcagcaacgtattcgccacgttgcagacacagctcggttcgcggtatataaacgacttcaacatgctgggccgcgcgtttcaggtcaacattcaggccgaaaacgactaccgtaatgcggtggacgacatcagccgcctgcacgtgcgcagcggtgacggacacatggtgccgctgggcagcatagcaaccatagagacagtgcttggaccgcaaagctactcgcgctacaaccagttcccctcggcgcagataatggccatacctgttccgggcttcagctccggtcaggccatggacctgttcgaggaactggcggacaaaacactgcccgaaggctacacctatgaatggtccggccagagctatcaggaaaagcagacgcagggacagaccggcattcttgtgggactggcactgctgttcggctacctgttccttgtggcacagtacgaaagctggacaacgccgctgcctgtcatgctctccattctgttcgcctccggcggcgcgctggcggggctgatgatagcaggcatgccgctgagcatatacgcccagatagggcttgtgctgctggtggggctggcggccaaaaacgccatcctcatcgtggaattctcgcgcgacaaacggcttgagggcgcctccatcatggaagccgccaccaccggcgcgcgtatcagattccgtgcggtgctcatgacggcgttctcgttcattctgggcgtgttccccatggtcatcgctcagggtgccggtgcaggcagccgtcagtccatcggcaccacggtgttcgcgggcatgctggcatccaccatggtggggatattcttcatcccgccgctgtatgccgcctttgaaaccatgcgcaccagaaccatggactgggtacaccgcaggcgcgacgccgcgcacgcagaactgaccgatacggggagcaacaatgacgcataa

SEQ ID NO: 74509 - protein, 1055 aa, Desulfovibrio desulfuricans G20
MIAELFVSRPRLAMVISLVITIAGLVTMFTIPVAQYPQINPPEIVVSAAYPGASAQVLADTVAAPIESQVNGVEGMVYMSSSSDNSGNYSLTVTFGPDVDPDIAQVNVQNRVALAEPVLPTEVKQQGVSIRSKSSNMLAVYSFISPQGSHDSLYLSNYVSINIKDALTRVNGVSDVTVFGAKDYSMRIWLDPDRMAALKVSPEEVIEAVGSQNIQAAAGSVGSAPSSPDQQLTFTVRAKGRLTTVEEFRNIVIRSNDTGGLLRLGDVARVELGAKDYGTEATFNGHPAIALGVYQSPTANALDTVENLNKELDRLSRFFPEDVEYRLMYDTTDYVRAALWEIILTLLITFALVMGVTYIFLQDLRATLIPTLTIPVSLLGTFAVLMALGYSANTFTLFALILAIGVVVDDAIVVVENVQRIMYEEKLPAPQATIKAMEQVTGPVIATTLVLLAVFVPIGFISGITGNIFRQFAVTISTSVLLSSVNALTLSPALCAILLRPVRMHQHGPLAVFNTVLNKCRNSFVSGTAWLIRKMVISGVLFLAVAAGTYYMMNSIHTSFVPDEDQGALFVDVQLPDGAAKPRTGNVIDEIGAQMETMDGMQEVLGINGFSFLSGRGANSGLLIANLLPWDERSDASLHATALQAKMTVAFNAIPYANTRVLLPPAIPGLGMAGGIDFRVLATQGQSPQELAAAVRSMLIAANSDPRIMAAFSSYSANVPQVFIKLDRAKAESMGVAVSNVFATLQTQLGSRYINDFNMLGRAFQVNIQAENDYRNAVDDISRLHVRSGDGHMVPLGSIATIETVLGPQSYSRYNQFPSAQIMAIPVPGFSSGQAMDLFEELADKTLPEGYTYEWSGQSYQEKQTQGQTGILVGLALLFGYLFLVAQYESWTTPLPVMLSILFASGGALAGLMIAGMPLSIYAQIGLVLLVGLAAKNAILIVEFSRDKRLEGASIMEAATTGARIRFRAVLMTAFSFILGVFPMVIAQGAGAGSRQSIGTTVFAGMLASTMVGIFFIPPLYAAFETMRTRTMDWVHRRRDAAHAELTDTGSNNDA

SEQ ID NO: 74510 - DNA, 3120 bp, Actinobacillus pleuropneumoniae serovar 1 str. 4074
  CDS (1)..(3120)
atgaaatttactgatatttttattaaacgtccggtacttgccgtttgtattagtttgctaattaccattttaggtttgcaatctattaacaaacttcaagtacgcgaatatcccgaaatgacgatttccattgtcacggtaaaagtcaattattcgggtgcggatgcaagccttatgcaggcattggtaacttctcaaattgaagaagcggtagcgcaggcggataatatcgactatgttacttcatcaagcggtcctagttcttccacgacaacgattaagatgaagttaaataccaatccgcaaatggcgctcgcggatatttctgcgaaggtaaatgcgattcgtgcgaatttgccgagcggtattgacgatccgtccattagcgtttcgtccggttcgaacgatgcgttaatgtatatccgtttcgtttcggatgaactttctacaccgcaaattaccgactatatcaatcgtgtggttaaacctcaattctttacggtaaacggcgtttcgagcgtagatattttcggtgcggcgaacttcggtttacgtatttggttagacccggacaaaatggcgggaaataacctttccggtgcggcggtattatcggcgttaagtgcgaataacttaaatacggctgccggtaatgcgaacggttattacacggtttataagaacaaagtggaatccagtacgccgtctgtcgaagaactggaaaacgtaaccatttcgacaacttccgacggtcgtatcgttaaacttaaagatattgcaaaagttgaattggataaatatcaagacgcttcccgagctatcgcagacggtaaagaagcggttgtattagcggttagtgccgcaacaacggctaactcgcttacggtggcaaaagatatttatccggtatttgaccttatcactaaaaatttaccgtcgtcagtgaacggtcaaattatgtatgataaaacggttgcaattaacagctcgattaatgaggtaattaaaactatcggagaggcgacagttatcgtattagcggtaatcattcttttcttaggatcattacgcgcaatgattgtgccgattattactattccgatttcattgatcggggtgttattcttcctgcaaatgttcggattctctattaacttattaaccttgttagcgttagtgttggcaatcgggcttgtggtggacgatgcgatttgtgtgttggaaaacgtcgaacgccacgtaaaagaagggaaaacaccgtttgatgcggcgatcatcggtacacgtgaaatcgccttaccggtaatttcaatgactataacacttgctgcggtatattctccgatggcattaatggaaggcgttaccggctctttatttaaagagtttgcactaacgcttgccggtgcggtatttatttcagggattgcggcattaaccttatctccgatgatgtccagccgagtattaaaagagcataatgaagaaaacgaaagtcgtttctcaaaatgtatcaatacaatgctagataaaatgaccgcttgttataccaatatgttaagaggtgtgatgtcggtacgttggttagtggttatctttgcaatgagcatttttgcggtattaccgacgttattaacttctctttccagtgaggttgcaccgaccgaagaccgtggattcgtggtcggtatcggtaacggcccgtccaataccaacttagattatacgcaagcggcaacagaaaaatttaatgaagaggtcgggaaaattccggaagtcgcatcgatgatgactgtttccggttttaacggcgcaaacagtgccttatcaattatttcattaaaagactggagcgagcgtgagcgtgaacgtaaaccgatttcggcggacgtttctgcaattgcgaaaaacgtagtcggtatggatattaacgcaatttccttcccggaaatttcaaccggtgaaaacggtttaccgttctcattggtaattactacggcggataattatgtgaagctagccgatgtcgcgaacgacttcttgaaaaaagcgcaagcatcgggtcaattcttcttctcaagtctggatttgaaatttgatacggtcacgatgaaatggaaatttgatcgtgagaaaatggggacttacggtgtaacgatgcaacaggtaagcggtacgttaggagcatatttatccggcgcgattattacgcgtgttgatatcgactctcgtgcttatccgattgtgtcgcaagcggttcgtcaagatcgattaaatccgcaggatttggttaattactatgtaaccaccgcaagtggcgagtccgtgccgttaagttcgtttgtttctttagaattatcaacggaaccggcggcgttacctcgtatgaaccagttaaattccgcaacgatttccggtgtggtatccagctcaatcggtgatgcggtaaattgggctaaagcggagcttgatcgcagcttaccgcaaggttatcaatacgactttaaatccgaagcgcgccaatatgtacaagaaggtaatgcaatggcgatgacatttgctttagccgtcgtgattatctatcttgttcttgcgattcagtttgaatcttggcgtgatccgatggtaattttggtttcggtaccgcttgcattaagtggcgctttagtcgtactaaatgtgttaggtattgccggaatagccggtgcaactttaaatatctattcgcaagtaggtttagtaacgttagtcggtttgattactaagcacggtatcttaatgtgcgaagtggcgaaagaagaacagttacataacggcttatcccgttttgatgcgatcgttcattcggcaactattcgtttacgcccgattatgatgacgaccgcggcgatggtggccggcttgatcccgttattgtttgcaatgggtgcaggggctattgctcgtttcagtatggggatggtgattgttgccggtttaagcatcgggacattatttaccttgtttgtactaccggttatttataccttcttaggacaagagcataaaccgcttcgtgaattcgacgaagaaaaatatgctaaagcgtccgtagaaaaaatcgagcataccggtatgtaa

SEQ ID NO: 74511 - protein, 1039 aa, Actinobacillus pleuropneumoniae serovar 1 str. 4074
MKFTDIFIKRPVLAVCISLLITILGLQSINKLQVREYPEMTISIVTVKVNYSGADASLMQALVTSQIEEAVAQADNIDYVTSSSGPSSSTTTIKMKLNTNPQMALADISAKVNAIRANLPSGIDDPSISVSSGSNDALMYIRFVSDELSTPQITDYINRVVKPQFFTVNGVSSVDIFGAANFGLRIWLDPDKMAGNNLSGAAVLSALSANNLNTAAGNANGYYTVYKNKVESSTPSVEELENVTISTTSDGRIVKLKDIAKVELDKYQDASRAIADGKEAVVLAVSAATTANSLTVAKDIYPVFDLITKNLPSSVNGQIMYDKTVAINSSINEVIKTIGEATVIVLAVIILFLGSLRAMIVPIITIPISLIGVLFFLQMFGFSINLLTLLALVLAIGLVVDDAICVLENVERHVKEGKTPFDAAIIGTREIALPVISMTITLAAVYSPMALMEGVTGSLFKEFALTLAGAVFISGIAALTLSPMMSSRVLKEHNEENESRFSKCINTMLDKMTACYTNMLRGVMSVRWLVVIFAMSIFAVLPTLLTSLSSEVAPTEDRGFVVGIGNGPSNTNLDYTQAATEKFNEEVGKIPEVASMMTVSGFNGANSALSIISLKDWSERERERKPISADVSAIAKNVVGMDINAISFPEISTGENGLPFSLVITTADNYVKLADVANDFLKKAQASGQFFFSSLDLKFDTVTMKWKFDREKMGTYGVTMQQVSGTLGAYLSGAIITRVDIDSRAYPIVSQAVRQDRLNPQDLVNYYVTTASGESVPLSSFVSLELSTEPAALPRMNQLNSATISGVVSSSIGDAVNWAKAELDRSLPQGYQYDFKSEARQYVQEGNAMAMTFALAVVIIYLVLAIQFESWRDPMVILVSVPLALSGALVVLNVLGIAGIAGATLNIYSQVGLVTLVGLITKHGILMCEVAKEEQLHNGLSRFDAIVHSATIRLRPIMMTTAAMVAGLIPLLFAMGAGAIARFSMGMVIVAGLSIGTLFTLFVLPVIYTFLGQEHKPLREFDEEKYAKASVEKIEHTGM

SEQ ID NO: 74512 - DNA, 3090 bp, Pseudomonas aeruginosa UCBPP-PA14
  CDS (1)..(3090)
atgacctttaccgacctgttcgtccgccggccggtgctggcgctggtggtcagcacgctgatcctgctgctcggcctgttctccctgggcaagctgccgatccgccagtacccgctgctggaaagctcgaccatcaccgtcaccaccgagtaccccggcgcctccgccgatctcatgcaaggcttcgtcacccagccgatcgcccaggcggtgtcgtcggtggagggcatcgactacctttcctcgacctcggtgcaggggcgtagcgtggtgaccatccgcatgctgctcaaccgcgattcgacccaggcgatgaccgagaccatggccaaggtcaactcggtgcgctacaagctgcccgagcgtgcctacgactcggtgatcgaacgctcttccggcgagaccaccgcggtggcctacgtcggcttttccagcaagaccctgccgatcccggcgttgaccgactacctgtcgcgggtggtcgagccgatgttctcttccatcgacggcgtggccaaggtccagacctttggcggccagcgcctggccatgcgcctctggctcgacgccgaccgcctcgccgggcgcggcctgaccgcctccgacgtggccgaggcgatccgccgcaacaactaccaggcggcgccggggatggtgaaggggcagtacgtgctgtccaacgtgcgggtcaacaccgacctgaccaacgtcgacgacttccgcgagatggtcatccgcaacgatggcaacggcctggtgcgcctgcgcgacgtcggtaccgtcgaactgggcgccgcggccaccgagaccagcgcactgatggacggcgacccggcggtgcacctggggttgttcccgacgcccaccggcaacccgctggtgatcgtcgacggcatccgcaagctgctgccggagatccagaagaccctgccgccggatgtccgcgtcgacctcgcctacgagacttcgcgcttcatccaggcctccatcgacgaggtggtgcggaccctggtggaagcgctgctgatcgtggtgctggtgatctacctctgcctcggctcgctgcgcagcgtgctgatcccggtggcgaccattcccctgtcgatgctcggcgccgccgcgctgatgctggccttcggcttcagcgtcaacctgctgaccctgctggcgatggtgctggccatcgggctggtggtggacgacgccatcgtggtggtggagaacgtccaccgccacatcgaggaaggcaagtcgccggtggcggcggcgctgatcggcgcccgcgaagtggccggcccggtgatcgccatgaccatcaccctggccgccgtgtacacccccatcggcctgatgggcggcctcaccggcgcactgttccgcgagttcgccctgaccctggcgggcgcggtgatcgtgtccggggtggtggcgctgaccctgtcgccggtgatgagttcgctgctgctccaggcgcaccagaacgaggggcgcatgggccgcgccgccgagtggttcttcggcggcctgacgcggcgctacgggcaggtcctggagttctccctgggccaccgctggctgaccggcggcctggccttgctggtgtgcatcagcctgccgctgctgtattcgatgcccaagcgcgaactggcgccgaccgaggaccaagccgcggtgctcaccgcgatcaaggcgccgcagcacgccaacctcgactacgtcgaactgttcgcgcgcaagctcgaccaggtctacaccagcatcccggaaaccgtgagcacctggatcatcaacggcaccgacggcccggcggcgagcttcggcgggatcaacctggcggcctgggaaaaacgcgagcgcgacgcctcggcgatccagtccgagctgcaaggcaaggtcggcgacgtcgagggcagcagcatcttcgccttccagttggccgccctgcccggctccaccggcggcctgccggtgcagatggtgctgcgcagcccgcaggactatccggtgctctaccggaccatggaagagatcaagcagaaggcccggcagagcgggctgttcgtggtggtcgacagcgacctcgactacaacaacccggtggtccaggtccgcatcgaccgcgccaaggccaacagcctgggcatccgcatgcaggacatcggcgagtcgctggcggtgctggtgggcgagaactacgtcaaccgcttcggcatggaaggccgctcctacgacgtgatcccgcagagcctgcgcgaccagcgtttcactccgcaagcgctggcacgacagttcgtgcgcacccaggacggcaacctggtgccgctgtcgacggtggtccgggtggagcttcaggtcgaaccgaacaagctgatccagttcgaccagcagaacgccgcgaccctccaggcgatccccgcgcccggcgtctccatgggccaggcggtggccttcctcgacgacgtggcgcgcggcctgccggccggcttcagccacgactggcaatccgactcgcggcaatacacccaggaaggcaacaccctggtgttcgccttcctcgccgccctggtggtgatctacctggtgctcgccgcgcagtacgagagcctggccgacccgctgatcatcctgatcaccgtgccgctgtcgatctgcggcgcgctgctgccgctggcgctgggctacgcgacgatgaacatctatacgcagatcggcctggtcaccctgatcggcctgatcagcaagcacggcatcctcatggtcgagttcgccaacgaactgcaactccacgagcgcctcgaccgccgcgcggcgatcctgcgcgccgcacagatccgcctgcggccggtgctgatgaccaccgcggcaatggtcttcggcctggtgccgctgctcttcgccagcggcgccggcgccgccagccgcttcggcctgggcgtggtgatcgtctccgggatgctggtcggcaccctcttcaccctgttcgtgctgcccaccgtctataccctgctggcgcgcaaccacgcggaagtcgacaagagcccgcgcagccggcaactggccgaggccgatctgctggtgaacaaggcatga

SEQ ID NO: 74513 - protein, 1029 aa, Pseudomonas aeruginosa UCBPP-PA14
MTFTDLFVRRPVLALVVSTLILLLGLFSLGKLPIRQYPLLESSTITVTTEYPGASADLMQGFVTQPIAQAVSSVEGIDYLSSTSVQGRSVVTIRMLLNRDSTQAMTETMAKVNSVRYKLPERAYDSVIERSSGETTAVAYVGFSSKTLPIPALTDYLSRVVEPMFSSIDGVAKVQTFGGQRLAMRLWLDADRLAGRGLTASDVAEAIRRNNYQAAPGMVKGQYVLSNVRVNTDLTNVDDFREMVIRNDGNGLVRLRDVGTVELGAAATETSALMDGDPAVHLGLFPTPTGNPLVIVDGIRKLLPEIQKTLPPDVRVDLAYETSRFIQASIDEVVRTLVEALLIVVLVIYLCLGSLRSVLIPVATIPLSMLGAAALMLAFGFSVNLLTLLAMVLAIGLVVDDAIVVVENVHRHIEEGKSPVAAALIGAREVAGPVIAMTITLAAVYTPIGLMGGLTGALFREFALTLAGAVIVSGVVALTLSPVMSSLLLQAHQNEGRMGRAAEWFFGGLTRRYGQVLEFSLGHRWLTGGLALLVCISLPLLYSMPKRELAPTEDQAAVLTAIKAPQHANLDYVELFARKLDQVYTSIPETVSTWIINGTDGPAASFGGINLAAWEKRERDASAIQSELQGKVGDVEGSSIFAFQLAALPGSTGGLPVQMVLRSPQDYPVLYRTMEEIKQKARQSGLFVVVDSDLDYNNPVVQVRIDRAKANSLGIRMQDIGESLAVLVGENYVNRFGMEGRSYDVIPQSLRDQRFTPQALARQFVRTQDGNLVPLSTVVRVELQVEPNKLIQFDQQNAATLQAIPAPGVSMGQAVAFLDDVARGLPAGFSHDWQSDSRQYTQEGNTLVFAFLAALVVIYLVLAAQYESLADPLIILITVPLSICGALLPLALGYATMNIYTQIGLVTLIGLISKHGILMVEFANELQLHERLDRRAAILRAAQIRLRPVLMTTAAMVFGLVPLLFASGAGAASRFGLGVVIVSGMLVGTLFTLFVLPTVYTLLARNHAEVDKSPRSRQLAEADLLVNKA

SEQ ID NO: 74514 - DNA, 3102 bp, Pseudomonas aeruginosa UCBPP-PA14
  CDS (1)..(3102)
atgatcgccttggtgatcatgctcgcgggcggcctgtcgatcctcagtctgccggtcaaccagtacccggccatcgccccgccggccatcgccgtgcaggtgagctacccgggcgcctcggccgagacggtgcaggacaccgtggtccaggtgatcgagcagcagatgaacgggatcgacaatctgcgctacatctcctcggagagtaactccgacggcagcatgaccatcaccgtgaccttcgaacagggcaccgaccccgacatcgcccaggtccaggtgcagaacaagctgcaactggccaccccgctactgccgcaggaagtgcagcgccaggggatccgggtgaccaaggcggtgaagaacttcctcatggtggtcggtgtggtttccaccgacggcagcatgaccaaggaagacctgtcgaactacatcgtttccaacatccaggacccactctcgcggaccaagggcgtcggtgacttccaggtgttcggctcgcagtactcgatgcgcatctggctcgacccggccaagctgaacagctaccagctgacccccggcgacgtgagcagcgcgatccaggcgcagaacgtgcagatttcctccggccagctcggcggcttgccggcggtcaagggccagcagctcaacgccaccatcatcggcaagacccgcctgcagaccgcggagcaattcgagaacatcctgctcaaggtcaatcccgacggttcccaggtgcgcctgaaggacgtcgccgatgtaggcctgggcggccaggactacagcatcaacgcgcagttcaacggcagcccggcgtccggtatcgcgatcaagctggccaccggcgccaacgcgctggataccgccaaggcgatccgccagaccatcgccaacctggaaccgttcatgccgcagggcatgaaggtggtctacccgtacgacaccaccccggtggtctcggcctcgatccatgaggtagtgaagaccctcggcgaggcgatcctcctcgtgttcctggtgatgtacctgttcctgcagaacttccgcgccacgctgatcccgaccatcgccgtaccggtggtgctgctggggaccttcggcgtgctcgccgcgttcggcttctcgatcaacaccctgaccatgttcggcatggtgctggccatcggcttgctggtggacgacgccatcgtggtggtggagaacgtcgagcgggtgatggccgaggaaggcctgtcgccaagggaggcggcgcgcaagtccatgggccagatccagggcgcgctggtcggtatcgccatggtgctctcggcggtattcctgccgatggcgttcttcggcggctccaccggggtgatctaccggcagttctccatcaccatcgtgtcggccatggccctctcggtgatcgtggcgctgatcctcaccccggcgctctgcgcgaccatgctcaagccgatcgagaaaggcgaccatggcgagcacaagggcggcttcttcggctggttcaaccggatgttcctttccaccacccacggctacgagcggggcgtggcgtcgatcctcaagcatcgcgcgccgtacctgctgatctacgtggtgatcgtggccgggatgatctggatgttcacccgcattcccaccgcgttcctccccgacgaggaccagggcgtactgttcgcccaggtacagaccccgccgggctccagtgccgagcgtacccaggtggtggtggactcgatgcgcgaatacctgctggagaaggaaagctcttcggtcagctcggtgttcaccgtgaccggcttcaacttcgccggccgcggccagagttcgggcatggcgttcatcatgctcaagccctgggaagagcgtcccggtggcgagaacagcgtgttcgaactggccaagcgcgcgcagatgcacttcttcagcttcaaggacgcgatggtgttcgccttcgcgccgccgtcggtactggaactgggtaacgccaccggcttcgacctgttcctccaggaccaggcgggtgtcggccacgaagtcctgctccaggcgcgcaacaagttcctcatgctcgccgcgcagaacccggcgctgcaacgcgtgcgccccaacggcatgagcgacgaaccgcagtacaagctggagatcgacgacgagaaggccagcgccctcggcgtgtcccttgccgacatcaacagcaccgtgtccatcgcctggggttccagctacgtcaacgatttcatcgaccgtggccgggtcaagcgggtctacctgcagggcaggccggacgcgcggatgaacccggacgacctgagcaagtggtacgtgcgcaacgacaagggcgagatggtgccgttcaacgccttcgccaccggcaagtgggaatacggttcgccgaagctggagcgctacaatggcgtgccggcgatggagatcctcggcgagccggcgcccggcctgagttccggtgacgccatggcggcggtcgaggagatcgtcaagcaattgccgaaaggcgttggctactcctggaccggcctgtcctacgaggagcgcttgtccggctcgcaggcgccggcgctgtatgcgctgtcgctgctggtggtgttcctctgcctggcggccctgtacgaaagctggtcgattccgttctcggtgatgctggtggtgccgttgggcgtgatcggtgcgctgctggcgacgtccatgcgcggcctgtccaacgacgtgttcttccaggtgggcctgttgacgaccatcggcctgtcggcgaagaacgccattctcatcgtggagttcgccaaggagctgcacgagcagggcaagggcatcgtcgaggcggccatcgaagcctgccgcatgcgtctgcggccgatcgtgatgacctccctggcgttcatcctcggcgtggtcccgctggcgatctccaccggcgccggctcgggcagccagcatgcgatcggtaccggcgtgatcggcggcatggtcactgcgaccgtcctggcgatcttctgggtaccgctgttctacgtggcggtcagcacgctgttcaaggacgaggcgtccaagcagcaggcgtccgtcgaaaaggggcaatga

SEQ ID NO: 74515 - protein, 1033 aa, Pseudomonas aeruginosa UCBPP-PA14
MIALVIMLAGGLSILSLPVNQYPAIAPPAIAVQVSYPGASAETVQDTVVQVIEQQMNGIDNLRYISSESNSDGSMTITVTFEQGTDPDIAQVQVQNKLQLATPLLPQEVQRQGIRVTKAVKNFLMVVGVVSTDGSMTKEDLSNYIVSNIQDPLSRTKGVGDFQVFGSQYSMRIWLDPAKLNSYQLTPGDVSSAIQAQNVQISSGQLGGLPAVKGQQLNATIIGKTRLQTAEQFENILLKVNPDGSQVRLKDVADVGLGGQDYSINAQFNGSPASGIAIKLATGANALDTAKAIRQTIANLEPFMPQGMKVVYPYDTTPVVSASIHEVVKTLGEAILLVFLVMYLFLQNFRATLIPTIAVPVVLLGTFGVLAAFGFSINTLTMFGMVLAIGLLVDDAIVVVENVERVMAEEGLSPREAARKSMGQIQGALVGIAMVLSAVFLPMAFFGGSTGVIYRQFSITIVSAMALSVIVALILTPALCATMLKPIEKGDHGEHKGGFFGWFNRMFLSTTHGYERGVASILKHRAPYLLIYVVIVAGMIWMFTRIPTAFLPDEDQGVLFAQVQTPPGSSAERTQVVVDSMREYLLEKESSSVSSVFTVTGFNFAGRGQSSGMAFIMLKPWEERPGGENSVFELAKRAQMHFFSFKDAMVFAFAPPSVLELGNATGFDLFLQDQAGVGHEVLLQARNKFLMLAAQNPALQRVRPNGMSDEPQYKLEIDDEKASALGVSLADINSTVSIAWGSSYVNDFIDRGRVKRVYLQGRPDARMNPDDLSKWYVRNDKGEMVPFNAFATGKWEYGSPKLERYNGVPAMEILGEPAPGLSSGDAMAAVEEIVKQLPKGVGYSWTGLSYEERLSGSQAPALYALSLLVVFLCLAALYESWSIPFSVMLVVPLGVIGALLATSMRGLSNDVFFQVGLLTTIGLSAKNAILIVEFAKELHEQGKGIVEAAIEACRMRLRPIVMTSLAFILGVVPLAISTGAGSGSQHAIGTGVIGGMVTATVLAIFWVPLFYVAVSTLFKDEASKQQASVEKGQ

SEQ ID NO: 74516 - DNA, 3228 bp, Psychrobacter sp. 273-4
  CDS (1)..(3228)
atgtcacgtttttttattaatcgccctatttttgcttgggtgctggctgttttggtcatgctcatcggggtgatatcggttcttaacctaccgattgaacagtatccacgtattgcaccaccgacgatttcggtcagtgcaagctaccctggtgctaacgcgcaaaccgttgaaaattcagtaatacagattattgagcagcgcatgaaagggcttgatggtctgatgtatatgtcatcatcgagctcttcaaatggtagtgcctcagtgacgcttacctttgagaacggtactgattctgatactgctcaggtacaagtacagaacaaactgcaagccgcgatgagctcgttacctgaatcggtacagcgtcaaggcgttaacgttaataaatcatctagcagctttatgatggtgcaggcgttcatctccgaagatggcaatatggatcgatcagatattggcgattatattaactccaatgtcctcgatgcgatcagtcgtgttgaaggtgtgggtgaggttcaagtctttggctctacctatgcgatgcgtgtttggcttgacccttcacgcctacgtagctacaacatggtgccatctgatgtcgtcaatgcgatacgagcacagaacactcaggtatctgctggtcaattaggacaagcacctgctgacactgaccaacaggttatcaacgctactgttacggtgcaaagctatttacaaacgcctgaagaatttcaaaacattctgttaaaaactgacaccgctggtgcgcaggtacgtttaggcgatgtggcggatgtcgaaatcggcagtgagaattatagcgttgtgtctttatataatggacaagaagcggctggtttgggtatttcgcttgctgctggtgccaacgcacttgaaactcgtgaggcagttggtgtgcgtatggcagagctggaaaagaattttccagctggtctgacatcagtggttccttatgacaccacaccatttgttcgtctatctatcgaacaagtcgttatgaccctcattgaggcgatcgtattagtatttatcgttatgttccttttcttacagaactggcgcgcgactatcattccaacgcttgccgtacctgttgttctattgggtacgtttggggtgctgtatattgctggctttagtatcaacgtattgaccatgtttgctatggtgctctccattggtctattggtcgatgatgcaatcgttgtcgtagagaacgttgagcgtatattagaagaagatcctcacatttctattaaagacgcgaccgttcaatcgatgggtgaaatcagtaagatcgttattggtattgcgcttattttatccgctgtattcataccgatggctttctttggcggctcaacaggcgtgatttaccgtcagttctctattactttgattaccagcatggtgttatcagccatggtcgcgcttgttttcacccctgccctatgtgtgacattgctaaaacgtggcaaaagtcatgaaaaaggcaatagcgaaaatcaaaaaggcttctttggttggtttaaccgctcttttaccaaaaccagtcaatcttatgaaaaatttattggtaaaagcttccgttttaaatggttatatctgattgtctatgccgccattatcggtattatggcagtggtgttcttgcgtattccgggctcatttttaccagaagaagatcaaggtattatgtttaccttggttcagcttcctgccggctctacactagatgagacacaagacgtactggataaaattagaaactattacgacactcaagagagcgataacattgcttctgtctttaccattgcaggctttagttttgctggtcaaggtcaaaatatgggtctggcatttgtacgtttgtcagattgggaggaacgttctggtgatgaaaacacagcccaagccgttgctggtcgagcaatgggttatttctttactcagttaaatgaagcgcaagtattcgccattgtacccccagctattactgagcttggtaatgccagtggttttaatttaatgcttcaagatagtggcaaccttggacacgatgggttacttgaagcccgtaatatgctcttaggtatggcagcacagaatgaacaagttgctggtgtgcgtcctaacggtcaagaagattcgccacaacttaaaattgatatcaaccaagaacaagctgctgcttatggcttgtcgttaagtaatatcaacagcgtcatctcaacagcgtggggctcaagttacgttaatgacttcgtcgatcgtggtcgtattaaacgcgtctatgtacaaggtgaggcaagcagccgcaccaaccctgatgacattggtaaatggtatgtacgaaatgacatgaacgatatgatttcgttcgatgcattctctagcagtgagtggcagtcaggctcaccacgtctcactcgctacaacagcttaccgtcaatgaatatccaaggtagcgcagcaccgggtttaagtactggtgaggcaatgagttctatggaagccatgatagataagttacctgaaggcatcagttacgagtggacaggcatgtcattggaagagcaaaagtcaggtgcacaagcgcctatactttatgcgctgtcaatcctagtcgtgttcttgtgcttggcggctctatatgaaagctggtctatacccttctctgtcctattggtcattccacttggggtattgggtgccgtgatatttacttggctacgcggttttgccaatgatatttacttgcaagttggtctacttacggtcgttggtctatcggccaaaaatgccatcttgattattgagtttgccaaagagcgccaagaggcaggttatagtctcacagaggccgtcatgacagcagcgcgtcaacgcttacgtccaattattatgacctctcttgcctttggactaggtgttgtgccattattcttagcaaacggtccaggttcaggcagtcaaaatgctatcggtaccagtgttatcggtggtgttataactgccacactcttaggcatcttctttattccaatgttttacatctgggtacgtagtgcgttcccgcacaaatacgagaacaataagccaaatgataaagatgatagcaacggtacgcctgactcgcacaacccaatgccttctgataatgatcagcctgcaagccttggagacaatacataa

SEQ ID NO: 74517 - protein, 1075 aa, Psychrobacter sp. 273-4
MSRFFINRPIFAWVLAVLVMLIGVISVLNLPIEQYPRIAPPTISVSASYPGANAQTVENSVIQIIEQRMKGLDGLMYMSSSSSSNGSASVTLTFENGTDSDTAQVQVQNKLQAAMSSLPESVQRQGVNVNKSSSSFMMVQAFISEDGNMDRSDIGDYINSNVLDAISRVEGVGEVQVFGSTYAMRVWLDPSRLRSYNMVPSDVVNAIRAQNTQVSAGQLGQAPADTDQQVINATVTVQSYLQTPEEFQNILLKTDTAGAQVRLGDVADVEIGSENYSVVSLYNGQEAAGLGISLAAGANALETREAVGVRMAELEKNFPAGLTSVVPYDTTPFVRLSIEQVVMTLIEAIVLVFIVMFLFLQNWRATIIPTLAVPVVLLGTFGVLYIAGFSINVLTMFAMVLSIGLLVDDAIVVVENVERILEEDPHISIKDATVQSMGEISKIVIGIALILSAVFIPMAFFGGSTGVIYRQFSITLITSMVLSAMVALVFTPALCVTLLKRGKSHEKGNSENQKGFFGWFNRSFTKTSQSYEKFIGKSFRFKWLYLIVYAAIIGIMAVVFLRIPGSFLPEEDQGIMFTLVQLPAGSTLDETQDVLDKIRNYYDTQESDNIASVFTIAGFSFAGQGQNMGLAFVRLSDWEERSGDENTAQAVAGRAMGYFFTQLNEAQVFAIVPPAITELGNASGFNLMLQDSGNLGHDGLLEARNMLLGMAAQNEQVAGVRPNGQEDSPQLKIDINQEQAAAYGLSLSNINSVISTAWGSSYVNDFVDRGRIKRVYVQGEASSRTNPDDIGKWYVRNDMNDMISFDAFSSSEWQSGSPRLTRYNSLPSMNIQGSAAPGLSTGEAMSSMEAMIDKLPEGISYEWTGMSLEEQKSGAQAPILYALSILVVFLCLAALYESWSIPFSVLLVIPLGVLGAVIFTWLRGFANDIYLQVGLLTVVGLSAKNAILIIEFAKERQEAGYSLTEAVMTAARQRLRPIIMTSLAFGLGVVPLFLANGPGSGSQNAIGTSVIGGVITATLLGIFFIPMFYIWVRSAFPHKYENNKPNDKDDSNGTPDSHNPMPSDNDQPASLGDNT

SEQ ID NO: 74518 - DNA, 3054 bp, Dechloromonas aromatica RCB
  CDS (1)..(3054)
atgaccaccttgatgatggtcgccctgctgattttcggcgttatcggctatcgtgccctgccggtttcggaattaccggccgtcgacttcccgaccatttcagtcaccgccaacctgcccggtgcctcgccggaaaccatggcggcagccgtcgccacgccgctcgaaggtcaattctcgaccatcgcaggactggactcgatgacctcgaccagcgcccaaggctcggccaccatcacgctgcagttctcgctggaccgtaacatcgacgccgcagctcaggacgtccagtcggccatttcggcagccctgcgcaagctgccgccgaacatgccgacgccaccgtcgttccgcaaggtgaacccagccgattcgccgattttctacatcgcgatgtcgtcgccgacgctgcccttgtccctcgtccatgaatatgccgagacccagttggcccaacggctttcgaccgttcccggcgttgcccaggtgcagatttacggttcgcagaaatttgctgtccgcgtccaggccaacccggaccagatggcagcccgcggcatcggcatcgatgaactgcagcaggccatcgctcagggcaacgtcaaccagccggtcggccagctcgatggcagccgccagaccttcgcgctgaaagacaatggccagctcagcaacgccgccgcctaccggcccttgatcgtcacctggcgcaatggcgcaccgattcggctggaagacatcgcgacaccgatcgacagcgtcgagaacacccgcatcgccagctggaacgtcgacaagcgcgccatcgtgctcgccatccagcgccagcccggcgccaacaccatcgaaacggtggatgcgatcaaacgcatcctgccctcgttccaggccaaactgccagccgcggtgacgatgaaagtactgttcgaccgcagcaactcgatccgccacgccatcgatgatgtccagttcacgctgattctgtccggcttcctggtcatcatggtcatcctgctcttcctgcgcaatctgtcggcaacggtcattcccagcctggcactgcccatttcggtggtcggcaccttcgccatgatgtcggtgctcggctacagcctcgacaatctgtcgctgctcgccctgacgctgtcggtcggctttgtcgtggacgacgccattgtcatgctggagaacatcgtccgccacgttgaagccggcgagccgcccttccaggccgcaatcaagggagccaaggaaatcggcttcacgatcatctcgatgaccatctcgctgattgccgtgttcatcccggtgctgttcatgcagggtatcgtcggtcgcctgctgcatgaattcgcagtgaccatctgcgtcgccattctcgtttccggcttcgtctcgctgaccctgacgccgatgctgtgcagccgctacgtcaagcatgccgagccggactcacacggccgcgtcttccagatgttcgaaagcttcttcaacgcagtgctcgccgcctacgaaagaacgctcaaacaggccatggcgcatccgcgcaccatcctcgccagtttctttgtcaccttgctgatgaccggctatctgttcacgctggtgcccaaggacttcattcccagtggcgactccggccagatcatcgcctttaccgaaggcgcacaggatgcctccttcacctcaatggtcgcgcatcaacgcgccgtggctgaaatcgtcggacaggaaccggacatcgcttccttcatgtcgtcggtcggcgccggcggcatccggccaaccgccaacaccggcaccgttttcatgattctcaaaccactcgacgagcgcaaatcgacgccggatcagatcatccagcgcctgcgtccgaaactggcggcggtgcccggcatcaaggtgtacatgcaaaacccgccggtgatccggatcggtggccagcttactgccgcccagtaccaatacaccttgcaggacaccgatctcgatgagttgtaccaatggaccgcaacgctgacccagaagatccgccagttgcccggtttcgtcgacgttgccaataacctgaacaacctcagcccggtcgtcgggctggacatcgaccgtgacaagctatccacgctgggcctgaccttcggccaggtcgaagacgccctgcagagcgccttcagcgcccgccaggtatcgacgatctacggctcgacggcgcaataccaggtgatcctcgaagtttccccggaattccaggctgacccacaggccctgtcgcgcatctatgtgcgcggtaacggcaagctgatcccgctcgacaccgtggcacgcttcacgcgcaagacgcaggccttgaccgtgaaccaccagggccaactgccttcagtcaccatttccttcaacctgctacccggcgtttcactgggcgatgcggtggaccggatcaaggcactggaacaggaaatccgcgttcccgtctcgctgaccaccagcctgcaaggcacggcgcaagccttccagtcctcgctgcaaggccttggcgtcctgttgctggtcgccgtactggtcgtctatctggtactcggcgtgctctacgagagcttcatccacccgctgaccattctttccggcctgccttcggccggtctcggcgccctgatcaccctgctcatcttcaaggttgacctcagtctctacgccttcgttggcgtgatcatgctgatcggtatcgtcaagaaaaacgccatcatgatgatcgactttgccctcgagcggcagcgcaaggatggcatgccgcccggcgaagcgatcttccaggccagcctgatccgtttccggccgatcatgatgaccacaatggccgcgctggtcggcaccctgcccatcgccctgggcatcggcgccggtgccgaggtgcgccagccgctgggtctggccgtcgttggcggcctgatgctgtcacagttgcttaccttgtatctgacaccggtcatctacctctatctcgaccgctttaccgacaagaccgaagcaccgctcgaaacggcggcggcaagctga

SEQ ID NO: 74519 - protein, 1017 aa, Dechloromonas aromatica RCB
MTTLMMVALLIFGVIGYRALPVSELPAVDFPTISVTANLPGASPETMAAAVATPLEGQFSTIAGLDSMTSTSAQGSATITLQFSLDRNIDAAAQDVQSAISAALRKLPPNMPTPPSFRKVNPADSPIFYIAMSSPTLPLSLVHEYAETQLAQRLSTVPGVAQVQIYGSQKFAVRVQANPDQMAARGIGIDELQQAIAQGNVNQPVGQLDGSRQTFALKDNGQLSNAAAYRPLIVTWRNGAPIRLEDIATPIDSVENTRIASWNVDKRAIVLAIQRQPGANTIETVDAIKRILPSFQAKLPAAVTMKVLFDRSNSIRHAIDDVQFTLILSGFLVIMVILLFLRNLSATVIPSLALPISVVGTFAMMSVLGYSLDNLSLLALTLSVGFVVDDAIVMLENIVRHVEAGEPPFQAAIKGAKEIGFTIISMTISLIAVFIPVLFMQGIVGRLLHEFAVTICVAILVSGFVSLTLTPMLCSRYVKHAEPDSHGRVFQMFESFFNAVLAAYERTLKQAMAHPRTILASFFVTLLMTGYLFTLVPKDFIPSGDSGQIIAFTEGAQDASFTSMVAHQRAVAEIVGQEPDIASFMSSVGAGGIRPTANTGTVFMILKPLDERKSTPDQIIQRLRPKLAAVPGIKVYMQNPPVIRIGGQLTAAQYQYTLQDTDLDELYQWTATLTQKIRQLPGFVDVANNLNNLSPVVGLDIDRDKLSTLGLTFGQVEDALQSAFSARQVSTIYGSTAQYQVILEVSPEFQADPQALSRIYVRGNGKLIPLDTVARFTRKTQALTVNHQGQLPSVTISFNLLPGVSLGDAVDRIKALEQEIRVPVSLTTSLQGTAQAFQSSLQGLGVLLLVAVLVVYLVLGVLYESFIHPLTILSGLPSAGLGALITLLIFKVDLSLYAFVGVIMLIGIVKKNAIMMIDFALERQRKDGMPPGEAIFQASLIRFRPIMMTTMAALVGTLPIALGIGAGAEVRQPLGLAVVGGLMLSQLLTLYLTPVIYLYLDRFTDKTEAPLETAAAS

SEQ ID NO: 74520 - DNA, 3123 bp, Dechloromonas aromatica RCB
  CDS (1)..(3123)
atggcaaagttttttatcaaccggccgattttcgcgtcggtcatctcgatcatcatcgtcattgccgggctggttgcctcgcaggtattgcccatcgcgcaatacccgcagattgccccgccgacggtgctgatcaccgccacctacccgggtgcttcggctgaaacgctggccaagacggtggctgcgccgatcgaggagcagctgaacggcgtcgagaacatgctctacttcacgtcatcggccagtgccaatggcgcggtgaccatcacggcgacctttgaagtcggcaccaatgtcgacatggcttcggtcaacgtcaacaaccgggtcaaggcggccgaaccgcgcctgccggaagcggttcgacgcaatggcgttattgtccagaagcgttccaacgacattcttcaggtcgtcgccctgaagtcggaaggcggcaagtacaacacgctcttcctgtccaactacgccagtctgaacatcgtcgatgaactgaagcgagtcaagggcgtcggcgacgttaccatttttggtgcgcaggattactcgatgcgcgtctggctgaagccggaccgcatggcccagcttggcctgacgacgactgaagtatcgaacgcgatcagcgcgcaaaatgcccagaacgccgccggcaagatcggccaggaacccgctccgaatgaccagcaactggtttatacggtaaccgctaaaggtcgcctgctgagtgaagaggaattcggcaacatcgtcatccgcgccagcggccctggcggcgtgctgcgcctgaaggacatcgcgcgcattgaactgggtgcctacagttacgaccagcgcgtgacgctggacggccagccaaccatcgccatgggcgttttcctgcagaccggcgccaatgcactggaggttgccgacctggtcaaggccaagatggttgaattgaagaccaagttccccgaagcgatggattacgtcattcctttcgacaccacgcgctttgtctcggcctcgattcacgaggttgtgcatacgctcgtcgaagcgatgatcctggtcttggcagtggtcttcctgttcctgcagagctggcgcgccacgctgattccgatggtcgccgtgccgatctcgctgatcggcacctttgccggcctgtggctgttcgggttctcgatcaataccctgaccctgttcgccatggtgttggccatcggtatcgtcgttgatgacgcgatcgtcgtgctcgaaaacgtcgaacgtttgatggccgaagagaagctgccgcccaagcaggccgccatcaaggccatgcatcaagtcaccggggcactgattgccatcgtgctggtgctgtgtgccgtgttcatcccggtcgccttcctcggtggcattgccggccagctctacaaacagtttgcggtgaccgtcgcggtggccgttgtgctctccggcgtggtcgcgctgaccttgacgccagcgctctgcgccctgctcctcaaggcccagcacaccgagaacaagctgttcgctccgttcaacaggatgttcgaacgtctgaccggcaactacacccgcgccgtcggcttcacgctcaagcacggtatcgttggctctctggtgttcctggctgtgattggtgccaccctggccttcttccgcatcatcccgggcagtttcgtgccggccgaagaccagggttacctgatctcggcgctgatgctgccggatggtgcgacgctgaaacgcacggaaaagaccggcgaaggcatgcgccagatgatcgccaaggacgaggccgtcaagcacaccttcatcgtctccggtttcgacctgatcggcggcggcaacaagcccaacgccggcaccatgttcattccgctcaaggactggtccgaacggcaaggcaaggcacaggatctggctggcaagttcatgggcattggcatgatgcagtcggacggcatgggtctggtgttcaaccccccgccgatcatgggtttgggctcggccggcggttttgaggtctacgtgcagaaccgtgtcgatggcgatgcccgcaagctcaacgacatcatccagacgttcatggaagcgctgaagacgcatccggaattcacccgaatttccaccttcttccgcccaaccgtgccgcagttgttcgtcgaagttgatgaacagaaagcgctggcgctgggcattcccattggcgacatctactcgacgctgcaaagcacgatgggtgcgctctacgtcaatgacttcaacaaggccggccgcgtctatcgcgtgcagttgcaggccgaagccaattaccgcatgaaggcggacgatatcggcaaggtctacgtacgcagcgcaacgaccaacgcgatgattccgctgtcggcagtcagcaaggtgaagaacgtcgtcggccctgaacaggtcgagcgcttcaacggcttcatcgccgccaaggtgatgggtgacagcaaaccgggcatcagctccggtgacgcaatcaagatcgttgaacaagtggccgaagaaaccctgcccagcggctatggcattgcctggaccggccaggctttccaggagaaacgcagttcaggttcctcgctgcaagccttcggcttcgccatcatcatggtcttcttgatcctcgccgcccaatatgaaaagtggtcgctgcccgtcgctgtcgtgatggctgtgcccttcgctctgatgggcgcactgactgcaatctggctgcggggtatgccgaatgacatctacttccagatcggcctcgtcgtgctgatcggattggcatcgaaaaacgccatcctgattgtcgagttcgccgcccagaagtacgccgaaggcatgagcgcggccgaagccgcggtcgaagcggctcgtctgcgcctgcgcccaatcatcatgacctcactcgccttcgtgctcggcgtcttcccgctggtcaaggccactggtgccggcgcgtcggcccgccagtcaatgggtaccggcgtcttcggcggcatgctggctgccaccttcatcgccacgctgttcatcccgctattcttcaagtggctggaacgcggcaagcagatcgacccctcgcacctcgataacaacgaggaggaacaagcatga

SEQ ID NO: 74521 - protein, 1040 aa, Dechloromonas aromatica RCB
MAKFFINRPIFASVISIIIVIAGLVASQVLPIAQYPQIAPPTVLITATYPGASAETLAKTVAAPIEEQLNGVENMLYFTSSASANGAVTITATFEVGTNVDMASVNVNNRVKAAEPRLPEAVRRNGVIVQKRSNDILQVVALKSEGGKYNTLFLSNYASLNIVDELKRVKGVGDVTIFGAQDYSMRVWLKPDRMAQLGLTTTEVSNAISAQNAQNAAGKIGQEPAPNDQQLVYTVTAKGRLLSEEEFGNIVIRASGPGGVLRLKDIARIELGAYSYDQRVTLDGQPTIAMGVFLQTGANALEVADLVKAKMVELKTKFPEAMDYVIPFDTTRFVSASIHEVVHTLVEAMILVLAVVFLFLQSWRATLIPMVAVPISLIGTFAGLWLFGFSINTLTLFAMVLAIGIVVDDAIVVLENVERLMAEEKLPPKQAAIKAMHQVTGALIAIVLVLCAVFIPVAFLGGIAGQLYKQFAVTVAVAVVLSGVVALTLTPALCALLLKAQHTENKLFAPFNRMFERLTGNYTRAVGFTLKHGIVGSLVFLAVIGATLAFFRIIPGSFVPAEDQGYLISALMLPDGATLKRTEKTGEGMRQMIAKDEAVKHTFIVSGFDLIGGGNKPNAGTMFIPLKDWSERQGKAQDLAGKFMGIGMMQSDGMGLVFNPPPIMGLGSAGGFEVYVQNRVDGDARKLNDIIQTFMEALKTHPEFTRISTFFRPTVPQLFVEVDEQKALALGIPIGDIYSTLQSTMGALYVNDFNKAGRVYRVQLQAEANYRMKADDIGKVYVRSATTNAMIPLSAVSKVKNVVGPEQVERFNGFIAAKVMGDSKPGISSGDAIKIVEQVAEETLPSGYGIAWTGQAFQEKRSSGSSLQAFGFAIIMVFLILAAQYEKWSLPVAVVMAVPFALMGALTAIWLRGMPNDIYFQIGLVVLIGLASKNAILIVEFAAQKYAEGMSAAEAAVEAARLRLRPIIMTSLAFVLGVFPLVKATGAGASARQSMGTGVFGGMLAATFIATLFIPLFFKWLERGKQIDPSHLDNNEEEQA

SEQ ID NO: 74522 - DNA, 3189 bp, Dechloromonas aromatica RCB
  CDS (1)..(3189)
atgaacatttcaaaattcttcatcgaccggccaatcttcgccggcgtgctgtccatcctgctgctgctggccggcgtgctggcgctgttccagctgccgatctcggagtatccggaggtcgtgccgccctcggtggtggtgcgtgcccagtaccccggcgccaaccccaaggtgatcgccgaaacggtggcctcgccactcgaggagtcgatcaacggcgtcgagaacatgctctacatgcagtcgcaggccaacagcgacggcaacctgacggtgacggtcaatttcaagctcggcgtcgatcccgacaaggcgcagcaactggtccagaaccgcgtctcgcaggccctgccgcgcctgcccgaggacgtccagcgcctcggcgtgacgacgatcaagagctcgccgacgctgaccatggtggtgcacctgatctcgcccgacgaccgctacgacatgacctacctgcgcaactacgcggtgctcaacgtcaaggatcggctggcccgcatccagggcgtcggcgaagtcggcctgttcggttccggcaactacgccatgcgcgtctggctcgacccgcagaaagtggcccagcgcggcctgaccgccagtgaagtggtgcgcgccatccgtgagcagaacgtgcaggtcgcggccggcgtcattggcgcctcgccgagcgccgccgacgtgccgctgcagctcaacgtcaatgcccagggccgcctgcaaagcgaaggggaattcggcgaaatcgtgctcaagacctcaccggacggtgccgtcacgcgcctggccgacgtcgcccgcatcgaactggcggcatccgaatacggcctccgttccctgctcgacaacaagccggcagtggccattcccattttccaggcgccaggcgccaacgcgctcgatgtctcggccaaggtgcgcgaagcgatggccgagctgtccaaggacttcccggcttcggtcgagtaccgcatcgtctatgacccgacgcagttcgtgcgggccagcatcaaggccgtcgtccataccctgctcgaagccatcgccctggtcgtgctggtcgtcatcgtcttcctgcagacctggcgcgcctcgatcatcccgctgctcgccgtgccggtttccatcgtcggtaccttctcgttgctgctcggcttcggctattcgatcaacgccctgtcgctgttcggcatggtgctggccatcggcatcgtggtcgatgacgccatcgtcgtcgtcgaaaacgtcgagcgcaacatcgaggccgggctgacgccgcgcgaagccacctaccgggcgatgcgcgaagtcagcgggccgatcatcgccatcgccctgacgctggtcgccgtcttcgtgccgctcgccttcatgaccggcctgaccggccagttctacaagcagttcgcgatgaccatcgccatctcgacggtgatctcggccttcaattcgctaaccctgtcgccggcgctggccgccatgctgctcaagggccacggcgaagcgccggactggctgacccggcagatgaaccgctacttcggccgtttcttcgccgccttcaaccgcttcttcggccgcgcttcagaaaactacggccgcggcgtcaccggcgtgatcggccgcaaggcttcggcgatgggcgtctatgccgtgctgctcgggctgaccgtcggcatttcctacctggtgcccggcggcttcgtgccggcccaggacaagcaatacctgatcggcttcacgcagctgccgaacggcgcctcgctcgaccgcaccgaggcggtgatccgcaagatgggcgaaatcgccctggcccagcccggcgtcgaaagcgccgtcgccttccccggcctgtcgatcaacggcttcaccaacagctcgagcgccggcatcgtcttcgcgacgctcaagcccttcgacgaacggcgcagcccggaactctcggccggcgccatcgccggcgcgctgaaccagaaatacgcggccatccaggaagccttcatcgccgtcttcccgccgccgccggtgatgggtctgggcaccgtgggcggtttcaagatgcagatcgaggatagaggcgcggtcggctatgccgagctcaacgccgcggcccaggccttcatggccgctgccgccaagaccccggagctggggccgatgttttccagctatcagatcaatgtgccccagctcgacgttgatctcgaccgcgtcaaggctaagcagcagggggtttcggtgaccgacgtcttcgacaccatgcagatctacctcggctcgctctacgtgaacgacttcaaccgcttcggccgtacctaccaggtccgtgcccaggccgatgcgccgttccgtgcccacccggaagacatcctgcaactgaagacccgcaacagccagggcgagatggtgccgctttcctcgctggtcaaggtgcgctccaccttcgggccggaaatggttgtccgctacaacggctacaccgcggccgacatcaacggcggtccggcccccggctactcctcggcgcaggccgaggccgcggccgaacgcatcgcggcggaaaccctgccgcgcggcgtgcgcttcgaatggaccgacctgacctaccagaagattctggctggcaacgccggcatctgggtcttcccgatcagcctgctgctcgtcttcctggtgctggccgcgcagtacgaaagcctgaccctgccgctggccgtgatcatgatcgtgccgatgagcatcctggcggcgctgaccggcgtctggctgaccggtggcgacaacaacatcttcacccagatcgggctgatggtgctggtcgggctggcctgcaagaacgctatcctgatcgtcgagttcgcccgcgaactggaactgcagggcgcgacgccgctgcaggccgccatcgacgccagccggctgcggctgcgcccgatcctgatgacctcgatcgccttcatcatgggcgtcatcccgctcgtcacctcgaccggcgccggttccgaaatgcgccacgccatgggcatcgccgtcttcttcggcatgctcggcgtgaccactttcggtctgttcctgaccccggttttctacgtgctgctacggacgctggacaagggccacaagttgcacaccgccgccccgcacgaggcgccgattgccccagcccatagcgcggcctga

SEQ ID NO: 74523 - protein, 1062 aa, Dechloromonas aromatica RCB
MNISKFFIDRPIFAGVLSILLLLAGVLALFQLPISEYPEVVPPSVVVRAQYPGANPKVIAETVASPLEESINGVENMLYMQSQANSDGNLTVTVNFKLGVDPDKAQQLVQNRVSQALPRLPEDVQRLGVTTIKSSPTLTMVVHLISPDDRYDMTYLRNYAVLNVKDRLARIQGVGEVGLFGSGNYAMRVWLDPQKVAQRGLTASEVVRAIREQNVQVAAGVIGASPSAADVPLQLNVNAQGRLQSEGEFGEIVLKTSPDGAVTRLADVARIELAASEYGLRSLLDNKPAVAIPIFQAPGANALDVSAKVREAMAELSKDFPASVEYRIVYDPTQFVRASIKAVVHTLLEAIALVVLVVIVFLQTWRASIIPLLAVPVSIVGTFSLLLGFGYSINALSLFGMVLAIGIVVDDAIVVVENVERNIEAGLTPREATYRAMREVSGPIIAIALTLVAVFVPLAFMTGLTGQFYKQFAMTIAISTVISAFNSLTLSPALAAMLLKGHGEAPDWLTRQMNRYFGRFFAAFNRFFGRASENYGRGVTGVIGRKASAMGVYAVLLGLTVGISYLVPGGFVPAQDKQYLIGFTQLPNGASLDRTEAVIRKMGEIALAQPGVESAVAFPGLSINGFTNSSSAGIVFATLKPFDERRSPELSAGAIAGALNQKYAAIQEAFIAVFPPPPVMGLGTVGGFKMQIEDRGAVGYAELNAAAQAFMAAAAKTPELGPMFSSYQINVPQLDVDLDRVKAKQQGVSVTDVFDTMQIYLGSLYVNDFNRFGRTYQVRAQADAPFRAHPEDILQLKTRNSQGEMVPLSSLVKVRSTFGPEMVVRYNGYTAADINGGPAPGYSSAQAEAAAERIAAETLPRGVRFEWTDLTYQKILAGNAGIWVFPISLLLVFLVLAAQYESLTLPLAVIMIVPMSILAALTGVWLTGGDNNIFTQIGLMVLVGLACKNAILIVEFARELELQGATPLQAAIDASRLRLRPILMTSIAFIMGVIPLVTSTGAGSEMRHAMGIAVFFGMLGVTTFGLFLTPVFYVLLRTLDKGHKLHTAAPHEAPIAPAHSAA

SEQ ID NO: 74524 - DNA, 3174 bp, Anabaena variabilis ATCC 29413
  CDS (1)..(3174)
atgtttgttgacttctttatcaggcgacctgtatttacaagtgtctgcgccattatcattttgctggtaggcgcaatcagtatacccaccctacctactgatcgctatccagaaattagccctacacaaattgttgttaatgctaactacactggggctagcgcggaagtcgtggaaaatacggtgacaagtatcttggagcgccaaatcaacggcgttcaaggtatgaagtacatgacatctagcagtagtaacgatggtactagcaccattaccgtcacctttgacccatcacgggacaaagatattgccgccgttgatgtccaaaaccgcgtatctattgcccagccccagttaccagaggctgtacaacgtactggagtcacagtcagcaaacagtctaacaatatcctgttagcgatggggctgtatagcgaacaacaggaatatgacaccgtatttttaagtaactacgccgaccaatatatagtagatgccctgaaaaggcttgatggtgtgggcgaggcgcggatttttggtgaacggcgctatgctatgcgattgtggcttgacccgaatcgtctaaccagtcgcaagctgactgctcaagatgtaattgatgccatcaacgaacaaaacatacaggtaggggtggggcaaattggtcagcagccgtccctgccagaccagatgtatcaaatagacttacaggctcgcggcagactttccgaagcaacggaatttgccgacatggtaattaagactggaaccgatggcacacttatcaagctcaaagatgtgggtcgggcagaattaggggcagaaaattatagttcgtttctgcgattccgaggtaatgagggtgtgggtatagggatatttcctacccctggtagtaatgctttggaagtatccaaggcagtaaaagccgaaatggctcggttagcacaaagctttcccccagggttgaaatatcaagtggcgtttgatacgaccctgtttgtggaagaatccctcgcggaagtggtcaagacactgatagaagccctgattctggttgtcttggtgatttttctcttcttgcaagactggcgtacaaccctgattccggtaattaccattcccttaactttaattgggacttttgcctttatcaaagtctttggattttccattaacaccttaactttgtttggtttgacattagctacggggttagtggtagacgatgcgattatcgtggtggaaaacatctcccggttaattgaggaagagggaatgtcgccccgtcaggctgcatccgagtccatgcgggaactgtttggggctgtaattgccacttccttagtgttgatggcggtatttgttcctgttgcctttttcccaggtactacaggacagatttataaacagtttgccctgaccatcgccttttcgatggctatttccacctttttggctctgacactcacaccctccctttcagccttattattacgtcggggacagcgcccccgtggttggttaggcaaaatttttcaccagattaataggtttttggattggatgcgccggggatatgagcgatcgctcaatattcttgtgaaggttagggcgatcgttgtcttattattcctagcttccatcgccttgacaggctgggtttatctcagcgtacccacagcatttatccctgacgaagatcaaggctatttcatcaccatcatccaagggccagaaggagtttccctcaactacaccagcaatgtcatggctcaggtggaaaaagaaatcctcaaattaccggaagttacaggaacctttgccattggtggctttagttttagtggtaacagtgccaacagtggggtaatttttactaccctccagccttgggatgagcgccaacaaccaggacaatcagcaccagaaattattggcaagttggcaggagtcttcgccaacatcaccgaagccagaattttccccgttagtcctccaccaatcaatggtttaggcaacttcggcggttttcaatttgaactgcaagatagagcaggtaacagtggcttagataatctgctgcaagtcatgggtcagatcatgatgaaggggaatcagactcctggtttgcaaggtgtatttagtacttttagtgctaacacaccccagatgttaatagacatcgaccgcaacaaagtcaaagccttacaagttaatgtagatgacgtgttcaacaccctgcaatcttacttgggttccaggtacgtcaacgattttaatttccaacaaagaacttaccgggtttacgtgcaagcagatgcgccatttcgctctaaccctgaggatatcggtaagttatatgtccgctctgccaacgatcaaatgatttccctgagtaacctagtgaaaattactccggcgactggagcgcaaacaatcaaccactacaacctattccgctcaattaccatcaacggtgcggctgcgcctggttatagttctggtcaagcaactacagcgatggagaaattagcaaaagaagttttacccgccagtatgggttacgaatggtcggggataactgcggaagaacaagaatcaggaggtcaagcacctgtaatttttggattagggttagtctttgtttttctcgtgttggcagctcaatatgagaactacgttgacccattaattattatgctgtcagttcccctagctattttaggagccttatcagctcagtggctgcggggtctgagtaatgatgtcttttgccaagtaggtttagtcatgttgattggcttggctagtaaaaacgccattttgattgtggaatttgccaatcaattgcgcgaacggggcttgcccattatcaaagccacagtgcaagcatcacaagaaaggttgcgacctattctcatgacttccctatcttttattcttggtgtctggccattgattaatcctataggagcaggtgcagcgagtagaaaatctctcggtacagccgtggcagggggaatgattgtctcaactgtgttgagtctatttgttgtccccattctctacatcgtaattagtaaaatccgcgatcgctttagaccaaaacccccacacataccactagattctacccgtgatgacaaaattccctcgactagtcatagatga

SEQ ID NO: 74525 - protein, 1057 aa, Anabaena variabilis ATCC 29413
MFVDFFIRRPVFTSVCAIIILLVGAISIPTLPTDRYPEISPTQIVVNANYTGASAEVVENTVTSILERQINGVQGMKYMTSSSSNDGTSTITVTFDPSRDKDIAAVDVQNRVSIAQPQLPEAVQRTGVTVSKQSNNILLAMGLYSEQQEYDTVFLSNYADQYIVDALKRLDGVGEARIFGERRYAMRLWLDPNRLTSRKLTAQDVIDAINEQNIQVGVGQIGQQPSLPDQMYQIDLQARGRLSEATEFADMVIKTGTDGTLIKLKDVGRAELGAENYSSFLRFRGNEGVGIGIFPTPGSNALEVSKAVKAEMARLAQSFPPGLKYQVAFDTTLFVEESLAEVVKTLIEALILVVLVIFLFLQDWRTTLIPVITIPLTLIGTFAFIKVFGFSINTLTLFGLTLATGLVVDDAIIVVENISRLIEEEGMSPRQAASESMRELFGAVIATSLVLMAVFVPVAFFPGTTGQIYKQFALTIAFSMAISTFLALTLTPSLSALLLRRGQRPRGWLGKIFHQINRFLDWMRRGYERSLNILVKVRAIVVLLFLASIALTGWVYLSVPTAFIPDEDQGYFITIIQGPEGVSLNYTSNVMAQVEKEILKLPEVTGTFAIGGFSFSGNSANSGVIFTTLQPWDERQQPGQSAPEIIGKLAGVFANITEARIFPVSPPPINGLGNFGGFQFELQDRAGNSGLDNLLQVMGQIMMKGNQTPGLQGVFSTFSANTPQMLIDIDRNKVKALQVNVDDVFNTLQSYLGSRYVNDFNFQQRTYRVYVQADAPFRSNPEDIGKLYVRSANDQMISLSNLVKITPATGAQTINHYNLFRSITINGAAAPGYSSGQATTAMEKLAKEVLPASMGYEWSGITAEEQESGGQAPVIFGLGLVFVFLVLAAQYENYVDPLIIMLSVPLAILGALSAQWLRGLSNDVFCQVGLVMLIGLASKNAILIVEFANQLRERGLPIIKATVQASQERLRPILMTSLSFILGVWPLINPIGAGAASRKSLGTAVAGGMIVSTVLSLFVVPILYIVISKIRDRFRPKPPHIPLDSTRDDKIPSTSHR

SEQ ID NO: 74526 - DNA, 3141 bp, Ralstonia eutropha JMP134
  CDS (1)..(3141)
atgaacccgtcacgcctcttcatcgagcgcccggtagccacggcgctgctgatgctggccatcctgctctcggggctggtggcctaccggctgctgccgctgtccgcgctgcccgaggtggactaccccaccatccaggtcaccacgctctatccgggcgcgagccccgacgtgatgacctcgtcgatcaccgcgccgctggagcggcagttcgggcagatgccggggctcaagcagatgtcgtcgtcctcgtcgggcggcgcgtcggtgatcacgctgcagttcgaactgacgctgccgctggacgtggccgagcaggaggtgcaggcggccatcaatgccggcagcaacctgctgccgtcggacctgccgatgccgccggtctacagcaaggtcaatccggccgacgcgccgatcatgaccattgcgatgacgtccgacacgctgccgctacccaagctgcaggacatggtggacacccgcgtagcggccaagatttcgcagatccagggcgtgggtctggtcacgatcagcggcgggcagcgccccgccgtgcgcatccaggcgaaccccaccgcgctcgcgtcgctgggcatgtcgatcgatgacctgcgcacagccatcggcgcggccaacgtgaacggcgccaagggcagcttcgacggcccggcgcgcgcttccaccatcgacgccaacgaccagctgcgttcggccgacgagtataagcagatcatcatcgcgtaccagaacggcgcgccgatccgcatcaccgacgtcgccgagatcgtcgacggtcccgaaaacaaccggctggccgcctgggccaacggcaacccttcgatcatcctcaatatccagcgccagccgggcgccaacgtgatcgaggtggtggaccgtatcaagacgctgctgccgcagctgcagaccgcgctgccggcttcggtccacgcgcagctcatgaccgatcgcacgacgacaattcgcgcgtcggtgcatgacgtggaattcgagctgttcctggccatcgcactcgtggtgatggtcatcttcgtgtttctgcgcaacgtctccgccaccatcatccccggtgtggcggtgccgctgtcgctcgtcggcacgttcggcgtgatgtacatggccggcttctcgatcaacaacctgacgctgatggcgctgaccatcgccacgggcttcgtcgttgacgacgccatcgtcatgatcgagaacatcatgcgctacatcgaggaaggcgattccccgatggaagccgcgctcaagggctcgaagcagatcggcttcaccatcatctcgctgacgttttcgctggtggctgtgctgatcccgctgctgttcatgggcgatgtggtcggccgcctgtttcgcgagttcgcgatcacgctggcggtgtcgatcctgatctcggccgtggtgtcgctgacgctcacgccgatgatgtgcgcgcggctgctgcgccatgtgccggaagaccagcagtcgcgcttccacaaggcgaccgggcgtttcttcgacaacgtgatccaccgctacggcgtggcgctcgaatgggtgctggatcggcagaaggcaacgctggtggtcgctgtcgccacgctggtgctgaccgtgctgctgtacatgctcgtgcccaaaggcttcttcccggtgcaggacaccggcctgattcagggcatcaccgaagccacgcagaccacctcgttccaggccatgggcatcaagcagcaggccgcggcgaaggtggtcgcggaagaccctgctgtggcgagcgtatcgtcgttcatcggcgtggacggctccaacaccacgctcaacgccgggcgcatgctgatcaacctcaagcccaagggcgagcgcgattcgatcgacgtggtctcgcagcgcctgcagcacgcggtggaaaagctcggcggcatctcgctgtacacgcaaccggtgcaagacctgacgatcgaagaccgcgtcgcgcgcacgcagtaccagttcacggtggaagaccccgatccgcagaacctggcgacgtgggtgccgcgcctggtcgagcgcctgcgccaggagcccgaactgcgcgatgtcgccagcgatcagcagaacaacggcctgcgcgcctacgtagacatcgatcgcgacgccgccgcgcgtttcggcatcacgactgccgtgatcgacagcgcgctgtacagcgcattcggccagcggctggtatcgaccatcttcacgcagtcgagccaataccgcgtggtgctggaaaccatgcccgagttccgcaaggacccgcagtcgctcgccgaactgcgcctgccctcctcgtccggcggacaagtgccgctgggcgcgttcgcgcgcatcagtgaacggacgggtccgctcgtgatcaaccaccagggccagttcccggccgcgaccatctcgttcaacctggcgccgggcgaatcgctgggcgccgcggtcgacaagatcaccaaggtggaaaacgagctgggcctgccgatctcgatgcaaaccgagttccagggcgccgcgctggcgttccgcgcgtcgttgtccaacacgctgtggctgatcctggccgccgtggtgacgatgtatatcgtgctgggcgtgctgtatgaaagcacgatccatccggtgaccatcctgtccacgctgccgtcggccggcgtgggcgcgctgctggcgctgctgctcgcggggcaggacctcggcatcatcgcgatcattggcatcatcctgctgatcggtatcgtcaagaagaacgcgatcatgatgatcgacttcgcgctcgaagccgagcgcgaaggcggcatggccccgcgcgaggcgatcttccaggcctgcctgctgcgtttccgcccgatcctgatgaccaccatggccgcactgctcgcggcactgcccatgatgctcggcaccggcatcggctcggaactgcgccgcccgctcggtgtgaccatggtcggcggcctgctcgtgagccaggtgctgacgctgttcaccacgccggtgatctacctggccttcgaccgcgtggctttccgcctcaaggactggcgcaagcgccgcttcggtgatccggaagaaggcggcaccgatgaaggcgatccgtcgtcagcggggccgcgatga

SEQ ID NO: 74527 - protein, 1046 aa, Ralstonia eutropha JMP134
MNPSRLFIERPVATALLMLAILLSGLVAYRLLPLSALPEVDYPTIQVTTLYPGASPDVMTSSITAPLERQFGQMPGLKQMSSSSSGGASVITLQFELTLPLDVAEQEVQAAINAGSNLLPSDLPMPPVYSKVNPADAPIMTIAMTSDTLPLPKLQDMVDTRVAAKISQIQGVGLVTISGGQRPAVRIQANPTALASLGMSIDDLRTAIGAANVNGAKGSFDGPARASTIDANDQLRSADEYKQIIIAYQNGAPIRITDVAEIVDGPENNRLAAWANGNPSIILNIQRQPGANVIEVVDRIKTLLPQLQTALPASVHAQLMTDRTTTIRASVHDVEFELFLAIALVVMVIFVFLRNVSATIIPGVAVPLSLVGTFGVMYMAGFSINNLTLMALTIATGFVVDDAIVMIENIMRYIEEGDSPMEAALKGSKQIGFTIISLTFSLVAVLIPLLFMGDVVGRLFREFAITLAVSILISAVVSLTLTPMMCARLLRHVPEDQQSRFHKATGRFFDNVIHRYGVALEWVLDRQKATLVVAVATLVLTVLLYMLVPKGFFPVQDTGLIQGITEATQTTSFQAMGIKQQAAAKVVAEDPAVASVSSFIGVDGSNTTLNAGRMLINLKPKGERDSIDVVSQRLQHAVEKLGGISLYTQPVQDLTIEDRVARTQYQFTVEDPDPQNLATWVPRLVERLRQEPELRDVASDQQNNGLRAYVDIDRDAAARFGITTAVIDSALYSAFGQRLVSTIFTQSSQYRVVLETMPEFRKDPQSLAELRLPSSSGGQVPLGAFARISERTGPLVINHQGQFPAATISFNLAPGESLGAAVDKITKVENELGLPISMQTEFQGAALAFRASLSNTLWLILAAVVTMYIVLGVLYESTIHPVTILSTLPSAGVGALLALLLAGQDLGIIAIIGIILLIGIVKKNAIMMIDFALEAEREGGMAPREAIFQACLLRFRPILMTTMAALLAALPMMLGTGIGSELRRPLGVTMVGGLLVSQVLTLFTTPVIYLAFDRVAFRLKDWRKRRFGDPEEGGTDEGDPSSAGPR

SEQ ID NO: 74528 - DNA, 3156 bp, Ralstonia eutropha JMP134
  CDS (1)..(3156)
atggccaagtttttcatcgaccggccggtgttcgcgtgggtgctcgcgctgatcatcgtgctgggcgggttgctgtcgatcgtgcagttgccgatcgcgcagtacccgaacatcgccccgccgacgatctcggtcaccgcgacctatccgggcgcctccgccaggacgctcgaggattcggtcacctcggtgatcgagcaggagctcaacggcgcgcccaacctgctgtactaccagtcgaccagcgaatcgtcggggctggcgtcgatcaccatcgcgtttgcgccgggatcgaacgtcgacctgaactcggtcgaagtgcagaaccgcctcaagcgcgtcgaggcgcgcctgccggcggaagtgcgccagcagggtgtgcgcgtcgacaaggcgggcaacaactacatgatgttcctgacggtgtcgtcgaagtccggcgaggccgacgccatccagctgggcaactacgtgtcgtcgcaggtgatcgactcgatccgccgcgtgccgggcgtgggccaggccgacctgttcggcacggaatacgccatgcgtgtgtggctggacccggcgaagctcaccggcttcaacctgacgccgcttgacgtcaccgccgcggtgcaggagcagaacatccaggtcgccgtgggcgaactgggcggcacgccgtcgcccaagggcacggagctgaacgccaccgtcaccaccgaaagccgcctgaccacgccggagcagttcggcaacatcctgctgcgcacgaacccggatggttcgtcggtgcgcatcaaggacgtgggccgcgtggaactcggcggcgccgattactcgacgctcgcgcgcaccaacggcaagccgtcggcggccatcgccatcaagctggccccgaccggcaacgcgctggccacggccaccgccgtgcgcgccaagatggaagagctgtccaagtacttcccggcggactaccagtacagcgtgccttacgacacgtcggccttcgtcaagatctcgatcgaggaagtgatcaagaccctgctcgaagccgtggtgctggtgttcctggtgatgtacctgttcctgcagaacttccgcgcgacgctgatccccacgctggtggtgccgatcgcactgctcggtacgttcggcgcgctgctcgcgttcggtttctctatcaacgtgctgacgatgttcggcatggtgctggcgatcggtatcctcgtggatgatgcgatcgtcgtggtggaaaacgtcgagcggatcatgagcgaggaagggctctcgccacgccaggctacgcgcaaggcgatgggccagatcacgggcgccatcgtgggcattacgctggtgctgacggccgtgttcatcccgatggcgttcttctcgggctcggtcggcaatatttaccgccagttctcgctgtcgctgatcgcgtcaatggcgttctcggcactgcttgcgctgacgctgacgccggcactgtgcgcgacgctgctcaagccggtcgaggcgggtcatcatcacgagaagacgggcttcttcggctggttcaaccgtacgttcgcgcgtgcatccacgagctaccagggggtggtgggccgcatcctcgcgcgcagcgggcgctacctgatcatctacgcggtcatcatcgtcggcgtggtggtgctgttcaagcgcctgccgtcgtcgttcctgcctgacgaagaccagggctacatgatcaccgtggtgcagttgcccaacggcgcgacgcaggaccgtaccatcggcgtgctcaagcagatcgaggattactacctgcagaaggaaagcaaggtggtggaccagatgatcacggtggcgggcttctcgttctttggccgcggccagaacggcggtatcgcgttcgtgcgcctgaaggactggaaggaacgtaccggtgccaacgaaaccgcgcaggcgctggtgggccgtgcattcggcgcgctgtcgttcatcaaggacgccatcatcttcccgctgaacccgccggcgatttcggaactcggcaactcgtcgggcttcgacttccgcctgcaggaccgctcgggccagggccacgccaagctgatggaagcgcgcaacatgatgctcggcatggcggccaagaacccggtgctcgtgggcgtgcgccctgaaggccaggaagatgctgcgcagctgcagatcgacatcgaccgcgagaaggccaaggcgctgggcgtgacggtggcaaccatcaactcgacgctgtcgattgcgttcggctccaactacgtcaacgacttcatctatgaaggccgcgtgcgcaaggtgatcgtgcaggcagaaggcgccgaccgccggctgccggacgacctgaccaagctgcgcgtgcgcaacagcaacggcgacatggtggcgtttgccgcgttcgcgacctcgaagtgggtcatgggctcgccgcgcctggagcgctacaacggcatgccggcagtgaagatcgcgggccaggccgcaccgggccacagcacgggtgaagccatgcgcgtgatggaagagaacttcgccaagctgccgccgggctttgggttcgagtggtcgggccagtcgtacgaagagcgcctggccggttcgcaagagccgatgctctacacgctgtcgctgatcatcgtgttcctgtgcctggccgcgttgtacgaaagctggtccatcccgttctcggtgctgctggtggtgccgctcggcgtgctgggcgcactgctcggcgtgacgctgcgcggcatgcctaacgacgtgtacttcaaggtgggcctgatcgcgacgatcggcttgtcagcgaagaacgccatcctgatcgtggaattcgccaaggacctgcaggcgcagggcaaggggctgatcgaagcgacgctcgaagcggtgcacctgcgcttccgcccgatcctgatgacgtcgatggcattcattttgggcgtgctgccgctggcgattgccaccggcgcgggctcgggcagccagcgcgcgatcggtaccggcgtgatgggcgggatgatcacggccacggcgctggcgatcttcctggtgccggtgttcttcgtggtggtgcgcaagcgcttcaagggcagcgagcgccagcacgaattcgaacgtgcgcgcctgtccgcagcgcaggaggacaattga

SEQ ID NO: 74529 - protein, 1051 aa, Ralstonia eutropha JMP134
MAKFFIDRPVFAWVLALIIVLGGLLSIVQLPIAQYPNIAPPTISVTATYPGASARTLEDSVTSVIEQELNGAPNLLYYQSTSESSGLASITIAFAPGSNVDLNSVEVQNRLKRVEARLPAEVRQQGVRVDKAGNNYMMFLTVSSKSGEADAIQLGNYVSSQVIDSIRRVPGVGQADLFGTEYAMRVWLDPAKLTGFNLTPLDVTAAVQEQNIQVAVGELGGTPSPKGTELNATVTTESRLTTPEQFGNILLRTNPDGSSVRIKDVGRVELGGADYSTLARTNGKPSAAIAIKLAPTGNALATATAVRAKMEELSKYFPADYQYSVPYDTSAFVKISIEEVIKTLLEAVVLVFLVMYLFLQNFRATLIPTLVVPIALLGTFGALLAFGFSINVLTMFGMVLAIGILVDDAIVVVENVERIMSEEGLSPRQATRKAMGQITGAIVGITLVLTAVFIPMAFFSGSVGNIYRQFSLSLIASMAFSALLALTLTPALCATLLKPVEAGHHHEKTGFFGWFNRTFARASTSYQGVVGRILARSGRYLIIYAVIIVGVVVLFKRLPSSFLPDEDQGYMITVVQLPNGATQDRTIGVLKQIEDYYLQKESKVVDQMITVAGFSFFGRGQNGGIAFVRLKDWKERTGANETAQALVGRAFGALSFIKDAIIFPLNPPAISELGNSSGFDFRLQDRSGQGHAKLMEARNMMLGMAAKNPVLVGVRPEGQEDAAQLQIDIDREKAKALGVTVATINSTLSIAFGSNYVNDFIYEGRVRKVIVQAEGADRRLPDDLTKLRVRNSNGDMVAFAAFATSKWVMGSPRLERYNGMPAVKIAGQAAPGHSTGEAMRVMEENFAKLPPGFGFEWSGQSYEERLAGSQEPMLYTLSLIIVFLCLAALYESWSIPFSVLLVVPLGVLGALLGVTLRGMPNDVYFKVGLIATIGLSAKNAILIVEFAKDLQAQGKGLIEATLEAVHLRFRPILMTSMAFILGVLPLAIATGAGSGSQRAIGTGVMGGMITATALAIFLVPVFFVVVRKRFKGSERQHEFERARLSAAQEDN

SEQ ID NO: 74530 - DNA, 3081 bp, Methylobacillus flagellatus KT
  CDS (1)..(3081)
atgaccttgccggaaatatcgatcaagcgccatgtattggcgtggatggtctccggcttgctggtactgctcggcatcattagctaccagcgcatcggggtcgatcggctgccctacatcgaattcccggtcatttcaatcaccaccaccttgaccggcgccaaccccgacgtcatcgatgccagcatcaccagcatcatcgaatcctcggtcaacaccacaccgggcatcgagcatatccagtcatcctcttcaccaggcgtttctgtcatcaccattaccttcagcctcgagaagaacatcgacgtggcatacaacgaggtgcaggccaaggttagccaggtgctgcgccgcctgccagatgatgccgatccgccgcaggtacagaaagtggaaaccaacgcccagcccattatgtggctagcattgcgcggcgaccgcaccatccagcaaatcaacctgtacgggttcaacgtcatcaagaaaaagctagagacgattaatggtgtcggcgaggtacgcctgggaggacgacgcgaccgcaccatccgcgtcaatgtgctgcctgaacgtatggccgcttacaatattacggctactgacctgatcgatgcgttcaggcgcgaacatgtgcaactgcctggcggtttcctggtaggcgagaatgcggaatatctcatgaagctggacatggaattccacaacctgcgcgacatggcggaaatgatcgtggcataccgcgatggtgctgccatcaagctcagacagattgccgaattggaggatggagttgccgactaccggcaactggcacgttataaaggcaaccctgcagtaggcctggggattgtcaaggtatccaatgccaataccgtggcgatcattgatgaagtattgcgcaagctggatacggaaatccgccccagcttgccgcccggcatgacgctggatatctcgaccaacgatgcgctgttcattgaggaaatcgtcggcgcattgcaggagcatctcgtcgaaggcaccctgcttgccgccttgatcgtttggctgttcctgcgttccgtccgctctaccctgatcatcgccactgcgatcccggtgtcgctgttgggctcgatcgcggtcatgtatttctccggctttactttcaacaccatgacgctgctagccttgctattactgatcggcgtggttgtggatgacgccattgtggtactcgagaatatctaccgccacctgaggctacgtgcgcaacaggagcccgctgccgactctggcaccattgcccgggcggctgccatcacgggcagccgggaggtggcttttgccgtgattgccgccacattttcgctggtctgtattttcgctcctgtgattttcatggaaggcatcatcggcaagttcttcaagtcgtttgcggtagtcgtcaccttcggcgtactggtctcgctgctggtctcactcacactgacacccatgctatgctcgcgctatctcaagacgcatgagccagaaggccgcttctatggctggatggaccgcctctttcaccgcatggaccatctctatgccggcatgttggcatggacgcttcgacaccgctggaaagtgatgctgctcaccgtgctggtagtggtcagcagcgggttcttctttggcaaggtgcagaaggaattcatcccagactcagatgaaggccgcttcctgatttccttccgtaccccgctgggctccagcattgaatacaccaacagtcgcctggagaaaatggaagcagtattgcaacgctatgatgcgcagatcgccagctacttcagtaccataggcgtgggcgcgcagggccaggtgaataagggcacggtcagcattcgcctcaaggatcggcgggagcgcgacatgagccagcaggcattgatacgcgccatccgcgctgaactggaccagattcccggtgtacgggcctttcctgtgcctgttgccattgttggaggccagcgctcggaaaaactccagttcaatatcaccggcgccaatctcgagcaggtcagccagctcggcaaaaccatgcaacgcaaactaggggatattccgggaatcggcaaggtagacctggacctggatctcgacctgccccagctcacattgaaaatagacaggatacgcgccgccagcctgggcatttccgctgtcgacatcgcaacagcgctcaatttgtacaccggcggcattgatattgccgatttcaacgacgaacccggagacggccagcgttacgagatccgcttgaaggccaaggaaggcagcctgcaaaccccggacgacctcaagaagatttatctgcgcagcggcacgggggagctcgtgcgcctggatagcgtcgcaagcttcaagcagacattgggcgcggccgtgatcggacgcttcgatctgcaatatgctgccagcctctactctaaccccatcatgcccttgggcgacgctgtcgagcacgtacgccggttggccgcagaaacactaccgccgggctaccaattcaacctggtgggtcaggccgaagagctgcagaaaaccgtaagcagcatgctattcgcgtttggcctggcgctggtattgctttatatggtgctcgccagccagttcaactcgttcctgcagcccttgatcatcatgctggcgcagcccctggcgattatcggcggggtgtttgcgttatggatcaccaacaactcgctcaatatcttctcgatgatcgggctggtattgctgatcggcctggtagccaagaactccattctgctcatcgacctcaccaaccagctgcatgaggaaggtaaatcagtggacgacgcattgcgcgaagcctgccccatcaggttgcgccctgtgctcatgacctcgctgaccatcatcctggccctgctgcctgcagcctttggattaggggcaggggcagagaccaacggtccactttccatcgccgtcatcggcggcatgatctcttccacactgttgacattggtagtggtgccagcggcctattccttgatcatgaacaaaatgtcccatcaccataatctataa

SEQ ID NO: 74531 - protein, 1026 aa, Methylobacillus flagellatus KT
MTLPEISIKRHVLAWMVSGLLVLLGIISYQRIGVDRLPYIEFPVISITTTLTGANPDVIDASITSIIESSVNTTPGIEHIQSSSSPGVSVITITFSLEKNIDVAYNEVQAKVSQVLRRLPDDADPPQVQKVETNAQPIMWLALRGDRTIQQINLYGFNVIKKKLETINGVGEVRLGGRRDRTIRVNVLPERMAAYNITATDLIDAFRREHVQLPGGFLVGENAEYLMKLDMEFHNLRDMAEMIVAYRDGAAIKLRQIAELEDGVADYRQLARYKGNPAVGLGIVKVSNANTVAIIDEVLRKLDTEIRPSLPPGMTLDISTNDALFIEEIVGALQEHLVEGTLLAALIVWLFLRSVRSTLIIATAIPVSLLGSIAVMYFSGFTFNTMTLLALLLLIGVVVDDAIVVLENIYRHLRLRAQQEPAADSGTIARAAAITGSREVAFAVIAATFSLVCIFAPVIFMEGIIGKFFKSFAVVVTFGVLVSLLVSLTLTPMLCSRYLKTHEPEGRFYGWMDRLFHRMDHLYAGMLAWTLRHRWKVMLLTVLVVVSSGFFFGKVQKEFIPDSDEGRFLISFRTPLGSSIEYTNSRLEKMEAVLQRYDAQIASYFSTIGVGAQGQVNKGTVSIRLKDRRERDMSQQALIRAIRAELDQIPGVRAFPVPVAIVGGQRSEKLQFNITGANLEQVSQLGKTMQRKLGDIPGIGKVDLDLDLDLPQLTLKIDRIRAASLGISAVDIATALNLYTGGIDIADFNDEPGDGQRYEIRLKAKEGSLQTPDDLKKIYLRSGTGELVRLDSVASFKQTLGAAVIGRFDLQYAASLYSNPIMPLGDAVEHVRRLAAETLPPGYQFNLVGQAEELQKTVSSMLFAFGLALVLLYMVLASQFNSFLQPLIIMLAQPLAIIGGVFALWITNNSLNIFSMIGLVLLIGLVAKNSILLIDLTNQLHEEGKSVDDALREACPIRLRPVLMTSLTIILALLPAAFGLGAGAETNGPLSIAVIGGMISSTLLTLVVVPAAYSLIMNKMSHHHNL

SEQ ID NO: 74532 - DNA, 3189 bp, Methylobacillus flagellatus KT
  CDS (1)..(3189)
atgaacatctcaaaattcttcatcgaccgcccgatctttgcgggcgtactgtcgatgctcatcttgctgggcggagcgctggccatgttccagctgcccatctcggaatatcccgaagtcgtgccgccctccgtggtggtacgcgcacaataccccggcgccaaccccaaggtgatcgccgaggcggtggcttcgccgctggaggaatccatcaacggcgtggaagacatgatctacatgcagtcgcaggccaacagcgacggcaacctcaccatcaccgtcaacttcaagcttggcgtggacccggacaaggcacagcaactggtgcagaaccgtgtcaaccaagcattgcccaggctgccgcccgacgtgcagcggctgggcctcaccacgctgaaaagctcgcccaccctcaccatggtggtgcacctggcctcgccggacaaccgctatgacatgacttacctgcgcaactatgccgtgatcaacgtcaaggataggctggcgcgcatccagggcgtgggcgaggtcggcctgttcggctccggcaactacgccatgcgcgtctggctcgatccgcagaaagtcgcccagcgcggcatgactgcatccgacgtggtgcaggcaatccgcgagcagaacgtgcaggtggcggccggcgtgatcggcgcgtcgcccaacaatgtgccgttgcagctgtcagtcaatgcccagggtcgcctcaagaccgaggaggaatttgctgcgattatcctcaagacttccgccgacggcgccatcacgcgcctgtccgacgtggcgcgcatcgagctcgccgcctccgaatacggcctgcgctccttgctggacaacaagcctgcggtcgccattccgatcttccaggcacccggcgccaacgcgctggcgatttctgatgccgtgcgcgccaccatgaaggagttggccgccgatttccccgaatcggtggaataccatattgtctacgacccgacgcagttcgtgcgctccagcatccgcgccgtggtgaccacgctgctggaagcgatcgccctggtggtgctggtggtgatcctgttcctgcaaacctggcgcgcatccatcatcccattgctggcggtcccggtctccatcatcggcactttctcgctgatgctggcgttcggctactctatcaacgcgctgtcgctgttcggcatggtgctggcgatcggcatcgtggtggatgacgccatcgtcgtcgtggaaaacgtcgagcgcaacatcgaatcgggcctgagtccgcgcgatgccacctaccaggccatgcgcgaggtgagcgggcccatcatcgccatcgcgctgaccctgattgcggtgttcgtcccattggcgttcatgaccggcctcaccgggcagttctacaagcagttcgccatgaccatcgccatttccaccgtgatctcggcgttcaactccctgaccttgtcccccgccctgtccgccatgctgctcaagggccacggcgacaagaaggactggctcacgcgcttcatggaccgttggctgggcggcttctttgccaggttcaaccgcatgttcagccgtgcctccgacagctacggcaagggcatcaagggcatcatcaaccataagggcgcagccatgggcgtctatgccgtgctgctcggcctgaccgtgggcgtgtcgctcgccgtgcccggcggcttcgtaccggcgcaggacaagcaatacctggtgggcttcgcccagctgcccagtggcgcctcgctggaacgcacggaggaagtcatccgccgcatgagcgagatcgcattgcagcagcccggcgtggaaaatgcggtcgccttccctggcctctccatcaacggcttcaccaacagttccagcgccggtatcgtcttcaccccgctcaagccgttcagcgaacgtaaagacaaggcactgtcggctgctgcgattgcacaatcgctgaacgagaaattcggccagatacaggacgcctatatcgccgtgttcccgccgcccccggtcatgggcctgggcaccatcggcggcttcaagctgcagatcgaggaccggggggcgctgggctatgccgagctggacaaggcggtaaacgccttcgttgccggggcttccaaggcgcaggaactcggcccgatgttcaccaattaccagatcaacgtgccgcagctgaacgtggacctggaccgcgccaaggccaagcaattgggcgtaccggtgaccgaagtgttcgacaccatgcagatctacctcggctcactttacatcaacgacttcaaccgcttcggtcgcgtgttccaggtgcgcgcgcaagccgatgcaccctaccgcgccaaggccgaggacatcctgcagctgaaaacgcgcaatatggcgggcgacatggtgccactgtcctcgctggtcagggtgacacccacctacggcccggaaatggtggtgcgctacaacggttataccgctgccgacatcaacggcggggcagcgccaggttattccaccgggcaggcccaggcggcagtggaaaggatagccgcgcagaccctgccgcccggcatcaagttcgagtggaccgacctgacctaccagcagatcctcgcgggcaatgccggtatctgggtgttcccgatcagcgttctgctcgtgttcctggtactggccgcactgtacgagagcctgaccttgccgctagcggtgatcctcatcgtgccgatgagcatcctggcggcgctcacgggcgtgtggctgaccaagggggacaacaacatcttcacccagatcgggctgatggtgctggtcgggctgtctgcgaagaacgccatcctcatcgtcgagttcgcacgcgaactggagctgcaaggcagcagcatcgtcaaggcggccatcgaggccagccgcttgcgtttacgccccatcctcatgacctccatcgccttcatcatgggcgtggtaccgctggtgacttccagcggcgcgggctcggaaatgcgctatgccatgggtatcgccgtgttcttcggcatgctgggcgtgaccctgttcggcctgttcctcacgcccgtgttctacgtgctgttgcgcaagctgagcggaggccgccggctgcactcggccaccaagcacgaaccccatgttgtcggcccagccgccagccatttgatatag

SEQ ID NO: 74533 - protein, 1062 aa, Methylobacillus flagellatus KT
MNISKFFIDRPIFAGVLSMLILLGGALAMFQLPISEYPEVVPPSVVVRAQYPGANPKVIAEAVASPLEESINGVEDMIYMQSQANSDGNLTITVNFKLGVDPDKAQQLVQNRVNQALPRLPPDVQRLGLTTLKSSPTLTMVVHLASPDNRYDMTYLRNYAVINVKDRLARIQGVGEVGLFGSGNYAMRVWLDPQKVAQRGMTASDVVQAIREQNVQVAAGVIGASPNNVPLQLSVNAQGRLKTEEEFAAIILKTSADGAITRLSDVARIELAASEYGLRSLLDNKPAVAIPIFQAPGANALAISDAVRATMKELAADFPESVEYHIVYDPTQFVRSSIRAVVTTLLEAIALVVLVVILFLQTWRASIIPLLAVPVSIIGTFSLMLAFGYSINALSLFGMVLAIGIVVDDAIVVVENVERNIESGLSPRDATYQAMREVSGPIIAIALTLIAVFVPLAFMTGLTGQFYKQFAMTIAISTVISAFNSLTLSPALSAMLLKGHGDKKDWLTRFMDRWLGGFFARFNRMFSRASDSYGKGIKGIINHKGAAMGVYAVLLGLTVGVSLAVPGGFVPAQDKQYLVGFAQLPSGASLERTEEVIRRMSEIALQQPGVENAVAFPGLSINGFTNSSSAGIVFTPLKPFSERKDKALSAAAIAQSLNEKFGQIQDAYIAVFPPPPVMGLGTIGGFKLQIEDRGALGYAELDKAVNAFVAGASKAQELGPMFTNYQINVPQLNVDLDRAKAKQLGVPVTEVFDTMQIYLGSLYINDFNRFGRVFQVRAQADAPYRAKAEDILQLKTRNMAGDMVPLSSLVRVTPTYGPEMVVRYNGYTAADINGGAAPGYSTGQAQAAVERIAAQTLPPGIKFEWTDLTYQQILAGNAGIWVFPISVLLVFLVLAALYESLTLPLAVILIVPMSILAALTGVWLTKGDNNIFTQIGLMVLVGLSAKNAILIVEFARELELQGSSIVKAAIEASRLRLRPILMTSIAFIMGVVPLVTSSGAGSEMRYAMGIAVFFGMLGVTLFGLFLTPVFYVLLRKLSGGRRLHSATKHEPHVVGPAASHLI

SEQ ID NO: 74534 - DNA, 1185 bp, Methylobacillus flagellatus KT
  CDS (1)..(1185)
atgctcgcgggtatcgtgtccatattcaggttggccgtcaaccattatcccaatgtcgcagcgccggccattgctattacggtgacttatcccggcgcttctgcacagaccgtgcaggataccgttgtgcaagtgattgagcagcagctgaatgggcttgatggtttacgctacatcacctctaccagcaattccgacggcagcatgaacatcacggtcacgtttgaccaaggtaccaatccggatattgcccaggtacaggttcaaaacaagctgcaactggccacgcctttattgccggaggaggtgcaacggcaaggaattcgggttgccaaatattctgtcaacttcatgatggtggcggttttagtgtcggaagatgggcgttgggacaatgcggacttgggtaactatgtgggttcctatctgcaggatccgattgtcagaaccaagggcgtgggtgatttcattgtgttcggttctccatatgcaatgcgcatttggctggatccggcaaagctgtacaacttcagtcttacaccaagcgatgtcatgactgcgattgagcagcaaaatgtgcaggtttccatgggccagttaggcggcttgccaactgccaaaggggttcagctcaatgccacgatcattggcaaaatgcgcatgaagactgctgaggagttcaatgagatcctggtcaaggtcaatgctgacggttcgcaagttaggttgaaagacatcgcggaagtcggcctcggcagccaaaactttgccattgcgggcaagtttgacggcaagcccgcatccggcttggcgattcgccttgccactggcgccaacaccctggagaccgctgctgcaattcatgagactatttccaagctggagccgtttctgcctgctggcgtgaaaatctattatccctatgagacggctcccaaggtgacggcctctatcgaagccatcatccacacgctggttgaagccatcatcttggtgttcgtcgtgatgttcgttttcctgcagaatttccgggccacgatcattcctaccattgcagtacccgtggtgatgcttggtacgatgtccgtgctctatgcgttcggttatagcatcaacttgatcaccatgttcgccttggtactggccatcggcctgctcgttgatcgaccaatttcattgaattag

SEQ ID NO: 74535 - protein, 394 aa, Methylobacillus flagellatus KT
MLAGIVSIFRLAVNHYPNVAAPAIAITVTYPGASAQTVQDTVVQVIEQQLNGLDGLRYITSTSNSDGSMNITVTFDQGTNPDIAQVQVQNKLQLATPLLPEEVQRQGIRVAKYSVNFMMVAVLVSEDGRWDNADLGNYVGSYLQDPIVRTKGVGDFIVFGSPYAMRIWLDPAKLYNFSLTPSDVMTAIEQQNVQVSMGQLGGLPTAKGVQLNATIIGKMRMKTAEEFNEILVKVNADGSQVRLKDIAEVGLGSQNFAIAGKFDGKPASGLAIRLATGANTLETAAAIHETISKLEPFLPAGVKIYYPYETAPKVTASIEAIIHTLVEAIILVFVVMFVFLQNFRATIIPTIAVPVVMLGTMSVLYAFGYSINLITMFALVLAIGLLVDRPISLN

SEQ ID NO: 74536 - DNA, 3126 bp, Crocosphaera watsonii WH 8501
  CDS (1)..(3126)
atgaattttgttgacttttttattaaacgtccagttttttcttctgtttgctcttttctaattttattagtaggattagttagtttatttaatctacctctggatagatttcctgaaattagtcccaccagggttcaagttcaatctacctatgatggggctagtgctgaagttgtagaaaatgctgttaccaatgttttagaacgacaaattaatggaattgaaggactaagatatattagttctagcagtagtaatagtggaaccagcagcattaccgttactttcgactcttcgagaaaccctgatttagctgccgttgacgtgcaaaatcaagtttctgtggtgcaatcacagttgccagatgtagtacaaagaactggggttcaagtaagaagacaaggggataatttactgttgggaattggtttatttagtgatgatgatcgttatgatcctgtctttttaagtaactatacagatcaatatttattagatgctatcaaacgtcttgatggcgtgggaaatgtccgcatttttggagaacgtcgttatgcaatgcgtctctggttagaccccaataagttagcaagtagaggcttaactacccaagatgttgttaatgctttgtcagaacaaaatttacaggtaggagccggaaaaataggcgcagaacccgcccccgaaggacaacaatttcagttcgatttacgggcaattagtcaattaaaagatcctaaagattttgagaatttattattaaaaaccgatgaaaatggcggtttagtttacttcaaagatgttggtagggcagagttaggggcgcaagactataacacttttctacggtttcggggacaagaagcagtgggaatgggtatttatcaaagaacgggatcaaatgccttagaagttgcccaaaaagttaaggcagaaatggagagattgtcggtattttttccccctggtttaaaatatattgttgcttttgatactactgaatttgtagaggaatctttatcggaagtagtgaaaactttgctcgtcgccgtgggcttagttattgtggttattttaatctttttacaaaattggagaactactttaattccggctttaactattcctttagccctgattggaacctttgcttttattaaagtattcgatttttcaattaatagtttaactctatttggtttaaccctagctaccggaatggtggtggatgatgccatcattgtcgttgaacaaattaaccgttatatcgaagataatgatatgtctccccaagctgctgctagtaaagctatgggggaattatcatcagcagttgtggctacttcattggtgttaatggcggtgtttgttccagtggcattttttccgggaactaccggggctttataccgacagtttgccttaactattgctttttctattgttatttctacctttttagccttaactttaactccttctttatgcgctttacttttaaagaagggacaaaagttacctggaattttaggaacaattttcaaccaatttaatcaccttttggactgtttaggaagacaatatcagcgatcgctccataccctagctaacctgcgcttagcagttgtcggtgtcttcgtggccctattattagtcacagtctggttatataacttagttcccaccgcttttaccccagaagaagatcaaggctatttcatcactattattcaagctcctcaaggggtttccttacaatacactagcaaggtgatgagacaggtagaaaacgctattttagaagagccagacgtgagagcaacctttgctgtgggagggttcgcttttggggggagtagtgccagtcaaggggtgatttttagccccctgaaaccctttaaagagcgtcggggcccccaacattccgcacaagcaatcatcggtaaactatggggtaagtttagtcaaataccagaagctaatatttttcccgttaaccccccttctattcgaggtttagggagttttggtggttttgtttatcaactgcaagatcaacagggcaacgaggatattaacaagttagtagaggttatggagccgttagtgggtgcagctaaccaaaaccctgctattggtcgggcatttagtcgcttttccgctaatacccctcaatatatcatcgaggtgaaccgtaataaggcccaagcgttacaagtctccatcgacgatatttttagcaccctacaaaccgctttaggttctcgttatgtcaatgattttaccctacaacagcgtacctatcgggtttatgtacaagcggataaacagtttcgctctaacccccaagatatcaataagttatatgtgcgatcgcaaaccgatcaaatggttcccttatctaacctcgttagcttgactgctactactggcgcccaaaccattaaccactataatttataccgttctgtggaagttaatggtagccctgcgccgggggtgggttccggtactgtcatagaaacgatggaaactctctctaaacagttgcttcccccaggttttggttacgaatggtccggcacttccttagaagaactaaattcagcaggtttagcaccgattatttttggtttggggttactgtttgtcttcttagtattggctgcacaatacgaaaattacatcgaccccttaattattattttggcggttcctttggctattttaggagcattatctgcacaattattaagagggtttgctaacgatgtttattgtcagatagggttagtaatgttgatcggtttagccagcaaaaatgctattttgattgtagagtttgctaaccagttacgggatgagggtttacctttagttaaagcagctatagaagcatcacaagaaaggttaagaccaattttaatgaccgcagtttctacattactggggatatttcctttagtagtagcaaccggtgcaggttcggggagtcgtcagtctttgggtacagcagtgtttgggggaatgttagtcgcttctttcttgagtttatttgtggtccctattctttatattgtgattaaaatgaccactgaaaaattcttacctaaaaaatcatcataa

SEQ ID NO: 74537 - protein, 1041 aa, Crocosphaera watsonii WH 8501
MNFVDFFIKRPVFSSVCSFLILLVGLVSLFNLPLDRFPEISPTRVQVQSTYDGASAEVVENAVTNVLERQINGIEGLRYISSSSSNSGTSSITVTFDSSRNPDLAAVDVQNQVSVVQSQLPDVVQRTGVQVRRQGDNLLLGIGLFSDDDRYDPVFLSNYTDQYLLDAIKRLDGVGNVRIFGERRYAMRLWLDPNKLASRGLTTQDVVNALSEQNLQVGAGKIGAEPAPEGQQFQFDLRAISQLKDPKDFENLLLKTDENGGLVYFKDVGRAELGAQDYNTFLRFRGQEAVGMGIYQRTGSNALEVAQKVKAEMERLSVFFPPGLKYIVAFDTTEFVEESLSEVVKTLLVAVGLVIVVILIFLQNWRTTLIPALTIPLALIGTFAFIKVFDFSINSLTLFGLTLATGMVVDDAIIVVEQINRYIEDNDMSPQAAASKAMGELSSAVVATSLVLMAVFVPVAFFPGTTGALYRQFALTIAFSIVISTFLALTLTPSLCALLLKKGQKLPGILGTIFNQFNHLLDCLGRQYQRSLHTLANLRLAVVGVFVALLLVTVWLYNLVPTAFTPEEDQGYFITIIQAPQGVSLQYTSKVMRQVENAILEEPDVRATFAVGGFAFGGSSASQGVIFSPLKPFKERRGPQHSAQAIIGKLWGKFSQIPEANIFPVNPPSIRGLGSFGGFVYQLQDQQGNEDINKLVEVMEPLVGAANQNPAIGRAFSRFSANTPQYIIEVNRNKAQALQVSIDDIFSTLQTALGSRYVNDFTLQQRTYRVYVQADKQFRSNPQDINKLYVRSQTDQMVPLSNLVSLTATTGAQTINHYNLYRSVEVNGSPAPGVGSGTVIETMETLSKQLLPPGFGYEWSGTSLEELNSAGLAPIIFGLGLLFVFLVLAAQYENYIDPLIIILAVPLAILGALSAQLLRGFANDVYCQIGLVMLIGLASKNAILIVEFANQLRDEGLPLVKAAIEASQERLRPILMTAVSTLLGIFPLVVATGAGSGSRQSLGTAVFGGMLVASFLSLFVVPILYIVIKMTTEKFLPKKSS

SEQ ID NO: 74538 - DNA, 3318 bp, Crocosphaera watsonii WH 8501
  CDS (1)..(3318)
atgttactgtctctatcaaacgcctttataaaaagaccggttttaagtacggtttgtaccattgtcatcattctcttgggaactatatctatggcggttttgcccctggataagttaccagagatcgccccgaaaaaagtagctgtaacggctaactatatcggtgccgatgctaaaaccacagaagacaacgttaccaccgtattagaacgagaaatcaacggaaccgaacaagtacgctggatcgactcctttaccgataatactggaaacgttactgttaacgtcactttccccacagaaaccgatcgcaacacagcacaggttttagtccaaaaccaagtttctcaagcagcctccgacttacctcaagtagtaaaccaggccggggtaagaaccaataaacaatctcccagtattactttaatttacgccttttactcagaaaaaggacccgacggggaatatctctacgataaaacttttttatataactacgtcgatcgctacatctggaacgagatgaaagggttgcctggtgtgggttcagtaagtttatttgggggggcaaaatatgccatgagaatatggctgaaccccgataaactggctgctaggggactaacggccatagatgtgatcaatgtcatcaacgaacaaaactttgatactggtgtggggagaataggacaacaacccgccccccctggacaacagtttgaaatacctttgcgggcccagggacggtttagagacgttaccgaagctgaagaaatggtggtcaaagtgggagaagatggtactttgatccgcattaaagatgtgggccgggccgagttagggatggaaaactatgacaccttggtagatgtaaacggcaaccctggtgtagcttttttgatgtatcagttaccaggtagtaacgccctggaaaccgcagaagcagctaaggccaaaatggcggagttagaacccagttttcccccaggtttgaaagtagttatcggcttggataacactttattcgttaacgcttctattgaagatttaacagttaccctcttacaagcgatcgccttagttgtcttggtgatcttcgtcttcctgcaagactggcgaaccacggtgattcccggtattgctattcctgtggcgttagtaggggcgatgatcggtttaaacgcctttggcttcaccctcaaccagttaagtctcttcgcctgtgtgttagctactgggttagtggtggacgatgggatcgttattgtagaatcagtttctagtaagttagcccagggaatgcgccccacacaagcagcaatggactccatggacgaactatttggggcaactattgccacatcggtggtattaatggcggtatttattcccgtgtgtttcttcccaggaaccacagggatcgtttatcggcagtttgctttaacgattatttttgcggttctattttccaccttcaacgccttaaccttttccccaactatgtcggccattttattgggcccaccggaagaacaacatggaccactggccgtatttttcaacgcctttaaccgggttttcaacgtcattcaagagggatatcgtcgttttgttaatttcctcacccatatcagaattattgttatggccttgtttgtggccgggttaatagccaccggttggatgtacacaaccatgccatctggttttattccagcagaggatcaaggttactttttcggtattaccgaagcccccccaggagtctctctcaactataccaacgccatcgatcaacaaaccacgaaaattattcaaaatatgcccaacgccgatcaagtgttggaccacgtggtaaacctgacagggttctcttttgaaggaagaaacgccaataagtctattaccttcatcaagcttaaaccctgggaagaaaggccaggaccacaaaaatcagcctttggtattattcaatatctcaacagagcctttgctcaagaagtcaccggggcaagggtgatcgcctctaatgcaccggccgttgacggtttgagtaactttgctggttcagaaatgtttatccaggatcgtcagttgaaagggatgcccgtcttaatcgataatgttaggaagatgatggcagcggccaaccaacgagaagagatcggtttcgtctttactacctttaccttcgacagtcctttgaccacaatggaaatagatcgggctaaggccaaggcccaagatgttcccgttgacgacgttttaaggacattgcaaacctatattggctctaactatgttaatcaatttgtgtttgaaggtcgtctctatcgggtttatgcccaagcagaagccgaagatcgggccaaccctcaagatattggtgagttgtatgtgcgatcgcgtaatggggcaatgatacaactgagtaacatcgtcacaaaaacctctatcacctaccccccaattctcacccgttacaaaacctatcctgctgttaagttaattatttcgccggcacctgggtatagttccggtcaggtgatctcaactatggaacaggtggctaatgagacgctacagcctggttttggttacgaatggaccaatacagcagccgaggaaaaaagttcggcaggggcagcccccgtggtgtttggcttagcttttgtcatggtattcctggtattagcagcgcaatacgaaagctatattgaccccctaatcatcctcttaacggttccattagctatattaggggcgttggggatgatttggttacgggtgacatttgtgcaaacggcaccctttaaccctggtaacggtatctggccggtgttaaacaataatatgtatgcccaggtagcgttagttatgttaattgggttagcggcgaaaaatgcgattttgatcgtagaattcgccaaccagtcccgtgatctcggcatgactatcaccaaagctgccattaacgctgctgaacaacggttacgccccattttaatgacggcagtttcctccctggtagggtttgcccccttattaagtgcttccagtgtgggggcggttagtcgttggtctttgggaacggctatttttggaggtttagccctagcaacggtgttgagtttggtgttggttcctgttctctatattgttgtcaagaactttgaaaaatatgtcttgggaggtggggataacggaacccctcctggagatcctggaaatggtcatggaaacggcaataaaccctctcccactgcaccggaagaagaaaaaacccccgtttttcaaacctctcctcaaggggaatag

SEQ ID NO: 74539 - protein, 1105 aa, Crocosphaera watsonii WH 8501
MLLSLSNAFIKRPVLSTVCTIVIILLGTISMAVLPLDKLPEIAPKKVAVTANYIGADAKTTEDNVTTVLEREINGTEQVRWIDSFTDNTGNVTVNVTFPTETDRNTAQVLVQNQVSQAASDLPQVVNQAGVRTNKQSPSITLIYAFYSEKGPDGEYLYDKTFLYNYVDRYIWNEMKGLPGVGSVSLFGGAKYAMRIWLNPDKLAARGLTAIDVINVINEQNFDTGVGRIGQQPAPPGQQFEIPLRAQGRFRDVTEAEEMVVKVGEDGTLIRIKDVGRAELGMENYDTLVDVNGNPGVAFLMYQLPGSNALETAEAAKAKMAELEPSFPPGLKVVIGLDNTLFVNASIEDLTVTLLQAIALVVLVIFVFLQDWRTTVIPGIAIPVALVGAMIGLNAFGFTLNQLSLFACVLATGLVVDDGIVIVESVSSKLAQGMRPTQAAMDSMDELFGATIATSVVLMAVFIPVCFFPGTTGIVYRQFALTIIFAVLFSTFNALTFSPTMSAILLGPPEEQHGPLAVFFNAFNRVFNVIQEGYRRFVNFLTHIRIIVMALFVAGLIATGWMYTTMPSGFIPAEDQGYFFGITEAPPGVSLNYTNAIDQQTTKIIQNMPNADQVLDHVVNLTGFSFEGRNANKSITFIKLKPWEERPGPQKSAFGIIQYLNRAFAQEVTGARVIASNAPAVDGLSNFAGSEMFIQDRQLKGMPVLIDNVRKMMAAANQREEIGFVFTTFTFDSPLTTMEIDRAKAKAQDVPVDDVLRTLQTYIGSNYVNQFVFEGRLYRVYAQAEAEDRANPQDIGELYVRSRNGAMIQLSNIVTKTSITYPPILTRYKTYPAVKLIISPAPGYSSGQVISTMEQVANETLQPGFGYEWTNTAAEEKSSAGAAPVVFGLAFVMVFLVLAAQYESYIDPLIILLTVPLAILGALGMIWLRVTFVQTAPFNPGNGIWPVLNNNMYAQVALVMLIGLAAKNAILIVEFANQSRDLGMTITKAAINAAEQRLRPILMTAVSSLVGFAPLLSASSVGAVSRWSLGTAIFGGLALATVLSLVLVPVLYIVVKNFEKYVLGGGDNGTPPGDPGNGHGNGNKPSPTAPEEEKTPVFQTSPQGE

SEQ ID NO: 74540 - DNA, 3114 bp, Methylobacillus flagellatus KT
  CDS (1)..(3114)
atgacgagattctttatcaccaggccgatttttgcatcggtcgtatcgatcattattgtgctggctgggttggctgctgcactccagcttcccatcgcacaatatccgcaaattgccccaccgacagtcatggtgacagccacttatccaggagcaagcgccgagactttggccaagactgtggctgcgccgattgaggagcagttaagtggcatcgagggcttgctttattatcaatccagcgctgattccagcggcaccttgactattaccgtgacctttgaaactggaacggatgtagatcaggcgaccttcaatgtgagcaaccgtgtcaatattgctacgccacggttacctgaagatgtgcgccggaccggcttgatcgttcagaagcggtcgaatgacattttgatggcattgatgctagtgtctccgaacaagacctacgatccgctctatctcagtaattatgcaaccattaatgtgttggatgagttgaagcgtatcaaaggcgtgggcgatgtgactgtgttcggcacccaggattattcaatgcggatatggttgcgtccggataagatggcgcaattaggggttactaccagtgatattgccgccgcaattgcttctcagaatgcacagtatgccgcaggccggatagggcaagatccagcaccagatgatcagcaaattgtttacaccgtgaccgcgaaaggccgtttgatcgagccggagcagtttgcgaatattattgtcaaggcgaatggtccacgcggtgtactttatcttaaggatgtcgctcggatagagctgggtgcacagaattacaatatccggactactctacaaggccaaccaggggtagggataccggtgttcctgcagacaggggcgaatgcactggatactgccgaggcaattaaagccaagatggaggagctgaagcagcgattccccgaagatatggattatcgtattccttacgataccagtgattttgtgaaggcttcgatcggtgaggtagtgcatacgctaggagaagccatgatcttggtggtattagtggtcttcctgtttctgcagagctggcgtgccactctcatcccgatcattgcagtgccgatttccttgatcggcacgtttgccggattatggctgttcggcttctcgatcaatacattgacgctatttgccatggtgctggcgattggtatcgtggtggatgatgccattgtggtgctggagaatattgagcgcctgatgagccaggaaaagctttctcctttgaatgcagccatcaagtccatgcagcaggtttccggggctgtagtggccatcgtactggtgttgtgtgctgtgtttattcccgtggctttcatgggaggtatcgcgggtgagctgtaccgccaatttgcggtaacggttgctgtttctgtagtgatctcagggattgtcgcattgaccttgacgcctgcactttgtgccattctgctcaagcatgcgcatggcgagtctaagttctttcgacctttcaatcgtggttttgacaagctgacaaacttttatacatctgtagtcggagtgactctccggcatcggatcatcggagcatgcgtgttcgtgggcatcatcattgcgggggcttatttgttccgcaccgtgccaacaggttttgtgcctcccgaggatcagggatatgtagtgacggctgcgatcatgcccgatggtgcaagcctttcgcgcacgagcaagacgatggaaaatgtccgcaagaccattgccgaagatcctgcggtcgccagccagttcgtaatcaatggcttcgatttgattggtggtggtaataaaaccagtgcagccacgatgtttgtgcgactgaaagactgggatgatagaaccacgactgcagagcagattgtgcagcgcctgtttggcatcggcatgatgcagccagatggcatggcgattgcattcaatcctcctgccattcgtggccttggtagttctggcagtatggaaatgtatattcagagccgcgaagatactgaccctatccatctttcagaggtggtgaataactttatggacgccttgcgcaaagagccgcgtttgacagggatcaatactttctttcggccgactgtgccacagctcgcgattgaggtagatgaagccaaggcgttgtctctgggcgtgccgattgctgatgtctacgctacattgcaaagcacgatgggcactttatatgtgaatgacttcaatcgttctggccggacttatagagtgcaattgcaagcggagccggcatatcggatgaagcctgaggatatcgggcgcgtctatgtcaggtctgccggaggggaaatgatccccatgtcggcgctgagcaaggtgaaggaaatcattggtgccgagcagttggagcgctaccagggcctgctggcggccaaggtgatggggggaggcgcttatggcgtcagctcgggtgatgcgatcaagctaatcgagcagattgccaatgacaccttgccttctggataccaattggcctggaccagccaagcttaccaggagaagctcacaggcaatgcggcgatcttcgcattcagttttgccatcgtgatggtgttcctgattctggcggcgcagtttgaaacctgggccttgccgcttgcggtcatcatggctgtaccgttcgcattggtaggtgccttgctggctgtgatgttcaggggcatgcctaacgacatctatttccagatcggcttggtcaccctggtgggcttggctgcgaaaaatgccattttgatcgttgagttcgcgagccagaaactggaagaggggttgccgctcaagcaggcggccatcgaagcagcaaagctgcgcttccgcccgattgtcatgacatcgatggctttcgttctgggtattgtgcctttggtggttgcttcaggtgcaggtgctgcggctcgccaatccatgggaaccggtgtttttggcggaatgctgatggctacatttattgcgacaatattcattccgatgttttttacctggttgtccagtgaaaccagtaaacgtgtgcatcacgatgatcaaaaggaaacagcatga

SEQ ID NO: 74541 - protein, 1037 aa, Methylobacillus flagellatus KT
MTRFFITRPIFASVVSIIIVLAGLAAALQLPIAQYPQIAPPTVMVTATYPGASAETLAKTVAAPIEEQLSGIEGLLYYQSSADSSGTLTITVTFETGTDVDQATFNVSNRVNIATPRLPEDVRRTGLIVQKRSNDILMALMLVSPNKTYDPLYLSNYATINVLDELKRIKGVGDVTVFGTQDYSMRIWLRPDKMAQLGVTTSDIAAAIASQNAQYAAGRIGQDPAPDDQQIVYTVTAKGRLIEPEQFANIIVKANGPRGVLYLKDVARIELGAQNYNIRTTLQGQPGVGIPVFLQTGANALDTAEAIKAKMEELKQRFPEDMDYRIPYDTSDFVKASIGEVVHTLGEAMILVVLVVFLFLQSWRATLIPIIAVPISLIGTFAGLWLFGFSINTLTLFAMVLAIGIVVDDAIVVLENIERLMSQEKLSPLNAAIKSMQQVSGAVVAIVLVLCAVFIPVAFMGGIAGELYRQFAVTVAVSVVISGIVALTLTPALCAILLKHAHGESKFFRPFNRGFDKLTNFYTSVVGVTLRHRIIGACVFVGIIIAGAYLFRTVPTGFVPPEDQGYVVTAAIMPDGASLSRTSKTMENVRKTIAEDPAVASQFVINGFDLIGGGNKTSAATMFVRLKDWDDRTTTAEQIVQRLFGIGMMQPDGMAIAFNPPAIRGLGSSGSMEMYIQSREDTDPIHLSEVVNNFMDALRKEPRLTGINTFFRPTVPQLAIEVDEAKALSLGVPIADVYATLQSTMGTLYVNDFNRSGRTYRVQLQAEPAYRMKPEDIGRVYVRSAGGEMIPMSALSKVKEIIGAEQLERYQGLLAAKVMGGGAYGVSSGDAIKLIEQIANDTLPSGYQLAWTSQAYQEKLTGNAAIFAFSFAIVMVFLILAAQFETWALPLAVIMAVPFALVGALLAVMFRGMPNDIYFQIGLVTLVGLAAKNAILIVEFASQKLEEGLPLKQAAIEAAKLRFRPIVMTSMAFVLGIVPLVVASGAGAAARQSMGTGVFGGMLMATFIATIFIPMFFTWLSSETSKRVHHDDQKETA

SEQ ID NO: 74542 - DNA, 2853 bp, Magnetospirillum magnetotacticum MS-1
  CDS (1)..(2853)
atgtttgacatctttatcaagcggccggttctggccgcggtggtcagcctgctgatcctgttcatcggcctgcgtgccctgatgagcctgccggtgcgccaatatcccgagatgaccaacacggtcatcaccatcaccaccacctttcccggcgccgatgccgacatgattcagggcttcgtcacccagccgctgcaaaaggccgtggccacagcggaaggcatcgactatctgacgtcgcgctcgcttcagggcgtcagtgagatcaaggccttcatccggctcaacgacgacccggaaaccgccatgaccggggtgatgagcaaggtggccgaggtcaaaagcctgctgcccaagggcatcaacgattccatcatcaagaaggaaacggggcaaagcttcgcctcggcctatctggccttctcgtccgaccgcctctcccagcagcagatcaccgattacgtcatgcgggtggtgcagcccaagctggccgctgtgcccggcgtggccaaccccgagctttacggcggccagaagttctccatgcgcgtctggctcgacccggagaagctggcccagcagggcatggggcccgacgaccttaaggcggcgctcgtcagcaacaacttcacctcggcctcgggctccaccaagggggcctatgacgtggtcaacacccaggcctccaccgacctgaaaagcgtcgaggagttccgcaatctggtggtcaagcatgacggcgcccggctggtccgcctgggcgaggtggccgatgtgcaattggggccggaaaatgacgatatgagcgtctttgccggtgatgagcgcgccatattcgtcggcatctacaccacgcccgaggccaatcccctgtcggtgatccgccaagtgcgcgaagaggcgctgcccgcgctgcaatcccagttgccgcccggcctcaccgccaagatcgcctatgattccaccttgttcatcgatgccgccatccgcgaagtggccaagaccatcctggaggccgccatcatcgtcatggtggtgatcttcttcttcatgggctcggtgcgctcggtggtgattccggtggtcaccgtgccgctgtcgctgatcggcgttgcggttctgctgctgtccttgggattctccatcaatctgctgaccttgctggccatggttctggccatcggactggtggtggacgacgccatcgtggtggtggaaaacgtccaccgtcatatcgaggagggcttgagccccgtgcgcgccgccctggttggcacgcgcgagatttcgggccccgtcatttccatgaccattaccctggccgccgtctatgcccccatcgccttcatgggcggccttaccgggtccctgttcaaggaattcgccttgacgctggccggtgcggtggtggtgtcgggtgtcattgccctgaccctgtcgcccatgatgtgttccaagattttgcgccacgaggatgacaagaagggtcttcccgccctcatcgaccgcaccttcgaccgggtgcgggccaaatacgagaagtggctgggcgcgtcgcttgccgaccgtcccaccaccttggtgttcgccgccatcgttttgggctcgctgcccttcctgtttctggcggtacccacggaactggcgccggaagaggatcagggcgtgattttcactgcctataatggcccggcctcggccaataccgacttcatggaggccttctcgcaccagatcgccaccaagctgaagggcttttccgagaccaacgagaccttcctgatcaacggcatgggcgccatcagtcagggattcggcggcgcggtgctgaccccttgggaaaagcgcgaccgctcggccaagacgctgaccgcggccgtgcaacaggcgctcaacgaggtgtcgggggtcaaggcctcggtcttcccgccgccgcccttgccgggtgtggacggtttgccggtgcagttcgtgctgtcatccatcaccgattacaagcagctcaacgagattatgggcgaggtcatgaagcgggcccaaggctcgggcatgttcgccttcatcgatgccgatctgaagatcgaaagcccccagacccaggtcatcatcgaccgcgacaaggcggcggcctacggcatctccatgcagcagatcggtgacgccttggggaccatgacgggcggcaattacgtcaatctggtcaatcttcagggccgctcctatcaggtgatcccccaggtcccgcgcgagttccgcctcgatcccgcccagttgggccgctatcacgtccgctcgtcttcgggcgcggcggtaccgctgtcgtccctggtcagcctggggtcctcggtgcgtcccggctcgctaaaccagttcaaccagttgaactcggtgaccatccaggcctttcccatgccgggtgtgacgctgggccaggccttggaccttttgcgcggtatcgccgatgaggttctgccccagggcaccacggtggattacgccggtcagtcgcggcaatacgtgcaggaaggcaacgccctggcgatgaccttcgtcttcgccctgatcatcatcttcctggttctgtcggcgcagttcgaaagcttccgcgatcccttggtcatcatggtctcggtgccgctgtccatctgcggcgccctgatccccctggcgctgggcgtggccagcatgaacatctatacccaggtgggcctggtgactctgatcggcttgatcaccaagcacggaatcctgatctgcgaagtggcgcgcgagcgccaggaggcggagggtcttagccgcgcccaagccgtgatggtggcggcggggctgcggctgcggcccatcctgatgtag

SEQ ID NO: 74543 - protein, 950 aa, Magnetospirillum magnetotacticum MS-1
MFDIFIKRPVLAAVVSLLILFIGLRALMSLPVRQYPEMTNTVITITTTFPGADADMIQGFVTQPLQKAVATAEGIDYLTSRSLQGVSEIKAFIRLNDDPETAMTGVMSKVAEVKSLLPKGINDSIIKKETGQSFASAYLAFSSDRLSQQQITDYVMRVVQPKLAAVPGVANPELYGGQKFSMRVWLDPEKLAQQGMGPDDLKAALVSNNFTSASGSTKGAYDVVNTQASTDLKSVEEFRNLVVKHDGARLVRLGEVADVQLGPENDDMSVFAGDERAIFVGIYTTPEANPLSVIRQVREEALPALQSQLPPGLTAKIAYDSTLFIDAAIREVAKTILEAAIIVMVVIFFFMGSVRSVVIPVVTVPLSLIGVAVLLLSLGFSINLLTLLAMVLAIGLVVDDAIVVVENVHRHIEEGLSPVRAALVGTREISGPVISMTITLAAVYAPIAFMGGLTGSLFKEFALTLAGAVVVSGVIALTLSPMMCSKILRHEDDKKGLPALIDRTFDRVRAKYEKWLGASLADRPTTLVFAAIVLGSLPFLFLAVPTELAPEEDQGVIFTAYNGPASANTDFMEAFSHQIATKLKGFSETNETFLINGMGAISQGFGGAVLTPWEKRDRSAKTLTAAVQQALNEVSGVKASVFPPPPLPGVDGLPVQFVLSSITDYKQLNEIMGEVMKRAQGSGMFAFIDADLKIESPQTQVIIDRDKAAAYGISMQQIGDALGTMTGGNYVNLVNLQGRSYQVIPQVPREFRLDPAQLGRYHVRSSSGAAVPLSSLVSLGSSVRPGSLNQFNQLNSVTIQAFPMPGVTLGQALDLLRGIADEVLPQGTTVDYAGQSRQYVQEGNALAMTFVFALIIIFLVLSAQFESFRDPLVIMVSVPLSICGALIPLALGVASMNIYTQVGLVTLIGLITKHGILICEVARERQEAEGLSRAQAVMVAAGLRLRPILM

SEQ ID NO: 74544 - DNA, 3192 bp, Burkholderia cepacia R18194
  CDS (1)..(3192)
atggccaagttctttatcgatcgcccgatctttgcgtgggtgatcgcgatcgtgctgatgctggccggcgtcgcatcgatcttcaagatgccgatcgcgcagtatccgacgatcgcaccgccgacgatccagatccaggcgaactatccgggcgcttccgcgaagacggtggaagacacggtgacgcaggtgatcgagcagcagatgagcggtctcgacaacttcctgtacatgtcgtcgaccagcgatgactcgggtaacgcgacgatcacgctgaccttctcgccgggtacgaatccggacgtcgcgcaggtgcaggtgcagaacaagctgtcgcttgcgacgccgaacctgccgcaggtcgtgcagcagctcggcatgcaggtcacgaagtcgagcagcaactggctgatgtggttcgcgttcaattccgacgacggcagcatgtcgaaggaggacctgacgaactatgtggcgtcgcacgtgcttgatccgctcagccgcgtgaacggcgtcggccagacgctgctgctcggttcgcagttttcgatgcgcatctggctcgacccggtcaagctgaccaactacagcctcacgccgaccgacgtgtcggccgcgatcacgcagcagaatgtgcagatcgcgggcggccagatcggcggcacgccggcgaagccgggcacgatgctgcaggcgacgatcaccgaatcgacgctgctgcgcacgcccgagcagttcggcaacatcctgctgaaggtcaaccaggacggttcgcaggttcgcctgaaggacgtcggccgcgcggcgctcggctccgagaactacacgttcgacacgaagtacatggggcagccgacggctggcctcggcatccagctcgcgaccggcgcgaacgcgctggcgaccgcgaccgcgctgcgggcgaagatcgacgaactgtcgaagtatttcccgcacggtctcgtcgtccactatccgtacgacacgacgccgttcgtgcgcctgtcgatcgaggaagtggtcaagacgctgctcgaagggatcgtgcttgtgttcctcgtgatgtacctgttcctgcagaacctgcgggcaacgatcatcccgacgatcgcggtgccggtcgtgctgctcggtacgttcgcgatcatgggcgtcgccggcttctcgatcaacacgctgtcgatgttcggcctcgtgcttgccatcggcctgctggtcgacgatgcgatcgtggtcgtggagaacgtcgagcgcgtgatggccgaggagggactgtcaccgaaggaggcgacccgcaaggcgatgggccagatcaccggcgcactcgtcggcgtggcgctcgtgttgtcggcggtgttcgtgccggtggcgttctcgggtggctcggtcggcgcgatctatcgtcagttctcgctgacgatcgtgtcggcaatggtgctgtcggtgctcgtcgcgttgattctgacgccggcactgtgcgcgacgatcctcaagccgatcccgcaagggcatcacgaggagaagaagggcttcttcggctggttcaaccgcacgttcgaccgcagccgcgatcgctatacggggggcgtgaatcacgtgatccgtcgctcgggacgctggctggtgatctacctggccgtgttcatcgcggtcggcgtgatgttcgtgcgcctgccgaagtcgttcctgccggatgaagaccagggctacatgttcatgatcgtgcagacgccgtccggctccacgcaggaaacgaccggcaagacgctcgacaacatcaacacgtacctgaccaccaccgagaaggacgtggtcgactcggtgttcacggtcaatggcttcagctttgcgggccgcggccagaacgccggtctcgtgttcgtgaagctgaaaccgtacgagcatcgccagcgttcggaccagaaggtgcaggcgctgatcggtcggaccttcgcgcactactcgcagtacaaggatgcgatggtgatcccgttcaacccgccgtcgattcccgaactcgggacggctgccggcttcgacttcgagctgacggacaacgccggtctcggccacgaagcgctgatggccgcgcgcgggcagttgctcgggatggccgcgaaggatcccgcgctggcactcgtgcgcccgaacggcctgaacgatacgccgcagtacaaggtcgacatcgatcgcgagaaggcgaacgcgctcggtgtgacggctgctgcgatcgaccagacgttctcgatcgcgtgggcgtcgcagtatgtgaacaacttcctcgatatggatggccggatcaagaaggtgtacgtgcagtcggacgcgccgttccggatgacgccggaagacatgaacatctggtacgtgcgcaatagcgcgggcggcatggtgccgttcagtgcgttctcgaccggccactggagctacggttcgccgaagctcgagcgctacaacggcgtgtcgtcgatcgagatccaggggcaggccgcggaaggcaagtcgaccggccaggcgatggctgcaatggaagcgctcgcgagcaagctgccggaaggtatcggctactcgtggacgggtctgtcgttccaggaaatacagtccggctcgcaggcgccgatcctgtacgcgatctcgatcctcgtcgtgttcctgtgtctcgcggcgctgtatgaaagctggtcgattccgttctcggtgatcatggtggtgccgctcggtgtggtcggcgcgctgctcgcgacgatgctgcgtgggctcgagaacgacgtgttcttccaggtcggcctgctgaccaccgtgggcctgtccgcgaagaacgcgatcctgatcgtcgagttcgcacgcgaattgcagacgagagagaacatggggccggtgcgcgcggcgatcgaggcggcgcgtctgcggctgcgtccgatcctgatgacgtcgctcgcgttcatgctcggcgtgctgccgcttgcgatcagcaacggcgcgggttcggccagccagcatgcaatcggcacgggtgtgatcggcgggatgatcacggcgacgttcctcgcgattttcatgatcccgatgttcttcgtgcgggttcgtgcgatcttcagcggcgagacggaaaacgtcgacgacgcatggcgtctcgtgcagggcgacctgcagcgcggtcacgacgacgcacacgattcgaaggggcagtaa

SEQ ID NO: 74545 - protein, 1063 aa, Burkholderia cepacia R18194
MAKFFIDRPIFAWVIAIVLMLAGVASIFKMPIAQYPTIAPPTIQIQANYPGASAKTVEDTVTQVIEQQMSGLDNFLYMSSTSDDSGNATITLTFSPGTNPDVAQVQVQNKLSLATPNLPQVVQQLGMQVTKSSSNWLMWFAFNSDDGSMSKEDLTNYVASHVLDPLSRVNGVGQTLLLGSQFSMRIWLDPVKLTNYSLTPTDVSAAITQQNVQIAGGQIGGTPAKPGTMLQATITESTLLRTPEQFGNILLKVNQDGSQVRLKDVGRAALGSENYTFDTKYMGQPTAGLGIQLATGANALATATALRAKIDELSKYFPHGLVVHYPYDTTPFVRLSIEEVVKTLLEGIVLVFLVMYLFLQNLRATIIPTIAVPVVLLGTFAIMGVAGFSINTLSMFGLVLAIGLLVDDAIVVVENVERVMAEEGLSPKEATRKAMGQITGALVGVALVLSAVFVPVAFSGGSVGAIYRQFSLTIVSAMVLSVLVALILTPALCATILKPIPQGHHEEKKGFFGWFNRTFDRSRDRYTGGVNHVIRRSGRWLVIYLAVFIAVGVMFVRLPKSFLPDEDQGYMFMIVQTPSGSTQETTGKTLDNINTYLTTTEKDVVDSVFTVNGFSFAGRGQNAGLVFVKLKPYEHRQRSDQKVQALIGRTFAHYSQYKDAMVIPFNPPSIPELGTAAGFDFELTDNAGLGHEALMAARGQLLGMAAKDPALALVRPNGLNDTPQYKVDIDREKANALGVTAAAIDQTFSIAWASQYVNNFLDMDGRIKKVYVQSDAPFRMTPEDMNIWYVRNSAGGMVPFSAFSTGHWSYGSPKLERYNGVSSIEIQGQAAEGKSTGQAMAAMEALASKLPEGIGYSWTGLSFQEIQSGSQAPILYAISILVVFLCLAALYESWSIPFSVIMVVPLGVVGALLATMLRGLENDVFFQVGLLTTVGLSAKNAILIVEFARELQTRENMGPVRAAIEAARLRLRPILMTSLAFMLGVLPLAISNGAGSASQHAIGTGVIGGMITATFLAIFMIPMFFVRVRAIFSGETENVDDAWRLVQGDLQRGHDDAHDSKGQ

SEQ ID NO: 74546 - DNA, 3087 bp, Burkholderia cepacia R1808
  CDS (1)..(3087)
atgagccagaccacgcaaggcgcgcgtttcaccgacatcttcgtgcggcggccggtgctgtcgatcgtctgcagcctgctgattttgctggtgggcctgcgctcgctcggtgcgctgccggtgcgccagtatccgatgctggagagcgcgacgatcagcgtcgagacggcctatcccggtgcgtcgcaggcgttgatgcagggcttcgtgacgacgccgatcgcccagtcgatcgcaaccgcggacggcatcgagtatttgacctccacgtccacgcagggcaagagcgtcgtgaaggcgcggctgcgcctgaatgcgaacgccgatcgcgcgatgaccgaaatcatggcgaaggtgcaggaggtcaagtacaagatgcccgagggtgcgtacgactcggtgatcaccaagctgaccgacgcgcccacggccgtgatgtatctgggcttctcgagcgatacgttgtcgatccccgagatcaccgactacgtggtgcgcgtggcgcagccgctggtcaccacggtgccgggcgtcgcctccgccgaaatcgtcggcggccagaatctcgcgatgcgcgtctggctcgacgcgtcgcggctcgccgcgcacgggctgtcggccggcgatgtcgcggccgcgctgaaggcgaacaacgtgcaggctgcgccgggccagttgaagggcgcgctgaccgtcgccgacatttccgcgaacaccgacctgaccgacgtcggcgcgttcggcaacctcgtcgtgaaatcggaggcgaacggcagtttcgtgcgcttgcgcgacgtcgcgacgatcgagctgggcggccagcaatacaacgcgagcgcgctgatgaacgggcgccgcgcggtcaacatcgcgatcaacgcgacgccgtcgggcaacccgctcgacatcgtgcgcggcgtacaggcgttgctgccgacgatggagcgcagcaagccggccagcatcaggatcggcgacgtgttcgacgtcgcgcgcttcgtcaacgcgtcgatcgacgaggtgcgcgagacgatcatcgaggcgatcgcgatcgtcgtggtcgtgatcttcctgttcctcggctcgttccgtgcggtcgtgatcccggtcgtgacgattccgctcgcgctcgtcggctcggccgcgctgatgctggccgcgggcttctcgctgaacctgctcacgttgctcgcgatggtgctggcgatcgggctcgtcgtggacgacgcgatcgtcgtcgtcgagaacattcaccggcacatcgaatccggcgagccgcccgcgcgcgcggcgctgctcggcgcgcgcgagatcgcgtcgccggtgatcgtgatgaccatcacgctcgttgcggtgtatgcgccgatcgggctgatgggcgggctgaccggctcgttgttccgcgagttcgctttcacgctcgcgggggcggtgtgcgtgtccgcggtgatcgcgttgacgctctcgccgatgctcagctcgctgctgctcgacagccggatgtcggagggccgtgtcgcgcgggcgatcgaacacacgctgtcgcgcgtcacgcacgcgtaccggcgcctgctgcatgcgagcctcggcgcgcggccggcggtgctggttttcggagcgggcgtcctgttgggcatcggcctgctgttcagcggcgtgaagcgcgaactggcgccgcaggaggaccagggctcgatcatgctgcaggtgaaggcgccgcagtacgcgaatctggactacctcgaacgctacgcgccgcagatcgagaaggtgttccgctcgctgccggaagcggataccagcttcgtgttgaacggtgtcggcggtgcgaatctcggcttcgccggcgtgaacctcgtcgactggtcgaagcgcacgcgcagtgcggccgacctgcaggcgcgggtgcaggcgggcgcgaacgcgatcgccggcgaccaggtgttcacgttcctgctgccgtcgctgcccgcgtcgagcggcggcctgccgatccagatggtgctgcgcgcgccggccgatttcaacggcatcttcgcgacgatggacaaattgaaggctgccgcgtcgaagagcgggctgttcgcggtggtcgacagcgatctgacgttcgacagccgtgcggtcggcgtaacgatcgaccgcaaccaggcgaatgcgctcggcgtgacgatgaaggacatcgccgatacgctcgcggtgctcgtgggcgagaactacgtgaaccgcttcgatcacgacggccgctcgtacgacgtgattccgcaggtcgcgcgcgccgagcgcctgtcgtcggacatgctgaaccgctactacgtgaagacgcgcggcggcaagatggtggcgctgtcgaccgtcgtgcgcgtgtcgaacggcagccaggccaacgcgctcacgcagttcaatcagatgaactcggcgaccctgtcggcggtgggcgcgccgggcgtgacgatggggcaagcggtcgagtttctgcagaaacagccgctgccggccggctacgagatcgactggctcggcgaatcgcggcagtacgtgcaggaaggcaaccggctgacggtcacgttcgtgttcgcgctcgtcgtgatctttctggtgctcgccgcgcagttcgagagcctgcgcgatccactggtgatcctcgtgtcggtgccgctgtcggtgtgcggcgcgttggtgcctctgtacctcggcttcgcgacgctgaacatctatacgcagatcgggctcgtgacgctgatcggcctgatttccaagcacgggatcctgatggtgagcttcgcgaacgaactgcaacgcacgcagcacctcgaccgccgcgcggcgatcgagcacgcggccgcggtacggctgcggccgatcctcatgacgacggccgcgatggtcgccgggctcgtgccgctgattttcgcacgcggcgcgggcgcggccagccgcttcgcgatcgggatcacggtctcgaccggcatgctggtcggtacgctgttcacgctgttcgtgctgccgaccgtgtacacgctgatcgcgaagcgccatcgcgaggccgcgaacagcgagcgcgcccgcgtgctggagaccgtatga

SEQ ID NO: 74547 - protein, 1028 aa, Burkholderia cepacia R1808
MSQTTQGARFTDIFVRRPVLSIVCSLLILLVGLRSLGALPVRQYPMLESATISVETAYPGASQALMQGFVTTPIAQSIATADGIEYLTSTSTQGKSVVKARLRLNANADRAMTEIMAKVQEVKYKMPEGAYDSVITKLTDAPTAVMYLGFSSDTLSIPEITDYVVRVAQPLVTTVPGVASAEIVGGQNLAMRVWLDASRLAAHGLSAGDVAAALKANNVQAAPGQLKGALTVADISANTDLTDVGAFGNLVVKSEANGSFVRLRDVATIELGGQQYNASALMNGRRAVNIAINATPSGNPLDIVRGVQALLPTMERSKPASIRIGDVFDVARFVNASIDEVRETIIEAIAIVVVVIFLFLGSFRAVVIPVVTIPLALVGSAALMLAAGFSLNLLTLLAMVLAIGLVVDDAIVVVENIHRHIESGEPPARAALLGAREIASPVIVMTITLVAVYAPIGLMGGLTGSLFREFAFTLAGAVCVSAVIALTLSPMLSSLLLDSRMSEGRVARAIEHTLSRVTHAYRRLLHASLGARPAVLVFGAGVLLGIGLLFSGVKRELAPQEDQGSIMLQVKAPQYANLDYLERYAPQIEKVFRSLPEADTSFVLNGVGGANLGFAGVNLVDWSKRTRSAADLQARVQAGANAIAGDQVFTFLLPSLPASSGGLPIQMVLRAPADFNGIFATMDKLKAAASKSGLFAVVDSDLTFDSRAVGVTIDRNQANALGVTMKDIADTLAVLVGENYVNRFDHDGRSYDVIPQVARAERLSSDMLNRYYVKTRGGKMVALSTVVRVSNGSQANALTQFNQMNSATLSAVGAPGVTMGQAVEFLQKQPLPAGYEIDWLGESRQYVQEGNRLTVTFVFALVVIFLVLAAQFESLRDPLVILVSVPLSVCGALVPLYLGFATLNIYTQIGLVTLIGLISKHGILMVSFANELQRTQHLDRRAAIEHAAAVRLRPILMTTAAMVAGLVPLIFARGAGAASRFAIGITVSTGMLVGTLFTLFVLPTVYTLIAKRHREAANSERARVLETV

SEQ ID NO: 74548 - DNA, 3243 bp, Rubrivivax gelatinosus PM1
  CDS (1)..(3243)
atgaacctgtccaagtttttcatcgatcggccgatcttcgccggcgtgctgtcgctgctgatgctgatcgccggcctgatcgcgctgcgcggcctgccgatctccgagtaccccgaggtcgtgccgccctcggtggtggtgcgtgcgcagtacccgggcgccaaccccaaggtgatcgccgagacggtcgccacgccgctcgaggaggccatcaacggcgtggaaggcatgctctacatgggcagccaggccacgactgacggcctgatgacgctgaccgtcaccttccgcctcggcaccgaccccgacaaggcccagcagctggtgcagaaccgcgtctcgcaggccgagccgcggctgccggaggaggtgcgccgcctcggcatcaccaccgtgaagagttcgccggacctgacgatggtggtgcacctgctgtcgccgaacgaccgctacgacatgacctacctgcgcaactacgcggtgctcaacgtcaaggaccggctggcgcgcatcgacggcgtgggccaggtgcagctgttcggctcgggcgactacgcgatgcgcgtctggctcgacccgcagaaggtggccgagcgcggcctgtcggccagcgacgtggtggcggcgatccgccagcagaacgtgcaggccgccgccggcgtggtgggcgcctcgccgggcctgccgggcgtggacctgcagctgtcgatcaatgcgcagggacggctgcagaacgaggaggagttcggcgacatcatcgtcaagaccggcgccgacggcgcggtgacgcggctgcgcgacctgggccgcatcgagctcggcgcggccgagtacgcgctgcgctcgctgctcgacaacaagtcggccgtcgcggtgccgatcttccaggcgccgggctccaacgccatcgagatctcgaaccaggtgcgcgccaccatggccgagctcaagaagtacatgcccgagggcgtggactacgagatcgtctacgaccccacgcagttcgtgcgcgcctccatcgaatcggtgatccacacgctgctcgaggcggtggcgctggtggtgctggtggtgatcctgttcctgcagacctggcgagcgtcgatcatcccgctgctggcggtgccggtgtcggtgatcggcaccttcgcggtgatgcacctgttcggcttctcgatcaacgcgttgagcctgttcggcctggtgctggcgatcggcatcgtggtggacgacgcgatcgtggtggtcgagaacgtggaacgcaacatcgaggccggcctgtcgccgcgagacgccacctaccgcgcgatgcgcgaggtctcgggaccgatcatcgcgatcgcgctggtgctgatcgcggtgttcgtgccgctggccttcatcagcgggctcaccgggcagttctaccgccagttcgcgctgacgatcgcgatctccacggtgatctcggcgatcaactcgctcacgctgtcgccggcgctcgccgcgatgttgctgaagggtcacggcgcgccgaaggatgcgctgacgcgcggcatggaccgcgtgttcggccgcttcttctcgctgttcaaccgcgccttcaagcgcggcgccgagggctacagcggcggcgtcacgcgcgccatctcgcgcaaggccgtgatgatcggcgtgtacctggtgttcctggcggtgacggtgggcctgttcaaggccgtgcccagcggcttcgtgccggcgcaggacaagcagtacctgatcggcttcgcgcagctccccgacggcgccacgctcgaccgcaccgaggacgtgatccgccgcatgggcgacatcgcgctgaagacgccgggcgtcgagcacgcggtggccttccccggcctgtcgatcaacggcttcaccaacagctccaactccggcatcgtgttcacgccgctgaagcccttcgacgagcggcgcgacccgagcctgagcggcgcggcgatcgcggccgacctgaaccgccagttctcgcagatcgaggacgccttcatcgtgatgttcccacccccgccggtgcagggcctgggcaccacgggcggcttcaagctgcagctcgaggaccgcggctcgctcggctacgcggcgatggacggcgcggtcaaggccttcatggcgaaggcccagcaggcgcccgagctggccgggctgttctcgagctaccaggtcaacgtgccgcagctctatgccgacatcgaccgcaccaaggcgcgccagctcggcgtcgcggtgaccgacgtgttcgacacgatgcagatctacctcggctcgctgtacgtcaacgacttcaacaagttcggccgcacctacaccgtgcgcgtgcaggccgatgccacgcaccgcgcgcgcgccgaggacgtgggcctgctgaaggtgcgctcggcctcgggcgagatggtgccgctgtcggcgctgatgacggtgcagccgagcttcggcccggagcgcgcgatgcgctacaacggctacctgtcggccgacatcaacggcggcccggccccgggctactcgtcgggtcaggcgcaggatgccgtgaaccgcatcgccgccgagacactgccgccgggcatcagctacgaatggaccgagctgacctaccaggagatcctggccggcaactcggcgatgtgggtgttcccgctcgcgatcctgctggtgttcctggtgctcgccgcgcagtacgagagcctgacgctgccgctgtccatcatcctgatcgtgccgatgggtctgctcgcggcgatgaccggcgtgtggctcgacggcggcgacaacaacgtgttcacgcagatcgggctgatcgtgctggtggggctgagcgcgaagaacgcgatcctgatcgtggagttcgcgcgcgagctggagttcgccggccgcacgccggtgcaggcggcgatcgaggccagccggttgcggctgcgcccgatcctgatgacgtcgctggccttcgtgatgggtgtgctgccgctggtgctgtcgagcggtgccggtgccgagatgcgccaggcgatgggcgtcgcggtgttcgccgggatgatcggggtgaccgccttcggcctcttcctcacgccggtgttctatgtgctgctgcgccgcctggccggcaaccgcccgctgacgcagcacggcgaggtgccgcacgccgaggcctttgccggcacccccggcaccggtggcgcgagcctgaagccgctgccggccgcgccggtggcccaccacgactga

SEQ ID NO: 74549 - protein, 1080 aa, Rubrivivax gelatinosus PM1
MNLSKFFIDRPIFAGVLSLLMLIAGLIALRGLPISEYPEVVPPSVVVRAQYPGANPKVIAETVATPLEEAINGVEGMLYMGSQATTDGLMTLTVTFRLGTDPDKAQQLVQNRVSQAEPRLPEEVRRLGITTVKSSPDLTMVVHLLSPNDRYDMTYLRNYAVLNVKDRLARIDGVGQVQLFGSGDYAMRVWLDPQKVAERGLSASDVVAAIRQQNVQAAAGVVGASPGLPGVDLQLSINAQGRLQNEEEFGDIIVKTGADGAVTRLRDLGRIELGAAEYALRSLLDNKSAVAVPIFQAPGSNAIEISNQVRATMAELKKYMPEGVDYEIVYDPTQFVRASIESVIHTLLEAVALVVLVVILFLQTWRASIIPLLAVPVSVIGTFAVMHLFGFSINALSLFGLVLAIGIVVDDAIVVVENVERNIEAGLSPRDATYRAMREVSGPIIAIALVLIAVFVPLAFISGLTGQFYRQFALTIAISTVISAINSLTLSPALAAMLLKGHGAPKDALTRGMDRVFGRFFSLFNRAFKRGAEGYSGGVTRAISRKAVMIGVYLVFLAVTVGLFKAVPSGFVPAQDKQYLIGFAQLPDGATLDRTEDVIRRMGDIALKTPGVEHAVAFPGLSINGFTNSSNSGIVFTPLKPFDERRDPSLSGAAIAADLNRQFSQIEDAFIVMFPPPPVQGLGTTGGFKLQLEDRGSLGYAAMDGAVKAFMAKAQQAPELAGLFSSYQVNVPQLYADIDRTKARQLGVAVTDVFDTMQIYLGSLYVNDFNKFGRTYTVRVQADATHRARAEDVGLLKVRSASGEMVPLSALMTVQPSFGPERAMRYNGYLSADINGGPAPGYSSGQAQDAVNRIAAETLPPGISYEWTELTYQEILAGNSAMWVFPLAILLVFLVLAAQYESLTLPLSIILIVPMGLLAAMTGVWLDGGDNNVFTQIGLIVLVGLSAKNAILIVEFARELEFAGRTPVQAAIEASRLRLRPILMTSLAFVMGVLPLVLSSGAGAEMRQAMGVAVFAGMIGVTAFGLFLTPVFYVLLRRLAGNRPLTQHGEVPHAEAFAGTPGTGGASLKPLPAAPVAHHD

SEQ ID NO: 74550 - DNA, 3222 bp, Rubrivivax gelatinosus PM1
  CDS (1)..(3222)
atgaacctgtcccgcttcttcatcgaccggccgatcttcgcggccgtgctgtcggtcttcatcacgctggtcggcgcgatcgcgatcttcaagctgccgatctccgaataccccgaggtcgcgccgccgcaggtggtggtgcgcgcgcagttccccggcgccaacccgcgcgtgatcgccgagacggtggccacgccgctcgaagagcagatcaacggcatcgagaacatgctctacatgggcagccaggcctcggccgacggtgccctgacgctgacgatcagcttcaagatcggcaccaaccccgaggtggccgagaccgcggtgcagaaccgcgtgaaccgcgcgctgccgcgcctgcccgaggtggtgcgccagatcggcgtgaccaccgagaagagctcgccgaacctgaccatggtggtgcacatggtctcgccggacaacaagtacgacgcgctctacctgcgcaactacgccacgctcaacgtgcgcgacccgctgctgcgcatcccgggcatgggctcggtgcagaccttcggctcgggcgactacgcgatgcgcatctggctcgacccgcagaagctgtcggcccgcggcctgacctcggccgacgtggtgggcgcgatccgcgagcagaacgcgcaggtcgccgccggtgtggtgggcgcgccgccgtcaccgaacaacaccgagttccagctcgcgatcaacacccagggccggctcagcagtgagcaggagttcggcgacatcatcgtgcgcgccgacaccgccgacggttcggtgatccgcgtgcgcgacctcggtcgcgtcgagctcggccccaacacctactcgctcggttcgctgctgaacaacaaggaagcagccgcgatcggcatcttccaggcgcccaactccaatgcgttgcagctgtcgaacgacgtgcgcgccacgatggagcggctgaaggccgacttcccgcccggcgtcgactacgccatcgtctacgaccccacgcgcttcgtcgccacctcgatcgagaaggtgatccacacgctggtcgaggcgatcgcgctggtggtgctggtggtgatcgtgttcctgcagacctggcgcgcgtccatcatcccgctgctggcggtgccggtgtccatcgtcggcaccttcgcggtgctgcttgcgctgggcttctcgatcaacaccctcacgctgttcggcctggtgctggcgatcggcatcgtggtcgacgacgcgatcgtggtggtggagaacgtggaacgcaacatcgaggccggcctgagcccgcgcgatgcgagcgtgaaggcgatgcaggaggtgtcgggcccgatcatcgccatcggcctggtgctgtgcgcggtgttcgtgccgctggccttcgtgtccggcctgtccggccagttctacaagcagttcgccgtgacgatcgcgatctccacggtgatctcggcgttcaactcgttgaccctgtcgccggcgctcagcgccatcctgctgaagccgcaccacgcgaagaaggactggttgacgcgcggcatggacaaggtgttcggccgcttcttcggctggttcaaccgtttcttcacgcgcaatgccgaccgctacagccgcggcgtcaccggcaccgtcgtcaagcgcaagtcgatcgcgctggtgatctacgcagtgctgctgggtgccaccctgctgctgttcaagctggtcccgccgggcttcgtgccgcagcaggacaagcagtacctgatcggcatcgcgcagttgcccgacggcgcgagcctcgaacgcaccaccaaggtcatccgccagctcagcgagatcgcgctgtcggtcccgggcgtgaagagttcggtggccttccccggcctgtcgatcaacggcttcaccgcggcgcccaactcgggcatcgtgttcctgagcctcgacgagttcgagaaccgcacggcgccggagcagagcgccgacgcgatcgtcgggcaggtcaaccagcggctgggcgcgatccaggacgccttcatgttcgtgctgtcgccgccgccggtgagcggcctgggcaatgccgggggcttcaagctgcagctgcaggatcgcgactcgctgggcgagggggcgctcaacggtgcggtgcagcagttgatgggccgcatctacggcaaccccaacagcacgatcacgcaggcgttctcgaactaccagatcaacgtgccgcagctgttcgccaacgtcgaccgcaccaaggccaagcagatgggggtcaacctcagcgacatctacgagacgatgcagacctatctgggttcgctctacgtcaacgacttcaaccgcttcggcaagacctaccaggtgatcgtgcaggccgactccggccaccgcgcgaaggccgaggacatcggcgcgctgaagatccgcaacgccgccggcgagatggtgccgctgtcggccatgatgcgcatcgaacccaccttcgggccgggttcggtgggccgctacaacggcttctacaccgccgacttcaacggcgcggccaagcccggcttcagctccggcgaggcgcaggccgagatggagaagatcctgaaggagacgctgccgcgcggcatcagctacgagtggaccgagctggtctaccaggagaagaccgccggcaacacgatgatctacatcttcccgctgtgcgtgctgctggtgttcctggtgctggcggccacctacgagagcaccacgctgccgctggcgatcatcctgatcgtgccgatgtgcatcctgagcgcgatcactggcgtgtggctcagcggcttcctggggcagccggccgacaacaacatcttcacgcagatcgccttcgtggtgctggtggggctggcgtgcaagaacgccatcctgatcgtcgagttcgcccgcgagctggaggaccacggccgcagcaccgtcaaggcggtggtcgaggcttgccgcctgcggctgcgtccgatcctgatgacttcgatcgccttcatcgccggcgtgatcccgctggtgctgtccagcggcgccggcgccgagatgcgccaggcgatgggcatcgcggtggcgagcggcatgctcggcgtcaccgtgttcggcctgttcctgacgccggtgttctacgtgctgctgcgcaagctcgcccccaagaagcacctgcccaccgcccatgccgcgccgctgaagccgcgcgccccgacgggagacgaccatgcgtga

SEQ ID NO: 74551 - protein, 1073 aa, Rubrivivax gelatinosus PM1
MNLSRFFIDRPIFAAVLSVFITLVGAIAIFKLPISEYPEVAPPQVVVRAQFPGANPRVIAETVATPLEEQINGIENMLYMGSQASADGALTLTISFKIGTNPEVAETAVQNRVNRALPRLPEVVRQIGVTTEKSSPNLTMVVHMVSPDNKYDALYLRNYATLNVRDPLLRIPGMGSVQTFGSGDYAMRIWLDPQKLSARGLTSADVVGAIREQNAQVAAGVVGAPPSPNNTEFQLAINTQGRLSSEQEFGDIIVRADTADGSVIRVRDLGRVELGPNTYSLGSLLNNKEAAAIGIFQAPNSNALQLSNDVRATMERLKADFPPGVDYAIVYDPTRFVATSIEKVIHTLVEAIALVVLVVIVFLQTWRASIIPLLAVPVSIVGTFAVLLALGFSINTLTLFGLVLAIGIVVDDAIVVVENVERNIEAGLSPRDASVKAMQEVSGPIIAIGLVLCAVFVPLAFVSGLSGQFYKQFAVTIAISTVISAFNSLTLSPALSAILLKPHHAKKDWLTRGMDKVFGRFFGWFNRFFTRNADRYSRGVTGTVVKRKSIALVIYAVLLGATLLLFKLVPPGFVPQQDKQYLIGIAQLPDGASLERTTKVIRQLSEIALSVPGVKSSVAFPGLSINGFTAAPNSGIVFLSLDEFENRTAPEQSADAIVGQVNQRLGAIQDAFMFVLSPPPVSGLGNAGGFKLQLQDRDSLGEGALNGAVQQLMGRIYGNPNSTITQAFSNYQINVPQLFANVDRTKAKQMGVNLSDIYETMQTYLGSLYVNDFNRFGKTYQVIVQADSGHRAKAEDIGALKIRNAAGEMVPLSAMMRIEPTFGPGSVGRYNGFYTADFNGAAKPGFSSGEAQAEMEKILKETLPRGISYEWTELVYQEKTAGNTMIYIFPLCVLLVFLVLAATYESTTLPLAIILIVPMCILSAITGVWLSGFLGQPADNNIFTQIAFVVLVGLACKNAILIVEFARELEDHGRSTVKAVVEACRLRLRPILMTSIAFIAGVIPLVLSSGAGAEMRQAMGIAVASGMLGVTVFGLFLTPVFYVLLRKLAPKKHLPTAHAAPLKPRAPTGDDHA

SEQ ID NO: 74552 - DNA, 3087 bp, Rubrivivax gelatinosus PM1
  CDS (1)..(3087)
atgaacctgtcggagctgttcatccgccgtccggtgatgacggtgctgctgaacctggccatggtggtggccggcgtcatcgcctaccggcagatcccgatcgccgcactgccgagctacaacaccccggtgatcaacgtcacggcctcgctgcccggtgccagccccgagaccatggccacctcggtggcgctgcagttggagaagcagttctcgacgatcccctcgctcagcatgatcagctcgaccagcacgctgggcaccacctcgctgacgctggagttcgacgagggccgcgacatcgacgcggcggcggtcgacgtgcaggcggcgctgctgcgtgccgaacgcacgttgccgcaggacatgaccgcgccgccgtcctatcgcaaggtcaacccggccgacgcgccggtgctgctgatggcgatgacctcgccctcgctgaacctgtcggacctgaacgactacgccgagcacctgatctcgcccgcgctgtccacgctgcctggcgtggcgcaggtcaacatcttcggccagcgacgcttcgcggtgcgggtgagggtgcacccgcaggcgctggccgcgcgcgacatcgcgatcgaggagctgagtgcggcgctcgccaccgccaatgccaacacgccggtcggcacgctcgagggcgaccgccagacgctgacggtgcaggccaaccggcagctgcgcaacgcggccgagttctccgacctgatcgtcagcagcaagaacggcaacacggtgcggctgcgcgacgtggcgaccgtggaggacagctacgagagcgtcaagacctcggccaacttcaacggcgaggcgtcgatcacgctggccgtgcagcgccagcccgacgccaacaccgtggcggtggtggatgcggtcaaggccgcgctgccgggcttcaccgcacagctgccgcagtcgatccagctgagcctgctgaacgaccgctccacctcgatccgcgaggcactgcacgacgtgaacctcacgctgctcggcaccatcgtgctggtggtgctggtgatctttctcttcctgcggagagcggtcgcgacggtgatcccgacgctgtcgctgccggtgtcgctgatcggtgcggtggcgctgctgtgggccggcggctacagcctcgacaacatctcgctgctgggcctgacgctggccgtgggcctggtggtggacgacgcgatcgtgatgctcgagaacatcatgcaccacgtcgagcagggcatggacccgttcgaggcggcgttgaagggctcgcgcgaggtcggcttcaccatcatctcgatctcgacctcgctggtcgcggtgttcatcccgatcttcttcatgcccggcgtgatcggcctgctgttccacgaattcgcggtgatcgtctcgctggccatcctggtgtcggccttcgtctcgctgaccctggtgcccatgctggccggacgctacctgaagcccgaggccacgcagcgcccgccgggtgcgctggtgcgcggcttcgagcgcggcttcgaggccgtcacgcgctggtacacgcgctcgctcgacctcgcgctgcggcaccgccgtctgatgctgggtgtgggcgtgctgaccttcgcgctgaccgcgctgatgttcgtcaccattcccaagggattcttcccggaggaggacatcggccagatccgcgcctccaccgaagccgccgaggacacctcgttcgcggcgatggtgaagctgcaggaccaggcggtgcaggtgatgctggccgacccgaacgtgctgagcgtgaactcggtcaacggcggcagcggcacgcagaacacgggccgcatgttcatcaacctcaagccgcgcggcgagcgcctgcccatgaagcaggtggtggaagggctgcgcaagaagttgagtcaggtggccggtatcaccgtctacctgcagccggtgcagaacctgcagctcggcgggcgccccagcaagagccgctaccagtacatcctgcagagcgtgaaggccgatgagctgaacgactgggcggccaggctgcaggagaagctgcgcgccgatccgcgcttccgcgacgtcacctccgactcacagctcaagggactgcaagcctcgctgaagatcgaccgcgacaaggccaacacgctgggcgtgtcggtcgactcgatccgcaacgcgctgttcagcgccttcggcgagcgccaggtcgccaccatttacaccaccgccgacagctaccaggtgatcatggaagtggcgcccgacgccaagcgcgacgagagcgccttcgacggcatctacctgcgcagcagcaacggtgcactggtgccgctgaacagcttcgcgacggtcgagcgcacgctggggccgacctcggtgaaccacgtcgggcagctgcaggcggtgacggtgtcgttcaacctcgcgccgggcgtgccgctcggcgatgccacccggcagctcgaggcctacgggcaggagatccgcctgccggcatcggtgatcaccagctacggcggtgacgcagcggtgttcaagacctcgcagggcagccaggccatcctcatcgttgcggcgttgctggtgatctacgtgctgctgggcgtgctgtacgagagctacatccacccgctgaccatcctggccggcctgccatcggccgcggtgggggccttgctgatgctggagttcttcgggcaggacctgacgctgatcgcgaccatcggcatcctgctgctgatcggcatcgtgaagaagaacgcgatcatgatgatcgacttcgcgctcgacgcgcagcgccatcagggcatggcgcccgaggcagcgattcgcgaagcctgcgtgcggcgcttccggccgatcacgatgaccacgctggccgcgctgatgggcgcgctgcccatcgcgctgggcatcggcgccggcgccgagctgcggcagccgctgggtctggcggtggtgggcggcctgctgttctcgcaggcgatcacgctctacctcacgccggtgatctacctctacctcgaccgctacagcggtcgtgggccgatccagacgccggaggtcgtggaagcccgctga

SEQ ID NO: 74553 - protein, 1028 aa, Rubrivivax gelatinosus PM1
MNLSELFIRRPVMTVLLNLAMVVAGVIAYRQIPIAALPSYNTPVINVTASLPGASPETMATSVALQLEKQFSTIPSLSMISSTSTLGTTSLTLEFDEGRDIDAAAVDVQAALLRAERTLPQDMTAPPSYRKVNPADAPVLLMAMTSPSLNLSDLNDYAEHLISPALSTLPGVAQVNIFGQRRFAVRVRVHPQALAARDIAIEELSAALATANANTPVGTLEGDRQTLTVQANRQLRNAAEFSDLIVSSKNGNTVRLRDVATVEDSYESVKTSANFNGEASITLAVQRQPDANTVAVVDAVKAALPGFTAQLPQSIQLSLLNDRSTSIREALHDVNLTLLGTIVLVVLVIFLFLRRAVATVIPTLSLPVSLIGAVALLWAGGYSLDNISLLGLTLAVGLVVDDAIVMLENIMHHVEQGMDPFEAALKGSREVGFTIISISTSLVAVFIPIFFMPGVIGLLFHEFAVIVSLAILVSAFVSLTLVPMLAGRYLKPEATQRPPGALVRGFERGFEAVTRWYTRSLDLALRHRRLMLGVGVLTFALTALMFVTIPKGFFPEEDIGQIRASTEAAEDTSFAAMVKLQDQAVQVMLADPNVLSVNSVNGGSGTQNTGRMFINLKPRGERLPMKQVVEGLRKKLSQVAGITVYLQPVQNLQLGGRPSKSRYQYILQSVKADELNDWAARLQEKLRADPRFRDVTSDSQLKGLQASLKIDRDKANTLGVSVDSIRNALFSAFGERQVATIYTTADSYQVIMEVAPDAKRDESAFDGIYLRSSNGALVPLNSFATVERTLGPTSVNHVGQLQAVTVSFNLAPGVPLGDATRQLEAYGQEIRLPASVITSYGGDAAVFKTSQGSQAILIVAALLVIYVLLGVLYESYIHPLTILAGLPSAAVGALLMLEFFGQDLTLIATIGILLLIGIVKKNAIMMIDFALDAQRHQGMAPEAAIREACVRRFRPITMTTLAALMGALPIALGIGAGAELRQPLGLAVVGGLLFSQAITLYLTPVIYLYLDRYSGRGPIQTPEVVEAR

SEQ ID NO: 74554 - DNA, 3030 bp, Pseudomonas fluorescens PfO-1
  CDS (1)..(3030)
atggcttttaccgatccgttcatccgccgcccggtgctcgccaccgtggtcagcctgctgattgtgctgctgggctttcaggcctggagcaagctgccgctgcgccagtacccgcaaatggaaaacgccctgatcacggtgaccaccgcgtaccccggggccaacgccgaaaccatccagggctatatcacccagccgatgcaacagagcctggccagcgccgagggcatcgactacatgacctcggtcagtcgccagaacttctcggtgatttcgatctacgcgcgcatcggctccaacagcgaccgcctgttcaccgaactgctggccaaggccaacgaggtgaagaacaaactgcctcaggatgccgaagacccggtgctgagcaaagaagccgccgatgcctcggcgctgatgtacatcagcttcttcagcaaggaactgaacaatccgcagatcaccgactacctgtcgcgggtgatacagccgaagctggcgaccctgccgggcatggccgaagcggaaattctcggcaatcaggtgttcgccatgcgcctgtggatcgacccggtgaaactcgccggcttcggcctcagtgccagtgacgtgaccaacgcggtgcgccagtacaacttcctctccgccgccggcgaggtgaaaggcgagtacgtggtcaccagcatcaacgccaacaccgaactgaagtccgccgaagccttcggcaagatcccgctcaaggtcagcggtgacagccgggtactgctcagcgatgtggcgcgggtcgagatgggcgcggaaaactacaactcgatcagttcgttcggcggaacgccttcggtgtacatcgggatcaaggccacgcccggcgccaacccgctggacgtgatcaaggaagtgcgcaagatcatgccggagctggaagcccagctgccgcccaacctcaagagcgaaatcgcctacgatgccacgctgttcattcaggcctccatcgacgaggtagtgaaaaccctgttcgaggcggtgctgatcgtgatcgtggtggtgttcctgttcctcggcgccctgcgttcggtagtgattccggtggtgaccattccgctgtcgatgatcggcgtgatgttcttcatgcagatgatgggctactcgatcaacctgctgaccctgctggcgatggtgctggccatcgggctggtggtcgacgacgcgattgtggtggtggaaaacatccaccggcacatcgaggaaggcaagacaccactggaagccgcgctcgaaggcgcccgggaaatcgccatgccggtggtgtcgatgaccatcaccctcgcggcggtgtacgcaccgatcggtttcctgaccgggctgaccggggcgctgttcaaggaatttgcgttgaccctggccggggcggtggtgatctccggcgtcgtcgccctgaccctgtcgccgatgatgtgcgccatgctgctgcgccatgacgaaaatcccacgggtctggcccaccgcctcgaccggattttcgacagcctcaagcggcgctatcagcgcatgctgcacggcacgctcaacacccggccggtggtgctggtgtttgcggtgatcgtgctgtgcctgattccggtgctgctcaagttcaccaagtcggaactggcaccggacgaggatcagggcatcatcttcatgatggccaacgcgccgcagccaaccaacctcgactacctgaacacctacaccgacgagttcatcaagatcttcaaggagttcccggagtactattcatcgttccagatcaacggctataacggcgtgcagagcggcatcggcggcttcctgctcaagccgtggaacgagcgcagccgcacgcaaatggaaattctccccgaggtgcagggcaaactcgagggcattccgggcctgcagatcttcggtttcaacctgccatccctgcccggcaccggtgaaggtctgccgttcgaattcgtgatcaacaccgccaacgactacgagctgttgctgcaagtggccgaccggatcaagaagcgcgccatggagtcaggcaagttcgccttcgtcgaccttgacctggccttcgacaaacccgaagtggtggttgacatcgaccgcgccaaggcagcgcagatgggcgtgtcgatgcaggatctgggcggcaccctcgcgaccttgctcggcgaagccgagatcaaccggttcaccatcgaaggccgcagttacaaggtcatcgcccaggtcgaacgggcctaccgcgacaacccggactggctgaacaattactacgtgaaaaacacccagggcgaactgctgccgctgtcgaccctgatcaccgtgaccgaccgcgcgcgaccgcgacaactcaaccagttccagcaactcaacgcggccaagctgtccggattcccgctggtgagcatgggggaagccatcgacagtgtgctgcagatcgcccgggaggaagccccggccggttttgccttcgattacggcggcgcctcccggcagttcgtccaggaaggcagtgcgctgtgggtgactttcgcgttagcactggcgatcattttcctggtgctggcggcgcagttcgaaagcttccgcgatccattggtgattctggtgaccgtgccgctgtcgatctgcggggcgctgattccgctgttcctcggctggtcgagcatgaacatctacacccaggtcggactggtgacgctgatcgggctgatcagcaagcacgggatcctgatcgtcgagttcgccaaccagttgcgcaaagacaagggcctgacaccccgcgaggcagtggaggaagcggcggcaatccgcctgcgcccggtgttgatgaccacagcggcgatggtgttcggcatggtgccgctgatcgtggccaccggcgccggtgccgtcagccgtttcgatatcgggacggtaattgccacggggatgtcgatcggtacgctgtttacgctgtttgtcctgccgtgcgtttacaccgttctggcgaaacccgaccccagggaatga

SEQ ID NO: 74555 - protein, 1009 aa, Pseudomonas fluorescens PfO-1
MAFTDPFIRRPVLATVVSLLIVLLGFQAWSKLPLRQYPQMENALITVTTAYPGANAETIQGYITQPMQQSLASAEGIDYMTSVSRQNFSVISIYARIGSNSDRLFTELLAKANEVKNKLPQDAEDPVLSKEAADASALMYISFFSKELNNPQITDYLSRVIQPKLATLPGMAEAEILGNQVFAMRLWIDPVKLAGFGLSASDVTNAVRQYNFLSAAGEVKGEYVVTSINANTELKSAEAFGKIPLKVSGDSRVLLSDVARVEMGAENYNSISSFGGTPSVYIGIKATPGANPLDVIKEVRKIMPELEAQLPPNLKSEIAYDATLFIQASIDEVVKTLFEAVLIVIVVVFLFLGALRSVVIPVVTIPLSMIGVMFFMQMMGYSINLLTLLAMVLAIGLVVDDAIVVVENIHRHIEEGKTPLEAALEGAREIAMPVVSMTITLAAVYAPIGFLTGLTGALFKEFALTLAGAVVISGVVALTLSPMMCAMLLRHDENPTGLAHRLDRIFDSLKRRYQRMLHGTLNTRPVVLVFAVIVLCLIPVLLKFTKSELAPDEDQGIIFMMANAPQPTNLDYLNTYTDEFIKIFKEFPEYYSSFQINGYNGVQSGIGGFLLKPWNERSRTQMEILPEVQGKLEGIPGLQIFGFNLPSLPGTGEGLPFEFVINTANDYELLLQVADRIKKRAMESGKFAFVDLDLAFDKPEVVVDIDRAKAAQMGVSMQDLGGTLATLLGEAEINRFTIEGRSYKVIAQVERAYRDNPDWLNNYYVKNTQGELLPLSTLITVTDRARPRQLNQFQQLNAAKLSGFPLVSMGEAIDSVLQIAREEAPAGFAFDYGGASRQFVQEGSALWVTFALALAIIFLVLAAQFESFRDPLVILVTVPLSICGALIPLFLGWSSMNIYTQVGLVTLIGLISKHGILIVEFANQLRKDKGLTPREAVEEAAAIRLRPVLMTTAAMVFGMVPLIVATGAGAVSRFDIGTVIATGMSIGTLFTLFVLPCVYTVLAKPDPRE

SEQ ID NO: 74556 - DNA, 3153 bp, Rhodospirillum rubrum
  CDS (1)..(3153)
atggccagtttctttatcgatcgccccgtcttcgcatgggtcatcgccatcatcatcatgctctccggggcgctctccatcctctttctgcccatcgagcagtatccgacggtggcgccgccctcggtgcgcatcaacgccacctatcccggcgcctcggcccaaactctggaaaatacggtcacccaggtgatcgaacagcagatgaacggccttgataatctgcgctatatctcctcgaccagcgattcctcgggttcggccaccatcactctgaccttcaaccccgaggccaatcccgacatcgcccaggttcaggtccagaacaagctccagctcgccaccccgcttctgccccaggaggtgcagcagcagggcatccaggtgaccaaggccaacaacaccttcctgatggtcgtcggcttcatctccaaggacggctcgctgaccgaatccggcatcgccgacttcgtttccagcaacatcaaggatccgctgagccggaccaacggcgtgggcgaagtgacggtctttggatcccagcacgccatgcgcatctggcttgatcccgacaagctgatcagcttcggcctgacgacgaccgaggttaaaagcgcgatcaccgcccagaacgccgaggtttccgccggccagatcggcggcgccccctccgtacccggccaagagctcaacgccaccatcgtcgcccagacccgcctggaaaccgtggaagagttcggcgccattctgatccgggtcaacgccgacggctcgcagatccggctgcgcgatatcgcgcgcatcgagatcggcgccgaaagctacggcaccatggcccgctacaacggccagccggccagcggcatcggcgtcagtttggcgaccggcggcaacgcccttgatacggccgacgccgttcgcgccaccatcgaacgcctgcggccgattttcccgcaaagcgtcgatgtcatctatccctatgacaccacgcccttcgtcaaaatctcgatcgaggaggtggtgcgcaccctgggcgaggccatcatcctggtcttcctggtgatgtatctgttcttgcagaacattcgcgccacgctgattccgacgatcgccgtgccggtggtgctgcttggcacctttggcatcatggcggcctttggcttcaccattaacaccctgaccatgttcggcttggtgctggccatcggcctgcttgtcgacgacgccatcgtcgtcgtcgaaaacgtcgaacgcgtgatgcacgaggacaatctttcgccgcgcgatgccacgcgcaaatcaatgaggcagatcaccggcgccctggtcggcatcgccctggtgctgtcggcggtgttcgtgccgatggcttttttcagcggctcggtcggcgccatctaccgccagttctcgctgaccgtcgcctcggcgatgctgctctcggtgctggtcgccgtcgtcctcaccccggcgctctgcgccaccttcctcaagcccagccatggcgatccttacgccaaaaaagggttcttcggctggttcaaccgcggcttcgaccgcaccaatagcttctatcaaagcagcgtcggccatgttatcggccgcaaatggcgctacttgctgatctatggactgatcctcgtcggcttgggcctgttgttcgtgcgcctgccctcgtcgttcctgcccaacgaggaccagggcattttgttcgcccaggcctcgcttcccgccggcgccacccaggagcgcacccaggaggtgctcgaccagatgtcgcgccacttccgcgaatccgaggcggatttcgtcgaaggggtgttcaccgtcaacggcttcagcttctccggccgtggccagaacagcggcctcgccttcgtgcgcatgaagaactgggacgatcgcgatcccgacaagggctcggtcttcgccgtcgccagacgggcgatgggcgccttgtcacggatcaaggaggcgcggatcttcgccttcgccccgccggcgatcatcgcccttggcaacgcctcgggcttcgagttccagttgcttgaccgcgccggtcagggccacgaaaaactgatggcggcgcgcaaccagttgctgggcatggcggccaagaacccggcgctgatggcggtgcgtcccgacgggctggaagacaatccccagctcaagatcgatatcgaccaggaaaaggccagcgcccttcagctgtcgctgtccgatatcaattccaccctgaccaccacctggggctcgtcctacgtcaacgacttcatcgaaaatggccgggtgaagaaggtctatctgatggccgacgcccccttccgcatgcaggccgccgaccttgatcgctggtatgtgcgcaacagccagggtgaaatggtgccgttctcggccttcaccgatgttcactggatctatggttcgccccgcctggaacgctacaacggccaatcctcgcgcaagatcgccggtcagccggccccggggatgagcaccggcgcggcgatggccgaaatggaggcgatggcggccaagctgccgccgggcttcggctatgaatggacggggttgtcctatgaggagcggctgtcgggttcgcaggctccggcgctctacgccttgtcgatcatcgtcgtcttcctctgtctggccgccctttacgaaagctgggccattcccttcgccgtcatcttggtggtgccgctcggcattctgggcgccgtcatcgccacctcggcgcgcggcctgtccaacgacgtgttcttccagatcggtctgttgacgaccatgggcctcgccgccaagaacgccattctgatcgttgaattcgccaaggagctttacgagggggggatggatctgctcgaggccacggtccatgccgcccgccagcgcctgcggccgatcatcatgacctcgatggccttcagcctgggcgtgctgcccttggcgattgccaatggcgcggggtcgggcagccagaacgccatcggaaccggcgtgttggggggcatgatcagcgctaccgtcctggccattttcttcgtacccttgttcttcatcctgatcttgcgcgccttcaccaaaaagaccccatcgacgccccccgcgcccccctcccccggagccgccgccgatgccccgtaa

SEQ ID NO: 74557 - protein, 1050 aa, Rhodospirillum rubrum
MASFFIDRPVFAWVIAIIIMLSGALSILFLPIEQYPTVAPPSVRINATYPGASAQTLENTVTQVIEQQMNGLDNLRYISSTSDSSGSATITLTFNPEANPDIAQVQVQNKLQLATPLLPQEVQQQGIQVTKANNTFLMVVGFISKDGSLTESGIADFVSSNIKDPLSRTNGVGEVTVFGSQHAMRIWLDPDKLISFGLTTTEVKSAITAQNAEVSAGQIGGAPSVPGQELNATIVAQTRLETVEEFGAILIRVNADGSQIRLRDIARIEIGAESYGTMARYNGQPASGIGVSLATGGNALDTADAVRATIERLRPIFPQSVDVIYPYDTTPFVKISIEEVVRTLGEAIILVFLVMYLFLQNIRATLIPTIAVPVVLLGTFGIMAAFGFTINTLTMFGLVLAIGLLVDDAIVVVENVERVMHEDNLSPRDATRKSMRQITGALVGIALVLSAVFVPMAFFSGSVGAIYRQFSLTVASAMLLSVLVAVVLTPALCATFLKPSHGDPYAKKGFFGWFNRGFDRTNSFYQSSVGHVIGRKWRYLLIYGLILVGLGLLFVRLPSSFLPNEDQGILFAQASLPAGATQERTQEVLDQMSRHFRESEADFVEGVFTVNGFSFSGRGQNSGLAFVRMKNWDDRDPDKGSVFAVARRAMGALSRIKEARIFAFAPPAIIALGNASGFEFQLLDRAGQGHEKLMAARNQLLGMAAKNPALMAVRPDGLEDNPQLKIDIDQEKASALQLSLSDINSTLTTTWGSSYVNDFIENGRVKKVYLMADAPFRMQAADLDRWYVRNSQGEMVPFSAFTDVHWIYGSPRLERYNGQSSRKIAGQPAPGMSTGAAMAEMEAMAAKLPPGFGYEWTGLSYEERLSGSQAPALYALSIIVVFLCLAALYESWAIPFAVILVVPLGILGAVIATSARGLSNDVFFQIGLLTTMGLAAKNAILIVEFAKELYEGGMDLLEATVHAARQRLRPIIMTSMAFSLGVLPLAIANGAGSGSQNAIGTGVLGGMISATVLAIFFVPLFFILILRAFTKKTPSTPPAPPSPGAAADAP

SEQ ID NO: 74558 - DNA, 3114 bp, Rhodospirillum rubrum
  CDS (1)..(3114)
atggacgtcagcagcctttttatccgccgcccggttttcgccaccgtgctcagcttgttgctggtggtcatgggcatcgcggcgatgacccggctggcggtgcgcgaactgcccgatatcgattccgccgtggtcagcgtcaccaccccctataccggggcggcgcccgagatcgtcgataccgatatcaccgaggtcattgaaaacgccgtcgccggcgtctcgggcattcgcaccatcacctcgcaaagccgccgtggccaggggcggacggtgatcgaattcgaaagcggcgtgtcgatggacgaggcggtcaacgacgtgcgcgacgccgtggccaaggtgcgcggcgatctgcccgacgatatcgaggagccgcgcatcgccaaaagcgacacggattccgatccggtgatgcgcctcagcctgaccagcccgcggatgacgccgatcgagctgaccgatttcgccgatcgctacatcgtcgaccggctggcgaccatcgatggcgtcgcccaggtcgatctctatggcgagcgccgccaggccatccgcctgtggctggaccgccgggcgatggccgcccgtcaagtgacggttcaggatgtggaagcggccctgcgccgggccaatgtcgaactgcccgccggcgagatcgaaagcgcctcccgcctgctgaccgtgcgggcggcgaccctgttgaccagccccgaggcctttggcagcacggttatcaaggtcgtcgacggctatccgctgcgggtgcgcgatgtcgcccgcgtcgaactgggagtggagaacgacgacaccaccgtgcgcgtcgaaggccgcgacgccctgaccatgggcgtgctgcgccagtcccaggccaatacggtggcgatttccaatcgcatccgcgccgagatcgaccgcttgcgtcccagcctgcccgaggggatgagcctggaggtgtcgtccgacgacgccctgttcatcaaccgctcgatccacgaggtgatcttgaccctcggcctgtcggggctgatcgtcatcatcgtcaatttcgcctttctcggctcgatccgcgccaccttggtgccgacggtgaccatcccggtggcggtgatcggcaccttcatcggcattttgctgctgggcttttcgatcaacctgctgaccttgctcgccttgatcttgtcgatcgggctggtggtcgatgacgccatcgtcgtgcttgagaacatccagcgccgcatcgaggccggcgagcccaagctggtggcggcggcgcgcggcacccggcaggtcactttcgccgtggtcgccacctcgttgaccctgatcgccgtcttcgtgccgatttccttcatggagggcacggtcggccggctgttcaccgaattcggtttcgtgctggcctgcgcggtggcgatctcgatgctggtcgccctgacgctctgcccgccgctggccgctggcgtgctggccgagggcaaggccgagggccggctggcccatgccctcaattacgccttcggcaccctgagccggggctatcagcgggccctgtcggcggttctcggcctgccgatggtcgtgttgacggtcgccctgctctgcggcggcgcgtcgttctggctctatcaggggctgcccaaggaattggttccggtcgaggatcgcggggtggtggtggtcagcctcaacggaccgcaaggggccaatacgcgttataccgatacccaaatccgcgccgtggaggccgccgttcagccggtgctcgatcgcggcgaggcggtgggggttctggcccaggtcggccaatggaaccgcccccatcgtggctatgtcgtcatccgcctggacgattgggaaaaccgcgggcgcaccgcctccgccctggccgagagcctgcgcaaggacctgggcaagctggccggggcgacggcgacgccggtggtgcccgccggcctggggctgcgcggcagccgcacccccttgcaggtggtgatcggcggccccgattacgccgaggtcgaggtctgggccaacgccctgctcaagcgggccgaggaattgcccgggttgatcaatcccgaactcgatttcgaacaaaaccaaccccagctcagcgtcggcatcgaccgcgaccgcgccgatgatctgggggtcggggtggaggccatcggccaaaccctgcagaccatgctggcctcgcgcgaggtgacgcgcttcgttgatcgcgggcgcgagtatcaggtggtggtccaggcccggcccgaggatcggcggacaccctcggatttgagcaataccttcgtgcgcgccgaaaagggcggcgctctggtgccgctcgatgccctggtgatcctcaaggaaaccgccggcgcccccgatctcaatcgctacgcccgcctgccgtcgatcaccttgcaaagcgcgctggcgcccggttacgacatggggcaggcgatcgacgacgtgatggcgctcgccagccaaaccgtgccgcccgaagcccggctttccctggccgggcaatccaaggaattcctggaaacctcggggggggtgctgttcacctttttgatggccctggtcatcgtctatctggtgctggccgcccagttcgaaagcttcctccatcctttgatcatcatgctgtcggtgccgctggcggtgtcgggggctttgctgtcgctatgggcgacgggcaattcgatcaatgtttacagccagatcggcatcgttttgctgatcggcctgacggcgaagaatggcatcttgatcgtggagttcgccaatcagctgcgcgacgaggggcgaagcgtgcgcgaggccatccttgaagccgccagcctgcgcctgcggccgatcctgatgaccgtcatctgcaccattcttggcgcggtgccgctggcctggtcgtcgggggcgggggcggaaagccgcgaggcgatcggcatcgtcgtcatcggcggtctggggctggcctcgctgctcaccctgttcgtcaccccggttctctatgatctgctggcgcccttcacccgctcggccggcgccgtgggccaagcccttgaccgcgccctggccgaaacccccgagggcgcgggcaagccggcggaataa

SEQ ID NO: 74559 - protein, 1037 aa, Rhodospirillum rubrum
MDVSSLFIRRPVFATVLSLLLVVMGIAAMTRLAVRELPDIDSAVVSVTTPYTGAAPEIVDTDITEVIENAVAGVSGIRTITSQSRRGQGRTVIEFESGVSMDEAVNDVRDAVAKVRGDLPDDIEEPRIAKSDTDSDPVMRLSLTSPRMTPIELTDFADRYIVDRLATIDGVAQVDLYGERRQAIRLWLDRRAMAARQVTVQDVEAALRRANVELPAGEIESASRLLTVRAATLLTSPEAFGSTVIKVVDGYPLRVRDVARVELGVENDDTTVRVEGRDALTMGVLRQSQANTVAISNRIRAEIDRLRPSLPEGMSLEVSSDDALFINRSIHEVILTLGLSGLIVIIVNFAFLGSIRATLVPTVTIPVAVIGTFIGILLLGFSINLLTLLALILSIGLVVDDAIVVLENIQRRIEAGEPKLVAAARGTRQVTFAVVATSLTLIAVFVPISFMEGTVGRLFTEFGFVLACAVAISMLVALTLCPPLAAGVLAEGKAEGRLAHALNYAFGTLSRGYQRALSAVLGLPMVVLTVALLCGGASFWLYQGLPKELVPVEDRGVVVVSLNGPQGANTRYTDTQIRAVEAAVQPVLDRGEAVGVLAQVGQWNRPHRGYVVIRLDDWENRGRTASALAESLRKDLGKLAGATATPVVPAGLGLRGSRTPLQVVIGGPDYAEVEVWANALLKRAEELPGLINPELDFEQNQPQLSVGIDRDRADDLGVGVEAIGQTLQTMLASREVTRFVDRGREYQVVVQARPEDRRTPSDLSNTFVRAEKGGALVPLDALVILKETAGAPDLNRYARLPSITLQSALAPGYDMGQAIDDVMALASQTVPPEARLSLAGQSKEFLETSGGVLFTFLMALVIVYLVLAAQFESFLHPLIIMLSVPLAVSGALLSLWATGNSINVYSQIGIVLLIGLTAKNGILIVEFANQLRDEGRSVREAILEAASLRLRPILMTVICTILGAVPLAWSSGAGAESREAIGIVVIGGLGLASLLTLFVTPVLYDLLAPFTRSAGAVGQALDRALAETPEGAGKPAE

SEQ ID NO: 74560 - DNA, 3159 bp, Rhodospirillum rubrum
  CDS (1)..(3159)
atggcacagttatttatcaagcggcccatccttgcctgggtattcgcgatcttcatctcgatcgccggcatcatcgctctgccgttgcttcccgttgcgcagtaccccaatgtcgcaccgccgcagctcagcctgtacacgacctatccgggcgcctccccccaggagatctatcagggggtcacgaggctgatcgaggaggaactaaacagcgtcgataacttgatctatttcgaatcgacctcggactccacgggggggatcacgatcaatgcgacgttccagccgggaaccaatctccaacaggcatccgtcaacgtgcaaaacgccatccgcagcgtcgcatcgcggctgcctgcggctgtcaccgcacagggcgttacggtggaagaggtcacagccggtttcttgatgttaatcacgctgacctcaaccgacggggcggtcgatgaggtcggtcttggggactatctgaaccgcaatatgctcggcgagctaaggcgcatcgatggcgttggcaaggctcagctcttctcggctcaacgcgccatgcgcgtctggatcgaccccgacaagatggttggtctcaagttgacggtcggcgatatcaacaccgccatcacaacccagaacgcccaggtggccgctggtcagataggcgccgcgcccaatccggtcagccaggatctgaccgcgacggtgctggtgaaggggcaactgaccgatatcgaagagttcggcaacatcgtgctgcgcgccaacccggacggctcgactgtccggctgaaggacgttgcgcgcctggaggttggcgcggagagctacaacttctccagccgtctcaatgggcagccgagtgcggccgtcgccatccagttgtcctcgacgggcaacgccgtggcgacctcggccgccatcaaggccaagctggacgagctttcccgcttcttcccgtccggggttcaatatgacgtgccatatgacaccagcccgttcgtttcggcgtccatccagaaggttttgatgacccttctggaagcggtcgggctcgtctttttggtgatgttcgtcttcttgcagaacttccgctacactgtcattccgacgctcgtggtcccgatcgccctgctgggcacatccgccgccatgctagcgacgggcttttcaatcaacgtcctgaccatgttcgcgatggtgcttgcgatcggcatcctcgtcgacgacgccatcgtcgtcgtggagaacgtcgaacggatcatggccgaggaaggcctgtcgccaaaggctgcgacgaataaggcgatgacgcagattaccagcgcgatcctcggcatcacgctggtgctgtcgtcggtctttatcccgatggccttcttccccggctcgacgggcatcatctatcgccagttctcgctgacgatggtggtgtcgattcttttctcggcgttcctggcgctgtcgctcacccccgcactctgcgcgacgttcctgaagccgatcaagcaggggcatcacgacaagaagggcctcggcggctggttcaaccggaagttcgaccgcctgaccgcgggctattcgcgttccgtgacgggactggtgcgtcgcgccggccgggtgatggtcgtctacctcgccctggtggtcgggcttggctatctgttcgtgaacctgccgagcggcttcgtgcccaacgaagatcagggctactttctggtcgacgtccagggaccgcccgaagccagcgccaaccgcacggtcgcgtccatcaagcagatcgaggagattttcaaaggcgagtccgccgtgcgcgacgtgctcgtcatccagggcttcagcttctcaggcagtggcgccaacgccgccatggttttcgtcacgctgaaggactggaaggagcgtggcgccggcaacaccgtcgacgaaatcaccgaacgggtgaacatgcgattgttcgccctgaaggatgcgacctcgtttgcgttgtcgccgccgccgatcgaagggttcggcacgacgaatggcttcagcttccgtcttcaagacaggagcggacttgggcagcaagcgcttagctcggcggccgcaaaactgatggccaaagccgaacaaagcccggtgctgacaggcctgcgtattgaaggtctgccggacgctgctcaggtggtgctggtgatcaatcgtgagaaggccaacacctttggtgtcaccttcgcagatatcaacagcacgatcaccgccaatctcggatcgtcctatatcaatgactatccgaatgcgggacgcatgcagcgtgtcatcgtgcaggcgcaggaccgggatcgactgcaggccgatgatctgttgaagctgaacgtgcgcaatgccggcggcggcatggtgccgttgtcgtccttcgcgatcgcagaatggcaaaagggcgcaccgcagatcgtcggttacaacggctatccgacagtgcgtatcgccggtgagccggtaccgggccagtcgaccggcgccgcgatcgccgagatggagcggctggcgtccgaactgccggaaggcttcggcttcgaatggaccggtcaggccctcgaagagatcaagtcgggttcacaggcgccgatgcttttcgggctcagcatcctgttcgtcttcctgctgctcgcgggcctctatgaaagctggtcgatcccgctttcggtgatgctcgtcgtgccgctcggcgcgattggatgcgtgcttgccgtcatgatgcgtgggatgcccaacgacatctatttcaaggttggtctgatcgcgatcattggtctgtcggcgaagaacgcgatcttgatcgtggaatttgccaaggactacttcgctcaaggacggtcgctgttcgattcggccgtggacgccgcccgggttcggtttcggccgatcgtcatgacgtcgctcgcctttgcgctcggcgtcgtgccgctggcgatcgcgaccggaccgagcgccgcaagccagaacgccatcggtacgggcgttctgggcggcataatcctgggaaccattctggcgatcttcttcgttccggccttcttcgtcttcgtgctgaagctcttccgcacgaaacggccggtcgaggaccacgaggacgacaagcccgaaaccggtgatgaggtcgccgggaagcccgtggcctga

SEQ ID NO: 74561 - protein, 1052 aa, Rhodospirillum rubrum
MAQLFIKRPILAWVFAIFISIAGIIALPLLPVAQYPNVAPPQLSLYTTYPGASPQEIYQGVTRLIEEELNSVDNLIYFESTSDSTGGITINATFQPGTNLQQASVNVQNAIRSVASRLPAAVTAQGVTVEEVTAGFLMLITLTSTDGAVDEVGLGDYLNRNMLGELRRIDGVGKAQLFSAQRAMRVWIDPDKMVGLKLTVGDINTAITTQNAQVAAGQIGAAPNPVSQDLTATVLVKGQLTDIEEFGNIVLRANPDGSTVRLKDVARLEVGAESYNFSSRLNGQPSAAVAIQLSSTGNAVATSAAIKAKLDELSRFFPSGVQYDVPYDTSPFVSASIQKVLMTLLEAVGLVFLVMFVFLQNFRYTVIPTLVVPIALLGTSAAMLATGFSINVLTMFAMVLAIGILVDDAIVVVENVERIMAEEGLSPKAATNKAMTQITSAILGITLVLSSVFIPMAFFPGSTGIIYRQFSLTMVVSILFSAFLALSLTPALCATFLKPIKQGHHDKKGLGGWFNRKFDRLTAGYSRSVTGLVRRAGRVMVVYLALVVGLGYLFVNLPSGFVPNEDQGYFLVDVQGPPEASANRTVASIKQIEEIFKGESAVRDVLVIQGFSFSGSGANAAMVFVTLKDWKERGAGNTVDEITERVNMRLFALKDATSFALSPPPIEGFGTTNGFSFRLQDRSGLGQQALSSAAAKLMAKAEQSPVLTGLRIEGLPDAAQVVLVINREKANTFGVTFADINSTITANLGSSYINDYPNAGRMQRVIVQAQDRDRLQADDLLKLNVRNAGGGMVPLSSFAIAEWQKGAPQIVGYNGYPTVRIAGEPVPGQSTGAAIAEMERLASELPEGFGFEWTGQALEEIKSGSQAPMLFGLSILFVFLLLAGLYESWSIPLSVMLVVPLGAIGCVLAVMMRGMPNDIYFKVGLIAIIGLSAKNAILIVEFAKDYFAQGRSLFDSAVDAARVRFRPIVMTSLAFALGVVPLAIATGPSAASQNAIGTGVLGGIILGTILAIFFVPAFFVFVLKLFRTKRPVEDHEDDKPETGDEVAGKPVA

SEQ ID NO: 74562 - DNA, 3090 bp, Rhodospirillum rubrum
  CDS (1)..(3090)
atgaaggccttcgatcttttcatccgccggccggtgctggccacggtcatcagcctgctgatcctggtggtcggcttccaggcgctgatgcgcctgcccatccgccaatatccggagatgagcaatacggtcatcaccgtcaccaccacctatccgggggcgaattccgatctgatccagggcttcgtcacccagccgatccagaaggcggtctcgacctccaagggtctggattatctgacctcgagctcgtcgcagggcgtcagcaccgtcaaggccttcgtccgcctgaacgaggatcccgacgcggcgatgaccgaggtgacggccaaggtcaacgaggtccgctcgctgctgccgcgcaacgtcgataatccggtgatctccaaggagaccggcgagaccttccccgccgccttcatcgccttttcctcgaaaagccattcccaagaacagatcaccgattacgtcaaccgggtgatccagcccaagctggccgcggtcagcggcgtttccaatcccgaggtcttcggcgccaagaacttctcgatccgcgtctggctcgatcccgaaaagatggcccagcaggggctgacggccagcgatgtccagaccgccctgacggcgaacaacttctcctcggccgccgggtcgatcaagggcagcctggatatcatcaacaccaaggccgaaaccgatctgaccgatatcgccgagttccgcaagctggtggtccgcaatgacggggcgcggctgatccgccttcaagatatcggcgaggtgtcgctggccgccgaaagcagcgacatgagcgtgttcgccagcggtcaggcggcgatcttcgtcggcgtcttcaccaccccggaagccaatccgctgtcggtgatcgccgagatccgcgagaccgccctgccggcgatcatcgaccagttgcccgagggcatgaccgccttgatggcctatgattcgacggtgttcatcaccgaatcgatccgcgaggtggtcaagaccatcgtcgaagccgcgatcatcgtcatggtggtgatcttcctgttcatgggatcggtgcggtcggtggtcattcccctggtcaccgtgccgctgtcgctggttggcgtcgccatcttgctgatggtcttgggtttttcgatcaatcttctgaccttgctggccatggttctggcgatcgggttggtggtcgacgacgccatcgtcgtcgtcgagaacgtccatcgccatatcgaggagggatccacccccttccaggcggcgatcgacggcacccgcgaaatcgccctgccggtgatttcgatgaccatcaccctggccgccgtctatgccccgatcgcctttatgggcgggctgaccggcgcgctgtttcgtgaattcgccctcgccctggccggctcggtggtggtgtcgggggtggtggcgctgacgctgtcgccgatgatgtgttcaaagatcctgcgccacgaggtgaccaagaaaggcttcgccgccaagctcgattcgttgttcgagcgccttcagggacgctatgggcgcctgctggacgcctcgctggccgaccgcccgaccacggtggtcttcgccctgatcgtcatgggatcgctgtacttcctgttctcggccatccccagcgaactggcccccgacgaggaccagggcgcggtgctgaccgccttcaacggcccggcctcggccagcaacgactatatgaacgtcttcgtgcaccagatcgatgacgcgctgcgcgcctatcccgaaaccgagcataccttcctgatcgccggcatcggcacccccaacagcggcttcggcggcgcctcgctcaagccctgggccgagcgcgagcgcgatgccaaggcgttgatcggcgcggtgcaaacgacgatgaacggcatcgccggggtcaaggcctcggtgttctcgcccgccgccctgcccggtgccgatggcctgcccgtgcagttcgtcatctcctcgaccaccccctatgaggcgatttccgacatccaggacgagatgatgaagcgggcccaggcctcggggcgcttcatcttcaccgatacggatctgaaattcgaaagcccgcagaccgtggtgtcggtcgaccgcgacaaggcggcggcctatggcatcaccatggatcagatcggtggcgccctggcgacgatgaccggcggcaactacgtcaatctggtcaatatccagggccgctcctacaaggtgatcccccaggttcccgacagcgcccgcatggatcccgactccctggggcgcttctatatccgcacccatagcggcaccgccattccgctgtcgtcgctggtgaccctggagcggcgcgtgctgccgcaatcgctcaaccagttcaaccagcttaacgccttcaccatctcgggcttcccgatgcccggggtgaccctgggtcaggccctggccgttctggagcaaagcgcggccgaggtgctgccctcgggctacaccatcgattacgccggccagtcgcggcagttcatccaggaaggcagcagcctgatcggcaccttcgtgttcgccctgatcatcatcttcctggtgctggccgcccagttcgaaagcttccgcgatccgctggtcatcatgatctcggtgccgttgtcgatttgcggcgccttgctgcccctggcgctcggcgccaccaccatgaacatctatacccaggtcggtctggtgacgttgatcgggctgatcaccaagcacggcatcttgatgtgcgaggtggcccgtgaacgccaggaagagcagggcctgacccgcgcccaggcgatcgaggtcgcggccaagctgcgactgcggccgatcctgatgacgacggcggcgatggtcgctgggttgattcccctgatgttcgccagcggcgccggcgccaacagccggttttccatcgccgtggtcatcgtcgcggggatgagcatcggcacgctgttcaccctgttcgtgctgccggtgatctataccttccttgccgaggatcgcagcaaggggcgcgacggctcctcgggcgccgagggcggcgtgtcgctttcgaaggcggccgaatag

SEQ ID NO: 74563 - protein, 1029 aa, Rhodospirillum rubrum
MKAFDLFIRRPVLATVISLLILVVGFQALMRLPIRQYPEMSNTVITVTTTYPGANSDLIQGFVTQPIQKAVSTSKGLDYLTSSSSQGVSTVKAFVRLNEDPDAAMTEVTAKVNEVRSLLPRNVDNPVISKETGETFPAAFIAFSSKSHSQEQITDYVNRVIQPKLAAVSGVSNPEVFGAKNFSIRVWLDPEKMAQQGLTASDVQTALTANNFSSAAGSIKGSLDIINTKAETDLTDIAEFRKLVVRNDGARLIRLQDIGEVSLAAESSDMSVFASGQAAIFVGVFTTPEANPLSVIAEIRETALPAIIDQLPEGMTALMAYDSTVFITESIREVVKTIVEAAIIVMVVIFLFMGSVRSVVIPLVTVPLSLVGVAILLMVLGFSINLLTLLAMVLAIGLVVDDAIVVVENVHRHIEEGSTPFQAAIDGTREIALPVISMTITLAAVYAPIAFMGGLTGALFREFALALAGSVVVSGVVALTLSPMMCSKILRHEVTKKGFAAKLDSLFERLQGRYGRLLDASLADRPTTVVFALIVMGSLYFLFSAIPSELAPDEDQGAVLTAFNGPASASNDYMNVFVHQIDDALRAYPETEHTFLIAGIGTPNSGFGGASLKPWAERERDAKALIGAVQTTMNGIAGVKASVFSPAALPGADGLPVQFVISSTTPYEAISDIQDEMMKRAQASGRFIFTDTDLKFESPQTVVSVDRDKAAAYGITMDQIGGALATMTGGNYVNLVNIQGRSYKVIPQVPDSARMDPDSLGRFYIRTHSGTAIPLSSLVTLERRVLPQSLNQFNQLNAFTISGFPMPGVTLGQALAVLEQSAAEVLPSGYTIDYAGQSRQFIQEGSSLIGTFVFALIIIFLVLAAQFESFRDPLVIMISVPLSICGALLPLALGATTMNIYTQVGLVTLIGLITKHGILMCEVARERQEEQGLTRAQAIEVAAKLRLRPILMTTAAMVAGLIPLMFASGAGANSRFSIAVVIVAGMSIGTLFTLFVLPVIYTFLAEDRSKGRDGSSGAEGGVSLSKAAE

SEQ ID NO: 74564 - DNA, 3147 bp, Ralstonia metallidurans CH34
  CDS (1)..(3147)
atgtctaatttctttatcgagcggccgatctttgcctgggtgatcgcgctggtcatcatgctggccggcgtgctctccatcagaacgctgccgatcaaccagtacccggcgatcgccccgccgaccatcgccatctccgtaacctacccgggcgcttcggcgcaaacggtgcaggatacggtggtgcaggtgatcgagcagcagctgaatggcctggatcgcctccgctacatctcgtcggaatcgaactccgacggcagcatgaccatcacggtcacgttcgagcaaggcaccaacccggatatcgcgcaggtgcaggtgcagaacaagcttgccctagccacgccactgttgccgcaggaagttcagcagcaggggattcgcgtaaccaagtcggtgcgtaacttcctgctgatcgtgggtctgatttcgaccgaccccaacatgacgcgggaggatttgtcgaactacatcgtttcgaacatccaggatccgctatcgcgtaccgcaggcgtgggcgacttccaggtgttcggctcgcagtatgcgatgcggatctggctggacccggccaagctcaacagctaccagctcgcgccgctggatgtgagcaacgcgatcaaggcccagaacgtccaggtggcttcgggtcagcttggtggcctgccggcggttcgcggacagcagcttaatgcgacggtgattggcaagacgcgtctccagaccgccgagcagtttggcgacatcctgctcaaggtcaatcccgacggctcgcaggtgcgcctgaaggacgtggccgatgttgctctgggtggccaggactacacgatcaacgcgcagtacaacggtcgcccggcatcgggtatcgcgattcgcctggcatccggcgccaacgcgctggagacggtcaagaacatccacaatacgctggctcagctggaaccgacgttcccgccgggcatcaaggtggtgttcccgtatgacacgacgccggtgatctccgactcgatccacgaggtgatcaagacgctgctcgaggcaatcgtgctcgtcttcctggtgatgtatctgttcctgcagaacttccgcgccacgctgatcccaacgatcgcggtgccggtggtgctgctcggcacgttcggcgtgttggccgcgtttggctattcgatcaacacactgacgatgttcggcatggtgctggccatcggtctgctggtggacgatgccatcgtggtggtcgagaacgtcgagcgggtgatggccgaagacgggctggggccaaaggaagccgcacgaaaatcgatggggcagatccagggcgcgctggttggtatcgcgctggtgctgtccgcggtgttcctgccgatggcgttcttcgggggctcgacgggtgtgatctatcgccagttctcgatcacgatcgtttccgcgatggtgctgtctgtgctcgtggcgcttgttctcacgccggcactgtgcgcgacgatgctccagccgatcgagaagggcgatcacggcgagcacaagcagggcttcttcggctggttcaaccgcagcttcatccggtcgacgcaaagctatgagcgtggggtctccggcattctcaagcgccgggctccgttcctgctgatctatctggcgatcgtggtggtgatgggattcctgttcacgcgcatcccgacctcgttcctgccggaagaagatcagggcgtgctgtacgcgcaggtgcagacaccggccggctcgtcggccgagcgcacgcaggccgtgcttgaccagatgcgcaactacctgctgaatgacgaaggcaagatcgtggagtcgctctttaccgtgaacggcttcaactttgccggccgtggccagagttcgggtctcgcgtttattctgctgaagccgttcaaggatcgcgaaggcgatgccacgagtgtgttcgacctgaccaagcgggcgcaggccaagttcagcacgttccgcgactcgctggcatttgccttcgcgccgccggcggtgcaggaactcggtaacgccacgggcttcgacttctatatgcaggatcaggccggcctggggcacgacgcgctgatgaacgcgcgcaacaagttcctgtcgctcgcagccaagaaccccgcgttgcagcgagtgcgtccgaacggcctcaatgacgagccgcagtacgtcctcgaaatcgacgatgagcgcgcgcgcgcgttggggctgtctctggcggacatcaacagcacggtgtcaattgcctggggttccagctacgtgaacgacttcattgaccggggccgcgtcaagcgtgtgtacctgcagggtcggccgaactcgcgaatgtcgccagaggacctcaacaagtggttcgtgcgcaacgacaagggtgacatggtgccgttctcgtcgtttgccacgggcaagtggggctttggatcgccgaagctgcagcgctacaacggtgtgccggcggtggaaatcctcggtgagccggcggcaggcaagagctcgggtgaagccatggcggcggtagaggaaatcatgaagcagatgccagccggcatctcctattcgtggacgggcctgtcgtacgaagaacggttgtcgggctcccaggcaccagcgctgtacgcgttgtcgctgctggtggtcttcctctgtctggcggcgctgtatgaaagctggtcgattccgttctcggtgatgctggtggtgccgctcggggtgatcggcgcgctgctggctacactcgcacgaggactgtcgaacgacgtgttcttccaggtggggctgttgaccacggtgggcctttccgcgaagaacgcgattctgatcgtggaattcgccaaggaactgcacgatcacggcaagggcctcgtggaggcggcggtggaggcgtgccgaatgcgtttacgccccatcatcatgacctcgatggcgttcatgctgggcgtgttcccgctggcggtgtcgcaaggcgccggcgcgggtagccagcacgccatcggtaccggcgtgatcggcggcatgatcaccgccaccgtgctcgccatcttctgggtgccgctgttctttgtcgtggtcagcgcgctcaaggagcggcgcggcaagtccgattcgtcctccctcgagaagggagcccaagcatga

SEQ ID NO: 74565 - protein, 1048 aa, Ralstonia metallidurans CH34
MSNFFIERPIFAWVIALVIMLAGVLSIRTLPINQYPAIAPPTIAISVTYPGASAQTVQDTVVQVIEQQLNGLDRLRYISSESNSDGSMTITVTFEQGTNPDIAQVQVQNKLALATPLLPQEVQQQGIRVTKSVRNFLLIVGLISTDPNMTREDLSNYIVSNIQDPLSRTAGVGDFQVFGSQYAMRIWLDPAKLNSYQLAPLDVSNAIKAQNVQVASGQLGGLPAVRGQQLNATVIGKTRLQTAEQFGDILLKVNPDGSQVRLKDVADVALGGQDYTINAQYNGRPASGIAIRLASGANALETVKNIHNTLAQLEPTFPPGIKVVFPYDTTPVISDSIHEVIKTLLEAIVLVFLVMYLFLQNFRATLIPTIAVPVVLLGTFGVLAAFGYSINTLTMFGMVLAIGLLVDDAIVVVENVERVMAEDGLGPKEAARKSMGQIQGALVGIALVLSAVFLPMAFFGGSTGVIYRQFSITIVSAMVLSVLVALVLTPALCATMLQPIEKGDHGEHKQGFFGWFNRSFIRSTQSYERGVSGILKRRAPFLLIYLAIVVVMGFLFTRIPTSFLPEEDQGVLYAQVQTPAGSSAERTQAVLDQMRNYLLNDEGKIVESLFTVNGFNFAGRGQSSGLAFILLKPFKDREGDATSVFDLTKRAQAKFSTFRDSLAFAFAPPAVQELGNATGFDFYMQDQAGLGHDALMNARNKFLSLAAKNPALQRVRPNGLNDEPQYVLEIDDERARALGLSLADINSTVSIAWGSSYVNDFIDRGRVKRVYLQGRPNSRMSPEDLNKWFVRNDKGDMVPFSSFATGKWGFGSPKLQRYNGVPAVEILGEPAAGKSSGEAMAAVEEIMKQMPAGISYSWTGLSYEERLSGSQAPALYALSLLVVFLCLAALYESWSIPFSVMLVVPLGVIGALLATLARGLSNDVFFQVGLLTTVGLSAKNAILIVEFAKELHDHGKGLVEAAVEACRMRLRPIIMTSMAFMLGVFPLAVSQGAGAGSQHAIGTGVIGGMITATVLAIFWVPLFFVVVSALKERRGKSDSSSLEKGAQA

SEQ ID NO: 74566 - DNA, 3192 bp, Ralstonia metallidurans CH34
  CDS (1)..(3192)
atgaatctctcgaaattctttatcgaccgccccattttcgcgggtgtgctatcggtgctgatcttcctgatcggcgccatatcgatgttcaagttgccgatctcggagtacccggaagtggtgccgccgtcggtggtggtgcgcgcgcagttcccgggcgccaacccgaaggtgatcgccgagaccgtggccacgccgctggaagagcagatcaacggcgtcgaggacatgctctacatgaactcgcaggccaacagcgacggcacgctgacgctgacggtgaccttcaagctgggcacggacccggacaaggcccagcagctcgtgcagaaccgcgtctcgcaggccgagccgcgtctgcccgaggacgtgcgtcgcctgggcattaccacggtcaagagctcgcctgatctgaccatggtggtgcacctggtctcgccgaacaatcgctatgacatgacgtatctgcgcaactacgcgctgatcaacgtcaaggaccgcctggcgcgtatccagggcgtcggtcaggtgcagatgttcggctcgggcgactactcgatgcgtgtgtggctgaaccccgacaagatcgccgagcgtcatctggcggcctcggacgtggtcaaggccatccgcgagcagaacgtgcaggtggcagccggcgtgatcggacaatcgccctcgctgccgggcaccgatctgcaactgtcggtcaacgcgcagggccgtctgcagacggtggaggagtttggcgacatcatcgtcaacacctcgccggacggcgcggtgacgtacctcaaggacatcgcccgcgtcgagctgggtgcctccgagtacgcactgcgttcgctgctcgacaacaagtccgccgtggcgctgccgatcttccaggcgccgggttccaacgcgatccagatctcggacgatgtgcgcaagacgatggccgagctgaaagcgaacatgccggagggcgtggactacagcatcgtctatgacccgacccagttcgtgcgccacagcatcgaggccgtgacgcacacgctgttcgaggccatcgcgctggtggtgctggtggtgatcctgttcctgcagacctggcgcgcgtcgatcattccgctgctggccgtgccggtgtcgatcgtcggcacgttcgggctgatgcacgcgttcgggttctcgatcaacgcgctgagcctgttcggtctggtgttggcgatcggtatcgtggtggacgatgcgatcgtggtagtggagaacgtcgagcgcaatatcgaggaagggttgtcgccgaaggaagccacgtacaaggccatgcgcgaggtaagtggtccgatcatcgccatcgcgctgacgctgatcgccgtgttcgtgccgctggcattcatgactggcctgaccgggcagttctacaagcagttcgcgctgacgatctcgatctcgacgatcatctcggcgttcaactcgctgacgctgtcgcccgcgctgtccgcgctgctgctcaagagccacgacgcgccgaaggattggctgacgcgcgccatggacaaggtgctcggcaagttcttcgtccgcttcaaccagttcttccgccgcagctcggacaactatggccggggcgtgaagggcgtgattcgccgcaagggctcggtgttcggcgtgtacgcgctgatgctggtcgcgacctggggcgtgttccagatggtgccgaagggcttcgtaccggcgcaggacaagcagtacctggtgagcttcgccaagctgcctgacggcgcgacgctggatcgcacggaagacgtgatccgccgcatgtcggatatcgcgctcaagcatccgggcgtggagtcggcggtggcattcccgggcctgtcgatcaacggcttcaccaatagcccgagcgccggcatcgtgttcgtcacgctcgatccgttcgacaagcgcaagagcaaggaactgtctggcaatgcgatcgcggctgatctgaacaagcagtacggctcgatccaggacgccttcattgcggtgttcccgccgccgccggtgcagggcctcggtacgatcggcggtttcaagatgatgatcgaggaccgcgccgcgctgggctatgacgaactgtttaacgcgaccaacgcgttcatggccaaggcgcgcgccacgcccgaactggctggcatcttcagcaactatcaggtgaacgtgccgcagctagacgtgaagctggaccgcaccaaggccaagcaactcggcgtgcccgtgaccgatgtgttcgacacgctccagacctacctcggctctgcgtacgtcaacgacttcaacaagtttggtcgcacgtaccaggtcaaggtgcaggccgatgcgcagttccgccagcatgcggaggacatcctgcagctgaagacgcgcaacgtgagtggtgagatggtgccgctgtcgtcgctggtgcaggtcaagcagagcttcggccccgacagcgtgatccgctacaacggcttcacggctgccgatatgaatggtggtccggctcctggcttctcgtcgggccaggcgcaggccgccgccgagcggatcgccgcggagacgctgcccaagggtatcgccttcgagtggaccgagctgacgtatcaggacatcctggccggcaatgcgggcgtctggatcttcccgctgtgcgtgttgctggtgttcctggtgctggccgcccagtacgaaagcctgacgctgccgctggcggtgatcctgatcgtgccgctgagcctgctggccgccatgactggcgtgtggctgacccgtggcgataacaacatcttcacgcagatcggtttcatcgtgctggtggggttatccgcgaagaacgcgattctgatcgtcgagttcgcgcgtgaactggaacatcacggccgtacggtggtgcaggccgcgatcgaggccagccgcctgcgtctgcgcccgatcctgatgacgtcgttcgctttcatcatgggtgtggtgccgctggtggtgtccaccggcgccggcgcggaaatgcgccatgcgatgggcgtggccgtgttcgcggggatgctgggggtgacgttcttcggcctgttcctgacgccggtcttctatgtggcgctgcgtttgctggccacgcgaggccagcgccagaaggtggctgagcagcctgcgtcggcgtcgcaggcggtggcatcggcagaataa

SEQ ID NO: 74567 - protein, 1063 aa, Ralstonia metallidurans CH34
MNLSKFFIDRPIFAGVLSVLIFLIGAISMFKLPISEYPEVVPPSVVVRAQFPGANPKVIAETVATPLEEQINGVEDMLYMNSQANSDGTLTLTVTFKLGTDPDKAQQLVQNRVSQAEPRLPEDVRRLGITTVKSSPDLTMVVHLVSPNNRYDMTYLRNYALINVKDRLARIQGVGQVQMFGSGDYSMRVWLNPDKIAERHLAASDVVKAIREQNVQVAAGVIGQSPSLPGTDLQLSVNAQGRLQTVEEFGDIIVNTSPDGAVTYLKDIARVELGASEYALRSLLDNKSAVALPIFQAPGSNAIQISDDVRKTMAELKANMPEGVDYSIVYDPTQFVRHSIEAVTHTLFEAIALVVLVVILFLQTWRASIIPLLAVPVSIVGTFGLMHAFGFSINALSLFGLVLAIGIVVDDAIVVVENVERNIEEGLSPKEATYKAMREVSGPIIAIALTLIAVFVPLAFMTGLTGQFYKQFALTISISTIISAFNSLTLSPALSALLLKSHDAPKDWLTRAMDKVLGKFFVRFNQFFRRSSDNYGRGVKGVIRRKGSVFGVYALMLVATWGVFQMVPKGFVPAQDKQYLVSFAKLPDGATLDRTEDVIRRMSDIALKHPGVESAVAFPGLSINGFTNSPSAGIVFVTLDPFDKRKSKELSGNAIAADLNKQYGSIQDAFIAVFPPPPVQGLGTIGGFKMMIEDRAALGYDELFNATNAFMAKARATPELAGIFSNYQVNVPQLDVKLDRTKAKQLGVPVTDVFDTLQTYLGSAYVNDFNKFGRTYQVKVQADAQFRQHAEDILQLKTRNVSGEMVPLSSLVQVKQSFGPDSVIRYNGFTAADMNGGPAPGFSSGQAQAAAERIAAETLPKGIAFEWTELTYQDILAGNAGVWIFPLCVLLVFLVLAAQYESLTLPLAVILIVPLSLLAAMTGVWLTRGDNNIFTQIGFIVLVGLSAKNAILIVEFARELEHHGRTVVQAAIEASRLRLRPILMTSFAFIMGVVPLVVSTGAGAEMRHAMGVAVFAGMLGVTFFGLFLTPVFYVALRLLATRGQRQKVAEQPASASQAVASAE

SEQ ID NO: 74568 - DNA, 3207 bp, Burkholderia fungorum LB400
  CDS (1)..(3207)
atgccatttttcttcatcgaccgcccggtcttcgcatggatcgtcgcgctcgccattgtcgtggcgggcgcgctggctattccgcaactgccggtgtcgcagtatccgcgtcttgcgccgccgcgcatcgtgatctccgccacgtatccgggtgcttcgaccgaagtcgtggacgccaacgtcggcagcatcatcgaggaaagtctcgatggcgccgacaatatgctgtactacgaaacgacgagcgacagcctgggtgaactcgaaatcgacgcgaccttcgcgcccggcaccaatcccgatctcgcgctggtggacattcagaaccggctcaagcaggtcgagccgcgcttgccgcagcaggtcgtgcagcagggcatcagcgtgttcaaggcggccaacacgttcctgatgctggtggcgctcacctccacggacggcacgcgcgactccgtgcaattgagcgattacctgagccgctacgtgttgcgcgaactgaagcgcgcgccaggcgtgggctcggcccagctctgggacgcggacgaagcgctgcgcatctggctcgatccgatgaagctgcgcgaatacggcctcggcgccgccgaagtgaacgccgccattgccgcgcagaatgcgaccgtcacggccggaacgctgggtgacgcgccgttcgtgccgggccagcaactcaccgcctcggtaagcgtgaaagggcaattgatctcgccggccgaatttggccagatcgtgctgaaggcgcggccggacggttcggccgtgcgcctgcgcgacgtcgcgcgggtcgaagtcgggcgcgacaattactcgttctattcgcgcctgaacggcaaggccgcggcgacggtcgggattcaactcgggccgcgcggcaatgcgctcgaaacgtcgaatgcgattcgtgcgcggcttgccgcgttgtcgaaaggattgccgtcgggcgtctccatcgagatcccgttcgacaacgcgcatttcgtgcagattgcaattcacgaggtgctcgtcacgctcgcggaagcggtggtgctggtgttcttcgtcatgtggttgttcctgcgcgatctgcgctacacgctggtgccgaccgtggtgattccggtcacgctgatgggcgcgtttctcgccatgtacgcgtgcggtctgtcgatcaacgtgttcaccctgttcggcctcgtgctcgccatcgggattctcgtcgacgacgcgatcgtggtggtggagagcgtgcaccgcgtgatggaagaagagggcctgccgccacgcgaggctacccgcaaggcgatgtcgcagatcggcggggcgatcgtcggcgtgaccgcggtgttgacggccgtgttcgtgccaatggcgtttttccccggcggtgtgggcggtatttaccggcagttcgcggtggccatgatcgcgtcgatgctggtgtcgtcgttcatggccttgtcgctgacgcccgcgttgtgcgcaaatctgctgaaggcgcacacgcagtcggtgcgtcaacgtgatgcgcgccgcggcgttctgggtttcgcggcgcgcgcggcaagccgcttcacatccggtttcgatcgtgcggcgcgtggctatcgcggcttgaccgcgcgcacgctgcgccgcatcggcccgatgctggcggtctacgcggtgctggtcggcgtgtgcggtctgctctactggcagatgcccggcggttttctgccgagcgaggaccaaggccagttgcaggtaatggtgcaattgcccgcgggcgccacccaggcacgcacgctggccgtggtggagcgcgtggaaaagattctgcatgcggagcccgccatcgccaacgtgacgagtgtgattggctggagcttttcgggcagcggtcagaacgtggcaatgggctttgtcgaactcaaggactggggcaagcgcgacgtcgacgcactcgctctgcgcgaccggctcaatgcaaagttcgacaggattctggatggcaacgtggaggcgcaattaccgccttcggtgccgggcgtcgggcactcggacggtttcgtgttccgtctggaggatcgcggcggcgtggggctcgacgcgctgaaggccgcgcgcgagcaactgttcacgcaggccagggcgagtccggtgctggcgtccgtgcattccgaggacctgcccgacgcgccgcgcgtcgagctgatcgtcgaccgtgcaaaagcgtatgcgctcggcgtgtcgttcgatcgtatcgccgacgtgctgggcagcaccttcggctcgacctatatcgacgatttccccgccggtggccgcatgcgtcgcgtgatgatcgccgccgacgccgccacgcgcatgaccgaagacgacctgctggcgctcgcggtgcccaacgcgacgggcggcatggtgccgctctcggccatcgcgacgcgccagtggacgatcggcccggtgatgctgacacgctacaacggttatccgtcgctcgacgtgagcggtcacgcggcgcccggctacagttccggcgcggcgatggcggagatggagcggctcgccgctgcgttgccggtcggcgtgcagtacgactgggtggacgcggcgcgcgaggaaaccgcggccgcgaaactcacgccgctgctgatcggcctttcgttattggcggtcttcatggcgctggcggcgctctatgaaagctggacgatcccgttggccgtgctgatggtcgtgccgctcggcgtgatcggcgcggtcgccgcggtgctgttgcgcggcatgcccaacgacgtgtacttcaaggtcggcatgatcacggtgatcggcctcgcggcgaagaacgcgatcctgatcgtgcagttcgcccgcgatctgcatcagcgtggcctgccgttgacgcgtgcggtggccgaagccgcaggcgcgcgcttccggccgatcgtgatgacctcggcggcgtttctgctcggcgtcgtgccgctggtggtgtcgagcggcgcgggcgccgaaagccgtcgctcgatcggcaccggcgtattcggcggcgtgctggcagccacgctgttcgggctggtattcgcgccggtcgcattccatgcggtcgcgtcgctcacgcacggccggcgccggcttgcgcaactgcatcgcaagcgcgaggagcggcggttgcgccgtgccacgatcgaacgcgcgccgctcgacgaatcgccgacggcctga

SEQ ID NO: 74569 - protein, 1068 aa, Burkholderia fungorum LB400
MPFFFIDRPVFAWIVALAIVVAGALAIPQLPVSQYPRLAPPRIVISATYPGASTEVVDANVGSIIEESLDGADNMLYYETTSDSLGELEIDATFAPGTNPDLALVDIQNRLKQVEPRLPQQVVQQGISVFKAANTFLMLVALTSTDGTRDSVQLSDYLSRYVLRELKRAPGVGSAQLWDADEALRIWLDPMKLREYGLGAAEVNAAIAAQNATVTAGTLGDAPFVPGQQLTASVSVKGQLISPAEFGQIVLKARPDGSAVRLRDVARVEVGRDNYSFYSRLNGKAAATVGIQLGPRGNALETSNAIRARLAALSKGLPSGVSIEIPFDNAHFVQIAIHEVLVTLAEAVVLVFFVMWLFLRDLRYTLVPTVVIPVTLMGAFLAMYACGLSINVFTLFGLVLAIGILVDDAIVVVESVHRVMEEEGLPPREATRKAMSQIGGAIVGVTAVLTAVFVPMAFFPGGVGGIYRQFAVAMIASMLVSSFMALSLTPALCANLLKAHTQSVRQRDARRGVLGFAARAASRFTSGFDRAARGYRGLTARTLRRIGPMLAVYAVLVGVCGLLYWQMPGGFLPSEDQGQLQVMVQLPAGATQARTLAVVERVEKILHAEPAIANVTSVIGWSFSGSGQNVAMGFVELKDWGKRDVDALALRDRLNAKFDRILDGNVEAQLPPSVPGVGHSDGFVFRLEDRGGVGLDALKAAREQLFTQARASPVLASVHSEDLPDAPRVELIVDRAKAYALGVSFDRIADVLGSTFGSTYIDDFPAGGRMRRVMIAADAATRMTEDDLLALAVPNATGGMVPLSAIATRQWTIGPVMLTRYNGYPSLDVSGHAAPGYSSGAAMAEMERLAAALPVGVQYDWVDAAREETAAAKLTPLLIGLSLLAVFMALAALYESWTIPLAVLMVVPLGVIGAVAAVLLRGMPNDVYFKVGMITVIGLAAKNAILIVQFARDLHQRGLPLTRAVAEAAGARFRPIVMTSAAFLLGVVPLVVSSGAGAESRRSIGTGVFGGVLAATLFGLVFAPVAFHAVASLTHGRRRLAQLHRKREERRLRRATIERAPLDESPTA

SEQ ID NO: 74570 - DNA, 3126 bp, Magnetococcus sp. MC-1
  CDS (1)..(3126)
atgatgtcgagtttctttattgaccgtccggtttttgcctgggtgatcgccattgtcattatgctggctggggtcttgtccattttacgtctgccggtggagcagtaccctaacattgcgccaccctcagtctccattaacgccagctatcctggtgcttcggctgagaccctggaaaatagcgtcacccaaattattgagcagagcctgacgggcattgaccatatgcgctatttctcctccagcagcgatgcttcggggatggcgagtattaccatcacctttgagcccgaggcggacccggacaccgcacaggtgcaagtgcagaataaacttcaggcggccatgccgctacttccccccgaagtgcagcagcagggggtgagtgtcaccaaggccaacaacagctttttgatggtggccggtttttattcggaggatggttccatctcccagatggagctgggggatatgctcaactccaaggtgaaagatgccattgcccgagttaatggggtgggtagtgtgaccatctttggcgagccccatgccatgcgaatctggctggatccacgcaaactgtttagctacaacctcacggtcatggatgtgcaacaggccattcgtgcccaaaacagcgatatttccgccggtcaattgggcggcctgcctgcgcgcaagggacaacagctcaacgccaccatcaccgcccaatcgcggttgcaaagcgtggaggattttcaacgcattttactgcgtgtcaataccgacggctcccaggtgcggttgcaggatgtggctcgggtggagctgggggcccaaagctatggtcgggtggtgcgctacaaacgtttgcccgcagcgggtgtggcggtaagcttggcctctggggccaacgccttggataccgcagcagcggtcaaggcgcggattgcagaactgtcacagaccctgccggccaaggttaaaattatttatccctatgacacgaccccctttgttaagctctcgatcaaagaggtgatcaaaacgctggtggaggccgtgtttttggtgtttgtggtgatgtttttgtttttacagaactttcgcgctacccttatccccaccatcgcggtgccggtggtgctgttaggcacctttggggtgctgtcagcctttggtttttccatcaacgtgttgaccatgtttgccatggtcttggccattggtttgttggtggatgacgccattgtggtggtggaaaacgtcgaacgcattatggagcatgaagggctctcgccccgtgaggctacccgtaaatccatgcagcagatcaccggcgcattggtggggattgccttggtgttgtcggcggtgtttgtgcccatggcattcttcagcggctcagcgggggcgatctatcgccagttttctatcaccattgtctcggctatgaccctctcggtggtggtggcgttggtgctttcgccctcgttgtgtgcaacctttcttaaacccgccgtaaagggggagcatagtcacggattttttggctggtttaaccgtacgtttaatgctggacgggagcggtttgtgaccagcgcgggctatattgccgcccgagtgggtcgctttacgctgatctatgggctgctggtggggggcatgctctatctgtttatgggtctgcccagctcctttttgcccaacgaagatcaaggcaccatgtacctcatggccagtgcccctgcgggctccaccgtggaacgtaccatggagagtgtggagcagattgaggactattttctcgaacatgaaaccgagaatgtgcgacatctatttactgtaaccgggtttagctttgcgggacgggcgcaaaatgtggcgctgggttttgtggggctgcgggattggagcgagcgcagccgtaaggatcaatcggtatttgccctgtcgggacgggccatgggggcctttgcgggcattaaagatgcccgtgcctttgccttttatccccctcctatccgtgagctgggtaatgcggcaggctttgacgtgcagctggtggatcgggccggtttggggcatgcaaaattgatgcaggcccgcaaccagcttttggggatggcggctaaaaatcccaaactccagggggtgcgtcccaatggcttgaacgatgttccccaattcacggtggatattgatcatgaaaaagccagcgccctagggctctccatcgccgatattaaccagaccttgcaaaccgcttggggatcggcctatgtcaatgattttctggataaaggtcgtataaaacgggtttatattcaaggggatactccctaccgcatgatgcccgcagacctggaccaatggtatgtgcgcaatacccagggcaagatggttccattcgcggctttttccacgtctcggtggagctatggcgcacccaagctggagcgctttaatgggagtggctcggtcaatattcagggctccgctgcccccggcgtgagtaccggtaccgccatgcaggagatcgaacagatgctccagaagctgcccgctgggattggcttggagtgggttggactctcctacgaagagcagcgctcgggtgcgcaagcgccgatcctgtacgcggtatccatcttgtttatctttttgtgtctggcggcgttgtatgagagctggtcggtgcccttttccgtcatccttagtgtcccgctggggattttgggtgcggtgttggcggccaaaagctatggtttgaacaatgatgtctactttcaggtaggtctgcttaccaccatgggtttggcttccaaaaatgccattttgattgtggagtttgctaaaaaacagtatcaggctggcatggacctccggactgctaccctgatgggggccaaacagcgttttcgccccattatcatgacatccatggccttcgttttgggggtatccccgttggccgtggccaatggagccggttcggccagccaaaacgccatcggtattagcgtggtgggggggatgctggcggcgacctttattgcgatcttttttgtgccgatgttctatatgggcatacaacgcctcgcgcgcgccccagaacagctcaagcaggaggttgctccgtga

SEQ ID NO: 74571 - protein, 1041 aa, Magnetococcus sp. MC-1
MMSSFFIDRPVFAWVIAIVIMLAGVLSILRLPVEQYPNIAPPSVSINASYPGASAETLENSVTQIIEQSLTGIDHMRYFSSSSDASGMASITITFEPEADPDTAQVQVQNKLQAAMPLLPPEVQQQGVSVTKANNSFLMVAGFYSEDGSISQMELGDMLNSKVKDAIARVNGVGSVTIFGEPHAMRIWLDPRKLFSYNLTVMDVQQAIRAQNSDISAGQLGGLPARKGQQLNATITAQSRLQSVEDFQRILLRVNTDGSQVRLQDVARVELGAQSYGRVVRYKRLPAAGVAVSLASGANALDTAAAVKARIAELSQTLPAKVKIIYPYDTTPFVKLSIKEVIKTLVEAVFLVFVVMFLFLQNFRATLIPTIAVPVVLLGTFGVLSAFGFSINVLTMFAMVLAIGLLVDDAIVVVENVERIMEHEGLSPREATRKSMQQITGALVGIALVLSAVFVPMAFFSGSAGAIYRQFSITIVSAMTLSVVVALVLSPSLCATFLKPAVKGEHSHGFFGWFNRTFNAGRERFVTSAGYIAARVGRFTLIYGLLVGGMLYLFMGLPSSFLPNEDQGTMYLMASAPAGSTVERTMESVEQIEDYFLEHETENVRHLFTVTGFSFAGRAQNVALGFVGLRDWSERSRKDQSVFALSGRAMGAFAGIKDARAFAFYPPPIRELGNAAGFDVQLVDRAGLGHAKLMQARNQLLGMAAKNPKLQGVRPNGLNDVPQFTVDIDHEKASALGLSIADINQTLQTAWGSAYVNDFLDKGRIKRVYIQGDTPYRMMPADLDQWYVRNTQGKMVPFAAFSTSRWSYGAPKLERFNGSGSVNIQGSAAPGVSTGTAMQEIEQMLQKLPAGIGLEWVGLSYEEQRSGAQAPILYAVSILFIFLCLAALYESWSVPFSVILSVPLGILGAVLAAKSYGLNNDVYFQVGLLTTMGLASKNAILIVEFAKKQYQAGMDLRTATLMGAKQRFRPIIMTSMAFVLGVSPLAVANGAGSASQNAIGISVVGGMLAATFIAIFFVPMFYMGIQRLARAPEQLKQEVAP

SEQ ID NO: 74572 - DNA, 3114 bp, Geobacter metallireducens GS-15
  CDS (1)..(3114)
atgagcatcgccgaggttttcatccggcggccggtcatgacgagcctcgtcatgctggctgtcatgctcttcggtctcctcgcctacagcaagctgccggtcaacgaccttcccaccgtcgactatccgaccatccaggtttccgccagccttcccggcgccaaccccgacaccatggccgcgtcggtggcgctccccctggagcgggagttctcaaccatagccggcgtggactccatgaactccaccaacggtctcggaacgtcccgcatcaccatcaaattcaccctggagcgcgacatcgacgccgccgcccaggatgtccaggcagccatctcccgggcccaacgccagctcccccaagacatgccggctccaccgtcgttccagaaggttaacccggcggaccaggcagttctctatctggccctcagctcgccgacgcttcccctgtcaacggtcaatgactatgccgaagccatgatcgcccagcggatttccatggttaacggcgtggcctcggtgcaggtcaacggttcccagaagtacgcggtgcgggtccaggtggaccccaaggcgcttgcggcccgcaagatcggcatcgacgaggtggcccaggccctggagcgcggaaacgtgaacctccccaccggcaccctccagggaaagcacgaggccctaacgatccagaccagcggccagctctatagcgccaaggagtatgagccgctcatcgttgcctaccgcaacggttcgccggtccgcctcggggagatcggcaaggtcatcgacagtgtggagaacgacaaggttgccggctggtacaagcagacccgcgccatcatcctcgccatccagcgccagcccggcaccaacaccatcgaggtggtgaaccgtatcaaggagctgattccccacttccgctcgcaactccccgcctcggtggacctgaacatccttttcgaccggaccggggggatcaaggagtcggtggccgacgtgaagttcaccatgatgctcaccatctgtctcgtcatcctggtgattttcctctttctgcgcaacctccccgccacactgattccgagcctcgccctgccactctccatcgtcggagccttttcagccatgtacctgatggggttctcggtcaacaacataaccctcatggccctgaccctttcggtgggcttcgtggtggacgacgccattgtcatgctggagaacatcgttcgacacctggagaagggagaggaccccagggaggcgtcgttgcgcggctcccgggagatcggcttcaccattgtctccatgaccatttcgctggtggcggtcttcattccggttctcttcatgcaggggatgctcggtcggctcctccacgaattcgccgtcaccatcagcctagcgatcctcatctccggtttcgtttccctctcgctcacccccatgctctgcagccgcttcctccgtccccatggcgagcagcgccacggccggttctacaatttcatggagcgcttcttcaacggcatgtaccgcttctatgaagtgaccctggcgcgagtcctgaggcttcgccggacggtgctggccggcacgctggtcttgacgctcctcaccatctggctctttaccaaggtacccacgggcctgttgccgagcgacgacatcggtgccatcttcgccatgaccgaaggggcccagggaatctccttcgaggagatgaaggccaagcagcagcaactggcggccatcgtgctccaggacccgaacgtggaggcgttcatgtcgacggcgggcgccagcgggagccgtgtgtcgtccaactcgggtttcatgttcatccgcctcaagccccgccaggagcggaagctgaacgccgatcaggtgattcagcagttgcgtcccaaggtaatgggggtgccggggattgtcatgttcctccagaacccgccgccgatccgcctggaggcccggctggcgaaaagccagtaccagttcgtgctccagagccccgacaccgaggatctctacgcgcgcgcggccgaactggaggcaaagctgaagcaggtgccgttgctgctggacgtgacgagcgaccttcagcttcagaatccacaggttcagctggacatcgaccgggacaaggcatcggccctcggggtcaccgcccatcaggtagaggacgcactgtactacgcctacggtgcacggcaggtcaccaccatcttcgcccccgacaatcagtataaggtgattctggaactggagccccaatatcagaccgatcctacagccctctccatgctctacatccgctcccagaagggggatctggtccccctgaatacgctggcaaacctgcggcgcaccctcggccccctgtcggtgaaccatctggggcagatcccggcggtgaccatctccttcaacctgcggcccgacacccccctgagcgaggcggtgtcagccatcgaaaaggtgagccgcgagacgcttcccgccaccttcaccacaagcttccagggggttgcccaggcctatcagcagtcaaccacggggctcacggttctgattatcatggcgattgttgttatctacatcgttctcggcatcctctacgagagctacatccatccgatcaccatcctgtcgggattgccttcagccggtttcggggcgctgatcaccctcatgattttcggcaaggagctgaacctctatggtttcgtgggccttatcatgctgatcggcatcgtcaagaagaacgccatcatgatgatcgacttcgcgctggaggcccagcgcagtgaagggatgccccccctggaggcgatccaccaaggcgcccttgtccgttttcgtcccattatgatgaccaccatggcggctctcatgggaacccttcccattgccctcggcatcggggcaggggccgaggcccggcgcaccctcgggctttcagtcgtgggggggcttgtcgtgtcgcagctgctgaccctctacatcacgccggtcatctactactatatggatcgcatgcaggagtgggtaaagacgcgtttcgggatcgggcagagttcccgaaaggagcgacagtcggcagggtag

SEQ ID NO: 74573 - protein, 1037 aa, Geobacter metallireducens GS-15
MSIAEVFIRRPVMTSLVMLAVMLFGLLAYSKLPVNDLPTVDYPTIQVSASLPGANPDTMAASVALPLEREFSTIAGVDSMNSTNGLGTSRITIKFTLERDIDAAAQDVQAAISRAQRQLPQDMPAPPSFQKVNPADQAVLYLALSSPTLPLSTVNDYAEAMIAQRISMVNGVASVQVNGSQKYAVRVQVDPKALAARKIGIDEVAQALERGNVNLPTGTLQGKHEALTIQTSGQLYSAKEYEPLIVAYRNGSPVRLGEIGKVIDSVENDKVAGWYKQTRAIILAIQRQPGTNTIEVVNRIKELIPHFRSQLPASVDLNILFDRTGGIKESVADVKFTMMLTICLVILVIFLFLRNLPATLIPSLALPLSIVGAFSAMYLMGFSVNNITLMALTLSVGFVVDDAIVMLENIVRHLEKGEDPREASLRGSREIGFTIVSMTISLVAVFIPVLFMQGMLGRLLHEFAVTISLAILISGFVSLSLTPMLCSRFLRPHGEQRHGRFYNFMERFFNGMYRFYEVTLARVLRLRRTVLAGTLVLTLLTIWLFTKVPTGLLPSDDIGAIFAMTEGAQGISFEEMKAKQQQLAAIVLQDPNVEAFMSTAGASGSRVSSNSGFMFIRLKPRQERKLNADQVIQQLRPKVMGVPGIVMFLQNPPPIRLEARLAKSQYQFVLQSPDTEDLYARAAELEAKLKQVPLLLDVTSDLQLQNPQVQLDIDRDKASALGVTAHQVEDALYYAYGARQVTTIFAPDNQYKVILELEPQYQTDPTALSMLYIRSQKGDLVPLNTLANLRRTLGPLSVNHLGQIPAVTISFNLRPDTPLSEAVSAIEKVSRETLPATFTTSFQGVAQAYQQSTTGLTVLIIMAIVVIYIVLGILYESYIHPITILSGLPSAGFGALITLMIFGKELNLYGFVGLIMLIGIVKKNAIMMIDFALEAQRSEGMPPLEAIHQGALVRFRPIMMTTMAALMGTLPIALGIGAGAEARRTLGLSVVGGLVVSQLLTLYITPVIYYYMDRMQEWVKTRFGIGQSSRKERQSAG

SEQ ID NO: 74574 - DNA, 3135 bp, Geobacter metallireducens GS-15
  CDS (1)..(3135)
atgatttcccagttcttcatcgaacgtcccatcttcgccaacgtcatcgcgctggtcacggtcatcatcgggctgatcttcctgaatcgcctgccagtggcccagtacccccagatcgtgcccccgaccatacaggtgaccgcgcgctaccccggcgcaagcgcggaggttgtcgcggcgaccatcggagtacctatcgaacaggcggtgaacggcgtggaaggctccatctacatgtcgtccaccagcgggagtgacggctcctataacctgaccatcaccttcgatgtcggaaccgacctcaatacctccctggctcttgtccagaacctggtaaacacctccctggcccaacttccgggcggggcgcagcagcagggagtcaccgtaaaaaaagtctcgcccaacatcctgctggtggccagcctctatgcggacgatgagagattcgaggagatcttcctctccaactatgccgtcataaacctgcaaaacccgctggccaggctccccggcgtcggccaggtgcgggtattcggcgctggtccctacagcatgagggtctggctcgacgccaagagactccagagcttcgacctcaccacaagcgacattctgaccgccatccagagacagaacgtccaggtggtggcgggacagctcggggccccgccggttccggcgagccagagtttccagttcaccgttaccacccttggccggctctctgatgtggggcagttcgaagatatcgtcgtcaagaccgcaaccggcccggctccgcaggtggtgcggctgcgagacgtggcacgggtggatctgagccagcagaacttcagcaattacgcccggttcaccggccacaaatcagcccagatcgtggttttcgcccttccggacgccaacgccatcgatgtggccgacagcgtttacaaggccctggacgggatgagcaagaaattccccgacgggatgaaatacgccatccgctacgacaccaccaagtttgtcagggaggcgatctccagcgtctacgacacactcttcatagccgcattcctggtgctcttcgtcatcctcctgttcctgcagaacatcagggcgatgctggttccggccaccactgtgccggtcaccatcattggcgcctttatcgccatggccggactcggtttcacgatcaacctgatgaccctgttcgcgctggtgctggtcatcgggatcgtggtggacgacgccatcgttatcgtggagagcagttcatactatatcgaaaaggggcttgccccgaaggaggccaccatcaaggcgatgcgggaactgaccgggccggtgatggggattacccttgccctggtcgcggtcttccttccggcggccttcttcccgggaatcaccgggcagatattccgccagttcgccctggtaatcgcctcaacggccgtgatcagcgccatcaacgcacttaccctgaagccggtccagtgcgccttgtggctgaggccgcgcggggaaaagcggcctaactggttctaccggggattcaaccgggcgttccagtccttcaccaatgtctacattgggatcgtcgcccggatggtgaaacggccggtcctgttcgttgtcattttcgccatcatcgtcacaacctctttcctggtattcataaatcgccccctcggctttctccccaccgaggaccagggttacggcgtcctggtgtcccgcatccccgaaggggcctcacagcccaggtcggagaaggtggcggtgcagatcaacgagattctcaaaaagacctccggtgtcgacttctgggtccacatcggcgggttgtcgatcctggatggtgccaacgtctcaaacatgtccaccaccttcgtcgtttacaaagactggagcgagcggggctccgccctgaaccaggacaggatcatagcgagcatcaatcgccagcttgccgagatccaggaggcacaggcgtttgtggtcatccctccgccgatccggggcctcggtcagactggcggtttccagatgatggtggaggatcgggggagcgtcggtcttgaacggctcaaggatgccgctgacgagctgatgcggagcggcaactcacagcctaacctgaagggcctcgcctccaccttcagcctaagcagcccccaattgtacctggatatcgacaggaccaaggcggaggccctcctggtgcccctgtcgaatgtcttcgagaccctccaggcatacctcggttcctcgttcgtgaacctcttcaacaaatacaaccaggtcttccaggtctatattcaggccgacagcccttaccgcatcaggcccgaggacataggaaaactctatgtgcgcaaccaacggggggagatggttcccctcggcgccctgattaatgtcaggcagacccagggccccgaactgataacccggtacaacctctacccggccgccgccattttcggctctgccgcccccggcttcagctccggtcaggccctgactctgatggagaggatggccgccgaaaagctccctgaggggattgacttcgattggacctccaccagcttccaggaaaagaaggtgggcaaacaagcctacttcatctacgccctctccgtcatcctggtctacatggtcctggcggccctgtacgaaagctggacttcgcccgcagcgatcattctcgtggtcccgatagcgctggtcggagtccttctggccctcatcatccggggctacgacaacaacctctatacccaggtggggctggtgctgatgattgcactggcgagcaaaaacgccatccttatcgtggaattcgcccgcgacctccaccacggagggatgtccatagccgaggccgccatcgaggcaacccgccgccggttccgtccgatcgtcatgacctcgttcgcgttcatcctgggagtcgttccgcttgtggtcgcgttcggagcgggttcggcgggccaacgtgccatcggctctgtcgtcttcgggggcatgatctcctccacccttctcgccatcccgttcgttccggtgttctatgtggtcctggaacgtatgagtgaatgggtgggcaattggcgttcgaagaggaccctgcgtcgataa

SEQ ID NO: 74575 - protein, 1044 aa, Geobacter metallireducens GS-15
MISQFFIERPIFANVIALVTVIIGLIFLNRLPVAQYPQIVPPTIQVTARYPGASAEVVAATIGVPIEQAVNGVEGSIYMSSTSGSDGSYNLTITFDVGTDLNTSLALVQNLVNTSLAQLPGGAQQQGVTVKKVSPNILLVASLYADDERFEEIFLSNYAVINLQNPLARLPGVGQVRVFGAGPYSMRVWLDAKRLQSFDLTTSDILTAIQRQNVQVVAGQLGAPPVPASQSFQFTVTTLGRLSDVGQFEDIVVKTATGPAPQVVRLRDVARVDLSQQNFSNYARFTGHKSAQIVVFALPDANAIDVADSVYKALDGMSKKFPDGMKYAIRYDTTKFVREAISSVYDTLFIAAFLVLFVILLFLQNIRAMLVPATTVPVTIIGAFIAMAGLGFTINLMTLFALVLVIGIVVDDAIVIVESSSYYIEKGLAPKEATIKAMRELTGPVMGITLALVAVFLPAAFFPGITGQIFRQFALVIASTAVISAINALTLKPVQCALWLRPRGEKRPNWFYRGFNRAFQSFTNVYIGIVARMVKRPVLFVVIFAIIVTTSFLVFINRPLGFLPTEDQGYGVLVSRIPEGASQPRSEKVAVQINEILKKTSGVDFWVHIGGLSILDGANVSNMSTTFVVYKDWSERGSALNQDRIIASINRQLAEIQEAQAFVVIPPPIRGLGQTGGFQMMVEDRGSVGLERLKDAADELMRSGNSQPNLKGLASTFSLSSPQLYLDIDRTKAEALLVPLSNVFETLQAYLGSSFVNLFNKYNQVFQVYIQADSPYRIRPEDIGKLYVRNQRGEMVPLGALINVRQTQGPELITRYNLYPAAAIFGSAAPGFSSGQALTLMERMAAEKLPEGIDFDWTSTSFQEKKVGKQAYFIYALSVILVYMVLAALYESWTSPAAIILVVPIALVGVLLALIIRGYDNNLYTQVGLVLMIALASKNAILIVEFARDLHHGGMSIAEAAIEATRRRFRPIVMTSFAFILGVVPLVVAFGAGSAGQRAIGSVVFGGMISSTLLAIPFVPVFYVVLERMSEWVGNWRSKRTLRR

SEQ ID NO: 74576 - DNA, 3162 bp, Geobacter metallireducens GS-15
  CDS (1)..(3162)
atgtcccgctttttcataaacagacccatctttgcctgggtaatcgccatcatggtcatgctggccggcctcctggcgatcaagaccctgccggtctcccaataccctcccatcgcaccaccccagatcaccatcaacgccatgtatcccggcgcctcggcccagacggtgcaggatacggtaacccaggtgatcgagcagaagctgaacgggatcgacaacctgatctacatgtcctccaccagcgattcggccggcgccgtggccatcaacctcaccttcaaggccggcaccgacccgaacatcgcccaggtgcaggtgcagaacaagctgcagctcgccacgccgctcctcccccagatcgtccagaaacaggggattcaggtggtcaagtccaccaagaacttcctcctgatcgtcggggtcgtgtcggaggacggctccatggaccgcccggccctgaccgactatctggttgccaacgtccaggacgtcatcagcaggacggaaggggtcggcgaggtaacggtcttcggctcccagaacgccatgcggatctggctcaacccggccaagctcaacaactaccacctcaccaccaacgacgtcatcgcggcggtgcaggcccagaacgcccaggtgtcagccggccagttcggcgggaatccggcgcccccgggacagcagttgaacgccaccatcacggcccgcaccctcctccagacaccggagcagttcaacgccatcatcctgaggaccaaccccgacggttccacggtcaggctgaaggatgtggccgaatgtaagatcggcaccgagaattacgatatcgaagcacggtacaagggaaaaccgatgggggggatggcgctgcgcctggccgcgggcgccaacgccctggacaccgccgaccgggtcaaggcgaagatggcggaactgtcgaaatacttccccgccggcatggaggtggtctacccctacgacaccacccccttcgtcaaggtctccattgaagaggtggtccagaccctgatcgaggcggtcttcctcgtcttcatcatcatgttcctcttcctgcagaatatccgggccaccctgatccccaccatcgccgttccggtcgtcctgctcggcaccatgggggcgttgtcggccgccggcttctccatcaacaccctgaccatgttcgccctggtcatcgtcatcggcctcctggtggacgacgccatcgtcgtggtggagaacgtggaacggatcatgtccgaggaggggctctcgccccacgacgccaccgtcaaatccatggggcagatcaccagtgccctctgggggatcgccaccgtcctctcggcggtcttcctccccatggccttcttcggcggctccaccggcgtcatctaccgccagttctccatcaccatcatctccgccatgattctctcggtgatgacggcccagattctgacgccggccctctgctccaccctgctcaagccggtggagaaggggcatgaggcgtgcgagactggctggttctgcggtttcttccgctggttcaacaaatgcttcaactggtgccggggcagatacgaagggatcgtcggccgttcattcggcaagccggtgcgctacctggtgatttacggggtcatcgtggcggccatggcgttcttcttcctgcgccttcccaccgcattcctccccgacgaggaccaggggttcatcgtctgccaggtccagctccctgcaggggctgcccaggagcggactatcacagtgctcgagcagcttgaacaccacttcctggagaaggagaagaagtcggtggagacgatcattaccattgccggcttcagctttgccggccggggccagaacatggggcttgcctttgtcaggctcaaggactggaagctgcgcccgacccccgacatgaaggcgccggccgttgccggacgggccatgaaggctttctcgcagatccgcgacggcctcgcctttgccttttcaccgccggcggtggtggagctggggcaggccaacggcttcgacttccagctgcaggaccgtgccggccttggccatgagaagctgatggaggcccgcaaccagctcctcggcatggccatgaagaaccccaagctgatcgcggtgcgccccaacgggcaggatgattcgccccagttcaagctcgacattgacgacgtgcgggccggggccctgggggtcaacctggccgatgtcaacagcgtactggccacggcctggggaagctcctacgtcaacgacttcatcgagaacggtcgggtgaagaaggtctatctccaggctgaacccaggtcccgcatgctgccggaggacatcaacagctggtacgtgaacaacagaaacggcgagatggtccccttctcggccttcgccaccgcccactggaagtacggctcgccccggcttgagcgttacaacggcattccgtccgtggagatcatgggacaggcggcgcccggggtgagcaccggcgaggccatggtcgagatggagaagatggcggcccagcttccgccgggcatcggttacgagtggaccggactctcctacgaggaaaaacaggccggcaagcaggcgcccgccctctacgccatctcgctcctggtggtgttcctctccgtggcggccctctacgaaagctggaccatccccttcgtcaacctgctgatgcttcccctcggcctggtgggggcggtcacggcggtgaagctgcggatgcttcccaacgacgtctatctccagatagggcttctcaccaccgtgggcctgtcgacgaagaacgccatcctgatcatccagttcatcaaggaccagatgcaccaggggcatgaactggtggaggcgaccctgacggcggtgaagatccgattgcggccggtcatcatgacctcactggccttcttcttcggcaccctgccgctggcactcaccaagggggccggggccgcggcccagaacgccatcggcaccgccgtgaccggggggctgctttcggctaccttcatcgacttgatcttcatcccgttcttcttcgtgatggtgtcgaaggtgtttgccaagaaaaagcagccttccgttcagccggccgctgaagcagcgtcggaggtgaattga

SEQ ID NO: 74577 - protein, 1053 aa, Geobacter metallireducens GS-15
MSRFFINRPIFAWVIAIMVMLAGLLAIKTLPVSQYPPIAPPQITINAMYPGASAQTVQDTVTQVIEQKLNGIDNLIYMSSTSDSAGAVAINLTFKAGTDPNIAQVQVQNKLQLATPLLPQIVQKQGIQVVKSTKNFLLIVGVVSEDGSMDRPALTDYLVANVQDVISRTEGVGEVTVFGSQNAMRIWLNPAKLNNYHLTTNDVIAAVQAQNAQVSAGQFGGNPAPPGQQLNATITARTLLQTPEQFNAIILRTNPDGSTVRLKDVAECKIGTENYDIEARYKGKPMGGMALRLAAGANALDTADRVKAKMAELSKYFPAGMEVVYPYDTTPFVKVSIEEVVQTLIEAVFLVFIIMFLFLQNIRATLIPTIAVPVVLLGTMGALSAAGFSINTLTMFALVIVIGLLVDDAIVVVENVERIMSEEGLSPHDATVKSMGQITSALWGIATVLSAVFLPMAFFGGSTGVIYRQFSITIISAMILSVMTAQILTPALCSTLLKPVEKGHEACETGWFCGFFRWFNKCFNWCRGRYEGIVGRSFGKPVRYLVIYGVIVAAMAFFFLRLPTAFLPDEDQGFIVCQVQLPAGAAQERTITVLEQLEHHFLEKEKKSVETIITIAGFSFAGRGQNMGLAFVRLKDWKLRPTPDMKAPAVAGRAMKAFSQIRDGLAFAFSPPAVVELGQANGFDFQLQDRAGLGHEKLMEARNQLLGMAMKNPKLIAVRPNGQDDSPQFKLDIDDVRAGALGVNLADVNSVLATAWGSSYVNDFIENGRVKKVYLQAEPRSRMLPEDINSWYVNNRNGEMVPFSAFATAHWKYGSPRLERYNGIPSVEIMGQAAPGVSTGEAMVEMEKMAAQLPPGIGYEWTGLSYEEKQAGKQAPALYAISLLVVFLSVAALYESWTIPFVNLLMLPLGLVGAVTAVKLRMLPNDVYLQIGLLTTVGLSTKNAILIIQFIKDQMHQGHELVEATLTAVKIRLRPVIMTSLAFFFGTLPLALTKGAGAAAQNAIGTAVTGGLLSATFIDLIFIPFFFVMVSKVFAKKKQPSVQPAAEAASEVN

SEQ ID NO: 74578 - DNA, 3135 bp, Novosphingobium aromaticivorans DSM 12444
  CDS (1)..(3135)
atgatttcgcgcttcttcgcccaccgcccgattttcgcctgggttcttgccatcgtcatcatggcggcgggcctgttcgccgtcagcaccatgggcgtggaacagtaccccgacatcgccccgcccaccgtctcgatcaatgcgacttatggcggcgccgatgcctctaccgtcgagaacagcgtcacccaggttctcgagcagcaactcaagggcctcgacggcctgctctatttcaattcgaactcgtccaacgggtcctcccagatcaccgtcaccttcgacaagggcaccgatcccgataccgcccaggtccaggtccagaacgccatctcgcgtgcggtcagccggcttccggcggtggtccagcagcagggcgtgaacgtcaacaagtcgcaatccgacatgctgatggtggtgtcgatctatgacaagaccgggcgcacgaccaacgcggatatctcggattacctgtcgacccacttccaggaccccatctcgcgcgtcgaaggcgtgggcaacgcgcagatatttggcgcgtcttatgcgatgcgcatctggctcgatccgctgcggcttgccgcggtccagctcatgccttcggacgttgtaaccgcactccaggcccagaacacgcaagtcgctgcgggcgagatcggcgcgaaccccgcgcccgacgggcagcgcctcaacgccacggtcaccgcgcgctcgcgcctccagacgcccgaggaattcgagaacatcgtcgtcaagacgcaggtcgatggctcggtcgtgcgcctgcgcgacgttgcccgggtggagatgggcgaggaaagctacggttcgatcagccgtttcaatggcatgccggcaaccggcctgtcggtcagcctcgcttcgggcgcgaacgcgatgaagaccgcgcagctggtcaaggataccgtggccgagctgtcgaaggatctgcccgccggatacgaagtggcctatccacgcgacagcagcactttcgtcaagctatccatcgaagaggtcgtctggtcgcttggcgaggcgatcgtgctggtcgtgatcgtgatgttcgtgttcctgcaaagctggcgcgcgacgctgatcccggcaatcgcggttccggtcgtcctgcttggtactttcggcgtgctgtcgcttgccggctatacgatcaacacgctgacgatgttcggcatggtccttgccatcggtctgctggtcgacgacgccatcgtcgtcgtcgaaaacgtcgagcgcgtgatgcacgaagaagggctgtccccgctcgacgccacggtcaagtcgatggacgagatcacatcggcgctcatcggcatcacgctggtgctgacggcggtattcgtgccgatggcgtttttcggcggctcgaccggcgcgatctatcgccagttctcggtcacgatcgtttcggccatgacactgtcggtcctcgtcgcgctggtcttcacgcccgcgctttgcgccacgctgctcaagccggttgcggaacatgaaaagcctggcggtcgcttcttccgcaggttcaacgatggctatgccaatctcgaggggcgttaccgcacccgccttgcccgggtcgtcgggcggccgctgccgtggatgatggtctttgcggggatcacgctgggcatggtcctgctctacgtgcggctgccgaccagcttcctgcccgctgaagaccagggcaacctctcgatcagctaccagcttccggtcggctccacctcggaacagacccgcgccgtagccaaccagctttcggactatatccgcacttcggaaaaggaggacgtgaaagccgtgttcgtggtgatgggccggggccaggcgggttcggcgcagaatgccgggcaaggcttcatcctgctcaaggactggtcggaacgttccggcaaggaacacagcgcggccgccatcgccgagcggcttaatgcctatttccgcaagtcccgggatgcgcagatcttcgtgctcgatccaccgccgatccgtggccttggcagttccggcggtttcgagatgtggcttcaggacgcgctgggggcgggccgtgatgcgctgaccgccgcgcgtcgccagcttaccaagctggctggcgaggacgagcgcctggcgcaagtccgcctgtccgggctcgaggacacgccgcagctcaaggtcgacattgatgacgatgcgctgacggccttccagatcagtccggcaagcgcgaactcgacgttatccatcgcctggggcgggctttacgtgaacgacttcgtcgaccgggggcgcgtgaagcgcgtctacgtccagggcgatgctccctatcgcaacgaaccgtcggatctgggccagtggtttgtgcgcagcaatggcgggcagatggcgccgttctcggccttcgcctcttcacactggacacaagggccggtccggctcgaccgcttcaatggcgttccggcgcagcaattgcagggcagcggcgctcccggcgtcagttcgggcgatgcgatgaagatcatggaggacaacgcggcaaagctcgacggcaacttcagcgtggcgtggagcggcctgtcctatcaggagcgcgccgcttccagccagtcgctcctgctctacaccgcatcgatcttcttcatcttcctgtgccttgccgcgctctacgaaagctggtcggtgccggtcgcggtgctgctggtcatcccgctcggcatcatcggcgcggtccttgccgtgaccttgcgcggctacaacaacgacatctatttccaggtggcgctgctgaccaccatcggcctctcggccaagaacgcgatcctcatcgtggagttcgccgaagctgcgctggcgcgcggggtggaaccggtggcggcggcgctcgaaggcgcgcgacttcgcctgcgtccgatcatcatgacgagcgtcgcgttcatcgccggcgttatcccgctcgctattgccgacggggccggggccaacggtcgtcgcgccatcggcaccggcgtcatgggcggtatgctttcggcgacaattctggcgatcttcctcgtgccactgttcttcgtgctggtgaagggctggttccgccgcaagcccgccacgcccgtcgaaaccgtgggagagcccgcatga

SEQ ID NO: 74579 - protein, 1044 aa, Novosphingobium aromaticivorans DSM 12444
MISRFFAHRPIFAWVLAIVIMAAGLFAVSTMGVEQYPDIAPPTVSINATYGGADASTVENSVTQVLEQQLKGLDGLLYFNSNSSNGSSQITVTFDKGTDPDTAQVQVQNAISRAVSRLPAVVQQQGVNVNKSQSDMLMVVSIYDKTGRTTNADISDYLSTHFQDPISRVEGVGNAQIFGASYAMRIWLDPLRLAAVQLMPSDVVTALQAQNTQVAAGEIGANPAPDGQRLNATVTARSRLQTPEEFENIVVKTQVDGSVVRLRDVARVEMGEESYGSISRFNGMPATGLSVSLASGANAMKTAQLVKDTVAELSKDLPAGYEVAYPRDSSTFVKLSIEEVVWSLGEAIVLVVIVMFVFLQSWRATLIPAIAVPVVLLGTFGVLSLAGYTINTLTMFGMVLAIGLLVDDAIVVVENVERVMHEEGLSPLDATVKSMDEITSALIGITLVLTAVFVPMAFFGGSTGAIYRQFSVTIVSAMTLSVLVALVFTPALCATLLKPVAEHEKPGGRFFRRFNDGYANLEGRYRTRLARVVGRPLPWMMVFAGITLGMVLLYVRLPTSFLPAEDQGNLSISYQLPVGSTSEQTRAVANQLSDYIRTSEKEDVKAVFVVMGRGQAGSAQNAGQGFILLKDWSERSGKEHSAAAIAERLNAYFRKSRDAQIFVLDPPPIRGLGSSGGFEMWLQDALGAGRDALTAARRQLTKLAGEDERLAQVRLSGLEDTPQLKVDIDDDALTAFQISPASANSTLSIAWGGLYVNDFVDRGRVKRVYVQGDAPYRNEPSDLGQWFVRSNGGQMAPFSAFASSHWTQGPVRLDRFNGVPAQQLQGSGAPGVSSGDAMKIMEDNAAKLDGNFSVAWSGLSYQERAASSQSLLLYTASIFFIFLCLAALYESWSVPVAVLLVIPLGIIGAVLAVTLRGYNNDIYFQVALLTTIGLSAKNAILIVEFAEAALARGVEPVAAALEGARLRLRPIIMTSVAFIAGVIPLAIADGAGANGRRAIGTGVMGGMLSATILAIFLVPLFFVLVKGWFRRKPATPVETVGEPA

SEQ ID NO: 74580 - DNA, 3105 bp, Cytophaga hutchinsonii
  CDS (1)..(3105)
atgggtttgctggcaatcaaaacgctccctaaatcacagttcccggatattgcgccacctatgattgtggtatatgcatcgtatccgggagccagttcaacggtacttacaaattctgtacttattcctttagaacaggccatcaacggtgtgccgggcatgaaatacatgttcaccaccggtgccagttcaggtgaagccaacttacagattgtattcaacctgggtaccgatcccaatcaggcacttgtaaacgtacagaaccgtattgagcagatgaagatgcgtcttccgccgcttgtacagcttgaaggtattgttgtacagcgtttgatgccaaacatgcttatgtatgtgaacgtgtatggcagagatacttctaaagtcgatatgaagtatatcttcaactatacgtacatcaacatgctttcggaattacaacgtgtggaaggtgtaggtcttgcccgtatccttggtagccgtcagtattccatgcgtatctggctgaatccggatcggatgcgtgcttacaatatttcatccgatgaagttatgaaagccctggatgaacaaagtatcattggttctccgggaaggattggcagagcagacagtaaagcatcagaagccattgaatatgtattaacctatcccggccgatacgataaagaatctcaatacaacgatgtcatcatccgggctacaccggaaggtgaagttttacgactgaaagatgtagcgaccgttgagttgggtagtgagtattatgatatttattcgaataaagatgaattcccttctgccgctattacaattaaccaggcggccggaagtaatgcaacagaggtaattgaaaaccttaaagtaaaactggaagaacttaaaaagtctttcccgccgggcattgaatacgaaatcaactatgacgtttcaacattcctggatgcctcaactgaagaagtagtacataccttacgggatgcctttattcttgtatcaattgtggttttcatcttcctgggcgactggagatctaccatcattccggtattggccgttcccgtatcgttgatcggtgccttctttatgatgcagctgtttggtctgaacatcaaccttattacgctctttgcccttgtacttgctatcggtattgtggtggatgatgcgattgttgtggtagaagccgtgcacgcaaaaatggaagaaaagcattgttctccttatatagctgtaaaagaagtattgggtgagatcagtggcgccattatcgccattaccttattgatgacatcagtattcgtaccggtagcgtttatgaccggtccggttgggatcttcttcagacagttcgccatcaccatggcatcttctatcgttatctcaggtgttgttgccttaacgcttacaccggtattgtgtgcgatgatcttaaagaatacccacggccagccaagaaagaaaacaatgctgaacagattcattgacagcttcaacagggtctttgaaaaactgacaggcaaatacgttggcttattgcgcgtcattgcgaacagaaaaactgtaaccttcggtttgctgatcactttctctgtgttaacatttggtatcacccgtattcttccttccggtttcgtgccatccgaagatcagggtatgatctacgcggttcttcagaccccgccgggatcaacacttgaaagaacctatgaggtaagcaggcagttacaggaagcgtgtaaaaaagtgcacggcgtacaatctgtttctgcccttgcaggttatgagatcttaacacaaggtagaggctctaactccggtaccttgctgatcaacttaacgccatggaatgaaagacaccacacggttgtagagatcaccgaagaactggaagaacttaccaaagacattccgggtgcaaagatcgaattcttcggtccgccagctgtaccgggttatggtgctgccggtggtatcggtctgcaactactggataaaaatacagatattgattacgaacgtttagatggtgtgagcaagcagttcatgaaagaccttgaaaaacgaaaagaattaactgccctgttcacattctacagaacagattacccgcaatacgaattagaaattgataacaaactagccatgcagaaaggtgtttccattaagacagcaatggataatatctctatcatgatcggtagtacatacgacatcggtttcatcaaattcggccgtttctttaaagtgttcgtacaggcagatccttctttcagacggattcctacagacatcctgaaactctatgtaaaaaatgacaaaggtgaacaggtcccttactcttctttcatgtctatcaaaaaaacacagggtatctacgagatcaacagatacaacatgtacacgacctcttctatcagatgttctcctgctgccggatacagcagcggtgaagcaattgaagcaattaaagaagtagctgcagaaacattacctaaaggttatgacattgactggtcaggcttgcagaaagatgaagttggccgtggtaatgaagccgtttacattttccttatcgtattggtattcgtgtatctcgtacttgctgcacaatatgaaagtttcattcttccgatggttgtaatcttatccttaccagccggtattttcggagcattcttattgatcaaaactgccggtatggcaaacgacatttatggtcaggttgccctggttatgcttgttggtttgctcggtaaaaatgccgtgttgattgttgaatatgccgtaatgaaaaacaacgaaggcttaagcgtgctggaatcggctattgaaggtgcaaaggcacgtttcagaccaatccttatgacatcctttgcctttattgcaggtttgattccgttgattttcgcgcatggtcctggtgccattggtaacaaaacaatcggagcggcctctcttggaggtatgctattcggaacagtattcggtgtaatcattgtacccggattgtattacatattcggcagtattgctgaaggacgtaaaatgattaaagatgaagattttgatccattaagcgaagacaaaaaccaccatgtttaa

SEQ ID NO: 74581 - protein, 1034 aa, Cytophaga hutchinsonii
MGLLAIKTLPKSQFPDIAPPMIVVYASYPGASSTVLTNSVLIPLEQAINGVPGMKYMFTTGASSGEANLQIVFNLGTDPNQALVNVQNRIEQMKMRLPPLVQLEGIVVQRLMPNMLMYVNVYGRDTSKVDMKYIFNYTYINMLSELQRVEGVGLARILGSRQYSMRIWLNPDRMRAYNISSDEVMKALDEQSIIGSPGRIGRADSKASEAIEYVLTYPGRYDKESQYNDVIIRATPEGEVLRLKDVATVELGSEYYDIYSNKDEFPSAAITINQAAGSNATEVIENLKVKLEELKKSFPPGIEYEINYDVSTFLDASTEEVVHTLRDAFILVSIVVFIFLGDWRSTIIPVLAVPVSLIGAFFMMQLFGLNINLITLFALVLAIGIVVDDAIVVVEAVHAKMEEKHCSPYIAVKEVLGEISGAIIAITLLMTSVFVPVAFMTGPVGIFFRQFAITMASSIVISGVVALTLTPVLCAMILKNTHGQPRKKTMLNRFIDSFNRVFEKLTGKYVGLLRVIANRKTVTFGLLITFSVLTFGITRILPSGFVPSEDQGMIYAVLQTPPGSTLERTYEVSRQLQEACKKVHGVQSVSALAGYEILTQGRGSNSGTLLINLTPWNERHHTVVEITEELEELTKDIPGAKIEFFGPPAVPGYGAAGGIGLQLLDKNTDIDYERLDGVSKQFMKDLEKRKELTALFTFYRTDYPQYELEIDNKLAMQKGVSIKTAMDNISIMIGSTYDIGFIKFGRFFKVFVQADPSFRRIPTDILKLYVKNDKGEQVPYSSFMSIKKTQGIYEINRYNMYTTSSIRCSPAAGYSSGEAIEAIKEVAAETLPKGYDIDWSGLQKDEVGRGNEAVYIFLIVLVFVYLVLAAQYESFILPMVVILSLPAGIFGAFLLIKTAGMANDIYGQVALVMLVGLLGKNAVLIVEYAVMKNNEGLSVLESAIEGAKARFRPILMTSFAFIAGLIPLIFAHGPGAIGNKTIGAASLGGMLFGTVFGVIIVPGLYYIFGSIAEGRKMIKDEDFDPLSEDKNHHV

SEQ ID NO: 74582 - DNA, 3093 bp, Cytophaga hutchinsonii
  CDS (1)..(3093)
atgagcatctcaagtctaagtattaagcgccctgtatttacaatcgtaatcaatctgttgctgattgtttttggaatcattggttatacgtttttaggtatccgggaatatccatccattgaccctgcaactatttctgtgcgtaccaactattccggcgccaatgccgatatcattgaatcgcagattacagaaccgctggagaaagccatcaatgccattgacggtatcaaaagtataaactctaccagtaatcagggaagcagtaacattacgattgaatttaacctggataaaaatttagaggaagccgccaacgatgtgcgggataaggtttctcaggcaacacgaagcctgccgctggatattgatgcaccgcctgtagtatcaaaagccgatgctgattcagagcccattgtaatccttacggtacgaagcaattcacgtgatgtactgcaattaagcgattacgcggaaaattccattgcacaacggttacaaaccataccaggcgtaagtagtgtgcaaatatacgggcaaaaaaaatatgccatgcgtttatggattgatccgatgaaactttcttcctacggccttaccgtagctgaagtaaagacggctttaaacaaagaaaacgttcagcttccgtccggaaaaatcaccggtgcaaatacagaactaagtgtgaacacgcttggaaaccttgctacagaagagcagtttcagaatctgatcatccgtacacaaggtaataaaatcatacgtttcagcgatatcgggaaagtgcagcttgggccggaaaacctggaaacacaaatgaccgaatcaggcacacctatggttggccttgctattactcctcaacccggaactaattacattgaaattgcaaacagcttttatgaacagcttgcaaaaataaaacaggaattaccttccgatcttgaactgaacgttgcggtagataatacattattcattaaacaatccgttacagaagttgccgaaacaattttaatctcgctggtcttagtaatcattatcatttacttattcttcagagattggggcgttgccttcagaccgcttattgatattcctgtgtcgcttattgcaacattcttcatcatgtacctgtgcggcttttctgtgaatgtattaaccctgcttgctattgtactggcaacaggtttagtggtagatgatggtattgttgttacggaaaacatttacaaaaaagttgaagaaggaatgtcccctatagaggccgcaattaaaggatcgaatgaaatattaattcctgttatctccatttcgattacattagctgccgtgtttcttccggtgatatttttacagggctttgtggggcagcttttccgtgaatttggtattgtaatcgcttctgcagtattgatctctgcatttgtatccttaaccttaacccctatgctaaatgcatacctgatgaaaggcggcgtacataaaaaatcaagattctatgaatggacagaaccattttttgtaaaaatgaatgccatgtatgcagatgcacttggtgtattcatgaaacgtaaatggatcagctacccgatcatctttggatgcatcggtttgattgttttgttttattccttgttgaaaaaagaaacagcgccttacgatgaccgcagttacctgcgtgtacagatcaacacacccgaaggtgccagctatgattacacgaaccggtttatgcaggaaatgacaaaactggtgaacgattccattcctgaaaaatatataaaccttgtcattacctctccgggctttggctcttcttccgttaacagcggccgtatgatcatgtctctgattcaacccaatgagcggcatcgttctcaaaaacaaattgcaaataagcttacgcaactgacaaaaaaatattcagaggcacgcgcgatggttacagaacagccgactattgcggtaaataaaaaaggcggcctgccggttcagtataacattaaagcattgaattttgataaactgaaagaaaaagtaccggaatttatgaatgctgcggcaaacgaccctacattctctactacagatgtgaacttaaaattcaacaaaccggaattgaatgtaaccattgaccgcgataaagcacaaagccttggtgtatccgtacttgacgtggcacaaacgttacagctttctttaagcgggcagcgcttctcttatttctacatgaatggaaaacaatatcaggtaattgctcagtttgataaaacagaccgcgatgcacccattgatttaacatctatttttgtaaaaaataattccgggcaattgattcagctggacaatgtgatcacaatcaacgaacgcagcagcccgccacagctataccacaccgaccggtatttatctgcgaccgtatcggcgggtcttgcaccgggaaaaagtatcggagatggtattgaagcgatggaccgcatcgctgaagaagtacttgatgaaagtttctctacatcacttacaggtgaatcacgcgactttgttgaaagcagctcaaacacgctgtttgcattcagcttagccatcttattgatctatttaattctttccgcacaatttgaaagttttcttgatccgttcatcatcatccttaccgtacccatggcggttgggggcgccttgttctcgctttggctgtttggccagacctggaatattttcagccagatcggcaccatcatgcttatcggtctggttaccaaaaatggcatactcattgttgaatttgcaaatcagttaaaagagcaaggcaaatcaaaagcggaagccatacttgaagcctctgaagcacgtttacggccaattttaatgaccagccttgccattgcattaggcgcgttacctattgcactagccttaggagctgcagccaaaagccgcataggaatgggtgttgtaattgtagggggaacattgtttgccttagtattaaccttatttgttatccctgcattctacgccatgtggtcaaaagaacacaaacataacaccgctttagaagaagcgcacaaagctgaaaaaagcatctaa

SEQ ID NO: 74583 - protein, 1030 aa, Cytophaga hutchinsonii
MSISSLSIKRPVFTIVINLLLIVFGIIGYTFLGIREYPSIDPATISVRTNYSGANADIIESQITEPLEKAINAIDGIKSINSTSNQGSSNITIEFNLDKNLEEAANDVRDKVSQATRSLPLDIDAPPVVSKADADSEPIVILTVRSNSRDVLQLSDYAENSIAQRLQTIPGVSSVQIYGQKKYAMRLWIDPMKLSSYGLTVAEVKTALNKENVQLPSGKITGANTELSVNTLGNLATEEQFQNLIIRTQGNKIIRFSDIGKVQLGPENLETQMTESGTPMVGLAITPQPGTNYIEIANSFYEQLAKIKQELPSDLELNVAVDNTLFIKQSVTEVAETILISLVLVIIIIYLFFRDWGVAFRPLIDIPVSLIATFFIMYLCGFSVNVLTLLAIVLATGLVVDDGIVVTENIYKKVEEGMSPIEAAIKGSNEILIPVISISITLAAVFLPVIFLQGFVGQLFREFGIVIASAVLISAFVSLTLTPMLNAYLMKGGVHKKSRFYEWTEPFFVKMNAMYADALGVFMKRKWISYPIIFGCIGLIVLFYSLLKKETAPYDDRSYLRVQINTPEGASYDYTNRFMQEMTKLVNDSIPEKYINLVITSPGFGSSSVNSGRMIMSLIQPNERHRSQKQIANKLTQLTKKYSEARAMVTEQPTIAVNKKGGLPVQYNIKALNFDKLKEKVPEFMNAAANDPTFSTTDVNLKFNKPELNVTIDRDKAQSLGVSVLDVAQTLQLSLSGQRFSYFYMNGKQYQVIAQFDKTDRDAPIDLTSIFVKNNSGQLIQLDNVITINERSSPPQLYHTDRYLSATVSAGLAPGKSIGDGIEAMDRIAEEVLDESFSTSLTGESRDFVESSSNTLFAFSLAILLIYLILSAQFESFLDPFIIILTVPMAVGGALFSLWLFGQTWNIFSQIGTIMLIGLVTKNGILIVEFANQLKEQGKSKAEAILEASEARLRPILMTSLAIALGALPIALALGAAAKSRIGMGVVIVGGTLFALVLTLFVIPAFYAMWSKEHKHNTALEEAHKAEKSI

SEQ ID NO: 74584 - DNA, 3171 bp, Cytophaga hutchinsonii
  CDS (1)..(3171)
atgattgcagatgtatttataaaacgacctgtaactgctattgtagtatcggttgtaataacattggtaggaacattaaccttaatgaaccttccgatcagtcaatacccggatatcaccccacctattgtgcaggtaacaggtaactttgccggtgcggatgcacaaaccgttgaacgtaccattgctactcctattgaagcgcaggtaaatggcagcccgggcatgtccttcctacaaacaaatagtacaagtgatggtactatgacaatgaatgtaacatttgatgtaggaacaaatattgatattgcgacacttgatgtacagaacagagttagtgtggcaacacctcaacttccggatgatgtaaaaaaaaccggcttaactgtacgtaaacgaaatcctacgatcttaatgctcgtagccatgtattcaccgaatggcacacacgatgttaagtttatggataactacacgaacatctacattaaagatgccttgctgcgtgttaaaggtgtaggtgatatcttcacccgtgcagataacttcagtatgcgtatctggatgaacccggataaactggcacaatatggtatgacagcaaacgaagttgttgcaaaacttcaacagcaaaacgttcaggttgcagcaggttcaatcggttcctctcctcagacgcccgatcaggcatttgaatattccattcaggtaaacggtatgcttgaaaaagctacagactttgaaaacattgttgtacgtacaaaacccgatgaaggctcaatcgtttatttaaaagatgttgcccgcgttgagttaggaaaattcaattactccagtaataactttgttgacggaaaaagatcttcgtatttattggtatatcaatctccgggaagcaatgcacttgaaacggcagaaggtgtatacaaagcaatggaagaattgaaaaaatctttcccgaatgatgttgaatatgtagtaccgtttgaatctgtttctgtagttgatgtatccattgatgaagttgtacatacacttgtggaagcattattacttgtaattgttgtggtgttcttattcctgcaaagctggagggcaacattgatcccgatccttgcaatcccggtttcaattatcggtacattcatcttcttcattccgcttggtttcacggtaaatacattaacactgttcggatttgtattagcaatcggtattgttgtggatgatgcaattgttgtggtagaagccacacaacattacattgaccatgaaaaactttctccgaaagaagcgacaattaaagccatgaaggatatttcgggaccggttatcgcgatcgcattgatccttgctgctgtattcgttcccgttggatttattcctggtattgtaggccgcttgtatcagcaatttgcaatcaccattgcggtatctgtattattatctgcatttgttgccttgtcgttaacaccggcactttgtgcgatgttattgagacctatgcacctggatgaaaattcacgtggcttaaataaattcttctttaaatttaacaattggtttgcacgcgttactgcctcctattcaaatggcgtaaaatactgtatccgcaaagctcctatcgcaatcatattattgatctgtattttcgttgctacctttggtttattcaaagcaaaacccaccggatttattcctacagaagatgaaggtcgtttgattattacctttgaacttccggatggagcttctacaacacgtacgcttgaagtaatgaaaaaaatcatggcggttgtaaaagaaaacccttctgtaaatcactttgctgccttaggtggtttgaatgcgattaccttttcttcaaaatcaaatagcggaaccttattctgccagctaaaaccatgggcacaacgcaaagatgcttccatgcaggtagaagcaatcatcggacaattccagaaagaatttgccgccattaaagaagctaatatcattgttattcccccacctcctattccgggtatgggtacagcttccggtttcagttttatgattgaacagaaacaaagcaacgatgacatcaaaggatttgaacgtgtggtaaaacaatttatgatggaagcaaacaagcgtcctgaaattgcccgtgcctttacattctttacagcacgtgctccgggttataaaatcaatgttgacagggtgaagtgtgaacgtatgggtgtatcaacaggcgatgtgttctccactattcagacattaatgggtagccgctacatcaatgatttctctatctatggaagaaacttccgtgttgttacacaagcggatactacattccgtaaagacattaccaatcttgataaatattatgttcgtaatgtaagcggcagcatgattccgttaagctcactggcaacgtacgaagcagttgaaaacgctccgttgatatcacattataaccttttccgttctgctgaattcaatggtacacctaaaccgggttacagcagcggtgatgctattaaagcactggaagaagttgcagcgcaggtattgccggcaggttatggatatgagttctcgggtttaagcagagaggaaatcaaatccggatcaagtgccgtttatatctttgcactctctattgtgtttgtattcttattccttgcagccttgtatgaaagctggtctgtaccgttctctgttatgcttgcggtaccattgggtgcatttggtgcaatccttacactttatttcttacctaagttaagcaataacgtatatgcccagattggcttaattacgttgattggtctggctgcaaaaaatgcaattcttattgttgaattcgcaaaagaacgtgtggacaaaggaatggaaattgttgcagcaaccatcgaagcggtgcaattacgtttacgacctattcttatgacatcgcttgcctttattcttggtgtattacctttagttgttgcatccggagcaggagctgtttccagacaaacgatcggctggacggtatttggcggtatgcttgcagcaacaggtctggcaatatttattgttcctgtattatatgtattgatcgcaaaggtcgcctatcgcaatcataagcctgaaaacaatacaactgaatcagacaaacctgcttctatccattaa

SEQ ID NO: 74585 - protein, 1056 aa, Cytophaga hutchinsonii
MIADVFIKRPVTAIVVSVVITLVGTLTLMNLPISQYPDITPPIVQVTGNFAGADAQTVERTIATPIEAQVNGSPGMSFLQTNSTSDGTMTMNVTFDVGTNIDIATLDVQNRVSVATPQLPDDVKKTGLTVRKRNPTILMLVAMYSPNGTHDVKFMDNYTNIYIKDALLRVKGVGDIFTRADNFSMRIWMNPDKLAQYGMTANEVVAKLQQQNVQVAAGSIGSSPQTPDQAFEYSIQVNGMLEKATDFENIVVRTKPDEGSIVYLKDVARVELGKFNYSSNNFVDGKRSSYLLVYQSPGSNALETAEGVYKAMEELKKSFPNDVEYVVPFESVSVVDVSIDEVVHTLVEALLLVIVVVFLFLQSWRATLIPILAIPVSIIGTFIFFIPLGFTVNTLTLFGFVLAIGIVVDDAIVVVEATQHYIDHEKLSPKEATIKAMKDISGPVIAIALILAAVFVPVGFIPGIVGRLYQQFAITIAVSVLLSAFVALSLTPALCAMLLRPMHLDENSRGLNKFFFKFNNWFARVTASYSNGVKYCIRKAPIAIILLICIFVATFGLFKAKPTGFIPTEDEGRLIITFELPDGASTTRTLEVMKKIMAVVKENPSVNHFAALGGLNAITFSSKSNSGTLFCQLKPWAQRKDASMQVEAIIGQFQKEFAAIKEANIIVIPPPPIPGMGTASGFSFMIEQKQSNDDIKGFERVVKQFMMEANKRPEIARAFTFFTARAPGYKINVDRVKCERMGVSTGDVFSTIQTLMGSRYINDFSIYGRNFRVVTQADTTFRKDITNLDKYYVRNVSGSMIPLSSLATYEAVENAPLISHYNLFRSAEFNGTPKPGYSSGDAIKALEEVAAQVLPAGYGYEFSGLSREEIKSGSSAVYIFALSIVFVFLFLAALYESWSVPFSVMLAVPLGAFGAILTLYFLPKLSNNVYAQIGLITLIGLAAKNAILIVEFAKERVDKGMEIVAATIEAVQLRLRPILMTSLAFILGVLPLVVASGAGAVSRQTIGWTVFGGMLAATGLAIFIVPVLYVLIAKVAYRNHKPENNTTESDKPASIH

SEQ ID NO: 74586 - DNA, 3147 bp, Cytophaga hutchinsonii
  CDS (1)..(3147)
atgtttagtatatttattaacagacccgttttatcgattgtaatatcgctcattatcgtttttttaggcgtgttgtcgctggtacaattgcccgttacccaatatccggatattgcaccgccggtagtagctgtaaccacaaagtatacaggcgcaagtgctgaagtatgcgccaaagctgttgtaacaccgctggaacgtgccatcaacggggtggccggcatgtcgtatatgacatccgtttccggtaacgacggtaccagtattatacaggtttattttcaggccggtgttgatcccgatctggcttcggtgaacgtgcagaaccgtgtgactgccgtgctcgaagaaatgccggaagaggttatcaaatccggtatcatcattgaaaaggaagtcaacagtatgctgatgtacttaaatattttaagctcagattctaccatcgatgaaaaattcctctataattttgccgatataaatattcttgcggaattaaaacggatcaatggtgtgggctttgcagacatcatggggcagcgggaatattccatgcgtatctggctgcgtccggatcgtatgaccgtgtatgatgtttcagctgctgatgtaatccattcactgcgtgaacagaacgttgaagcagcaccgggtaaaataggcgaaagctccggccgcaaatcccaatcactgcagtatgtaatacggtataccggtaagtttacaaaaaaagaacagtatgaaaatattgcgatcaaagccagtgccaacgggcagattctgcgtctgaaagatattgccgagattgaattcggctcgctggattacgacgtattatcaaaagaaaacggccggccttctgccgctattatattgaaacagcggccgggttccaatgccagtgaagtgattgaaaacataaaatccaagatggcagaactgaaagccacaagctttccgccgggcatggaatataccatcagttacgatgtatcgcgctttctggatgcttctattcatgaggtaatcaagacgctgatcgaagcctttattttagttgccattgtagtatttattttcttacaggattttcgctctaccattattccgattattgccgtacctgtttcgctgatcggtacgttcttctttatggatatgcttggtttctccatcaacctgcttaccttatttgccctggtattggcaattggtattgtggtagatgacgccattgtggtagttgaagctgtgcacgtaaaaatggaaaagtttcatatgaatgcgcgtgaagctacacatgcatctatgaaagagatcagcggtgccattatcgcaatcaccctggttatgtccgccgtgtttatccccgtagcttttatgactggtcccgtgggtgtattctatcgccagttctccataactatggccattgctattgtaatctccggggtgaacgcgttaacattaacgccggccttgagtgccttgttattaaagtctcaccacggacagaaaaagaaaaacaatattctaaccaagtccttttacattttcaacaaaggtttttataacgtaaccttcaaataccagcatttacttacactggtggtaaacagaaagattgtgactttcggtctgctgttatttttccttattggtattaaaggattaagtgttgtattgccaaccggctttattcctacggaagatcagggtaccatctatgcaagtgtaacgacaccatccggcgctacgctggagcgtaccgaatcggtagtggatgccattgaccgcattaccagaggccttgatggagtagaatctgtttcgactatggcaggatttaacgtgatgacagatggttcgggtgctaccttcggtatggccatggtaaacctgaaaccctgggaagaacgtaaatcatcggttgatgaaatcatcgattcgttaaccataaaaacaaaatacctgaaggatgcgtcgatccaattctttccgccgcccgctgtaccgggttatgggaatgccagcggttttgaattccggatccaggaccgttccggtacgggggatctgcagaagttgcagcaggtaacagataaatttattacagaactgaataagtgtaaacagattgatgaagcgtttaccagttttgatgcaagcttcccgcaatacctggttaaaattgattatgataaagcggcgcagaaagatgtaacggtaaacaatgccatggataaccttcaatcgctgatcggaagttattacgcaacaaactttatccgtttcggacagatgtataaagtaatggtgcaggcgcttccgaagtacagagcgcagccgcaggatattttgaaactgtatgtgaaaaataataaaggagaaatggttccgtattctgcattcattaccgttgaacgtatttatggtccggaacagttaacgcgtcataatatgtttactgcagctatgataaacggcgagcctgctcccggctacagcagcggtgaagccattgttgcgattaatgaaacagcagaaaaattcctgcccaaaggatatacctttgaatggtcgggcatgacgcgcgatgagattctttccggcaatcaggtaaccgttatctttatcgtctgcctgatttttgtgtatctgattcttgccgcacaatacgaaagttttattcttccctttgccgttattctgtctttgccaacaggtattttcggcgcctatttattgttgtacctgttaggcctgcagaataatatttatgcccaggtagcactggtaatgcttattggtttgctgggtaaaaatgccattctgattattgagtttgccttattaaaacagaaggaaggaaaaacaccctacgaagccgcgattgaaggtgcagctgcccgtttcaggccaatcttaatgacatcgtttgcatttgttgccggtttgatcccgctgatgattgcaagcggcgcaggggcaatcggtaaccgtaccatcggtacagccggtgccggcgggatgttcattggcaccatcctgggcctggttattattccgggactttatgtagtttttgcaacactggatcagcgtttttctaccaaaaaagatcagcaacttaatttaaatgtttaa

SEQ ID NO: 74587 - protein, 1048 aa, Cytophaga hutchinsonii
MFSIFINRPVLSIVISLIIVFLGVLSLVQLPVTQYPDIAPPVVAVTTKYTGASAEVCAKAVVTPLERAINGVAGMSYMTSVSGNDGTSIIQVYFQAGVDPDLASVNVQNRVTAVLEEMPEEVIKSGIIIEKEVNSMLMYLNILSSDSTIDEKFLYNFADINILAELKRINGVGFADIMGQREYSMRIWLRPDRMTVYDVSAADVIHSLREQNVEAAPGKIGESSGRKSQSLQYVIRYTGKFTKKEQYENIAIKASANGQILRLKDIAEIEFGSLDYDVLSKENGRPSAAIILKQRPGSNASEVIENIKSKMAELKATSFPPGMEYTISYDVSRFLDASIHEVIKTLIEAFILVAIVVFIFLQDFRSTIIPIIAVPVSLIGTFFFMDMLGFSINLLTLFALVLAIGIVVDDAIVVVEAVHVKMEKFHMNAREATHASMKEISGAIIAITLVMSAVFIPVAFMTGPVGVFYRQFSITMAIAIVISGVNALTLTPALSALLLKSHHGQKKKNNILTKSFYIFNKGFYNVTFKYQHLLTLVVNRKIVTFGLLLFFLIGIKGLSVVLPTGFIPTEDQGTIYASVTTPSGATLERTESVVDAIDRITRGLDGVESVSTMAGFNVMTDGSGATFGMAMVNLKPWEERKSSVDEIIDSLTIKTKYLKDASIQFFPPPAVPGYGNASGFEFRIQDRSGTGDLQKLQQVTDKFITELNKCKQIDEAFTSFDASFPQYLVKIDYDKAAQKDVTVNNAMDNLQSLIGSYYATNFIRFGQMYKVMVQALPKYRAQPQDILKLYVKNNKGEMVPYSAFITVERIYGPEQLTRHNMFTAAMINGEPAPGYSSGEAIVAINETAEKFLPKGYTFEWSGMTRDEILSGNQVTVIFIVCLIFVYLILAAQYESFILPFAVILSLPTGIFGAYLLLYLLGLQNNIYAQVALVMLIGLLGKNAILIIEFALLKQKEGKTPYEAAIEGAAARFRPILMTSFAFVAGLIPLMIASGAGAIGNRTIGTAGAGGMFIGTILGLVIIPGLYVVFATLDQRFSTKKDQQLNLNV

SEQ ID NO: 74588 - DNA, 3132 bp, Microbulbifer degradans 2-40
  CDS (1)..(3132)
atgaaatctattaccgatatttttgtacgcaagccggtactcgcgatagtggtgaacatcatcattattatcgctgggttgcaggccgtaagctcgcttaccgttcgccaatacccgcgcaacgataacgcagttattactattaacaccgcctacataggcgcagatgcagagctggtgcgcggttttattacctcgcccattgagcgcgcagtatctggcgcagacggcattgattacgtctcgtcttcaagcagtcaaggcgtatctagcgttagcgtgcgcctagagcttaactacgaccccattaaagcgcttgccgaaattacctctaaggtaaaccaagtgcgcggcgacctgccccccgaggctgaagtaccggttattaatgtggagtctgccgacagccagtttgcagcggcctacctaagctttagctcagacatattggccgataaccaaattaccgattacttagtaagggttgtgcaacctcgtctttccgccctagaaggtattcaacgcgcggatgtactgggcgctcgcacctttgccatgcgcatttggctgcagccagacagaatggccgcgcacaacattagcccaacgcaagtaagacaagcactgcaagccaacaactacctcgcggcactgggcagcaccaagggtcaatacattcaagtaaacctttcggccaacaccgatttaaattctgtcgatgaatttaaagagttggtactgcgctcagaaaacggcgccatcattcgcttaaaagatgttgccgaagtggtgcttggctccgaatcctacgatatggaagttcgttattcgggcaaaaccgctacatttatgggtattttcccgcaacctaacgccaactccttagatgtaatggcgctagtgcgtgaagaaatgaaaaacatgcaggcggcgctacccaaaggtttggacgccgttattgcctacgatgccaccgcttatatcgaaagctctattagcgaagtaataagtacattaatagaaactctgcttattgttgtagtggttatcttcttgtttttaggctccattcgctcggtgattattcccgtggtggccataccgctatcgctgattggcgccgtgtttgtgatgcaaatatttggctttagcttaaacctgcttacgctactggctattgtattgtctgtaggtatcgtagtggatgacgccatcgtaatggtggaaaacgttgagaggcatatatctgagggccaaacaccgtttaaagcagccatattaggcgcacgcgaactcgtaggcccagtgatagccatgaccacaaccttggttgcggtttacttaccaatcggcctacagggcggcttaaccggctctttgtttaaagagtttgcctttacgcttgctggtgcagttaccatttcgggcatagttgctattaccctctcgcccatgatggcttctaaaatgctgaaagaaggcatggaagacgaaggctttgccagcacagtggcgcgcatttttgatcgcgttaagaatcgctacacccgcatgctagatcacactttggagcatcgctttcccgtgtatatggtgtgggtagccactgcgatactaggtgtagtgttctatatgcagtctcccaaagagttagcacccacagaagaccaaggtgttatttttgggattgtggaaggctctgctagctcaacaatggatcaagcatccatttttgctgctgccgccaacgacgcgttctctagttttgaagaaaccgacttcacctttcagctaacattccccaattcaggttttggaggcatggtgcttaagccttgggacgaacgcgagcgcaccgtgtttgacgtgctaccagaagccggtggaaagctttcgcaaattcctggtatcaatttattcccgattacccctccagcactgcctggcggcggtaatatgccagtggaatttgtaattgcttctactgcagagccagagcaaatattaaagtttgcccaagaactgcaacaaaaagccacaatgagcggccagtttgcattcccgccgatgatagatacccaaatcgacttacctaaagcggagcttataatcgaccgcgacaaggtggctgatatggggttgaacatgcaacaagtaggggccgatgtaggcactatgcttggcggcggctatgttaaccgctttaatattgccggtcgcagctaccgtgtaattcctcaagttgaacgcatagagcgcctcaacccagagcaactgggtaacatttacgtcaccgggcctgagggcaaattagtgccacttagcactctcgcccgcgtagagcgtaaaaccgtcgcccgttcgctcaatcgcttccaacaattaaatgcggtaaaactaagcggtgtagctattggtccgcttgataacgcgttaaaagtattggaagaagaggctgcaaaaatattgccacaaggctatatgattgattacacaggcgaatcccgccagttgcgacgcgaaggcaataaacttttgcccgcaatgatgatggctagcctgttaattttcttagtacttgccgcgcaatttaatagcttccgcgacccgctaattgtattgggtggctcagtgccattggcgtggttcggcgcactaatatttactttcttaaaaatgcccaaccccaatatgcacttttggacagacgggtggaccaccacactcaatatttattcgcaaattggcttggttacccttatcgggctagttgctaagaatggtattttggtggtggagtttgccaacaaaatgcaggagcaaggcctaacaaaactagcagctattaaagagtctgccggcacccgcttgcgcccagtacttatgaccaccgttgcaactgttgccggtcacttcccgttggtattggtaacaggcgccggcgccgaagcgcgtaactctattggcttgatactagtaggtggcatggcaattggtactttctttacactatttgtgattccttcaatatatatgcttatagcgaaagaccaccgtggtgaaaaatttcatgtatccgagtttgagctggaggatgagttaatagaggaggaaagtaaaacaactgcctaa

SEQ ID NO: 74589 - protein, 1043 aa, Microbulbifer degradans 2-40
MKSITDIFVRKPVLAIVVNIIIIIAGLQAVSSLTVRQYPRNDNAVITINTAYIGADAELVRGFITSPIERAVSGADGIDYVSSSSSQGVSSVSVRLELNYDPIKALAEITSKVNQVRGDLPPEAEVPVINVESADSQFAAAYLSFSSDILADNQITDYLVRVVQPRLSALEGIQRADVLGARTFAMRIWLQPDRMAAHNISPTQVRQALQANNYLAALGSTKGQYIQVNLSANTDLNSVDEFKELVLRSENGAIIRLKDVAEVVLGSESYDMEVRYSGKTATFMGIFPQPNANSLDVMALVREEMKNMQAALPKGLDAVIAYDATAYIESSISEVISTLIETLLIVVVVIFLFLGSIRSVIIPVVAIPLSLIGAVFVMQIFGFSLNLLTLLAIVLSVGIVVDDAIVMVENVERHISEGQTPFKAAILGARELVGPVIAMTTTLVAVYLPIGLQGGLTGSLFKEFAFTLAGAVTISGIVAITLSPMMASKMLKEGMEDEGFASTVARIFDRVKNRYTRMLDHTLEHRFPVYMVWVATAILGVVFYMQSPKELAPTEDQGVIFGIVEGSASSTMDQASIFAAAANDAFSSFEETDFTFQLTFPNSGFGGMVLKPWDERERTVFDVLPEAGGKLSQIPGINLFPITPPALPGGGNMPVEFVIASTAEPEQILKFAQELQQKATMSGQFAFPPMIDTQIDLPKAELIIDRDKVADMGLNMQQVGADVGTMLGGGYVNRFNIAGRSYRVIPQVERIERLNPEQLGNIYVTGPEGKLVPLSTLARVERKTVARSLNRFQQLNAVKLSGVAIGPLDNALKVLEEEAAKILPQGYMIDYTGESRQLRREGNKLLPAMMMASLLIFLVLAAQFNSFRDPLIVLGGSVPLAWFGALIFTFLKMPNPNMHFWTDGWTTTLNIYSQIGLVTLIGLVAKNGILVVEFANKMQEQGLTKLAAIKESAGTRLRPVLMTTVATVAGHFPLVLVTGAGAEARNSIGLILVGGMAIGTFFTLFVIPSIYMLIAKDHRGEKFHVSEFELEDELIEEESKTTA

SEQ ID NO: 74590 - DNA, 3165 bp, Trichodesmium erythraeum IMS101
  CDS (1)..(3165)
atgtgttccctactaattatcctaattggattagtcggttatatcagtctaccagtacaagaatttcctagcattgataccccagtagtcagtgtacgaaccaactacccaggagctagcccagaagtagtagaaacagaagtaacagaaattctggaagcagaaattaatggtgttgaaggtgtgaaaactctgacatctagcaccagggaaggttcaagttccataaacgttgaatttcaactgagtcgcaatatagaagcagcagctcaagatgttcgtagtcgtgtctcccgtgccatgagaagacttcccaatgaagttgatgcaccagtagtttctaaacgaagtagcgatgaagaaagaattatttggctttccctaactggggaaaaatattcatcattagaattaagcaactatgccgataaattcattaaaaatatcttagaaactgttaatggagtgggtagtgtttttatcggaggcgaacgtcgttacgccatgcgactatggttaaacccccaaaaaatggctgctcgaaatattactgctttagatgtcaaacaagctcttagacaacaaaacgtagaaattcccagtggtagaatagaaggaaaatctacagaataccccatccgcactattggtcgtctacaaacaccagaagcttacgaaaacttggtgatcagacgcaatgatgacacctctctgacaagattcaaagatattggtagagcagaaattggagcagaaagtaatcgcacaattgctcgctataatggtaaaccagcaataggtattggaattagtaagctttccggagcaaatatcatagaagttgccacaagtgtcaaaactaggatgaaagaattatctaaagattttcccgatggaatggaatactacgtcagcgttgactactcaacatttgtggaagttgccatcaaagaagtctggaaaagtttgctattcgccatctgtttagttgtcttagttatctatatgtttttgcaaaattggcgggcaacaattattcctactatcaccattcccatttccctcattggtgcctttggggtaatgtttttcatgggattttctatcaacactctcaccttatttgctctaacactttcaacaggtttggtagtagatgatgctattgtgatcttagaaaatattgttcgatatattcaacagaaaggcaaaactcccatggaagctgcaatattaggagtcggggaagttgtatttgctgtcattgccacaaccattgtcttaattgcagtatttctacctgtaggattttccggtgggggtgcagggcgaatatttaatgaatttgccctaactattgcagtgtcagtagtgttttctacctttgttgctctgacattagcaccatcattgtcagggcgaattcttaaaaaacaagaaccagaggaacaaaaaaattttatctctcgtttatttaccattccccttaatttatttgattatgctctcagtcgcatttcagtaatatacgatcgctcattacgtctgttgatgagaatcaaaccattagtaattttaggatttatcctatctttttggataatagtttggttatttcaacagttgccccaaggatttttgcccacagaagatcgcggaagagtatttgtttctgtaactgcaccagaaggggtaagcattgaatatactgacaatgtcatgggtcaggtagaaaataaacttgctcaagttcccgaaatgaaaggttatttcagtattactgggttcggtcgttcagctcaagctaaccgagcttttgctttcaccaacttgaaaccctggtcagaacggacaaaaccagggcaagcacaacaagaagttgtcaaaaagttatttagagcatttgcaccaattacagatgcacgaatatttccaattaatcctggttcattacctggtactggtcttagtcgctccatacagtttgtcttgcagggaaatgattttgaagagttagtgcgagtatctgaagaatttaacaatgaggcgcaacagttaccccaactaaaaaatgttgacacagatttaaaaattaataagcctgagatcgtagtagaaataaatcgttaccaagctgctaatttagggatatcggtagagaatattgctcagacattacaaattatgatgggtggggaagatattacgaattttactcaaggaaaccagcgctatgatgtaattgtgcgggctgaggatgagtttcgcaataatctccaagatattgaggatctatatgtgcgaactgagcaaggggtgatgatacctttgagtaatgtggtgactgtgaagacaagcacaactcctcctgagattaatcattttaaccgctttcgttcggcaacaattacaggaagtccggctccaggagttagtttgggtgaggcattgcaagcattatacgatttggcggatcgggttttacctgctgatatgcggatagatctaaagggtgagtcatcccagtttcgagatgctggtcaggcaacgacatatatttttgggttggcattaatttttattttcttaactttggcagctcagtttgagagttatatcgacccgctggtgattttattgtcggtacctttatctttgttgggtgcttttggggcgttatggttggcagatttagaggtgaatgtttacagtcgtattgggttaattatgttaattggtttggcaactaagaattcaattttgattgtggaatttgctaaccagttattggcagagggaatgtctattactaaagctgctattgaggcatcgcggttgcggtttcgtccgattttgatgacagggttttcgacaatttttggggtgatgcccttggcgtttgcttctggtccaggcgctgctagtcgggtttccatcggaatgtcggttatgggtggaatgttggtgtctacagttttgactttgtatgtagtgcctgtgttttatgtggtgatggggaagagtttgcagttcggtttatttcgtaagcatgctcaatattcggcagatggtgatgagattagtaatggttctgttaatggaaatagtaaaactgctcctgttaatgataaaaatcaggatagtgcggaaaaattgagcaggtga

SEQ ID NO: 74591 - protein, 1054 aa, Trichodesmium erythraeum IMS101
MCSLLIILIGLVGYISLPVQEFPSIDTPVVSVRTNYPGASPEVVETEVTEILEAEINGVEGVKTLTSSTREGSSSINVEFQLSRNIEAAAQDVRSRVSRAMRRLPNEVDAPVVSKRSSDEERIIWLSLTGEKYSSLELSNYADKFIKNILETVNGVGSVFIGGERRYAMRLWLNPQKMAARNITALDVKQALRQQNVEIPSGRIEGKSTEYPIRTIGRLQTPEAYENLVIRRNDDTSLTRFKDIGRAEIGAESNRTIARYNGKPAIGIGISKLSGANIIEVATSVKTRMKELSKDFPDGMEYYVSVDYSTFVEVAIKEVWKSLLFAICLVVLVIYMFLQNWRATIIPTITIPISLIGAFGVMFFMGFSINTLTLFALTLSTGLVVDDAIVILENIVRYIQQKGKTPMEAAILGVGEVVFAVIATTIVLIAVFLPVGFSGGGAGRIFNEFALTIAVSVVFSTFVALTLAPSLSGRILKKQEPEEQKNFISRLFTIPLNLFDYALSRISVIYDRSLRLLMRIKPLVILGFILSFWIIVWLFQQLPQGFLPTEDRGRVFVSVTAPEGVSIEYTDNVMGQVENKLAQVPEMKGYFSITGFGRSAQANRAFAFTNLKPWSERTKPGQAQQEVVKKLFRAFAPITDARIFPINPGSLPGTGLSRSIQFVLQGNDFEELVRVSEEFNNEAQQLPQLKNVDTDLKINKPEIVVEINRYQAANLGISVENIAQTLQIMMGGEDITNFTQGNQRYDVIVRAEDEFRNNLQDIEDLYVRTEQGVMIPLSNVVTVKTSTTPPEINHFNRFRSATITGSPAPGVSLGEALQALYDLADRVLPADMRIDLKGESSQFRDAGQATTYIFGLALIFIFLTLAAQFESYIDPLVILLSVPLSLLGAFGALWLADLEVNVYSRIGLIMLIGLATKNSILIVEFANQLLAEGMSITKAAIEASRLRFRPILMTGFSTIFGVMPLAFASGPGAASRVSIGMSVMGGMLVSTVLTLYVVPVFYVVMGKSLQFGLFRKHAQYSADGDEISNGSVNGNSKTAPVNDKNQDSAEKLSR

SEQ ID NO: 74592 - DNA, 3072 bp, Thiobacillus denitrificans ATCC 25259
  CDS (1)..(3072)
atgaacctgtcgcggcgcttcatcgagcggccggtcgccacgctcatgctggcgctggcgatggccttgttcggcgcgctcgcctacacccagctgccgattaacgacctgccgcaggtcgatttcccgaccttgcgcgtgagcgccgcgttgcccggcgcgaaccccgagacgatggccaacacggtcgcgacgccgctcgaacggcagctcgcgaccgtcgccgggatcgagtcgatgagttcgcagtcgagtcagggatcgaccagcatcacgctgcagttcgagctcggtcgcgacatcgacgccgcggcgcaggacgtgcagaccgccgtggcgcaggcggcgcgcaatctgccccagggcatggacccgccacagctgcggaagatcaacccggccgattcaccgatcctctatctcgcgctctcgtccgagcgcctgccgctgaccgagctcgacgcgctcgccgattcgcgcgtcgcgcagcgcctgtcgagcctctccggggttgcccaggtgctcgtgttcggctcgcagaaatacgcattgcggatctacctcgacccggcgaagctgcaggcgcgcggcctcaccttcgccgacgtcatcgagaaggtacaggccgccaacgccaacctgccggccggaacgctagacggcgcgtcgcgcgcctataccgtgaaagcgccagtcgcgctcgccgatgcgcgcgacttcggcgaaatcatcgtcgcctaccgcgacggcaccgcgctcagggtgaaggatctcggacgcgccgaggacagcgtcgaggacgacaagcgccgcacctggtacaacggcacgcgcgcgatcgtcctcgccatccagcgccagcccggcgcgaacacggtcgaggtcgtcgagcgcatccgcgcgatgctgccgcagatcgaggccgagctgcccgacggcgtgcgcctgcaggtgcattccgaccgttcgcgcttcgtcaaggattcgctgcacgaagtgaatttcacgctcttgctcgcgctcgtgctggtgatcctcgtcatcttcgccttcctgcacaacctgcgcgcgacgctgatcgccgcgctggtgctgccgagctcgctgctcggcaccttcgccttcatgcatctgcttggctacagcctcaacaacctctcgctgatggcgatcacgctcgccatcggtttcgtcgtcgacgacgccgtcgtcgtgatcgagaacatcacgcgccacctcgacatgggcaagccgcgcatgcaggccgcgctcgatggcgcccaggagatcggcttcacggtgctgtcgatgacgatttcgctcgccgcggtcttcctgcccatcctgttcatgggcggcatggtcggccggctgttccaggaattcgccgtcagcatcggcgtcgccgtgctgctctcgggcgtcgtcgcgctgacgctgacgccgatgctgtgcgcgcgcgcgctcgttcgcgaatcgccgacgaaccggctctcgcgcgcgttcgacgccggattcacgcgcttccagcgcttttacggcgacagtctgcgcgcgtcgatgcgccatcgcggcgccatgcttctgttgtcgctcgtcctgctcgtcgcgatgctgtggctcgccggccaggtgaagcagggattcattccgcgcgtcgactcgggaatgattttcgcgagcgtgcagtatccggaaggcatccctttcgacgagctgtcccgccgccagcagcaactcgcggcacgcgtgcagcggcacccggccgtcgagggcctgatgtcgtcggccgggcagggcggcggcggggtcagcggcggcaacgtcggccgcctcgtgatccgcctcgcgccgcgcggggaccggccgggcgccgacgaggtcatcgaccagctgcgcgcagagacgcgcggtctcgccggcgtcaacgtgagcttccagaatccggcgtcgatcaacgtcggcgcgctcgcgtcgagcagcgattaccagctgacgctgacctcgggcgacttcgaggcgctcaaggccgccgccagcgaggtcgagacacggctcgccagcgtcgcgcagatcgacgaggtcacgagcaacctcgagttgcgcaaccccgagctgcgcgtgaacctcgacccggtcgcggcggcgcgcctcggcgtgaccacgcaacaggtccagcaggcgctctacgacgccttcggcgggcgccgcatcagcgaaatctacggcgccagcgaccaatacgtcgtgagcgtcaaggcgcttcccgaggcgcaacagaatccagccgtcatcggcgagttgccgctgaagaccgcgtcgggcacgctgatccggctcgacgccgtcgcgaccgtcgaggccggggtcgggccggtggcggtgcatcactacggccagcagcccgccgtcacgctgtcgttcgacctcgcaccgggcgtctcgctcgacgccgccctggccgcggcgcatacggccgccgccgaagttgtcccggccgacgtcgcgctggcgttcaccggggcggcggaaaaattccaggaatcgaccgtgcaactgccgctgctgctgctgttcacggtcgtcgtcatctacatggtgctcgcggtgctgtacgaacacctcggccatccgctcacgatcctgaccgccttgccgctcgccggcttcggcgcgctgctcgtgctgctgctcgccgagcaggaactcaacatcttcagcttcgtcggcatcatcctgctcgtcggcctggtcaagaagaacggcatcatgatgatcgacttcgcactggcccggcagcgcgccggcatgagcgccgaggacgcgatcgtcgaggcgagcctcgtgcgcctgcggccgatcatgatgacgaccttcgccgcgatcctcgccacgctgccgatcgcgatcggcttcggcgcgggcggcgaggcgcgccgcccgctcggcatcgccgtcgtcggcgggctcgcgttctcgcagttcctcacgctctacatcacgccgaccttctacgtcagcatggccagcgccggcgccgcgctgacgcgctggcgcgcgcgccacgcctga

SEQ ID NO: 74593 - protein, 1023 aa, Thiobacillus denitrificans ATCC 25259
MNLSRRFIERPVATLMLALAMALFGALAYTQLPINDLPQVDFPTLRVSAALPGANPETMANTVATPLERQLATVAGIESMSSQSSQGSTSITLQFELGRDIDAAAQDVQTAVAQAARNLPQGMDPPQLRKINPADSPILYLALSSERLPLTELDALADSRVAQRLSSLSGVAQVLVFGSQKYALRIYLDPAKLQARGLTFADVIEKVQAANANLPAGTLDGASRAYTVKAPVALADARDFGEIIVAYRDGTALRVKDLGRAEDSVEDDKRRTWYNGTRAIVLAIQRQPGANTVEVVERIRAMLPQIEAELPDGVRLQVHSDRSRFVKDSLHEVNFTLLLALVLVILVIFAFLHNLRATLIAALVLPSSLLGTFAFMHLLGYSLNNLSLMAITLAIGFVVDDAVVVIENITRHLDMGKPRMQAALDGAQEIGFTVLSMTISLAAVFLPILFMGGMVGRLFQEFAVSIGVAVLLSGVVALTLTPMLCARALVRESPTNRLSRAFDAGFTRFQRFYGDSLRASMRHRGAMLLLSLVLLVAMLWLAGQVKQGFIPRVDSGMIFASVQYPEGIPFDELSRRQQQLAARVQRHPAVEGLMSSAGQGGGGVSGGNVGRLVIRLAPRGDRPGADEVIDQLRAETRGLAGVNVSFQNPASINVGALASSSDYQLTLTSGDFEALKAAASEVETRLASVAQIDEVTSNLELRNPELRVNLDPVAAARLGVTTQQVQQALYDAFGGRRISEIYGASDQYVVSVKALPEAQQNPAVIGELPLKTASGTLIRLDAVATVEAGVGPVAVHHYGQQPAVTLSFDLAPGVSLDAALAAAHTAAAEVVPADVALAFTGAAEKFQESTVQLPLLLLFTVVVIYMVLAVLYEHLGHPLTILTALPLAGFGALLVLLLAEQELNIFSFVGIILLVGLVKKNGIMMIDFALARQRAGMSAEDAIVEASLVRLRPIMMTTFAAILATLPIAIGFGAGGEARRPLGIAVVGGLAFSQFLTLYITPTFYVSMASAGAALTRWRARHA

SEQ ID NO: 74594 - DNA, 3165 bp, Thiobacillus denitrificans ATCC 25259
  CDS (1)..(3165)
atggcgcgctttttcatcgaccggcccattttcgcgtgggtcatcgccatcgtcatcatgctcgccggcgcgctgtcgatcctgacactgccggtttcgcaatatccggcgatcgcgccgccgacggtcgcgatcaacgcgagctatccgggcgcgtccgcgaagaccgtcgaagactcggtcacgcaggtcatcgaacagaagctgaccggcctcgacaacctgctctacatgagttcgcagtccgactcctacggccgggcgacggtcacgctcaccttcgacgccggcaccgaccccgacatcgctcaggtgcagacgcagaacaagctccagctcgcgctgccgttgctgccgctcgctgtgcagcagcagggcgtgcaggttgtgaagtcgacgcgcaacttcctgatgatcatcggcttcgtttccaaggacggttccatgagccggaccgacctggccgatttcctcaattcgaccgtgcaggagccgctgtcgcgcgtcaccggcgtcggtgaggtccaggtgttcggcgcgcagtacgcgatgcgcatctgggtcgacccgggcaagttgaacaagtaccggctgaccccgggcgacgtcgaggaggcgatccgggaacagaacaaccaggtctccgccggccagctcggcggcacgcccgccgtgccgggccaagggttcaccgcgtcgatcacggcgcagagccggctgcagaccgtcgacgagttcgagcgcatcctgctgcgcagctcggcgcagggcggcgaggtgcggctgaaggacgtcgcgcgcgtcgagatcggcgccgagaactacggcatcgtcggccgcttcaacggccagcccgcctcgggcatcggcatcaagctcgccgcgggcgccaacgcgctcgacaccgccgaagccgtgaaggccaggatcgagcagatgaaggcctatttcccggccggtctcgagaccgtcatcccctacgacacgacgcccttcgtccagatttcgatcatgaacgtcgtgtacacgctgatcgaggcgatcatcctcgtgttcctggtgatgtatctgttcctgcagaacttccgcgcgacgctgattccgacgatcgccgtgccggtcgtcctgctcggcaccttcggcgtgatggcggcgttcggcttctcgatcaacacgctcacgatgttcgggctcgtgctggcgatcggcctgctcgtcgacgacgcgatcgtcgtggtcgagaacgtcgagcgcatcatgagcgaggaggggttgtcgccgaaggaggcgacccgcaaatcgatggggcagatcaccggtgcgctcgtcggcatcggcctcgtgctctcggccgtgttcgtgccgatggccttcttcggcggctcgaccggcgtcatctaccgccagttctcgatcacgatcgtcgccgcgatggcgctttcggtgctggtcgcgatcatcttcacgccggccctgtgcgcgacgatgctgaagccggtcgaaaagggccatggccacggtgaaggcggctggttctcgggattcttcggctggttcaaccgcatgttcgcgcgcaacaccgagcgctacgagtccgcggtcggcaagatcctcggccgcagcctgcgcttcctggcgatctacatcgcgatcgtcggcgtgctcgcgctgctgttcttccgcatgccgaccgccttcctgccggaggaggaccagggcgtgatgttcacccaggtcatcctgccggcgggcgcgagccaggagcgcacggtcgaggtcctgaaaaaggtcgagcaccagtacctcgagaacgagaagggcaatgtacgctcgattttcgccgcggccggcttcagcttcgccggccagggtcagaacatgggcatcggcttcgtcaacctcgagccctgggaccagcgtcacgaacccgaacaggacgtgaactcgatcgccgggcgggccatgggcgcgttctcgcagatcaaggaggcgatggtgttcgccttcgtgccgcccgccgtgctcgaactcggcacctcgagcggcttcaacgtgcaactgcaggaccgcgccggcctcggtcacgacgcgctgatcgccgcgcgcaaccaattcctcggcatggccgcgcaggacaagcgtctggtcggcgtgcggccgaacggccaggacgacgtcgccgagtaccaactcgacatcgactacgccaaggccggcgcgctcggcgtctcggtcgccgacatcaacgacacgctggcgaccgcgtggggcggcacctacgtcaacgacttcatcgaccgtgggcggatcaaacgggtctacctgcaagccgacgccgacgcacgcatgaagcctgaagacctcgcgaagtggtacgtgcgcaacacggcgggcgagatggtgccgctgtcggcgttcacgcgcgcgcactgggcctacggctcgccgcgcctcgaacgcttcaacggccagccctcggtcgaactgctcggccaggcggcgccgagcctgtcctcgggcgatgccatggcggcggccgaggagatcatcgccaagctgccggccggcatcggctacgaatggaccggcacctcgttcgaggagcgccgcagcggctcacaggcgccggcgctctacgcactgtcgctgctggtcgtgttcctgtgtctcgccgcgctctacgagagctggtcggtgccgttcgcggtgatgctcgtggtgccgctcggcgtcttcggtgccatgctcgccgcgagcggactcggattgtcgaacgacgtgtatttccaggtcgcactcctggcgacgatcggcctgtcgtcgaagaacgcgatcctgatcgtcgagttcgccaaggcgcagatggagaaggagggccgcgacctgatctcggcgacccgcgaggccgtgcgcatgcgtctgcggccgatcctgatgacctcgctcgccttcggcttcggcgtgctgccgctcgcccttgccagcggcgcgggttcgggcgcacagaatgcggtgggaaccggcgtcctcggcggcacgattgccggcacgctgctcggaatcttcttcatcccgctgttctacgtggttatcaagcgggtattcaaggacaagccgcggccaggcagcgtcgccgccgcccccgtgccgcaggagctcaagtga

SEQ ID NO: 74595 - protein, 1054 aa, Thiobacillus denitrificans ATCC 25259
MARFFIDRPIFAWVIAIVIMLAGALSILTLPVSQYPAIAPPTVAINASYPGASAKTVEDSVTQVIEQKLTGLDNLLYMSSQSDSYGRATVTLTFDAGTDPDIAQVQTQNKLQLALPLLPLAVQQQGVQVVKSTRNFLMIIGFVSKDGSMSRTDLADFLNSTVQEPLSRVTGVGEVQVFGAQYAMRIWVDPGKLNKYRLTPGDVEEAIREQNNQVSAGQLGGTPAVPGQGFTASITAQSRLQTVDEFERILLRSSAQGGEVRLKDVARVEIGAENYGIVGRFNGQPASGIGIKLAAGANALDTAEAVKARIEQMKAYFPAGLETVIPYDTTPFVQISIMNVVYTLIEAIILVFLVMYLFLQNFRATLIPTIAVPVVLLGTFGVMAAFGFSINTLTMFGLVLAIGLLVDDAIVVVENVERIMSEEGLSPKEATRKSMGQITGALVGIGLVLSAVFVPMAFFGGSTGVIYRQFSITIVAAMALSVLVAIIFTPALCATMLKPVEKGHGHGEGGWFSGFFGWFNRMFARNTERYESAVGKILGRSLRFLAIYIAIVGVLALLFFRMPTAFLPEEDQGVMFTQVILPAGASQERTVEVLKKVEHQYLENEKGNVRSIFAAAGFSFAGQGQNMGIGFVNLEPWDQRHEPEQDVNSIAGRAMGAFSQIKEAMVFAFVPPAVLELGTSSGFNVQLQDRAGLGHDALIAARNQFLGMAAQDKRLVGVRPNGQDDVAEYQLDIDYAKAGALGVSVADINDTLATAWGGTYVNDFIDRGRIKRVYLQADADARMKPEDLAKWYVRNTAGEMVPLSAFTRAHWAYGSPRLERFNGQPSVELLGQAAPSLSSGDAMAAAEEIIAKLPAGIGYEWTGTSFEERRSGSQAPALYALSLLVVFLCLAALYESWSVPFAVMLVVPLGVFGAMLAASGLGLSNDVYFQVALLATIGLSSKNAILIVEFAKAQMEKEGRDLISATREAVRMRLRPILMTSLAFGFGVLPLALASGAGSGAQNAVGTGVLGGTIAGTLLGIFFIPLFYVVIKRVFKDKPRPGSVAAAPVPQELK

SEQ ID NO: 74596 - DNA, 3129 bp, Silicibacter sp. TM1040
  CDS (1)..(3129)
atgatttcagaagtctttgtccgccgcccacgcctggccatggtgatttccatcgtcataaccatcgccggcctgatcgccatgtctgccattccggtggcgcagtaccccgagatcgcgccccccaccgtccaggtcagtgccagctatagcggtgcggacacggcaaccgtagaagaagccatcgcggtgccgattgagagccaggtcaacggggtttcaggcatgcgttacatgcgctccaactccaacaacgcgggcgaatacagcctcactgtgagcttcgagttgggtgaagacccggatctcgccaccgtgaacgtgcaaaatcgcgtaaagttggctgaaccccgacttccacaggcggtgcgcgatcagggccttcagatcaaaaaggcctccacggacatcttgcaggtctttacttttcactcagacgacccggcgcatgaccaactgttcctcgccaatttcgtcgcgatcaacatcatcgacgagctaaagcgcatcgacggcgtaggggacgtgttcaactacggtgtccgggactacgcgatgcgcatctggcttgatccgcaaaaaatgtcggatcgcgagatgagcgtcgacgacatcgtaagcgccatacgcagccagcacctgcaggcctcggccgggcggatcggcgcggcccctcttgtggaagatggtgcgggcttgcagatgacgattgttaccaaaggcaagctgaccagcgccgatgagttcgaaaacatcatcctccgcagcgagaccgatggatcttttgtgcgcgtcaaggatgtggcccgcgtggagcttggcgcagcgacctacgatgtcgagactcgatttgaaggcacgccgagtgcgccaatagcggtgtttctctcccccggagctaatgcggtcgcggtggccgaaaccgtgcgccacaagctcgaagagttgcaggaacggtttcccgacggcgtaagctacagctttatctatgacaccgccgaatttgtcgaagccatgatcaagaaggtggaacacacgctgatcgaggcctttgtccttgtcggcatcgttgtgtttgtctttctgggacgcttgcgcccgacgctcattccgctgatcgcggttcccgtttcgatcgtgggcacattcgcggtgctcttggcgcttgggtattcggccaatacgatttcgctcttggcgatgatccttgcaattggaatcgtggtggatgacgcgatcgtggtggtcgagaacgtcgaaaaggtcatgcatgaagagccgcacctgtcgcccgccgacgcgacgcgcaaggccatgaaagagatcaccgggccgatcattgcaatcacgctggtgctattgtcggtctttgtgccggtggcattcctgcccggatcaagcggcgtcctgtttcgccagttcgcggttaccatctcggcggcaatggtgatttctgcgatcaatgcgctgacgctctctcctgccctctgcgcgatcctgatgaaacctggcgaaccgatccgcttcatgcgtagggtctctgatgggatcgatgccttcagccgaggctatggcaacctgatccgcaggctggcgcgtttggctgtattgagcctggccctgacggcgctctttggctttgcgaccttccggctgggcagcattaccccctcgggatttctgccggcagaagacaagggtttcatccttgcggtcgcaaccctgccccccggtgcctcgttggatcggaccaccgccgtgctggaggcaggcgacgccctgatccgccaggaagagggcgtcgagagcatcgttaccatcgcaggtttcagcctgatcgacggtggtctggcctcgaatgcgggcatcgtctttatccgtcttgcggattttgccgatcgcgaagaccctgccatgcactcgacggagatcgtgcgacggatcacgggccgcctgcagcagatcggcggcgccaacttcatcgccttgaacccaccagcgcttccgggcgccggggcgacgggcggctttgagatgatgctggaggcgctacaggggcaatcgccgcgcgagatggcagccgtcatgaacggggtcgtcgtctccgccaatcaggacccgcgtctctcggcggtttactctacctttgaggcagccactccacaggtgcggctcgatattgatcgggaccggctctacacgctggggctgacactgccgcaggtgttttcttctctgcagggcacgttgggcggggtctacgtgaacgacattaccctctttggcaaaggctttacggtttgggtcaatggcgatgcagactaccgaggcaacattggcgcgatcaacaacatccgcatccgaaatgcgtcgggcgaaatggtgccggtctcatcctttgcgaccgcgcgcctagaatccggcacacgctctcaggtgcgctacaacaactatcgcgctgtggcgataaacggcagcccggccgctggcgtgggcgatggcgatgcaattaccgcaatggaggaaatcggcgcagcaaccatcccggatgggtttgcctatgagtggaccggcatggcgtccgaggtcaaaagctcggccgggcaaacggggattgttctgggctttgccctgctctttgcctatctgtttctggtcgcgctctacgagagctggaatgtcccggtgggcgtcatgctttctgtggtggccgcggtaatggtcgccatttttggcgtctgggtcgcgggatcttcccttgatgtctatgttcagatcggaatcgtggttctcatcgcgctggcggccaagaacgcgatcctgatcgtagagtttgctttgttgcgattgggagagggcaaatcgattgaggacgccgccgccttgggggcgcaagagcgtttccgtccggtgatgatgacttcttttgcctttatcgcaggtctggttccgctggtaactgcctcgggtccgggggctgacagcatgttcgccgttggggtgccagtctttgcggggatgatcggatccgctgtcattggcgtgatcttgatccccttgttgttcatcgtgtttgagcacatgcgcagctggagcaggcgcgcatctcctgctgcggacagccaataa

SEQ ID NO: 74597 - protein, 1042 aa, Silicibacter sp. TM1040
MISEVFVRRPRLAMVISIVITIAGLIAMSAIPVAQYPEIAPPTVQVSASYSGADTATVEEAIAVPIESQVNGVSGMRYMRSNSNNAGEYSLTVSFELGEDPDLATVNVQNRVKLAEPRLPQAVRDQGLQIKKASTDILQVFTFHSDDPAHDQLFLANFVAINIIDELKRIDGVGDVFNYGVRDYAMRIWLDPQKMSDREMSVDDIVSAIRSQHLQASAGRIGAAPLVEDGAGLQMTIVTKGKLTSADEFENIILRSETDGSFVRVKDVARVELGAATYDVETRFEGTPSAPIAVFLSPGANAVAVAETVRHKLEELQERFPDGVSYSFIYDTAEFVEAMIKKVEHTLIEAFVLVGIVVFVFLGRLRPTLIPLIAVPVSIVGTFAVLLALGYSANTISLLAMILAIGIVVDDAIVVVENVEKVMHEEPHLSPADATRKAMKEITGPIIAITLVLLSVFVPVAFLPGSSGVLFRQFAVTISAAMVISAINALTLSPALCAILMKPGEPIRFMRRVSDGIDAFSRGYGNLIRRLARLAVLSLALTALFGFATFRLGSITPSGFLPAEDKGFILAVATLPPGASLDRTTAVLEAGDALIRQEEGVESIVTIAGFSLIDGGLASNAGIVFIRLADFADREDPAMHSTEIVRRITGRLQQIGGANFIALNPPALPGAGATGGFEMMLEALQGQSPREMAAVMNGVVVSANQDPRLSAVYSTFEAATPQVRLDIDRDRLYTLGLTLPQVFSSLQGTLGGVYVNDITLFGKGFTVWVNGDADYRGNIGAINNIRIRNASGEMVPVSSFATARLESGTRSQVRYNNYRAVAINGSPAAGVGDGDAITAMEEIGAATIPDGFAYEWTGMASEVKSSAGQTGIVLGFALLFAYLFLVALYESWNVPVGVMLSVVAAVMVAIFGVWVAGSSLDVYVQIGIVVLIALAAKNAILIVEFALLRLGEGKSIEDAAALGAQERFRPVMMTSFAFIAGLVPLVTASGPGADSMFAVGVPVFAGMIGSAVIGVILIPLLFIVFEHMRSWSRRASPAADSQ

SEQ ID NO: 74598 - DNA, 3210 bp, Azotobacter vinelandii
  CDS (1)..(3210)
atgagcctgtcccactactgcatcgagcggccgatcttcgcctcggtgatttccatcgtcatcaccctggccggggcagtggcgatgttcaacctgccggtggcccagtacccggacatcaccccgccgcagatcaccgtatcggccacctatcccggcgccgacgccgaagtggtggccaacaacgtggcggcgcccatcgagcagcaggtcaacggcgccgacgacatgatctacatgaactcgtcgagttcggcgaccggcaacatgaccctcaacgtgttcttcgagatcggcaccgatccctcgctggcccaggtggacgtgcagaaccgggtcaacctggccctgccgcaactgccctcggcggtgcagagccagggcatccaggtgcagaagaagtcctcggccttcatgatggtcatcgcggtctactccccggacgaacgctacgacagcacctacatcgccaactacgccaacctgtacattctcgacgcgatcaagcgcatccccggcgccaaccaggcgagcatcttcggcaccccggactacgccatgcgcatctggctcaagcccgaccgcatggcccagttgaagatcaccgccgccgacgtgcagcaggcggtggccaaccagaaccagcagttcgccgtgggccgcatcggccagtcgccgaccggcgaggcggtggagcagtccttcgccgtcaccaccaagggccggctgaccgagccggaggagttcgagaacatcatcatccgcgccgccagcggcggggcggccatcgtccgcctgcgcgacgtgggccgcgccgagctgggccagaaggactactccctgcgcagcacctaccagggcaagccggcgacgctgatggcggtgtaccagcagcccggcgccaatgccctggacgtgtccgacgccgtcaggacgaccctggcggagatggagaagagttttcccgccggcatcgaatacaagatcgtgatggacaccacggccttcacccgcacctccatcgccgaggtggtgcacaccttcttcgaggccctggtgctggtggtggcggtcgtttacctgttcctgcagagcctgcgcgccaccctgatcccggtgctggcagtgccggtgtcgatcgtcggcaccttcatcggcatgaccgccctgggcttctcgatcaacatgctgaccctgttcggcatggtgctggcgatcggcatcgtggtggacgacgccatcgtggtgatcgagaacgtcgagcgcaacatgcaggtccaccgcctgccgcccagggaggccgccaagcgggcgatggacgaggtggccggcccggtggtggccatcgtcctggtgctctgcgcggtgttcgtcccggtggccttcatgggcggcatcaccggccagctctacaagcagttcgccatcaccatcgccatctccgtggtgatctccggcctggtcgccctgaccctgtcgccggccctcgccgcgatcctcatcaagcccgcccacgggcgcaagcgcggcttcttccgctggttcgaacgcaacttcgagcgcatgaccgagggctactcgcgcgcggtggccttcatgatcaagcgcttcctgctcgccctgctgctgttcgccgggatggtcgtgctcaccgtgctgatggcgcagcgcatccccggcgccttcctgccgccggaggaccagggctacctgctcggcgcggtgatcatgcccgacgccgccagcctggaccgcaccggcgaggtgggccgggcggtcagcgactacttcatgcgcgacgaagccgtcgagggggtggccatcgtcaacggctacagcctgctcgacagccagaacaagaacaacgccggcaccttcttcgtcggtttcaaggacttcgaggaacgctacaaggacgacgaaagcatccgtacgcagagcgccccggcggtcatcgcggccgccggccaggccttctcccgggtccgcgagggactcgtggtgccggtcaacccgccgtccattcccggcctgggcaccacgggcggcatggaggtgtgggtccagaacaagggcgacggcagcgtcggccaactcgccgggatagtgaacgatttcgtcgccaaggcccgccagcgaccggagatcggcgccatcaccgccaccttcaacgccgcctcgcggcaactgctggccgacgtggaccgggaaaaggcggaaaccctgggcgtgccggtggaggacgtgtacagcaccatgcagaccatgttcggctcgttgtacgtgtcgcagttcaacaagttcagccgcctgtggcaggtgatcctgcaggccgagccgacctaccgcctcagggtcgaggacctgcagcagatctacgtgcgcaaccgcggcggcgagatgatcccgctcaaggccctgctgagcacccgctacgtcaccggcccggacctgctgacccgcttcaacaacttcccggcggtgaagatcaccgccaacgcggcgccgggcttcagctccgggcaggcgctggcggccctggagacgctggccgcgcagaacatgtccggcgactacgccctggccctgagcggcgaggccttcgaggagaagaaggccggcggcaccagcgcccaggtgttcgtcttcggcctgatcatggtgttcctgatcctggcggcgcaatacgagaagtggacgctgccggtcggcgtgctgctggcggtgcccttcgcgctgttcggcgccctgctggcgatcctgttgcgcggcctggtcaacgacgtgtacttccagatcggcctgaccatgctggtggccctggcggcgaagaacgccatcctgatcttcgagttcgccgtgctgaaccgcgagaaaggcatgtccgtgttcgacgcggcgatgaccgcggcgcgcgaacgcctgcgccccatcgtgatgacctcgctggccttcattctcggctgcgtgcccctggccatcgccgtcggcgcctcggagaacagccgccactcgatcggtaccggggtgatcggcggcatgctggcggcgacggtgatcgcggtgttcttcatcccgctgttctactacctgatcgagcggctttccgagaagagcggcaccgcgaagcaggaagcgccgcccgccgagccggcgcccctgggcggcgacctgagcggcgtgccgcaacgccggcgcgaggacgactga

SEQ ID NO: 74599 - protein, 1069 aa, Azotobacter vinelandii
MSLSHYCIERPIFASVISIVITLAGAVAMFNLPVAQYPDITPPQITVSATYPGADAEVVANNVAAPIEQQVNGADDMIYMNSSSSATGNMTLNVFFEIGTDPSLAQVDVQNRVNLALPQLPSAVQSQGIQVQKKSSAFMMVIAVYSPDERYDSTYIANYANLYILDAIKRIPGANQASIFGTPDYAMRIWLKPDRMAQLKITAADVQQAVANQNQQFAVGRIGQSPTGEAVEQSFAVTTKGRLTEPEEFENIIIRAASGGAAIVRLRDVGRAELGQKDYSLRSTYQGKPATLMAVYQQPGANALDVSDAVRTTLAEMEKSFPAGIEYKIVMDTTAFTRTSIAEVVHTFFEALVLVVAVVYLFLQSLRATLIPVLAVPVSIVGTFIGMTALGFSINMLTLFGMVLAIGIVVDDAIVVIENVERNMQVHRLPPREAAKRAMDEVAGPVVAIVLVLCAVFVPVAFMGGITGQLYKQFAITIAISVVISGLVALTLSPALAAILIKPAHGRKRGFFRWFERNFERMTEGYSRAVAFMIKRFLLALLLFAGMVVLTVLMAQRIPGAFLPPEDQGYLLGAVIMPDAASLDRTGEVGRAVSDYFMRDEAVEGVAIVNGYSLLDSQNKNNAGTFFVGFKDFEERYKDDESIRTQSAPAVIAAAGQAFSRVREGLVVPVNPPSIPGLGTTGGMEVWVQNKGDGSVGQLAGIVNDFVAKARQRPEIGAITATFNAASRQLLADVDREKAETLGVPVEDVYSTMQTMFGSLYVSQFNKFSRLWQVILQAEPTYRLRVEDLQQIYVRNRGGEMIPLKALLSTRYVTGPDLLTRFNNFPAVKITANAAPGFSSGQALAALETLAAQNMSGDYALALSGEAFEEKKAGGTSAQVFVFGLIMVFLILAAQYEKWTLPVGVLLAVPFALFGALLAILLRGLVNDVYFQIGLTMLVALAAKNAILIFEFAVLNREKGMSVFDAAMTAARERLRPIVMTSLAFILGCVPLAIAVGASENSRHSIGTGVIGGMLAATVIAVFFIPLFYYLIERLSEKSGTAKQEAPPAEPAPLGGDLSGVPQRRREDD

SEQ ID NO: 74600 - DNA, 3114 bp, Methylobacillus flagellatus KT
  CDS (1)..(3114)
atggctcgatttttcattgaacgcccagtcttcgcctgggtcatttccctactgatcatcctggcgggcctgctcgcgatccgcggcctgccggtcgcgcaatatccggacattgcgccgccagtagtgaacatttccgccacctatccaggggcgtccgccaaggtgatcgaggaatcggtcactgccatcatcgagcgcgaaatgaacggtgcgcccggcctgatgtatatctcggccaccagcagcccgggcacggcttcgctcagcctcaccttccgccagggcaccaacccggatctggcggcggtggaagtgcagaaccgcttaaagacggtggaggcgcgcctgccggaagtcgtacgccgcaacggtatcttcatcgagaaatccgcagacagcatccaattgattgtttccctcacctccgaaggcaatcgcctgaccgagatcgagctgggcgagctggccgcagccaacgtactgcaggcattacggcgcgtcgagggcgtgggcaaggtgcagatatggagcccggaatacgctatgcgtatctggcccgaccccgccaaactgactgcaatgaacctcagcgcttccgatgtcgcctctgcaatccgtagccacaatgcccgtgtcacggttggcgacttgggcaaccgggcggtgccagaccacgcacccatcagcgccaatgtcatttccgacagcgccctgacaacgccggaagacttcgagcgcattccgctgcgtaccagggccgacggctcggccatcctgctcaaagacgtcgcgcgggtagaattcggtggcagtgattacgcgttcgtgtcgcgcgtgaacggcaataacgctgccggcatggccgtcaaaatggcgccgggctcgaacgccgtcgccaccgtcaagcgcattcgcgccaccatggatgagctcgtgcgctatctgccggctggcgtcagttaccagattccctatgacacttccgcttttgtcgagatttccatcgagaaagtcgtgcataccctattggaagccatcgtgctggtgttcctggtgatgttcctgttcatgcaaaacctgcgcgccacgctgattcccaccatcgtcgtgcccatcgccctgcttggcacgtttgccgtgatgctcgcggctggcttctcgatcaatgtgttgagcatgttcggcatggtgctggccatcggcatcgtggtcgatgatgccattgtcgtcgtagagaacgtcgaacgcatcatggcagaagaaggcctgccgccgttgcaggccacgatcaaggccatgaagcagatcagcggcgcgatcatcggcatcaccgtcgtgctgatttccgttttcgtgcccatggcgttcttcagcggcgcggtcggcaacatctaccgccagttctcgatgtcgcttgccgtatcgattgccttttccgcttttctcgcactttcgctcacgcctgccctgtgcgctacactgctcaagcctattatccaggaccaccatgaaaagcgcggtttcttcggctggttcaaccggatgtttgcagccttgaccggccgctaccagcagcgcgtcggtgccatcatcaagcgtcccatcaggtggctggtggtatatggcaccatcatcgctgtggtcgtattcatgttcgtgcgattgcccacagccttcctgcccgatgaggaccagggcgacttcatgattaccgtgctgctgccggccggtgccaccatgcatgaaaccatgggcacactggcacacatcgcacattacctgaatgagaacgagccggtgaaatacgtctacgaggtcggcggtttcagcttctatggcaccggctccaacagcggcatgatcttcgccaccctcaaggactggaaggaacgcgaggatgccgggcagcatgtcaaggcgattgtagaccgcgtcaatatgcaattcatggggctgaaaaacaccacggtattcgcggtcaacaccccaccacttcccgagctgggctcctccaacgggttcgacctgcggctgcaggatcgtggctcggcaggctaccaggcattccttgccgccaaggaccagctcatgagcgaaggcatgaaaagcccggtactgaccaacctcatttttgcaggcttacccgaggccgccctggtgaacctcgacatagaccgccgcaaggccgaggcactgggcgtaggcatggatgagatcaatatcacgctggcctccatgttcggctccgactacatcggcgacttcatgcacggcaaccaggttcgccgcgtcatcatgcaggcggacggcaaggacaggctggaactggaggatatccgcaagctcagggtgcgcagcagcaatggcagcatggtgcctttatcttcgatcgtgcaactggaatggatttccggcccgccacagctcacgcgctacaacggctacccgtccttcaccatcaacggcaatgccgcccccggctacagcagcggcgaggccatgcaagcgattgaaggcattgcccgcagcttgccccgcaccattggctacgactggtcaggccaatccctggaagaacgccgctcgggcgcacaggcacccatgctgttcggcttgtccgtgctgatcgtcttcctggcactggcagcgctatatgaaagttggctgattcccctggccgtgatcctggtggtgcccttgggcatactcggtgcattgctgggcgtgaccttgcgcgacatgcccaatgatatctacttcaaggtcggcctgatcgccaccatcggcctttccgccaagaatgcaatcctgatcgtggaagtcgccaaggacctctatgccgacggcatgggactcatggaagcgacactggaagctgcccgcctgcgactgcgccccatcgtcatgacatccctggctttcggcgtgggcgtattgccgctggccattgccacaggcgccgcctccggcgcccagtcggcaatcggcaccagcgtgctgggcggcatcatcactgcaaccctgctcgccatcttcctcgtccccttgtttttcgccgtgatcggtcgctatatcaagcgaccgcaacaccatacgcgggagtctgcatga

SEQ ID NO: 74601 - protein, 1037 aa, Methylobacillus flagellatus KT
MARFFIERPVFAWVISLLIILAGLLAIRGLPVAQYPDIAPPVVNISATYPGASAKVIEESVTAIIEREMNGAPGLMYISATSSPGTASLSLTFRQGTNPDLAAVEVQNRLKTVEARLPEVVRRNGIFIEKSADSIQLIVSLTSEGNRLTEIELGELAAANVLQALRRVEGVGKVQIWSPEYAMRIWPDPAKLTAMNLSASDVASAIRSHNARVTVGDLGNRAVPDHAPISANVISDSALTTPEDFERIPLRTRADGSAILLKDVARVEFGGSDYAFVSRVNGNNAAGMAVKMAPGSNAVATVKRIRATMDELVRYLPAGVSYQIPYDTSAFVEISIEKVVHTLLEAIVLVFLVMFLFMQNLRATLIPTIVVPIALLGTFAVMLAAGFSINVLSMFGMVLAIGIVVDDAIVVVENVERIMAEEGLPPLQATIKAMKQISGAIIGITVVLISVFVPMAFFSGAVGNIYRQFSMSLAVSIAFSAFLALSLTPALCATLLKPIIQDHHEKRGFFGWFNRMFAALTGRYQQRVGAIIKRPIRWLVVYGTIIAVVVFMFVRLPTAFLPDEDQGDFMITVLLPAGATMHETMGTLAHIAHYLNENEPVKYVYEVGGFSFYGTGSNSGMIFATLKDWKEREDAGQHVKAIVDRVNMQFMGLKNTTVFAVNTPPLPELGSSNGFDLRLQDRGSAGYQAFLAAKDQLMSEGMKSPVLTNLIFAGLPEAALVNLDIDRRKAEALGVGMDEINITLASMFGSDYIGDFMHGNQVRRVIMQADGKDRLELEDIRKLRVRSSNGSMVPLSSIVQLEWISGPPQLTRYNGYPSFTINGNAAPGYSSGEAMQAIEGIARSLPRTIGYDWSGQSLEERRSGAQAPMLFGLSVLIVFLALAALYESWLIPLAVILVVPLGILGALLGVTLRDMPNDIYFKVGLIATIGLSAKNAILIVEVAKDLYADGMGLMEATLEAARLRLRPIVMTSLAFGVGVLPLAIATGAASGAQSAIGTSVLGGIITATLLAIFLVPLFFAVIGRYIKRPQHHTRESA

SEQ ID NO: 74602 - DNA, 3180 bp, Methylobacillus flagellatus KT
  CDS (1)..(3180)
atgctgaatattttcatcaaaagaccggtcatggcgattgtattgtcgctattgatcgtattcatggggttcttgtcgatcaagaccctgcccacatcgcagtttcccgacatcgcgccgccgcgcgtgatcgtctcgctggcctaccccggcgccagcgccgacgtgctggtgcagtcatcgctgatcaccattgagcgtgcgatcaacggcgtacccggcatgaagtacatcgtgtctgatgccaccagcgcgggcgaagccacgatccaggtgatcttcgacctcggcgtggaccccaaccaggccatgatcaacgtcaagacccgtatcgaccaggtgatgagccgcctgcccgagctggttcagatggaaggcgtggtggtcgaacgcgtccagcccagcatgctgatgtacatcaatctttacagcaaggataagcacgcggacgagaaattcctcttcaactacgccaacgtcaacatcatccccgagatacagcgcgtcaacggcatcgcccaggccaagatcctcggcagccgccagtacgcgatgcgcatctggctcaacccagaacgcatgcgcgcctacaacgtctccaccgaggaagtcatgaaggcgatcaacagccagagcgtgatcggccgccccggccgcctgggccagagctcgggcatcaccgcgcaatccaaggaatacgtgctgatctaccagggccgctacaacaagcccgagcagtatgcagacatcatcatccgcgcaaactccgaaggcgagatcctccacctcaaggacatcgccaaggtcgagctgaacagcgagttctacgacatttactccaacaaagatggctatccttcagcggccatcgtgctcaagcagaactacggcagcaacgccaccgaagtgatcgagcatgtgaaggaaagaatggaggaactgaaggcatccttccccgaaggcatggattatgaagtcaactacgacgtatccaagttcctggatgcttcgatcgaaaaggtgatccacaccctgatcgaggcgttcgtcctggtagccctggtggtgttcatcttcctgggcgactggcgctccaccctgatcccgatcctggcggtgccggtgtcgctgatcggcaccttcttcgtcatgcagatgttcgggatttcgatcaacctgatcacactgtttgcactggtgctggcaatcggtattgtggtggataacgccattgtggttgtggaagctgtccatgccaagatggaaaccgagcacttgactccctacaaggccacccaaaaggtgctgggggagatcggcggggcgatcgtcgccattaccctggtgatgaccgccgtgttcgtgcccgtggccttcatgactgggccggtgggcgtgttctaccgccagttctccatcaccatggcagcttccattatcatctcgggcgtcgtcgccttgtcgctgacgccggtgctgtgcgcgatgctgctgaagaacaaccacggccagcccaagcgcaagacgccggtcagcctgttcatcaacgccttcaaccatgtgttcgagaaggtgacgggacgctacacccaattgctggatatcgtcgtcacgcgccgcatcgtcaccttcctcatgctggccgcgttcgccgccggtaccttcctggtcgacaagacattgcccgcaggcttcatcccgggcgaggaccagggcatggtgtacgcgatcatccagacgccgcccggctccacgctggaagtcaccaacaagatcgcccggcagttgcagggcatcgcctccaaggtcgagggcgtgcagtcggtatcttccctggcgggctacgaggtgctgaccgagggccgcggctccaatgccggcacttgcatcatcaacctcaaggactggtctgagcgcaagcaatccgtgcaccagatcatcgaggagctggaagaaaaaaccaaggacttcggcgccgtgatcgagttcttcgagccgccagccgtccccggctacggcgcggcatcgggcctggcgctgcgcctgctcgacaagaccgataacacggattaccacgagttcgacaagatcaaccaggatttcatgaaggcgctcgccaagcgcaaggagctcaccggcctgttcaccttctatgcggcgaactacccgcagtatgaaatccagatcgacaacaagctcgcgatgcagaagaaggtttcgatcgccaaggcgatggacaacctggacatcctgatcggcagcacctacgagcagggcttcatccgcttcaacaacttcttcaaggtctacacccaggccgggccggaattccgccgctacccgaccgacatcctcaactactacgtgaagaacgaggaaggcgaaatggtgccctactcggccttcatgaagctgaagaagatgcagggcccgaacgagatcacgcgctacaacctctacaactccgccaccatccgcgccatgcctgccgacggctacaccacggacgacgcgatcaaggcggtggagcaagtggcgaaagccaccctgccgcacggctatgacatcggctgggaaggcctgtcattcgacgaggccaaccgtggcaacgaggccatcatcatcttcggcgtcgtgctggtgttcgtctacatggtgctggcagcgcagtacgagagcttcattctgccgctggtggtcgtgctctcgctgcccgcgggcgtgttcggctcgttcttcatgttgaaagcattggggcttgccaacgacatctacgcccaggtcgggctggtgatgctggtcgggctgctcggaaagaacgcggtgctgatcgtggaatatgcggtgcagaaacatgcgcaaggcctgtcgatcaaggatgccgcgatcgagagcgcacgcgtacgcttccgccctatcctgatgacctcgtttgccttcatcgccggcctgatcccgctggtcgtcgccacgggcgcgggcgcggtgggcaaccgtaccatcggcagctccgcgctcggcggcatgctgttcggcaccatcttcggcgtcattctcatccctggtctgtactacatatttgccaaactgtccgacggcaaatccatgatccggaacgaagagtttgagccactcactgaaacctaccattacagcaagagcgatgatgaccaagaataa

SEQ ID NO: 74603 - protein, 1059 aa, Methylobacillus flagellatus KT
MLNIFIKRPVMAIVLSLLIVFMGFLSIKTLPTSQFPDIAPPRVIVSLAYPGASADVLVQSSLITIERAINGVPGMKYIVSDATSAGEATIQVIFDLGVDPNQAMINVKTRIDQVMSRLPELVQMEGVVVERVQPSMLMYINLYSKDKHADEKFLFNYANVNIIPEIQRVNGIAQAKILGSRQYAMRIWLNPERMRAYNVSTEEVMKAINSQSVIGRPGRLGQSSGITAQSKEYVLIYQGRYNKPEQYADIIIRANSEGEILHLKDIAKVELNSEFYDIYSNKDGYPSAAIVLKQNYGSNATEVIEHVKERMEELKASFPEGMDYEVNYDVSKFLDASIEKVIHTLIEAFVLVALVVFIFLGDWRSTLIPILAVPVSLIGTFFVMQMFGISINLITLFALVLAIGIVVDNAIVVVEAVHAKMETEHLTPYKATQKVLGEIGGAIVAITLVMTAVFVPVAFMTGPVGVFYRQFSITMAASIIISGVVALSLTPVLCAMLLKNNHGQPKRKTPVSLFINAFNHVFEKVTGRYTQLLDIVVTRRIVTFLMLAAFAAGTFLVDKTLPAGFIPGEDQGMVYAIIQTPPGSTLEVTNKIARQLQGIASKVEGVQSVSSLAGYEVLTEGRGSNAGTCIINLKDWSERKQSVHQIIEELEEKTKDFGAVIEFFEPPAVPGYGAASGLALRLLDKTDNTDYHEFDKINQDFMKALAKRKELTGLFTFYAANYPQYEIQIDNKLAMQKKVSIAKAMDNLDILIGSTYEQGFIRFNNFFKVYTQAGPEFRRYPTDILNYYVKNEEGEMVPYSAFMKLKKMQGPNEITRYNLYNSATIRAMPADGYTTDDAIKAVEQVAKATLPHGYDIGWEGLSFDEANRGNEAIIIFGVVLVFVYMVLAAQYESFILPLVVVLSLPAGVFGSFFMLKALGLANDIYAQVGLVMLVGLLGKNAVLIVEYAVQKHAQGLSIKDAAIESARVRFRPILMTSFAFIAGLIPLVVATGAGAVGNRTIGSSALGGMLFGTIFGVILIPGLYYIFAKLSDGKSMIRNEEFEPLTETYHYSKSDDDQE

SEQ ID NO: 74604 - DNA, 3156 bp, Methylobacillus flagellatus KT
  CDS (1)..(3156)
atgaagcgcatcatttcctggtccaggctcaggcccgatgagcgcggacctgcctccctgttcatcctgcggccagtgatgaccctgctggtgtcgctgggcatgatgcttgcgggctggctggcttttggcctgttgccggttgcgccgttgccgcaggtggatttcccgacgatcaatgttaccgcctcgctggccggtgcgaacccggagaccatggcctcttcggtggcgacaccgctagagcgtagcctgggccggatatcgggcatcagcgaaattacgtcatccagttcccaggggagcacgtcgattaccttgcagttcaacctggacaaggatatcgatgtcgctgcacgggaagtgcaggccgcaatcaatgcggctgcgagcatgttgcccagcggcatgccgaatcgacccagctatcgcaagatcaatccggcggatatgccgagcatggtgcttaccatgacttccagaaccaagagcatgggtgagctgtacgacctggctaccaacatggtgtcgcgcaagatttcgcaagtacagggggtgagccaggtcaatgtcgcaggcagctccctgccggcagtacgcgtggatatcaatcccgatgccttggttcagcaaggactgtcgctggatgcagtacgcaatgccatcagcgctgctaatggcaacggccccaagggatatctgcagaatgacgaataccgttggcagctggatgcggatgaccgcctgctgcgtgccaaggattaccgctcactcatcatcgccaccaatcaaggtgcggtgacgcgcctgagcgacgtggccagggtgtatgactcggtggaggatatccgcaacgtgggcttccacaataaccagcgtgccatcctgctgatggtcagccgcgagccgggcgccaacatcatcgagatgattgagcgtatccatgcagagctgcccagcatccagagtagcctgggcgaggatatcaagctcaccgttgtggaagaccgcagcccgaatatccgtgcttccctgcacgaagccgagctgacactggtgattgcggtggcgcttgtgatcctggtagtgtttcttttcctgcgaaatagtcgcgcgacgctgattcctgcgttggccgtgccggtgtcgctgatatcaacctttgccgtcatgtatctttgtgggtattcactgaataacctgaccttgatggcgctgatcatcgccacgggttttgtcgtggatgatgccatcgtggtggttgagcatatcagcaagcgcatcgagcagggtgaagcgccgctccgggcttcgttgcgcggtgcccgtgaagtcggctttaccgtggtgtccatgagcttttcgctggtggcggtgttcatcccgctgctgttcatgggagatatcactggccgcctgttccgggagtttgcagtgacgctgtctgtcgcgatcctggtctcgctgttcgtctcgctgacgctgacgcccatgctgtgcgcctatctgctcaggcgtcaagatgctgcgaccattgagggagaaagcgccccggagagacgcagagcaggcttgttcatccgcatacagcgccgctaccgccagagcctggcctgggctttggatcatgctgcggggatgatggtgatcctgctgttcgcagttgcggtcaatgtctacctctatattgccatccccaaggggatgtttccggagcaggatactggccggctgtttggcaatgcccgcgcggaccaaggcgtgtcgttcaatgagctacagagaaagctggaagcattccgcagcatcctgctggcagatcccgcagtagaccaggtcatggggatgtcgggtagtggacgcgggccgggtgcctccaccaattccggcaactttatcattatcctcaagaacattcgcgagcgtgagtcggcacaagccgtcattgcacgcttgcggcccaagctggcgcaagtgccgggggcctccatgttcctggtcaatatgcaggatttgcgcatcggcggccgatctaccgattccagctaccagatgacactgaagagcgatgatgtcaaagacctacgcaaatgggagaacaaggtattggagactctgcaatccttgcccgatatcacggatgttggcggcggcggccgcagccgttcaatacaggttttcctcgatatagaccgcgaggcggccaaacgcctgggtatcgacgttgagatggtgattgcgctgctgaacaactcctacgcccagcgccagatttccacgatttacgaagaccagaaccagtaccgcgtggtcatgggtgtggacgaaaaatacatgcagggccccgatatcttgtctagcctttatgtgctgactgccagcggcaaccgtgtaccgctgtccaacctcgtgagcctgagttacaacaatgcaccgccaaggatagagcacgaggggcagttcgcctccgtgacctattccttcaatctgccagagggcggtaatctcgaatatgcgaagcagaagatcaggagtgcccttgccgatctcaaaatgccgctcaacgtgcaggcgaccttttccggtacggccagcgcccaaagcaaagtgctcaagcaaatgccatggctgatcctggctgcgctggtttcggtctatattgtcctgggcatgctgtacgagagttacgtccatccactcaccatcctctcgacactgccttctgcaggtgtgggtgcgttgctcgccttgatcctgttcgatacgccgctcaccctcatcgccttgatcggcatcatcctcctgattggcatcgtcaagaaaaacgccattctcatgatcgatttcgcactggtggcggagcgcgaacgtggcttgtcttccagggatgccatcatggatgcctgccagcagcgtctgcgccccattctcatgacgaccatggcggcgttgctgggcgcattgccattgatattcggcaccgacggcgatgcgccattgcgtcggcctctgggtatcgcgatcgtcggcggcctgctgctgagtcagttgcttaccttatacaccacacccgtggtctatctttaccttgatcgtttacgcctgtgggtcttgcgtcgcaagccgcaggccgcaatgatggagaaaacggaatga

SEQ ID NO: 74605 - protein, 1051 aa, Methylobacillus flagellatus KT
MKRIISWSRLRPDERGPASLFILRPVMTLLVSLGMMLAGWLAFGLLPVAPLPQVDFPTINVTASLAGANPETMASSVATPLERSLGRISGISEITSSSSQGSTSITLQFNLDKDIDVAAREVQAAINAAASMLPSGMPNRPSYRKINPADMPSMVLTMTSRTKSMGELYDLATNMVSRKISQVQGVSQVNVAGSSLPAVRVDINPDALVQQGLSLDAVRNAISAANGNGPKGYLQNDEYRWQLDADDRLLRAKDYRSLIIATNQGAVTRLSDVARVYDSVEDIRNVGFHNNQRAILLMVSREPGANIIEMIERIHAELPSIQSSLGEDIKLTVVEDRSPNIRASLHEAELTLVIAVALVILVVFLFLRNSRATLIPALAVPVSLISTFAVMYLCGYSLNNLTLMALIIATGFVVDDAIVVVEHISKRIEQGEAPLRASLRGAREVGFTVVSMSFSLVAVFIPLLFMGDITGRLFREFAVTLSVAILVSLFVSLTLTPMLCAYLLRRQDAATIEGESAPERRRAGLFIRIQRRYRQSLAWALDHAAGMMVILLFAVAVNVYLYIAIPKGMFPEQDTGRLFGNARADQGVSFNELQRKLEAFRSILLADPAVDQVMGMSGSGRGPGASTNSGNFIIILKNIRERESAQAVIARLRPKLAQVPGASMFLVNMQDLRIGGRSTDSSYQMTLKSDDVKDLRKWENKVLETLQSLPDITDVGGGGRSRSIQVFLDIDREAAKRLGIDVEMVIALLNNSYAQRQISTIYEDQNQYRVVMGVDEKYMQGPDILSSLYVLTASGNRVPLSNLVSLSYNNAPPRIEHEGQFASVTYSFNLPEGGNLEYAKQKIRSALADLKMPLNVQATFSGTASAQSKVLKQMPWLILAALVSVYIVLGMLYESYVHPLTILSTLPSAGVGALLALILFDTPLTLIALIGIILLIGIVKKNAILMIDFALVAERERGLSSRDAIMDACQQRLRPILMTTMAALLGALPLIFGTDGDAPLRRPLGIAIVGGLLLSQLLTLYTTPVVYLYLDRLRLWVLRRKPQAAMMEKTE

SEQ ID NO: 74606 - DNA, 3135 bp, Methylobacillus flagellatus KT
  CDS (1)..(3135)
atgaatccctcccgggtttttatcgaaaggccggtagcgactacgctgctgatgctggccttgcttatatcaggcctgctggcctataccttgttgcctgtcgcctccttgccggaagtggaatatcccactatccaggtgaagaccttgtatcccggggccagccccgaggtggtcaattccatgatcacagcaccgttggaaagccagctcggcaggattgcaggcctggacgaaatgtcttccagcagttcaggcggcgcttcggtgatcacactgcgcttcaacctcaatacgagcctgggcattgccgagcaaggcgtgcaagccgcgatcaataccgcatccaacctgctgcccaatgatttgccgactcagccggtctacagcaaggtcaatcctgctgatgtccctgtgttgaccctggccgtcacttccgacgccttgcccctgcccaaggtgcaggacctggtcgatacgcggctcgcacagaagatcgcgcagatttcaggtgtcggcatggtcagcatcagtggtgggcagcggccggcagtacgcgtcagcgccaatcccaccgcgctggcggcttatggcctcagcctggagtccatccggacggcgattgccagcaataacctgaacggatccaagggcagcttcaacggtgccacgcgctctaccatcatcgatgccaatgatcagatgcgcagcgtcgaggagtatcgcaacctggtgctgagctaccagaatggcgcgccgataaggctcaaggacgtggctgaggcctatgacggtgccgaaaacgaatacctcgccgcgtgggcaaatgacaagccggccgtcatcgtcaatatccagcgccagcccggggcgaatgtgatcgaggtggtcgagcgtgtgcgggacatgttgcccagcctcaaggaaagcctgccagagaatgtgcatgtctccatcctgagcgaccgcagtcacaccatccaggcttcggtgagggatacgcagttcgaactgctgcttgcgatcgggctggtagtcctggtgactttccttttcctgcaggatgcccgtgcaaccctgataccgtccattgccgtgccactgtcgttgatcggcacctttggcgtcatgtacctggctgggttttccctcaataaccttaccttgatggcattgacgattgccaccggcttcgtcatcgacgatgccatcgtcatgctggaaaatatcgagcgctacattgagcagggagacagtccgctgcaggcggcattgaagggttcgaagcagatcagcttcaccatcatttcattgacggtttcactggttgccgtattgattccgctccttttcatgagcgatattgccggacgcttgttccgcgagtttgcgttgaccctcgccatcgccattctcgtatcgatgctgatttctctgaccttgacccccatgttgtgctcgttatggctcaaacatgtgccacacaccgaaaaggggcggttttctcaggccggcgcccggatgatgcaggggctcatcacgcattatggccgcgcattgaaatgggtgttgtcgcatcagtggtcgacactgtttgcagcattggtgacgctgctcattacggtgctgctctatctctatttgcccaagggtttcttcccgacccaggacaccgggttgatccaggggatcagcgaggcaccacagtcggcgtcatttaacgccatggcaagaaagcaagcgcatctggcccgcgtgatccagcgcgacccggccgtggaaagcgtgtcatcctacatcggggtagacggtaccaacgaagcgcttaataccggacgtttgctgatcaacctcaagccccatgcggatcgcgacgtgaccgccagtcaggtgatcgcccgtctcaagcaggcgacggcggatatcccggatttcaagctctacctgcagccggtgcaggatctcaccatagaggacaagagcagccgcacacagtaccgcttcttgctcacggaccccgatatcagcgtgctgcagtctgccatgccgcgcgtgctggaacgcctgggccagttgccgcagatcaccgatgtcgccagtgaccttcagggcaagggcctgcaggctttcctggtgatagaccgtgacaatgcggcccggctcggggtgaccgttgccaatatcaatgcggtgttgtacaacgctttcggccaacggctgatttccaccatctacacccaggccaaccaataccgtgtggtcatggaagtgccgcccaacttccgcagcggccctgtggcgctcgccaatctctatgtgcccgggagcagcaccgatagcgcaggcaatgtagtgacgacgcaggtgccactcaatacactggtacacgttgaggagcgcaacaccttgctcaccattaaccatatcggccaattccctgccgccaccgtgtctttcaatctggctgaaaatgtcgcgctgggtgatgctgtggcggctattcgagaggccgtggccgggctgcagttgccgggcagtgtacagacccggttccagggagcggcgctggcattcgaggcttcgctttccaataccttgttcctgatcctggcggcgctggtatgcatgtatatcgtactcggcatcctgtatgagagctttatccatccagtgaccattctttccacgctgccttcagcaaccgtgggggcgatgctggcattgtgggtgtacggacatgaaatcggcatggtggccatcatcggcatcatcttactgatcggcatcgtgaagaagaacgccatcatgatgatcgattttgcactggctgcggagcgcgagcaggggctcaagccggtagatgcgatctaccaggcctgcctgctgcgtttccgccccatcctgatgacgaccatggcagccttgttcggcgccttaccgctgatgttttccaccggggcgggcgcggaattgcggcagcccctaggtattaccatggtgggtgggctgttgctgtcgcaattgctgaccatcttcactacgcctgtgatttacctgatgttcgatcgtctggtgcggcgccgacgtgccagtgcggaacgccgtagcggcaacacgggtgaggagctggcctga

SEQ ID NO: 74607 - protein, 1044 aa, Methylobacillus flagellatus KT
MNPSRVFIERPVATTLLMLALLISGLLAYTLLPVASLPEVEYPTIQVKTLYPGASPEVVNSMITAPLESQLGRIAGLDEMSSSSSGGASVITLRFNLNTSLGIAEQGVQAAINTASNLLPNDLPTQPVYSKVNPADVPVLTLAVTSDALPLPKVQDLVDTRLAQKIAQISGVGMVSISGGQRPAVRVSANPTALAAYGLSLESIRTAIASNNLNGSKGSFNGATRSTIIDANDQMRSVEEYRNLVLSYQNGAPIRLKDVAEAYDGAENEYLAAWANDKPAVIVNIQRQPGANVIEVVERVRDMLPSLKESLPENVHVSILSDRSHTIQASVRDTQFELLLAIGLVVLVTFLFLQDARATLIPSIAVPLSLIGTFGVMYLAGFSLNNLTLMALTIATGFVIDDAIVMLENIERYIEQGDSPLQAALKGSKQISFTIISLTVSLVAVLIPLLFMSDIAGRLFREFALTLAIAILVSMLISLTLTPMLCSLWLKHVPHTEKGRFSQAGARMMQGLITHYGRALKWVLSHQWSTLFAALVTLLITVLLYLYLPKGFFPTQDTGLIQGISEAPQSASFNAMARKQAHLARVIQRDPAVESVSSYIGVDGTNEALNTGRLLINLKPHADRDVTASQVIARLKQATADIPDFKLYLQPVQDLTIEDKSSRTQYRFLLTDPDISVLQSAMPRVLERLGQLPQITDVASDLQGKGLQAFLVIDRDNAARLGVTVANINAVLYNAFGQRLISTIYTQANQYRVVMEVPPNFRSGPVALANLYVPGSSTDSAGNVVTTQVPLNTLVHVEERNTLLTINHIGQFPAATVSFNLAENVALGDAVAAIREAVAGLQLPGSVQTRFQGAALAFEASLSNTLFLILAALVCMYIVLGILYESFIHPVTILSTLPSATVGAMLALWVYGHEIGMVAIIGIILLIGIVKKNAIMMIDFALAAEREQGLKPVDAIYQACLLRFRPILMTTMAALFGALPLMFSTGAGAELRQPLGITMVGGLLLSQLLTIFTTPVIYLMFDRLVRRRRASAERRSGNTGEELA

SEQ ID NO: 74608 - DNA, 3198 bp, Polaromonas sp. JS666
  CDS (1)..(3198)
atgctgtcgctgctcatgctcatctcgggcctgattgcgctgcgctcgctgccgattgccgaataccctgacgtggtgccgcccaccgtggtggtgcgcgccaactaccccggcgccaaccccaaggtgattgccgagaccgtggccacgccgctggaggaagccatcaacggcgtggacggcatgctctacatgagcagccaggcgaccaccgacggcctgatgacgctcaacgtcaccttcaagctcggcaccgaccccgacaaggcccagcagctggtgcaaaaccgcgtctcgcaagccgagccgcgcctgccggaagaagtgcgccgcctcggcattaccacgatcaagagctcacccgacctcacgatggtggtgcacttgctgtcgcccagcggccgctatgacatgacctatctgcgcaactacggggtgctcaatgtcaaggacaggctggcccgcatcaacggcgtgggccaggtgcagctgttcggctcgggcgactactcgatgcgcgtctggctggacccgcaaaaggtggccgagcgcggcctgtccgccggtgacgtggtgcgcgccatccgcgagcagaacatccaggctgcggccggcgtggtgggtgcctcgcccggattgcccggcgtggacatgcaactgtccatcaacgcccagggacgcctgcaaagtgaagaagaattcggcgacatcattgtcaaaaccgaaaaggccgaaaaaggcggcgcagtcacgcgcctgcgcgacatcgcccgcctggaactgggcgcctccgactatgcgctgcgctcgctgctcgacaacaagcaggccgtggccgtgccggtgttcgccgcgccgggctccaatgccatccagatttccgatgacgtgcaggccgtgatgaaggacctgaaaaagaacatgcccgaaggcgtggactacgagatcgtttacgacaccacccagttcgtgcgctcgtccattgaagccgtggtgcacacgctgctcgaggccgtggccctggtggtgctggtcgtgatcatctttttgcagacctggcgcgcttccatcattccgctgctggccgtgcccatctcggtcatcggcacctttgcggtgatgcatctcttcggcttttccatcaacgcgctcagcctgttcgggctggtgctggccatcggtatcgtggtggacgacgccatcgtggtggtcgaaaacgtggagcgcaatatcgaggcgggcctgagtccgcgcgacgccacctaccgcgccatgcgcgaggtgtcggggcctatcatcgcgattgccctggtgctgatcgccgtgttcgtgccgctggccttcatcaccggcctgtcgggccagttctacaagcagttcgcgctgacgattgcgatttccaccgtgatctctgccatcaattcgctgacgctgtcgccagcgctggccgccttgctgctcaagagccatgacgcaccgaaagacgcgctgacccgcggcatggacaaggtgttcggccgcttctttgccgccttcaacaaggcctttggccgcggctctgacaactacagccgcggtgtcaagggtgcgatctcgcgcaaggccgtgatgctgggcgtgtacctggtgctggtgctggccacggcaggcctgttcaaggccgttcccagcggctttgtgcccgggcaggacaagcagtacctgatcggctttgcccagttgcccgacggcgccacgctggaccgcaccgaagacgtgatccgcaagatcagcgacatcgccatgaaacaacccggcgtggaacacgcgattgctttccccggcctgtcgatcaacggcttcaccaacagctccaactcgggcatcgtgtttctctcgctcaagccgttcgatgagcgcaagagtgcggacatgagtgcaggcgccatcgccggccagctcaacggcaaattcggaggcatccaggaagcgtttatcgcgatgttcccgccgcctccggtgcagggcctgggcaccaccggcggcttcaagctgcagctggaagaccgcggctcgctcggctatgccgcgctggacgccgccaccaaggctttcatggccaaggcttatcagacgcctgaactggcggggctgttctccagcttccaggtcaacgtgccgcagctctatgccgacatcgaccgcaccaaggcgcgccaattgggtgtgccgataaccgatgtgttcgacaccatgcagatctacctgggcagcctgtacgccaacgacttcaacaagttcggccgcacctattccgtgcgggtgcaggccgatgcgccttaccgggcccgtgccgaagacatcggccagctcaaggtgcgctcgaccaccggcgagatggtgccgctgtcggcgctgatgaaagtcacgccgagcttcggccctgaacgcgccatgcgctacaacggcttcctgtcggccgacatcaatggcggcgctgcccccggctattcgtcgggccaggcgcaggatgcggtcgcgcgcatcgcggccgagacgctgccgcccggcatcagctacgagtggacggatctgacctaccaggaaatcattgccggcaactcggccatgtgggtgttcccgctggcgctgctgctggtgttcctggtgctggccgcgcagtatgaaagcttgaccctgccgatcgccatcgtgctgatcgtgcccatgggcctgctggctgccatgctgggggtgaagctgaccggtggcgacaacaacatcttcacgcagatcggtttgattgtgctggtggggctgtcggcgaagaacgccattttgattgtggaatttgcgcgcgagctggagtttgccgggcgcacgccgctgcaggctgccattgaagccagccgcctgcgcctgcgtcccattctgatgacctcgctggctttcatcatgggcgtgctgcccctggtgctgtcgacgggcgccggtgccgaaatgcgccatgccatgggcgtggccgtgttctcgggaatgattggtgtcacggcttttggcctgttcctcacgccggtgttttacgtgaccctgcgccgcctcacgggcaaccgcccgctcaagctgcatggcgaagtgccgcatctcgaggccttcgcgggcagcggcggtgccggcgcgcatgcccagccggcggcgcccctcaagcatcacgaataa

SEQ ID NO: 74609 - protein, 1065 aa, Polaromonas sp. JS666
MLSLLMLISGLIALRSLPIAEYPDVVPPTVVVRANYPGANPKVIAETVATPLEEAINGVDGMLYMSSQATTDGLMTLNVTFKLGTDPDKAQQLVQNRVSQAEPRLPEEVRRLGITTIKSSPDLTMVVHLLSPSGRYDMTYLRNYGVLNVKDRLARINGVGQVQLFGSGDYSMRVWLDPQKVAERGLSAGDVVRAIREQNIQAAAGVVGASPGLPGVDMQLSINAQGRLQSEEEFGDIIVKTEKAEKGGAVTRLRDIARLELGASDYALRSLLDNKQAVAVPVFAAPGSNAIQISDDVQAVMKDLKKNMPEGVDYEIVYDTTQFVRSSIEAVVHTLLEAVALVVLVVIIFLQTWRASIIPLLAVPISVIGTFAVMHLFGFSINALSLFGLVLAIGIVVDDAIVVVENVERNIEAGLSPRDATYRAMREVSGPIIAIALVLIAVFVPLAFITGLSGQFYKQFALTIAISTVISAINSLTLSPALAALLLKSHDAPKDALTRGMDKVFGRFFAAFNKAFGRGSDNYSRGVKGAISRKAVMLGVYLVLVLATAGLFKAVPSGFVPGQDKQYLIGFAQLPDGATLDRTEDVIRKISDIAMKQPGVEHAIAFPGLSINGFTNSSNSGIVFLSLKPFDERKSADMSAGAIAGQLNGKFGGIQEAFIAMFPPPPVQGLGTTGGFKLQLEDRGSLGYAALDAATKAFMAKAYQTPELAGLFSSFQVNVPQLYADIDRTKARQLGVPITDVFDTMQIYLGSLYANDFNKFGRTYSVRVQADAPYRARAEDIGQLKVRSTTGEMVPLSALMKVTPSFGPERAMRYNGFLSADINGGAAPGYSSGQAQDAVARIAAETLPPGISYEWTDLTYQEIIAGNSAMWVFPLALLLVFLVLAAQYESLTLPIAIVLIVPMGLLAAMLGVKLTGGDNNIFTQIGLIVLVGLSAKNAILIVEFARELEFAGRTPLQAAIEASRLRLRPILMTSLAFIMGVLPLVLSTGAGAEMRHAMGVAVFSGMIGVTAFGLFLTPVFYVTLRRLTGNRPLKLHGEVPHLEAFAGSGGAGAHAQPAAPLKHHE

SEQ ID NO: 74610 - DNA, 3180 bp, Polaromonas sp. JS666
  CDS (1)..(3180)
atggccaaattttttattgatcggccgatctttgcctgggtgattgccttgttcatcctggtggtcggcggtgtgtcgatcacgcagctgccgattgcccagtacccacccgtggcaccgcccgcgatcgtcatcaatacggcataccccggcgcgtcggcccagacgctcgaggacagcgtgctgtcggtgattgagcgtgaaatgaacggctcgcccggcctgatctacatggagtcggtcgcgcaggccgacggttccggcagcatcacgctgagcttccagcccggcaccaatgccgagctggcgcaggtggacgtgcagaaccgcctgtcgcgcgcctcgccgcggctgcccgctgctgtggcgcagcagggcgtacgcgtagacaagtcgcgtgccaacttcctgctgttcaccatgttgtcgtccgacaacccggcgcacgacccggtcgcgctcggcgactatgcctcgcgcaacatcgtgcccgaactccagcgcctgcccggcattggccaggcccagctgttcggcagcgagcgcgccatgcgcatctggctcgacccggccaagctgaccggcttcagcctttcggcgaacgatgtcaatacagcgattcgtgcgcaaaatgcccaagtagccgccggcagcatcggcgaccggcctaacgtggcaggccagggcattgcggccaccgtggtggtcaatgggcagctcgccaacgtcgggcagtttggcaatatcgtgctgcgcgccaaccccgatggctcgtcggtgcgcctgaaggatgtggcgcgcatcgaattgggtggccagacctacgcgacgtcggcgcgcctgaacggcaagccggccgtgggtatcggcgtgcaactcgcgccgaacggcaatgcacttgcctccgccaaggctgtgcgagagaagatggccgaacttcagcgctacttcccgcagggcatgaaatgggacatcccctacgacagctcgcgcttcgtcaggatatcgatttcgcaggtggccgagacgctgttcgaggcggtggcgctggtgttcctggtgatgttcctgttcctgcagaactggcgctacaccatcatcccgaccatcgtggtgccgatctcgctgcttggcactttcgccacgctgctggcgctcggattttcaatcaacgtgctcaccatgttcggcatggtgctggtgattggtatcgtggtggacgatgcgatcgtggtggtcgagaacgtcgagcgcatcatgaccgaagaggggctgccgccgctcgaggccacgcgcaaggcgatgaagcagatctccggcgccatcatcggcgtgaccgtggtgctgatctccgtgttcgtgccgctggcgttcttcgcgggctcgaccggcaatatctatcgccagttctcggcggtgatggtgtcgtcgatcggcttctcggcattcatggcgctgtcgctcacgccggcgctctgcgccacgctgctcaaaccggtagaggccggacaccaccacgaaaagaccggtttcttcggttggttcaatcggggcttcacacgcacggccaagggttatgaaagcgtggttgcgcgcatcctcaagcgtgcagcgcgctatctggtgatctacgcagcgatcatcggcgcgatcgccgtggtcttcctgcgcctgccaacttcatttttacccaacgaagaccagggcactctcctggtgaacgtgcagttgcccccgggtgcgacatatgagcgcacgctctcggtgatgcagaacgtcgaggagttcatcctcaagcagcccgaagtgcaaagcatggttggcgtactgggttttagcttttcgggccagggtcaaaacgccgcgctggcgttcgtgacgctcaaggactggaaagagcgcgcgggtgagcagcattcggccggagcggttgcgggacgggccttcggtgcgctcatgggtgtgcgtgatgcattcatctttccgctgagcccaccgccgattcccgaactgggcacggcgtcgggcttcagcttccgtttgcaggatcgcggcggcgcgggccacgaggcgctcgtcaatgcccgcaaccagttgctgggcctggcgtccaagagccctgtccttgggcaggtgcgtcccgatggcctggaagacgcgccgcaactgcagatcgacattgaccgcgacaaggccaatgcgctgggcataccgttcgacgcgatcaattcggtgttgtcgacctcgctgggctccagctacgtgaacgacttcccgaaccaggggcgcttgcagcgtgtggtggtgcaggccgatgcaccggcgcgcatgcagcccgatgaccttctcaaactgaacgccagcaacagcaaggggcaatcggtgccgctctcggcatttgccacgacgcgctgggtcaagggcgcgatgcagacggtgcgctacaacggctatccggcgatgcgcatcggcggcagcgccgcaccgggctacagcaccggcgccgcgatggccgagatggagaagctggcggcgcagctgccgcaaggcttcggctatgagtggaccggccagtcgcgagaggaaaaactcgccggctcccaggcgacccttctctatggtttcgcgatcctcgcggtgttcctgtgcctcgccgcgctgtacgaaagctggaccattccgctggcggtgattctggtggtgccgctgggcgtgatcggcgtgttgctggcgaccctgctgcgcgcctattcgaacgacgtgtactttcaggtgggcctgatcaccatcatcggcctgtcggcgaagaacgccattttgatcatcgagtttgcgaaagaccttcaggcgcagggcaagggcgtgatcgagtcggcgctggccgcagcccatctgcgttttcgccccatcatcatgacctcgctggctttcggcctgggcgtgatgcctctcgtgctggcttcgggcgccggctctgctagccagcgcgccatcggtaccgccgtgatcggcggcatggtgaccggcacggcgctggcggtgatttttgtcccggtgttctttgtcgtggtgcgcggctttttcaaaggcagcgagcggcaaaacaggatctattcggagcatgccaaagcggcaggcatctcggaagatgaaggaaatgaaggtaaagcccatgcgtaa

SEQ ID NO: 74611 - protein, 1059 aa, Polaromonas sp. JS666
MAKFFIDRPIFAWVIALFILVVGGVSITQLPIAQYPPVAPPAIVINTAYPGASAQTLEDSVLSVIEREMNGSPGLIYMESVAQADGSGSITLSFQPGTNAELAQVDVQNRLSRASPRLPAAVAQQGVRVDKSRANFLLFTMLSSDNPAHDPVALGDYASRNIVPELQRLPGIGQAQLFGSERAMRIWLDPAKLTGFSLSANDVNTAIRAQNAQVAAGSIGDRPNVAGQGIAATVVVNGQLANVGQFGNIVLRANPDGSSVRLKDVARIELGGQTYATSARLNGKPAVGIGVQLAPNGNALASAKAVREKMAELQRYFPQGMKWDIPYDSSRFVRISISQVAETLFEAVALVFLVMFLFLQNWRYTIIPTIVVPISLLGTFATLLALGFSINVLTMFGMVLVIGIVVDDAIVVVENVERIMTEEGLPPLEATRKAMKQISGAIIGVTVVLISVFVPLAFFAGSTGNIYRQFSAVMVSSIGFSAFMALSLTPALCATLLKPVEAGHHHEKTGFFGWFNRGFTRTAKGYESVVARILKRAARYLVIYAAIIGAIAVVFLRLPTSFLPNEDQGTLLVNVQLPPGATYERTLSVMQNVEEFILKQPEVQSMVGVLGFSFSGQGQNAALAFVTLKDWKERAGEQHSAGAVAGRAFGALMGVRDAFIFPLSPPPIPELGTASGFSFRLQDRGGAGHEALVNARNQLLGLASKSPVLGQVRPDGLEDAPQLQIDIDRDKANALGIPFDAINSVLSTSLGSSYVNDFPNQGRLQRVVVQADAPARMQPDDLLKLNASNSKGQSVPLSAFATTRWVKGAMQTVRYNGYPAMRIGGSAAPGYSTGAAMAEMEKLAAQLPQGFGYEWTGQSREEKLAGSQATLLYGFAILAVFLCLAALYESWTIPLAVILVVPLGVIGVLLATLLRAYSNDVYFQVGLITIIGLSAKNAILIIEFAKDLQAQGKGVIESALAAAHLRFRPIIMTSLAFGLGVMPLVLASGAGSASQRAIGTAVIGGMVTGTALAVIFVPVFFVVVRGFFKGSERQNRIYSEHAKAAGISEDEGNEGKAHA

SEQ ID NO: 74612 - DNA, 3156 bp, Polaromonas sp. JS666
  CDS (1)..(3156)
atgcaactcgctgaagtctccatacgccgcccggtatttgccaccgtgctgtcgctgctcatcgtgttggttggcgctgtgagtttcaatcgcctcacggtgcgtgaataccccaagatcgacgagcccgtggtcaccgtgagcgtgcgctacgccggggcctccgccgaggtgatcgagtcgcaggtgaccaagccgctggaggactccatcgcgggcattgatgcggtggatgtgatcacctccatcagccgggccgaccaggcgcagatcagcgtgcgcttccggctcgaaaaagacgccgactcagcggccgccgaggtgcgcgaccgcacctcgcgtgtgcgcaaccgcctgccgcaagcgattgacgagcccgtcattgcaaaggtcgaggctgacgccttcccggtcattcaaatcgctttttccagcgagtcgatgacgccgctgcagatcaacgacctggtcaaccgcattgtcaagccacgcctgcagaccgtgacgggtgtggccgatgtccgcatttttggggagcgcaagtacgccatgcgggtctggctggacaccgacaggctggcggcctaccggctgaccacccaggatgtcgaggatgcgatccgccgcagcaacctggagttgcctgccggccggatcgaatcgcagcagcgcgagttcagcgtgacctcgcaaaccgaccttgtgaagccttcgcaatttggcgagatcgtgatcaagaacgtcaacgggttttccgtcaaggtccgcgatgtggcccgggtgcaggagggcccggcagacgagcgcaccgccgtccggctcaacggccgctcggtggtggcggtgggcgtgattcgccaggcgacagccaatccgctcgacctgtccaagggtgtacgggacgtcattcccaggctgcgggctgacctgccaccgggcatgctgattgatattgccaatgacaattcggtcttcattgaccgttcggtcaggaacgtctaccgcacgattgccgaggcggtgggactggtggccttggtgatttttgtgtttttgcgcaccttgcgcgcctctctcattcccatcgtcaccattcctgtcagtctgattggcacttttgccctgatggccctggccggtttcaccatcaacaccctgacgctgctggccctggtgctggcgatcggccttgtcgtggatgatgccatcgtgatgctggaaaacatttttcgccacattgaagagggcatggatcccttctcggccgggatccggggtgcgcgcgaaatcggttttgcggtggtcaccatgaccgccacgctggtcgctgtgtatgcgccgctggccttcacaccggggcgcaccgggcgcctgtttgtggagtttgcactggcgctggccggtgccgtggtggtgtccggttttgtggcgctgacgctgacgcccatgctgtgtacccagctgctcaggcacaaccccaagcccaatctgtttgaccgcacgatggaacgcgtgctgacggccacctctgaccgctatggcgctgtgctgcgctggctggtcaccatgcgctaccaacccgcggccgctggcggcatggggcagcggatcaagggctgggtatttcaggcgcgctggttggtggtgggggtgatgctgctcagcggactggcgatcgcgttggttttcccgtccatgaagcaggaactctcgcccatcgaagaccgcggcgtgatcctggccaacgtcaatgcgcccgacggcgccaccctggactacaccaaccggtatgcccaggcgcttgagaaaatggggcagtccttcaaggagtttgaccgcatcttcgccaacgtgggtaatccgacggttgcgcaggccagtgtggtgtatcggacggtggactgggacgaccgcaagcgcaccaccatggagatggcgcgtgagttgcaaccgaaattcaacgcgctgcctggcgttacggcctttccgatcacgccgccttctctcggccagggctttcgcgagcggcccctcaattttgtgatccagacctcggacagctaccagaacctgaacacggtcgtgcgccagatgctcgatgagattgccaaaaatcccggcatcgtctctcccgatgtggacttgcgcctgaacaagcccgaactgcgcatcgaggtggagcgcgacaaggcggctgatttgggcgtgagcgtcgaagtggtggccaaggcgattgaaaccctgctgggtggacgcaatgtgacgcgctacaagcgtgatgccgagcagtacgatgtgatcgtgcagacccaggccagcgggcgcagcacacccgaagacattgaccgcatatacgtgcgcggccgcaacgacgtggtgataccgctgtcggccttggtgaaagtgcatgaaagcgtgtcaccacgcgagctgaaccacttcggccagcgccggtcggtgtcgattaccgccagcctggcggccgactactcgctgggtgaggccctgaagttcatggaccagaccgcagccaaggtgctgaagacgggctacagcaccgacttgaacggcacctcccgcgagttcaggaactcccaaggcgcgctggcgattgttttcgtgctggcgctggtgtttattttcctggtgctgtctgcacagttcgagagctttatcgacccgctggtgatcatgctgtcggtcccgctgtccatgattggcgcgttgctggccctgaaatggagcggcggctcgctcaacgtgtattcgcagatcgggctgatcacgctggtggggctgatcaccaagcacggcatcctgattgtcgagttcaccaaccagctgcgcgggcagggcatggagatggttgatgcgctcgtgaaggcgtcgtcgcagcgtttgcgcccgatcctgatgaccaccggcgccatggtgctgggtgccgtgcccctggcgctggcggatggcgccggcgctgaaagccgcatccagatcggctgggtcattgtgggcggcatgtcgttgggcaccttgctgaccatttttgtcgtgccaaccatgtattcgctgtttgcccgcgccaaaatcccgggtgccaacaaggccgtggtcaaggatgcgggagcgcaccacaagggcgatctggtagcaaaatag

SEQ ID NO: 74613 - protein, 1051 aa, Polaromonas sp. JS666
MQLAEVSIRRPVFATVLSLLIVLVGAVSFNRLTVREYPKIDEPVVTVSVRYAGASAEVIESQVTKPLEDSIAGIDAVDVITSISRADQAQISVRFRLEKDADSAAAEVRDRTSRVRNRLPQAIDEPVIAKVEADAFPVIQIAFSSESMTPLQINDLVNRIVKPRLQTVTGVADVRIFGERKYAMRVWLDTDRLAAYRLTTQDVEDAIRRSNLELPAGRIESQQREFSVTSQTDLVKPSQFGEIVIKNVNGFSVKVRDVARVQEGPADERTAVRLNGRSVVAVGVIRQATANPLDLSKGVRDVIPRLRADLPPGMLIDIANDNSVFIDRSVRNVYRTIAEAVGLVALVIFVFLRTLRASLIPIVTIPVSLIGTFALMALAGFTINTLTLLALVLAIGLVVDDAIVMLENIFRHIEEGMDPFSAGIRGAREIGFAVVTMTATLVAVYAPLAFTPGRTGRLFVEFALALAGAVVVSGFVALTLTPMLCTQLLRHNPKPNLFDRTMERVLTATSDRYGAVLRWLVTMRYQPAAAGGMGQRIKGWVFQARWLVVGVMLLSGLAIALVFPSMKQELSPIEDRGVILANVNAPDGATLDYTNRYAQALEKMGQSFKEFDRIFANVGNPTVAQASVVYRTVDWDDRKRTTMEMARELQPKFNALPGVTAFPITPPSLGQGFRERPLNFVIQTSDSYQNLNTVVRQMLDEIAKNPGIVSPDVDLRLNKPELRIEVERDKAADLGVSVEVVAKAIETLLGGRNVTRYKRDAEQYDVIVQTQASGRSTPEDIDRIYVRGRNDVVIPLSALVKVHESVSPRELNHFGQRRSVSITASLAADYSLGEALKFMDQTAAKVLKTGYSTDLNGTSREFRNSQGALAIVFVLALVFIFLVLSAQFESFIDPLVIMLSVPLSMIGALLALKWSGGSLNVYSQIGLITLVGLITKHGILIVEFTNQLRGQGMEMVDALVKASSQRLRPILMTTGAMVLGAVPLALADGAGAESRIQIGWVIVGGMSLGTLLTIFVVPTMYSLFARAKIPGANKAVVKDAGAHHKGDLVAK

SEQ ID NO: 74614 - DNA, 3084 bp, Burkholderia cepacia
  CDS (1)..(3084): transl_table=11
atgaacatttccaaattctttatcgaccggccgatctttgcaggagtcctatcggtgatcatcctgctcggcggggtgatcgcgatgttcctgctgccgatttcggaatatccggaagtcgtgccgccttcggtgatcgtgaaggcgcagtacccgggcgcgaacccgaaagtgatcgccgagacggtcgcgtcgccacttgaagagcagatcaacggcgtcgagaacatgctctacatgcagtcgcaggcgaacagcgacggcaacatgacgatcaccgtcacgttcaagctgggcaccgatccggacaaggccacgcagctcgtgcagaaccgcgtgaaccaggcgctgccgcgcttgccggaagacgtgcagcggctcggcatcaccacggtgaagagctcgccgacgctgacgatggtggtccacctgatctcgccggacaaccgctacgacatgacctacctgcgcaactacgcgctgatcaacgtgaaggatcgcctgtcgcggatccagggcgtcggccaggtgcagctgtggggttcgggcgactacgcgatgcgcgtgtggctcgatccgcagaaggtcgcgcagcgcgggctgtcggccgaggacgtcgtgcaggcgatccgcgagcagaacgtgcaggtcgcggccggcgtgatcggcgcatcgccgtcgctgcccggcacgccgctgcagctgtcggtgaacgcgcgcggccgtctgcagacggaagacgaattcggcgacatcgtcgtgaagacgacgccggatggcggcgtcacgcacctgcgcgacatcgcgcggatccagctcgacgcgtccgagtacgggctgcgctcgctgctcgacaacaagccggccgtcgcgatggcgatcaaccagtcgccgggcgcgaactcgctgcagatctcggacgaagtgcgcaagacgatggccgaactgaagcaggacatgccggcgggcgtcgactacaagatcgtctatgacccgacgcagttcgtgcgctcgtcgatcaaggccgtcgtgcacacgctgctcgaagcgatcgcgctggtcgtgatcgtcgtgatcgtgttcctgcagacctggcgcgcgtcgctgattccgctgatcgcggtgccggtgtcgatcatcggcacgttctcgctgctgctcgcgttcgggtattcgatcaacgcgttgtcgctgttcgggatggtgctcgcgatcgggatcgtggtcgacgatgcgatcgtcgtcgtcgagaacgtcgagcgcaacatcgagaacgggatgaacgcgcggcaggcgacctacaaggcgatgcaggaagtgagcgggccgatcatcgcgatcgcgctgacgctggtcgccgtgttcgtgccgctcgcgttcatgtcgggcctgaccggccagttctacaagcagttcgcgatgaccatcgcgatctcgacggtgatctcggcgttcaactcgctgacgctgtcgccggcgctgtccgcgatcctgctgaaggggcacggcgacaaggaagactggctcacgcgtgtgatgaaccgcgtgctcggcggcttcttccgcggcttcaacaaggtgttccatcgcggggcggagaactacggccgcggcgtgcgcggcgtgctgtcgcgcaagacgctgatgctcggcgtgtatctcgtgctggtgggcgcgacggtgctcgtgtcgaaggtcgtgccgggcggcttcgtgcccgcgcaggacaaggaatacctgatcgcgttcgcgcagctgccgaacggtgcgtcgctcgaccgcaccgagaaggtgatccgcgacatgggttcgatcgcgctgaagcagccgggcgtcgagagcgcggtcgcgttcccggggctgtcggtgaacggcttcaccaacagctcgagcgcgggcatcgtgttcgtcacgctcaagccgttcgcggaacggcacggcaaggcgctgtcggccggcgccatcgcgggtgcgctgaaccagaagtacggcgcgatgaaggattcgttcgtcgcggtgttcccgccgccgccggtgctcggcctcggtacgctcggcgggttcaagatgcagatcgaggatcgcggcgcggtcggctacgcgaagctgtcggatgcgaccaacgacttcatcaagcgcgcgcagcaggcgcctgaactcggcccgctgttcacgagctaccagatcaacgtgccgcagctcaacgtcgatctcgaccgcgtgaaggcgaagcagctcggcgtgccggtgaccgacgtgttcaacacgatgcaggtgtatctgggttcgctgtacgtgaacgacttcaaccgcttcggacgcgtgtaccaggtgcgcgtgcaggccgatgcgccgttccgccagcgcgcggacgacatcctgcaactgaagacgcgcaacgacaagggcgagatggtgccgctgtcgtcgctggtcaccgtgacgccgacgttcggcccggaaatggtcgtgcgctacaacggctacacggcggccgacatcaacggcggcccggcgcccggcttctcgtcggggcaggcgcaggccgcggtcgagcgcatcgccgacgagacgctgccgcgcggcgtgcgcttcgagtggaccgacctcacgtaccagcagatcctcgcgggcgattcggcgatgtgggtgttcccgatcagcgtgctgctcgtgttcctcgtgctcgccgcgctgtatgaaagcctgacgctgccgctcgcggtgatcctgatcgtgccgatgagcattctgtcggcgctgacgggcgtgtggctcacgcagggcgacaacaacatcttcacgcagatcggcctgatggtgctggtggggctgtcggcgaagaacgcgatcctgatcgtcgaattcgcgcgcgagctcgaacacgacggcaggacgccgctcgaggccgcgatcgaggcgagccggctgcggctgcgcccgatcctgatgacgtcgatcgctttcatcatgggcgtggtgccgctcgtcacgtcgaccggcgcgggttcggaaatgcgtcatgcgatgggggtcgcggtgttcttcgggatgctcggcgtgacgctgttcgggctgatctga

SEQ ID NO: 74615 - protein, 1027 aa, Burkholderia cepacia
MNISKFFIDRPIFAGVLSVIILLGGVIAMFLLPISEYPEVVPPSVIVKAQYPGANPKVIAETVASPLEEQINGVENMLYMQSQANSDGNMTITVTFKLGTDPDKATQLVQNRVNQALPRLPEDVQRLGITTVKSSPTLTMVVHLISPDNRYDMTYLRNYALINVKDRLSRIQGVGQVQLWGSGDYAMRVWLDPQKVAQRGLSAEDVVQAIREQNVQVAAGVIGASPSLPGTPLQLSVNARGRLQTEDEFGDIVVKTTPDGGVTHLRDIARIQLDASEYGLRSLLDNKPAVAMAINQSPGANSLQISDEVRKTMAELKQDMPAGVDYKIVYDPTQFVRSSIKAVVHTLLEAIALVVIVVIVFLQTWRASLIPLIAVPVSIIGTFSLLLAFGYSINALSLFGMVLAIGIVVDDAIVVVENVERNIENGMNARQATYKAMQEVSGPIIAIALTLVAVFVPLAFMSGLTGQFYKQFAMTIAISTVISAFNSLTLSPALSAILLKGHGDKEDWLTRVMNRVLGGFFRGFNKVFHRGAENYGRGVRGVLSRKTLMLGVYLVLVGATVLVSKVVPGGFVPAQDKEYLIAFAQLPNGASLDRTEKVIRDMGSIALKQPGVESAVAFPGLSVNGFTNSSSAGIVFVTLKPFAERHGKALSAGAIAGALNQKYGAMKDSFVAVFPPPPVLGLGTLGGFKMQIEDRGAVGYAKLSDATNDFIKRAQQAPELGPLFTSYQINVPQLNVDLDRVKAKQLGVPVTDVFNTMQVYLGSLYVNDFNRFGRVYQVRVQADAPFRQRADDILQLKTRNDKGEMVPLSSLVTVTPTFGPEMVVRYNGYTAADINGGPAPGFSSGQAQAAVERIADETLPRGVRFEWTDLTYQQILAGDSAMWVFPISVLLVFLVLAALYESLTLPLAVILIVPMSILSALTGVWLTQGDNNIFTQIGLMVLVGLSAKNAILIVEFARELEHDGRTPLEAAIEASRLRLRPILMTSIAFIMGVVPLVTSTGAGSEMRHAMGVAVFFGMLGVTLFGLI

SEQ ID NO: 74616 - DNA, 3177 bp, Morganella morganii
  CDS (1)..(3177): transl_table=11
atgccaaagttttttattgaaagaccgatatttgcatgggtaatcgcaattattaccatgcttgcaggtctgttggcgatcatgaaattgccggtggcacagtatccgactgttgcgccgccgaccatttcaatttccgcaaactatccgggtgcggatgccgagacggttcagaatacggtaactcaggttatcgaacagaacatgaacggtatcgacaagatggtgtacatgtcttcaaccagtgactcagcgggtagtatgaatatctcgctgacctttgaagctgacgccaacccggatattgcccaggttcaggttcagaacaaactccagctggcaatgccgctgcttcctcaggaagttcagcagcagggtattaccgttgaaaaatccaccagttccttcctgctggtggccggtttcgtgtctgaggacggtaccatgtcccagaacgatatcgcggactacgtcggctctaacgtcaaagacccgatcagccgtgtgaccggggttggtgaaacccagctcttcggtacccagtatgccatgcgtatctggctcgatccggacaaactggtgaaatataacctgagtaccatagatatcatcaatgcgattcaggtgcagaataaccaggttgccgccggtcagctggggggaacaccgccggtaccaaaccagcgtctgaatacctctattattgcgcagacccgtctgaacacgcctgagcagtttcaggaaatcatgctgcgggttaacactgacggttcggttgtccgcctgaaagatgttgcttacgtggaactcggtgctgaaaactacgggattatcgcgcgttataacgggaaaccggcagccggtatcggtatcaagctggcaaccggtgctaacgccctggataccgccaaagcggttcgcgataaactgacagaaatgtcagagtttttccctgacggcctggaagttgtttacccgtacgatacaacaccattcgttaaaatctccattttcgaagtggtgaaaacactggttgaagcaatcatgctggtgttcgtggtgatgtatctgttcctgcaaaacttccgtgcaacactgatcccgactatcgccgtaccggtggtactgctggggacctttgccacccttgccgcattcgggtattcgataaataccctgacgatgttcgcgatggtgctggcaatcggtcttctggtggatgacgccatcgtggtggtggaaaacgtcgagcgtgtcatgcaggaaaccggcctgccgccgaaagaagccacaaaaatatcgatgggtcagatccagagtgctctggtcggtattgccatggtgttatcagcggtatttattccgatggccttcttcggcgggtcaaccggggcaatttaccgtcagttctcaattaccattgtttccgcgatgatactgtcagtcttcgtggcgctgatcctgacaccggcactgtgtgccaccatgctcaagccggttgccaaaggcagccacggcagtcagaccggtttcttcggctggtttaaccgtgtgtttgagaaacagaccaatcactacactgacagtgtcggccgtatgctgcgcggcacaggacgttacctgctgatctatgtgctgctggttgcgggtatgatcgtgatgttcacccgtctgccgacttctttcttaccggaagaagaccagggcgtactgctctcgatggttcagttaccaccgggttcgacgcaggaacaaactcagactgttcttgatggtgtcagtaagtactatctggaagatgagaaaaaagttgttgaatctgtctttaccgttaacggcttcggcttcgcgggtcagggacagaacatgggtctggcgtttattgttctgaaaaactgggacgaacgtaaagcaaaagaagataaggtggaagctgttgttgcacgcgccaaccagcacttctttaccaactcgtcagcctcaattttcgcggtaaacattccgccgattgtggaactgggttcatccagcggttttgacctcgaactgatggataacgctaaccagggtcacgaagcgctgaccgcagcccgtaaccagttactgaagatggcaggcgagcatccggatatgctggtgcaggtgcgcccgaacgggatggaagatacctcacagtatcatatccatgtcgatcagcagaaagccgaagcattaggggttgatatcaagaccattaacgccgcgctgagcaccatgttcggcggcagctacgtcaatgactttatcgaccgcggtcgtgtgaagaaagtgtacgtacaggctgatgctccgttccgtatgcagccgaaaaatattgctgagcagtatgtccgcaataaccagggccagatggtaccgttctctgcctttatcgatacgaaaaaggacccgtggaccttcggttcaccgcgccttgaacgttataacggtattcctgctatgcagattcagggcagcgccgcaccgggcaagagtagtggtgatgcgatggcactgatggaaaacatggcgaaagaactgccgcagggctttggtgttgagtggacaggtatgtcttaccaggaaaaactgtccggtaaccaggcgcctgcactgtataccatctctctgatcgtggtcttcctctgtctggcagccctgtatgagagctggtcggttccgttctcggttatgctggtggttccgctcggggttatcggtgcactgttactgacccatgcacgcgggctggacaacgacgtgtacttcaaagtcggcctgctgacaaccattggtctgtcggcgaagaacgccatcctgattgtcgaattcgccaaagacctgatggagaaagaaggcaaagggctgattgaagcaacactggaagccgttaagatgcgtctgcgccctattctgatgacatcactggcctttatgctcggggttattccgttagtcctgagtaacggtgccggttccggtgcacagaacgccgtaggtaccggggtgttcggtggtatgatcgccgcaacatcactggctatcttcttcgtgccggtcttctatgtggttatccgccgccgcttcagtaagaagagtgaagacattgagcatgctcatgcggtaacgcagaagagcgatagtcctgacggattttaa

SEQ ID NO: 74617 - protein, 1058 aa, Morganella morganii
MPKFFIERPIFAWVIAIITMLAGLLAIMKLPVAQYPTVAPPTISISANYPGADAETVQNTVTQVIEQNMNGIDKMVYMSSTSDSAGSMNISLTFEADANPDIAQVQVQNKLQLAMPLLPQEVQQQGITVEKSTSSFLLVAGFVSEDGTMSQNDIADYVGSNVKDPISRVTGVGETQLFGTQYAMRIWLDPDKLVKYNLSTIDIINAIQVQNNQVAAGQLGGTPPVPNQRLNTSIIAQTRLNTPEQFQEIMLRVNTDGSVVRLKDVAYVELGAENYGIIARYNGKPAAGIGIKLATGANALDTAKAVRDKLTEMSEFFPDGLEVVYPYDTTPFVKISIFEVVKTLVEAIMLVFVVMYLFLQNFRATLIPTIAVPVVLLGTFATLAAFGYSINTLTMFAMVLAIGLLVDDAIVVVENVERVMQETGLPPKEATKISMGQIQSALVGIAMVLSAVFIPMAFFGGSTGAIYRQFSITIVSAMILSVFVALILTPALCATMLKPVAKGSHGSQTGFFGWFNRVFEKQTNHYTDSVGRMLRGTGRYLLIYVLLVAGMIVMFTRLPTSFLPEEDQGVLLSMVQLPPGSTQEQTQTVLDGVSKYYLEDEKKVVESVFTVNGFGFAGQGQNMGLAFIVLKNWDERKAKEDKVEAVVARANQHFFTNSSASIFAVNIPPIVELGSSSGFDLELMDNANQGHEALTAARNQLLKMAGEHPDMLVQVRPNGMEDTSQYHIHVDQQKAEALGVDIKTINAALSTMFGGSYVNDFIDRGRVKKVYVQADAPFRMQPKNIAEQYVRNNQGQMVPFSAFIDTKKDPWTFGSPRLERYNGIPAMQIQGSAAPGKSSGDAMALMENMAKELPQGFGVEWTGMSYQEKLSGNQAPALYTISLIVVFLCLAALYESWSVPFSVMLVVPLGVIGALLLTHARGLDNDVYFKVGLLTTIGLSAKNAILIVEFAKDLMEKEGKGLIEATLEAVKMRLRPILMTSLAFMLGVIPLVLSNGAGSGAQNAVGTGVFGGMIAATSLAIFFVPVFYVVIRRRFSKKSEDIEHAHAVTQKSDSPDGF

SEQ ID NO: 74618 - DNA, 3153 bp, Escherichia coli
  CDS (1)..(3153): transl_table=11
atggacttttcccgcttttttatcgacaggccgattttcgccgcggtgctgtcgattttaatttttatcaccgggttaatcgctatcccactgctgccggtgagcgaatatccggatgtcgtcccgccgagcgtccaggtgcgcgcggagtatcccggcgccaacccgaaagtgattgccgagaccgtggcgacgccgctggaggaagcgatcaacggcgttgaaaacatgatgtacatgaaatcggtcgccggctccgacggcgtgctggtcaccaccgtcaccttccgcccgggtaacgacccggatcaggcgcaggttcaggtgcagaaccgcgtcgcgcaggccgaagcgcgtctgccggaggatgtacgccgtctggggatcaccacccagaagcagtctccgacgctgaccctggtggtgcatctgttctcccccggcgggaagtacgactcgctgtatatgcgcaactacgccacgctgaaagtgaaggatgagctggcgcgcctgcccggcgtcggccagatccagatttttggctccggtgaatatgcgatgcgcgtctggctggatcccaataaggtcgctgcccgcggtctgacggcctcggatgtggtgacggcgatgcaggagcaaaacgtccaggtgtctgccggacagcttggcgccgagccgctgccgcaggagagcgatttcctgatctccattaacgcccagggccgtctgcataccgaagaagagtttggcaatatcattctgaaaacggcgcaggatggctcgctggtccgcctgcgcgacgtggcgcgcatcgagatgggttccggtagctatgcgctgcgctcccagctcaacaataaggatgcggtcgggatcggtatcttccagtcacccggcgctaacgccatcgatctgtcgaacgcggtacgcgccaaaatggccgagctggccacccgcttcccggaagatatgcaatgggcggcgccgtacgacccgacggttttcgtccgcgactccatccgcgcggtggtgcagacgctgctggaggcggtagtgctggtggtgctggtagtgatcctgttcctgcagacctggcgcgcgtcgattatcccgttgatcgctgtgccggtatcggtggtgggtaccttcagcattctctatctgctgggcttctcgctgaataccctgagcctgttcgggctggtactggctatcggtatcgtggtggacgacgccatcgtggtggtggagaacgtcgagcgtaatatcgaagaggggcttgcgccgcttgcctcggcgcatcaggcgatgcgtgaggtctccgggccgattatcgccattgcgctggtgctgtgtgcggtgttcgtgccgatggcgtttctctccggggtcaccggccagttctacaaacagttcgcggtgaccatcgccatctcgacggtgatctcggccatcaactcgctgacgctctccccggcgctggcggccctgctgttaaagccgcacggcgcgaagaaagacctccctacccggctgatcgatcgcctgtttggctggattttccgtccgtttaaccgctttttcctgcgcagctcgaacggctatcagggactggtaggcaaaacgcttggacgccgtggcgcagtgtttgcggtgtacctgctgctgctctgcgccgctggggtgatgtttaaagtcgtccccggcgggtttattcccacccaggataagctgaatctcattggcggcgtgaagatgccggaagggtcgtcgctggcgcgcaccgacgcggtgatccgcaaaatgagcgagatcgggatgaataccgaaggggtcgactatgcggtcgctttcccggggcttaacgcgctgcagttcaccaacacgccgaataccgggacggtcttttttggcctgaaaccgttcgaccagcgcaaacacacggcggcggaaattaacgcggagatcaacgccaaaatcgcgcaaatccagcagggctttggcttttccatcctgccgccgccgattttaggtctgggtcagggttccggctactccctgtacatccaggatcgcggagggctgggctatggcgcgctgcaaagcgcggtgaatgcgatgtccggggcgattatgcagacgccggggatgcacttcccgatctcgacttaccaggctaacgtgccgcagctggacgtgcaggtcgatcgcgataaggcgaaagcgcagggggtatcgctaaccgatctgttcggtacgctgcagacctatctcggctcgtcttatgtcaatgactttaaccagttcgggcgtacctggcgcgtgatggcccaggctgacggaccataccgcgagagcgtggaagatatcgccaatctgcgcacccgcaataatcagggcgaaatggtaccgatcggcagtatggtgaatatcagtaccacctacgggccggatccggtgatccgctacaacggttatccggcggcggacctgattggcgatgccgatccgcgggtcctctcttcttcgcaggcgatgacgcatctggaagagctgtcgaagcagatcctgccgaatgggatgaatattgagtggacggatctcagcttccagcaggccacccagggcaacacggcgctgatcgtcttcccggtggcggtgctgctggcattcctcgtactggccgcgctgtatgaaagctggaccctgccgctggcggtgatccttatcgtaccgatgacgatgctctccgcgctgtttggcgtctggctgaccgggggcgataacaacgtcttcgtgcaggtgggtctggtggtcctgatgggcctggcctgtaaaaacgccattctgatcgtcgagtttgcccgcgagctggagatccaggggaaaggcatcatggaagcggcgctggaggcatgccgcctgcgtctgcgcccgatcgtgatgacctccatcgcctttatcgccgggaccattccgctgatcctcggccacggcgcgggggcggaagtccgcggcgtcaccgggatcacggtgttctccgggatgctgggcgtgacgctcttcggtctgttcctgacgccggtgttttacgtgacgctacggaaactggtgacccgcaggaagccggtccaggaggatctgcccgcctag

SEQ ID NO: 74619 - protein, 1050 aa, Escherichia coli
MDFSRFFIDRPIFAAVLSILIFITGLIAIPLLPVSEYPDVVPPSVQVRAEYPGANPKVIAETVATPLEEAINGVENMMYMKSVAGSDGVLVTTVTFRPGNDPDQAQVQVQNRVAQAEARLPEDVRRLGITTQKQSPTLTLVVHLFSPGGKYDSLYMRNYATLKVKDELARLPGVGQIQIFGSGEYAMRVWLDPNKVAARGLTASDVVTAMQEQNVQVSAGQLGAEPLPQESDFLISINAQGRLHTEEEFGNIILKTAQDGSLVRLRDVARIEMGSGSYALRSQLNNKDAVGIGIFQSPGANAIDLSNAVRAKMAELATRFPEDMQWAAPYDPTVFVRDSIRAVVQTLLEAVVLVVLVVILFLQTWRASIIPLIAVPVSVVGTFSILYLLGFSLNTLSLFGLVLAIGIVVDDAIVVVENVERNIEEGLAPLASAHQAMREVSGPIIAIALVLCAVFVPMAFLSGVTGQFYKQFAVTIAISTVISAINSLTLSPALAALLLKPHGAKKDLPTRLIDRLFGWIFRPFNRFFLRSSNGYQGLVGKTLGRRGAVFAVYLLLLCAAGVMFKVVPGGFIPTQDKLNLIGGVKMPEGSSLARTDAVIRKMSEIGMNTEGVDYAVAFPGLNALQFTNTPNTGTVFFGLKPFDQRKHTAAEINAEINAKIAQIQQGFGFSILPPPILGLGQGSGYSLYIQDRGGLGYGALQSAVNAMSGAIMQTPGMHFPISTYQANVPQLDVQVDRDKAKAQGVSLTDLFGTLQTYLGSSYVNDFNQFGRTWRVMAQADGPYRESVEDIANLRTRNNQGEMVPIGSMVNISTTYGPDPVIRYNGYPAADLIGDADPRVLSSSQAMTHLEELSKQILPNGMNIEWTDLSFQQATQGNTALIVFPVAVLLAFLVLAALYESWTLPLAVILIVPMTMLSALFGVWLTGGDNNVFVQVGLVVLMGLACKNAILIVEFARELEIQGKGIMEAALEACRLRLRPIVMTSIAFIAGTIPLILGHGAGAEVRGVTGITVFSGMLGVTLFGLFLTPVFYVTLRKLVTRRKPVQEDLPA

SEQ ID NO: 74620 - DNA, 3201 bp, Burkholderia pseudomallei
  CDS (1)..(3201): transl_table=11
atggcaaagttttttatcgatcgcccgatcttcgcgtgggtgatcgccatcatcctgatgctggccggcgtcgcggcgatcttcacgctgccgatcgcccagtatccgacgatcgcgccgccgtcgatccagatcaccgcgaactacccgggcgcttcggcgaagaccgtcgaagacaccgtcacgcaggtgatcgagcagcagatgagcggcctcgacaacttcctgtacatgtcgtcgacgagtgacgactcgggcaacgcgacgatcacgatcacattcgcgccgggcacgaacccggacatcgcgcaggttcaggtgcagaacaagctgtcgctcgcgacgccgatcctgccgcaggtggtgcagcagctcggcctgtcggtgacgaagtcgagcagcagcttcctgctcgtgctcgccttcaactccgaagacggcagcatgaacaagtacgacctggcgaactacgtcgcgttgcacgtgaaggacccgatcagccggatcaacggcgtcggcactgtcacgctgttcggctcgcagtacgcgatgcggatctggctcgacccgaccaagctcacgaactacgggctcacgccggtcgacgtgacgagcgcgatctccgcgcagaacgtgcagatcgcgggcggccagctgggcggcacgccggccgtgccgggcaccgtgctgcaggcgacgatcaccgaggcgacgctgctgcagacgcccgagcagttcggcaacatcctgctgaaggtgaatcaggacggctcgcaggtgcggctgaaggacgtcgcgcagatcggcctcggcggcgagacgtacaacttcgacacgaagtacaacggccagccgaccgccgcgctcggcatccagctcgcgaccaacgcgaacgcgctcgcgaccgcgaaggcggtgcgcgcgaagatcgacgagatgtcggcgtacttcccgcacggcctcgtcgtcaagtacccgtacgacacgacgccgttcgtgcgcctgtcgatcgaggaagtggtgaagacgctgctcgagggtatcgtcctcgtgttcctcgtgatgtatctgttcctgcagaacctgcgggcgacgatcatcccgacgatcgcggtgcccgtcgtgctgctcggcacgttcgcgatcatgtcgatggtgggcttctcgatcaacgtgctgtcgatgttcggcctcgtgctcgcgatcggcctgctcgtcgacgatgcgatcgtcgtcgtcgagaacgtcgagcgggtgatggcggaagagggcttgccgccgaaggaggcgacgcgcaaggcgatgggccagatcacgggcgcgctcgtgggcgtggcgctcgtgctgtcggcggtgttcgtgccggtggcgttctcgggcggctcggtcggcgcgatctatcggcagttctcgctgacgatcgtctcggcgatggtgctttccgtgctcgtcgcgttgattctgacgccggcgctgtgcgcgacgatcctcaagccgatcccgcaagggcatcacgaggagaagaagggcttcttcggctggttcaaccgcaccttcaactcgagccgcgacaagtatcacgtcggcgtccaccacgtgatcaagcgctcgggccgctggctcatcatctatctcgcggtgatcgtcgcggtcggcctgctgttcgtgcgcctgccgaaatcgttcctgcccgacgaggaccagggcctgatgttcgtgatcgttcagacgccgtcgggctcgacgcaggagacgaccgcgcgcacgctcgcgaacatttccgactacctgctcacgcaggagaaggacatcgtcgaatccgcgttcacggtcaacggcttcagcttcgcgggccgcggccagaactcgggcctcgtgttcgtcaagctgaaggactactcgcagcggcagagctcggaccagaaggtgcaggcgctgatcggccggatgttcggacgctacgcgggctacaaggacgcgctcgtgattccgttcaacccgccgtcgattcccgaactcggcacggcggccggcttcgacttcgagctgaccgacaacgcgggcctcggccacgatgcgctgatggccgcgcgcaaccagttgctcgggatggccgcgaaggatccgacgctgcggggcgtgcgtccgaacgggctgaacgacacgccgcagtacaaggtcgacatcgatcgcgagaaggcgaacgcgctcggcgtgaccgcggatgcgatcgaccagacgttctcgatcgcgtgggcgtcgaagtacgtgaacaacttcctcgacaccgacggccggatcaagaaggtgtacgtgcagtccgacgcgccgttccggatgacgccggaggacatgaacatctggtacgtgcgcaacggctcgggcgggatggtgccgttctccgcgttcgcgaccggccactggacctacggctcgccgaagctcgagcgctacaacggcatctcggcgatggaaatccagggccaggccgcgccgggcaagtcgaccggccaggcgatgacggcgatggagacgctcgcgaaaaagctgccgacgggcatcggctattcgtggacggggctgtcgttccaggaaatccagtcgggctcgcaggcgccgatcctgtacgcgatctcgatcctcgtcgtgttcctgtgtctcgccgcgctgtatgaaagctggtcgatcccgttctcggtgatcatggtcgtgccgctcggcgtgatcggcgcgctgctcgccgcgacgctgcgcgggctcgagaacgacgtgttcttccaggtcggcctgctgacgacggtggggctgtcggcgaagaacgcgatcctgatcgtcgagttcgcgcgcgagctgcagcaaacggagaagatggggccgatcgaggcggcgctcgaggcggcgcggctgcggctgcgtccgattctgatgacgtcgctcgcgttcattctcggcgtgatgccgctcgcgatcagcaacggcgcaggctcggcgagccagcacgcgatcggcaccggcgtgatcggcgggatgatcaccgcgacgttcctcgcgatcttcatgatcccgatgttcttcgtgaaggtgcgggcagtgttcagcggcgagaaggaagacgccgacgaagcgctgcgcctcgcgcacgagcacatgcaccgtgacgacaagccggagcacggcgacgacgctggcaagaaggactaa

SEQ ID NO: 74621 - protein, 1066 aa, Burkholderia pseudomallei
MAKFFIDRPIFAWVIAIILMLAGVAAIFTLPIAQYPTIAPPSIQITANYPGASAKTVEDTVTQVIEQQMSGLDNFLYMSSTSDDSGNATITITFAPGTNPDIAQVQVQNKLSLATPILPQVVQQLGLSVTKSSSSFLLVLAFNSEDGSMNKYDLANYVALHVKDPISRINGVGTVTLFGSQYAMRIWLDPTKLTNYGLTPVDVTSAISAQNVQIAGGQLGGTPAVPGTVLQATITEATLLQTPEQFGNILLKVNQDGSQVRLKDVAQIGLGGETYNFDTKYNGQPTAALGIQLATNANALATAKAVRAKIDEMSAYFPHGLVVKYPYDTTPFVRLSIEEVVKTLLEGIVLVFLVMYLFLQNLRATIIPTIAVPVVLLGTFAIMSMVGFSINVLSMFGLVLAIGLLVDDAIVVVENVERVMAEEGLPPKEATRKAMGQITGALVGVALVLSAVFVPVAFSGGSVGAIYRQFSLTIVSAMVLSVLVALILTPALCATILKPIPQGHHEEKKGFFGWFNRTFNSSRDKYHVGVHHVIKRSGRWLIIYLAVIVAVGLLFVRLPKSFLPDEDQGLMFVIVQTPSGSTQETTARTLANISDYLLTQEKDIVESAFTVNGFSFAGRGQNSGLVFVKLKDYSQRQSSDQKVQALIGRMFGRYAGYKDALVIPFNPPSIPELGTAAGFDFELTDNAGLGHDALMAARNQLLGMAAKDPTLRGVRPNGLNDTPQYKVDIDREKANALGVTADAIDQTFSIAWASKYVNNFLDTDGRIKKVYVQSDAPFRMTPEDMNIWYVRNGSGGMVPFSAFATGHWTYGSPKLERYNGISAMEIQGQAAPGKSTGQAMTAMETLAKKLPTGIGYSWTGLSFQEIQSGSQAPILYAISILVVFLCLAALYESWSIPFSVIMVVPLGVIGALLAATLRGLENDVFFQVGLLTTVGLSAKNAILIVEFARELQQTEKMGPIEAALEAARLRLRPILMTSLAFILGVMPLAISNGAGSASQHAIGTGVIGGMITATFLAIFMIPMFFVKVRAVFSGEKEDADEALRLAHEHMHRDDKPEHGDDAGKKD

SEQ ID NO: 74622 - DNA, 3156 bp, Serratia marcescens
  CDS (1)..(3156): transl_table=11
atggctaagttctttatagaccgcccaattttcgcctgggtaatcgccatcatcgtcatgttggcgggggtgcttgcaataatgaaactgcctattgcgcagtatcccactattgcaccgccggcggtgagtatttccgccaactacccgggcgcagatgccaaaacggtgcaggataccgtcacgcagattatcgaacagaacatgaacggtatcgataacctgatgtacatgtcctccaccagtgattcctctggtagcgtcaccattaccctgacgtttgaatccggcaccgatcctgacatcgcgcaggttcaggtccagaacaaactgtcgttggccaccccgttgctgccgcaagaagttcagcaacagggcctgaaagtagaaaaatccagcagcagcttcctgatggtggccggcttcgtttccgacgatccgaacatgactcaggacgatattgcggactacgtggcgtccaacatcaaggatccgatcagccgttcgtccggcgtgggtgaagtgcagctgttcggtgcccagtacgcgatgcgtatctggctggatccgaacaagctgaacaactaccagctgacgaccacggacgtgacctccgccatcaccgagcagaacaaccagatcgccgcaggcaagctgggcggcctgcccggtggccgggggcagcagttgaacgcctcgatcatcgcgcagacccgtctgacttcgccggaagagttcggcaagatcctgctgaaggtgaataccgaccggttccaggtacgcctgcgcgacgtcgctcacatcgagcgcggccgaaaagctatgccgtttaccgctcgctataacggtaagcctgccgccggtctgggtatcaaactggcaaccggcgccaacgctttgaacaccgccaaaggtgtgaaagacgagctggccaagatgacgccattcttcccgcaagggatgaaagtggtttatccgtacgacaccaccccgttcgttaagatctccatcaacgaagtggtgaaaacgctgatcgaagccatcatcctggtattcctggtgatgtatctgttcctgcagaacttccgcgcgacgctgatcccaaccatcgcggtgccggtggtgctgctggggacctttgcgatactcgcggcgttcggcttctcgataaacaccctgacgatgttcggcatggtgttggcgatcggcctgctggtggatgacgccatcgtggtggtggaaaacgtcgagcgcgtcatggccgaagaggggctgccgccgaaagaagccacccgtaaatcgatgggccagattcagggcgcgctggtaggtatcgccatggtgctgtcggcggtattcgtgccgatggcgttcttcggcggttcaaccggcgccatctatcgccagttctcgatcaccatcgtgtccgcgatggcgctgtcggtgctggtggccttgatactgacgccggcgctgtgcgccaccatgctcaaaccgatcccgaaaggcgatcacggggttaaaacaggcttcttcggctggtttaaccgcatgttcgagaaaagcacgcatcactataccgacagcgtgggcaacatcctgcgcagcaccggtcgctatctgatcatctacctgctgatcgtggttggcatgggcctgctgttcctgcgcctgccttccctcgttctgccggacgaagatcagggcatcctgttgaccatggtgcaagctcgtgccggcgccaccgagtcccgcaccaacaaagtgctggaagaatgctccgactacttcctgaacaaggaaaaggacaacgtggtttcggtgtttaccgtcgcgggcttcggcttcaacggtaacggccagaacaacggcctggcattcgtcagcctgaaagactggggcgagcgtccagggagcgagaacaaggtcgaagcgatccgcggcgctcgtggggcgcatttctcgcagattaaagtaaggcctgtattcccgttcaaactgccggctatcattgaactcggtaccgcaaccggcttcgacttcgagctgattgaccagggcggcctggggcacgagaaactgaccgaagcgcgtaaccagctgttgggcatggttgctcaacatccgtacgtgctggtgggcgtgcgcccgaacggcctggaagatacgccgctgttcaaactgatcgtcgatcaggagaaagccaaggcgctgggcgtcagcatcaccaccatcaacagcacgctgagcaccgcgctgggcggctcgtacgtcaacgacttcatcgaccgcggtcgtgtgaagaaggtatacgtacaggccgacgcgccgttccgtatgctgccggaagacatcaacaagtggtacgtgcgcggcacgagcggccagatggtgccattctccgccttctcttcggcgaaatgggaatacggctcaccgcgcctggaacgctataacggcttgccgtcgatggaaattctgggccaggccgcaccgggcaagagtaccggtgaagcgatgaacctgatggaacagctggcgtccaaactgccaagcggcatcggttacgactggaccggcatgtcctatcaggaacgtctgtcgggcaaccaggcgccggcgctgtacgccatctcgattctggtggtgtccctgtgtctggcggcgctgtatgaaagctgggtcgtgccgttctcggtcatgctggtattgccgctgggggttatcggtgcgttggcctcgacgatgcgcggcatgaacaacgacgtgtactcccaggtggggctgctgaccaccatcggtctattcgcgaagaacgccatcctgatcgtggaattcgccaaggatctgatggagaaagaaggcaaaggcctgaccgaagcgacgttggaagcagtgcgtatgcgtctgcgtccaatcctgatgacgtctctggccttcatcctcgggattctgccgctggttatcagcagcggtgcgggctccggcgcacagaacgcggtaggtaccggcgtaatgggcgggatgaccaccgccaccgtcttggcgatcttcttcgtaccggtgttcttcgtggtggttcgccgccgcttcagcaagaagaacgaagacctggaacacagccatccggtagagcaaccactgatcgctcagtga

SEQ ID NO: 74623 - protein, 1051 aa, Serratia marcescens
MAKFFIDRPIFAWVIAIIVMLAGVLAIMKLPIAQYPTIAPPAVSISANYPGADAKTVQDTVTQIIEQNMNGIDNLMYMSSTSDSSGSVTITLTFESGTDPDIAQVQVQNKLSLATPLLPQEVQQQGLKVEKSSSSFLMVAGFVSDDPNMTQDDIADYVASNIKDPISRSSGVGEVQLFGAQYAMRIWLDPNKLNNYQLTTTDVTSAITEQNNQIAAGKLGGLPGGRGQQLNASIIAQTRLTSPEEFGKILLKVNTDRFQVRLRDVAHIERGRKAMPFTARYNGKPAAGLGIKLATGANALNTAKGVKDELAKMTPFFPQGMKVVYPYDTTPFVKISINEVVKTLIEAIILVFLVMYLFLQNFRATLIPTIAVPVVLLGTFAILAAFGFSINTLTMFGMVLAIGLLVDDAIVVVENVERVMAEEGLPPKEATRKSMGQIQGALVGIAMVLSAVFVPMAFFGGSTGAIYRQFSITIVSAMALSVLVALILTPALCATMLKPIPKGDHGVKTGFFGWFNRMFEKSTHHYTDSVGNILRSTGRYLIIYLLIVVGMGLLFLRLPSLVLPDEDQGILLTMVQARAGATESRTNKVLEECSDYFLNKEKDNVVSVFTVAGFGFNGNGQNNGLAFVSLKDWGERPGSENKVEAIRGARGAHFSQIKVRPVFPFKLPAIIELGTATGFDFELIDQGGLGHEKLTEARNQLLGMVAQHPYVLVGVRPNGLEDTPLFKLIVDQEKAKALGVSITTINSTLSTALGGSYVNDFIDRGRVKKVYVQADAPFRMLPEDINKWYVRGTSGQMVPFSAFSSAKWEYGSPRLERYNGLPSMEILGQAAPGKSTGEAMNLMEQLASKLPSGIGYDWTGMSYQERLSGNQAPALYAISILVVSLCLAALYESWVVPFSVMLVLPLGVIGALASTMRGMNNDVYSQVGLLTTIGLFAKNAILIVEFAKDLMEKEGKGLTEATLEAVRMRLRPILMTSLAFILGILPLVISSGAGSGAQNAVGTGVMGGMTTATVLAIFFVPVFFVVVRRRFSKKNEDLEHSHPVEQPLIAQ

SEQ ID NO: 74624 - DNA, 3147 bp, Erwinia amylovora
  CDS (1)..(3147): transl_table=11
atggctaagttttttatcgatcgccctattttcgcctgggttatcgccatcattgttatgttggcgggtacgctgtcgatcctgaaactgccgattgagcaatatcctaacgttgctccgccggccattgagatcacggcgacctacccgggcgccgatgcgaaaaccctgcaggactccgtcacccaggttatcgaacaaaatatgaatggcatcgacggcctgatgtatatgggttccagcagcgactcgtcaggcacgctgcagcttaccctgacattcgagtccggtactgatgccgatatcgctcaggtgcaggtgcagaataagctgcagctggcaacgccgctgctgccccaggaagtccagcaacaggggatcagcgtacagaaatcctccagcagctttctgatggtcgccggtttcattaatgacagcggcaccatgacgcagaatgatatctccgactacgttggatctaatatcaaagatccgctcagtcgtgtctccggcgtgggggatacccagctgttcggggcgcaatatgcgatgcgtatctggatggacccgcacaagcttaacaactaccagcttaccccggtagacgttattagcgcgattaacacgcagaacgcccaggtagcggcgggccaactcggtggttcaccgccggttaaaggccaacagctgaatgcctcgatcatcgcgcagacccgtctgacctcgacggaagagttcggtaaaatcctgctgaaagtgaatgctgacggttcacgcgtacgcctgagcgatgtggcgcatattgagctgggcggtgaaaattacgaggttattgctcgctataacgggcaacctgcctcgggtttgggtatcaagctggctaccggagcaaacgcactggataccgcggcggcagtgaaagcggagttagttaagctggagccgttcttcccctcagggctgaaggtggtttacccgtatgacaccacgccattcgtcaaaatttcgatcaatgaagtggttaaaactctggtagaagctatcgtgctggtgttcctggtgatgtatctgttcttgcagaacttccgcgccaccctgatcccaacgattgcggtgccggtcgtattgctgggtactttcgccataatcagcgctttcgggtactcaatcaataccttgacgatgttcgggatggtgctggctattggcctgctggtcgatgacgccatcgtagtggtggaaaacgtcgagcgtgtcatggccgaagagggcctgtcgccaaaagaagccacgcgcaagtcgatggatcagatccagggtgcgctggtcggcatcgctctggtgctgtcagcggtatttatcccgatggccttcttcggtggttctaccggcgttatctaccgccagttctcgattaccatcgtttcggcgatggtgctgtcggtcattgttgcactgattctgaccccggcactctgtgccactatgttgaagcccataaataaaggcgatcatggcaaaaccaccggtttctttggctggtttaaccgactgtttgacaaaagcacccatcactataccgacagcgtcggccatattgtgcgcagtaccggtcgttacctggtgatttatctgctgattgtggtgggtatggcattcctgttcctgcgtctgccaacctccttcctaccggaggaggaccagggggtatttctgaccatggcacagctgcctgctggcgcaacccaggaacgtacccagaaagtgctcgaccaggtaacggattactacctgaataaagaaaagacgaacgtcaactcggtgtttaccgttaacggcttcggctttgccgggcgcgggcaaaataccgggctggcttttgtcagtctgaagccctgggatgaacgttctggtgccgaaaacaaagtcccggccattaccggtcgggcaatgggcgcactttcggcgatcaaagatgcgatggtgatcccgtttaacctgccggctattgttgaacttggaaccgccaccggttttgacttccagcttatcgatcagggcgccctgggccatgaaaaactcaccgcggcacgcaaccagctgttggggatgattgctcagcattcagatacgctggttggtgtgcgtccaaacgggttggaagacaccccacagtacaaactgactatcgaccaggagaaagctcaggcattgggggtttcgctgtctgatatcaacacgacgctcgctgccgcctgggggggatcatacgtcaatgacttcattgaccgtggccgtgtgaagaaagtgtacgtgatgggtggtgctccataccgcatgctgccaactgacattggtaactggtatgttcgcgctaccaacggcgaaatggtgtcgtttaacgcctttgcttccgcacaatgggtttacggttcaccacgtctggaacgctataacggtcttccttcgatggaactactgggccagccggcggcgggtaaaagctccggtgaagcgatgaacctgatgcaagagctggcgtctaagttgccaaccggtatcggctatgactggaccggcatgtcttaccaggaacgactatcgggtaatcaggctccggcactgtatgcaatttcattgattgtggtgttcctgtgtctggctgcgttgtacgaaagctggtccatcccctttgccgttatgctggtcgtaccgcttggggttatcggcgcattaattttcaccactctgcgtggactgagtaatgatgtctactttgtggtagggctgctaaccaccatcgggctgtcggcgaaaaacgccatcctgattgtcgagtttgctaaagacctgatggagaaagaaggaaaaggcctggtggaggcaacgctggaggcggtgcgaatgcgtttacgcccaatcctgatgacctcactggcatttatcctcggcgtgctgccgttggcgatcagtagcggtgccggttccggcgctcagaacgccgtaggtaccggcgtgatgggcggcatggtaaccgctacggtgctggcgatattcttcgtaccggtgttcttcgtggtagtgcgccgccgcttcagtaaaaacaaagatgatattgaacacagccatcctgtggacaaacactaa

SEQ ID NO: 74625 - protein, 1048 aa, Erwinia amylovora
MAKFFIDRPIFAWVIAIIVMLAGTLSILKLPIEQYPNVAPPAIEITATYPGADAKTLQDSVTQVIEQNMNGIDGLMYMGSSSDSSGTLQLTLTFESGTDADIAQVQVQNKLQLATPLLPQEVQQQGISVQKSSSSFLMVAGFINDSGTMTQNDISDYVGSNIKDPLSRVSGVGDTQLFGAQYAMRIWMDPHKLNNYQLTPVDVISAINTQNAQVAAGQLGGSPPVKGQQLNASIIAQTRLTSTEEFGKILLKVNADGSRVRLSDVAHIELGGENYEVIARYNGQPASGLGIKLATGANALDTAAAVKAELVKLEPFFPSGLKVVYPYDTTPFVKISINEVVKTLVEAIVLVFLVMYLFLQNFRATLIPTIAVPVVLLGTFAIISAFGYSINTLTMFGMVLAIGLLVDDAIVVVENVERVMAEEGLSPKEATRKSMDQIQGALVGIALVLSAVFIPMAFFGGSTGVIYRQFSITIVSAMVLSVIVALILTPALCATMLKPINKGDHGKTTGFFGWFNRLFDKSTHHYTDSVGHIVRSTGRYLVIYLLIVVGMAFLFLRLPTSFLPEEDQGVFLTMAQLPAGATQERTQKVLDQVTDYYLNKEKTNVNSVFTVNGFGFAGRGQNTGLAFVSLKPWDERSGAENKVPAITGRAMGALSAIKDAMVIPFNLPAIVELGTATGFDFQLIDQGALGHEKLTAARNQLLGMIAQHSDTLVGVRPNGLEDTPQYKLTIDQEKAQALGVSLSDINTTLAAAWGGSYVNDFIDRGRVKKVYVMGGAPYRMLPTDIGNWYVRATNGEMVSFNAFASAQWVYGSPRLERYNGLPSMELLGQPAAGKSSGEAMNLMQELASKLPTGIGYDWTGMSYQERLSGNQAPALYAISLIVVFLCLAALYESWSIPFAVMLVVPLGVIGALIFTTLRGLSNDVYFVVGLLTTIGLSAKNAILIVEFAKDLMEKEGKGLVEATLEAVRMRLRPILMTSLAFILGVLPLAISSGAGSGAQNAVGTGVMGGMVTATVLAIFFVPVFFVVVRRRFSKNKDDIEHSHPVDKH

SEQ ID NO: 74626 - DNA, 3123 bp, uncultured Acidobacteria bacterium
  CDS (1)..(3123): transl_table=11
atgttcgtagacacgttcatcagccggcccatcctggcctccgtctgctcgctcgtcctgattctcgccggagcgatcgcgatcccgacgatgcccgtggcacagtacccgccgctggcgccgccggtcatcagcgtgtccacgttctatacgggcgccgatgcgcaggcggtcgagacggcggtcacgaccccgctcgagcaggcgattaacggcgtcgagggcatgctctacatgacctcgtcgagcaccaacagcggcgcggccagcatcagcgtggtcttcgacgtgacgcgcgactcggacattgccgccgtcgacgtgcagaaccgcgtgtcgacggcgctcgcgcggctgccgagcgaggtccggacaaacggcgtgaccgtgcagaagggccagaccggcttcgtgctggccgccggagtctatgcagaaaagggcgagtacgattccctcttcatcagcaactacatcgacgtctacgtgaaggacgcgctgaagcgcgtggagggggtcggcaacgtccagatcttcggcgagcggcggtactcgatgcggctgtggctcgatcccggcaagctcgccagccgcgctttgacggcaggcgacgtggtcaatgcgctgcgcgagcagaacatccaggtggcggcaggggccatcgggcagtcgccctcccgggacaatcagcggttccagatcagcgtgcgggcggcgggccggctgcacgaggccggcgagttcgaaaacgtcatcatcaaggcgggaaggggcggctcgctcgtccggatgaaggacatcggcaccgtggagctcggcgccgaaacctacggatcgcagcttcgctttcagggcatcgacgccgtcggtttcggcgtcacgcagctgccgtcggccaacgcgctcgacgtcgaacgcggcgtccgggcggagctcgaccgcctcgccgtgcacttcccgcctgggttgaagtatcaggtcgcgttcaacacgacccaggtcgtcgccgaatcgatccgcgaggtcctcatcacgctcgtcgaggccatcgcgctcgtcgtgctcgtcatgttcctgttccttcagagctggcgcagcacgctcatcccgacgatcacgatccccgtctcgctcatcggcgccttcgcgttcgtcaagctgatggacttttccatcaacacgctgacgctgttcggcatcatcctcgccaccgggatcgtcgtggacgatgcaatcgtggtgatcgagaacatcgagcgccacatccaggagttcaagacgccggccaggaaggcggcctcggatgcgatgcgcgaagtgttcggcgccgtcatcgcgacggcgctcgtgctcatcgcggtgttcgtgccggtggcgttctttcccggcacgaccgggcggctctacgcgcagttctcgatgacgattgcgttctcggtcgcactgtcggcgttcaacgcgctgacgctcacgccggcgctgtcggcgctgctgctggatcgcggccaccacggcaaaggggccttcttctcgagggtcgagcgcgtcatctcgggcggcaccaacgcgtatgtgtccgtgctgtcccgcctgctgcccctccggtgggtggtggtgctcgttttcgtgatctgcctcggcctgacgtggctgatgtaccgcatcgtcccgcaggcgttcgtgccggccgaggatcagggctacttcatcagcatcgtgcaggcgcccgcgggtgcgtcgttgcagtacaccggcgagattgcgcggcaggcggagcagatcctgctgaaggatccggaggtcctgggagtgttctcggtgatggggttcagcttcagcggcgcagcgccgaaccaggggctgatcttcacgagcctgaagcccttcgccgagcgcgaagggccggaacattccgcccagacggtgatcaaccgcgtccgcggccagttcgccggaatcagcggcgcgaacgtgtttcccacgccgcccgcctcaatccccgggctcggcgcgttcggcgggttcgagttccaggtgctcgaccaggggggcaccgacatcaacgcgctggccgccgccacgtacgcgatggcgggcgcgggcaaccagtcgccgaggctgcgcgggttgttcacgtcgttcaccgtgaacgatccgcagatctccgtccagatcgaccgcgatcgcgccctggcgctggggttgccggtcggcgagatcacggaggcgctgcagatctatctcggctcgcagtacgtcaacgacttcgacttcaacaaccgcgcttaccgggtgtacgtgcaggccgacaaagcgttccgttcggagccgggcgcgttgaagcagttctacgtgcggaaccgcgcgggggagatgatcccgctcgaaagcgtcgtgcgcctcagcgaggcgacggcgccgcaggtcatcagccatttcaacctgttccggtcggcctcgatcaacgggtcggccgcgcccggctacagctcgggccaggcgctccaggagatgcaggaccttgcggcgcgaacactgccgcagggcatgggttacgcgtggtccgggttgtcgctcgaggagagcaaggccggccgtcagtcgttcctcattttcggtctcgcgatcctgctcgtgtatctcacgctctccgcgcagtacgaaagcctcgtgctgccgttcatcgtgctgctgggggtcccgctcgcggtgctcggcgccctgaccgcgcagtgggcgcgggggtttgccaacgacgtctactgccagatcggcctggtcatgctgatcgggctggcggccaagaactcgatcctgattgtggagttcgccgaacagctgcgccacaaaggggcgacggtggtcgaggccgccgtgcaggccgcgcggatccggttgcggccgattctgatgacgtcgctcgcgttcatcctcggcgtgctgccgctcgtcttcgcctccggcgccggagcggaagcccggaattcggtcggcacggcggtggcgggcggcatgctggtctcgacgttcctgaacctcatcttcatccccgttctttacgtcgtggtgcagacgattcggggcgggggacggggtcaggcggggacgcaacaggccaactaa

SEQ ID NO: 74627 - protein, 1040 aa, uncultured Acidobacteria bacterium
MFVDTFISRPILASVCSLVLILAGAIAIPTMPVAQYPPLAPPVISVSTFYTGADAQAVETAVTTPLEQAINGVEGMLYMTSSSTNSGAASISVVFDVTRDSDIAAVDVQNRVSTALARLPSEVRTNGVTVQKGQTGFVLAAGVYAEKGEYDSLFISNYIDVYVKDALKRVEGVGNVQIFGERRYSMRLWLDPGKLASRALTAGDVVNALREQNIQVAAGAIGQSPSRDNQRFQISVRAAGRLHEAGEFENVIIKAGRGGSLVRMKDIGTVELGAETYGSQLRFQGIDAVGFGVTQLPSANALDVERGVRAELDRLAVHFPPGLKYQVAFNTTQVVAESIREVLITLVEAIALVVLVMFLFLQSWRSTLIPTITIPVSLIGAFAFVKLMDFSINTLTLFGIILATGIVVDDAIVVIENIERHIQEFKTPARKAASDAMREVFGAVIATALVLIAVFVPVAFFPGTTGRLYAQFSMTIAFSVALSAFNALTLTPALSALLLDRGHHGKGAFFSRVERVISGGTNAYVSVLSRLLPLRWVVVLVFVICLGLTWLMYRIVPQAFVPAEDQGYFISIVQAPAGASLQYTGEIARQAEQILLKDPEVLGVFSVMGFSFSGAAPNQGLIFTSLKPFAEREGPEHSAQTVINRVRGQFAGISGANVFPTPPASIPGLGAFGGFEFQVLDQGGTDINALAAATYAMAGAGNQSPRLRGLFTSFTVNDPQISVQIDRDRALALGLPVGEITEALQIYLGSQYVNDFDFNNRAYRVYVQADKAFRSEPGALKQFYVRNRAGEMIPLESVVRLSEATAPQVISHFNLFRSASINGSAAPGYSSGQALQEMQDLAARTLPQGMGYAWSGLSLEESKAGRQSFLIFGLAILLVYLTLSAQYESLVLPFIVLLGVPLAVLGALTAQWARGFANDVYCQIGLVMLIGLAAKNSILIVEFAEQLRHKGATVVEAAVQAARIRLRPILMTSLAFILGVLPLVFASGAGAEARNSVGTAVAGGMLVSTFLNLIFIPVLYVVVQTIRGGGRGQAGTQQAN

SEQ ID NO: 74628 - DNA, 3144 bp, Serratia marcescens subsp
  CDS (1)..(3144): transl_table=11
atggacttttcccgttttttcatcgaccggccgatctttgccgcggtgctgtcgatactgatttttgtcgccggggtgatcgccatcccgctgctgccgatcagcgagtacccggacgtggtgccgcccagcgtgcaggtgcgcgcagaatacccgggcgccaacccgaaagagatcgctgaaacggtggccacgccgctggaagaagcgatcaacggcgtcgaaaacatgatgtacatgaaatcggtcgccggttccgacggcgtgctggtgaccaccgtcaccttccgccccggcaccgatcccgatcaggcgcaggtgcaggtgcaaaaccgcgtggcgcaggccgaagcgcgcctgccggaagacgtgcgccgccagggcatcactacccagaaacagtctccggcgctgacgctggtggtgcatctggtgtcgccttccggcaagtacgactcgctgtacctgcgcaactacgccaccctgaaggtcaaggatgaactggctcgcctgccgggcgtcggccaggtgcagatcttcggcgccggtgaatacgcgatgcgcatctggctcgatccgaacaaggtcgccgcgcgcgggctgaccgcctccgacgtggtgagcgccatgcaagagcaaaacgtgcaggtctccgccggccagctcggcgcggagccgatgccgacgcgcagcgactatctgctgtcgatcaacgcccagggccgcctgcaaaccgaagaagagttcggcaatatcatcctcaaaagcggcgataacggcgagatcgtgcggctgcgcgacgtggcgcgcatcgagatgggttccggcagctacgcgctgcgcgcccagctcaataacaaggatgcggtcggcatcggcatcttccagtcgccgggcgccaacgccatcgagctgtcggacgcggtgcgcggcaagatggccgagctggcgacccgcttcccggatggcatgagctggaaatctccgtacgatccgacggttttcgtgcgcgattcgatccgcgcggtggtggataccctgctggaagcggtgatcctggtggtgctggtggttattctgttcctgcagacctggcgcgcctcgatcattccgctgttggcggtgccgatctccgtggtcggcaccttcgccgcgctgtatctgctgggcttctcgctcaacaccctcagtctgttcgggctggtgctggcgatcggcatcgtggtggatgacgccatcgtggtggtggagaacgtcgagcgcaacatcgaagaggggctgtcgccgctggcggcggcgcaccaggcgatgcgcgaggtctccggcccgatcatcgccatcgccgtggtgctgtgcgcggtgttcgtaccgatggcgttcctttccggcgtcaccggccagttctacaagcagttcgccgtcaccatcgccatctcgacggtgatctccgccatcaactcgctgaacctgtcgccggcgctggcggcgcgcttgctgaaaccgcacggcgcgccgaaagatatgccgtcgcgcctgatcgacaggctgttcggttggctgttccggccgttcaaccgcttcttcgccagcggttcgcaacgctaccagcgcggcgtctcccgcgtgctgggccggcgcggcgcggtgttcatcgtctatctgctgctgctggccgccgccggggtgatgtttaagaccgtgcccggcggctttatcccgacgcaggacaagctgtatctgattggcggcgtgaagatgccggaaggcgcctcgctggagcgcaccgatgcggtgatccgcaagatgagcgccatcggtatgagcgtggacggcgtcaccgatgcggtggccttccccggcctgaacgcgctgcagttcaccaatacgccgaataccggcacggtgttcttcgcgctggagtcattgagcacccgtacccgcaccgcggcgcagatcaacgccgagatcaacgcgcgcatttcgcagatccaggaaggtttcgccttctcgatcatgccgccgccgatcctcggcatcggccagggttccggctattcgctgtacgtgcaggatcgcggcgggctgggttacggcgcgctgcagaccgcgatcaacacgatgtccggcgccattatgcaaacgccaggcatggggttcccgatctcctcttatcaggccaacgtgggccaacgtgacgccaaaatcgatcgcgacaaggccaaggcccagggggtgccgctcaatgcgctgttcagcacgctgcagacctacctcggttcgtcttatatcaacgacttcaaccgctatggccgcacctggaaggtgatggcgcaggccgacgcccagttccgcgacagcgtggaagacatcgccaacctgcgtacccgcaacgacaagggcgaaatggtgccgatcggcagcatggtcagcataggcaccacttacggcccggatccggtgatccgttataacggcttcccggcggcggatctgatcggcgacgccgatccgcgcgtgctctcctctacccaggcgatgggtgcgctgacgcagatggccgataagctgttgccgaacggcatgaacatccagtggaccgatctgagctatcagcaatcgacccagggcaacgccgcgctggtggtcttcccggtggcagtgctgctggcgttcctcgcgctggcggcgctgtatgaaagctggacgctgccgctggcggtgatcctgatcgtgccgatgaccatgctgtcggcgctgttcggcgtgtggctgaccggcggcgacaacaacgtgttcgtgcaggtcgggctggtcgttctgatggggctggcctgcaagaacgccattctgatcgtcgagttcgcccgcgagctggaaatgcagggcaaaggcatcgtcgaggcggcgctggaggcctgtcgcctgcggttgcgcccgatcgtgatgacctccatcgccttcatcgccggcaccatcccgctgatcctcggccacggcgccggcgccgaggtgcgcggcgtcaccggcatcacggtgttctccggcatgctgggggtcaccctgttcgggctgttcctgacgccggtgttctacgtcaccctgcggcgcctggtggcgcgcaaagcgcagccgcagacggcgtaa

SEQ ID NO: 74629 - protein, 1047 aa, Serratia marcescens subsp
MDFSRFFIDRPIFAAVLSILIFVAGVIAIPLLPISEYPDVVPPSVQVRAEYPGANPKEIAETVATPLEEAINGVENMMYMKSVAGSDGVLVTTVTFRPGTDPDQAQVQVQNRVAQAEARLPEDVRRQGITTQKQSPALTLVVHLVSPSGKYDSLYLRNYATLKVKDELARLPGVGQVQIFGAGEYAMRIWLDPNKVAARGLTASDVVSAMQEQNVQVSAGQLGAEPMPTRSDYLLSINAQGRLQTEEEFGNIILKSGDNGEIVRLRDVARIEMGSGSYALRAQLNNKDAVGIGIFQSPGANAIELSDAVRGKMAELATRFPDGMSWKSPYDPTVFVRDSIRAVVDTLLEAVILVVLVVILFLQTWRASIIPLLAVPISVVGTFAALYLLGFSLNTLSLFGLVLAIGIVVDDAIVVVENVERNIEEGLSPLAAAHQAMREVSGPIIAIAVVLCAVFVPMAFLSGVTGQFYKQFAVTIAISTVISAINSLNLSPALAARLLKPHGAPKDMPSRLIDRLFGWLFRPFNRFFASGSQRYQRGVSRVLGRRGAVFIVYLLLLAAAGVMFKTVPGGFIPTQDKLYLIGGVKMPEGASLERTDAVIRKMSAIGMSVDGVTDAVAFPGLNALQFTNTPNTGTVFFALESLSTRTRTAAQINAEINARISQIQEGFAFSIMPPPILGIGQGSGYSLYVQDRGGLGYGALQTAINTMSGAIMQTPGMGFPISSYQANVGQRDAKIDRDKAKAQGVPLNALFSTLQTYLGSSYINDFNRYGRTWKVMAQADAQFRDSVEDIANLRTRNDKGEMVPIGSMVSIGTTYGPDPVIRYNGFPAADLIGDADPRVLSSTQAMGALTQMADKLLPNGMNIQWTDLSYQQSTQGNAALVVFPVAVLLAFLALAALYESWTLPLAVILIVPMTMLSALFGVWLTGGDNNVFVQVGLVVLMGLACKNAILIVEFARELEMQGKGIVEAALEACRLRLRPIVMTSIAFIAGTIPLILGHGAGAEVRGVTGITVFSGMLGVTLFGLFLTPVFYVTLRRLVARKAQPQTA

SEQ ID NO: 74630 - DNA, 3108 bp, Enterobacter aerogenes
  CDS (1)..(3108): transl_table=11
atgttctcccgtttcttcgtgcgtcgcccggtctttgcatgggtgatcgctatccttatcatgcttgccggggcgctggcgatccgcacgctgccggtgggacaatatccggacgtcgccccgccggcggtaaaaatatccgctacctataccggcgcttccgcagaaaccctcgaaaacagcgtcacccaggttatcgagcagcagctcaccgggctggataacttactttatttcacctccaccagcagttcggatggtacggtaagtattaccgtcacctttgagcagggaaccgatccggataccgctcaggtacaggtgcaaaacaaagtgcagcaggcggaatcgcgtctgccgagtgaagtacagcaatctggcgtaacggtagaaaaatcgcaaagcagcttcctgttaatcctcgcggtgtatgacaaaaccaaccgcgccaccagttctgatatctccgactggctggtcagcaatatgcaggacccgctggcgcgcgtggagggcgtcggcagcctgcaggtattcggggccgaatacgcgatgcgcatctggatggatccgaccaaactcgcctcttactcgttgatgccttccgacgtacagtcggcgattgaggcgcagaacgtgcaggtctccgcgggtaaaatcggcgcgctaccgtcgtccaatacccagcaattgaccgctaccgtgcgcgcgcagtcgcggctgcaaacgcctgaccagttcaaagcgatcattgtaaagagccagtccgacgggtcggtggtgcgcctgagcgatgtcgcgcgggtggagatgggcagcgaggattacaccgccaccgctaatctgaacggccaccccgccgccgggattgcggtgatgatggcacccggcgctaacgcgctggataccgcgacgctggtgaaaagcaaaatcgctgaattccagcgtcaaatgccgcagggctacgatatcgcctacccgaaagacagcaccgagttcatcaaaatctcggtcgaggacgtcattcagaccctgtttgaggcgattatcctcgtggtctgcgtaatgtatctgttcctgcagaatttccgcgcgacgctcattccggcggtagcggtaccggtcgtgttacttggcacctttggggtgctggcgctgttcggctactccattaataccctgacgctgtttgccatggtgctggcgatcggcctgctggtggatgatgccattgtggtggtggaaaacgtcgaacggattatgcgcgacgaagcgctgcccgcccgcgaagccaccgaaaaatcgatgggcgaaatctccggcgcgctggtggcgatcgccctggtgctgtcggcggtattcctgccaatggcctttttcggcggttcgaccggggtaatctatcgccagttctcggtgacgattatctcggcgatgatgctgtcggtggtcgtagcgttaaccctcactccggcgctgtgcggcgcgctgctaagccactccaaacctcatgacaaaggtttcttcggcgcctttaatcgcctgtgggggcgtacggaagatggctaccagcgtcgcgtactcggcggcttacgccgcggcgcggtgatgatgggcgcttacgccttgatttgcggggcgatggcgttggcgatgtggaaactgccgggcagctttctgccggtggaggatcagggcgaaatcatggtccagtacaccttgcctgccggggcgacggcggtgcgtaccgccgaggtgcgccgtcaggtgaccgactggttcctcaccaaagagaaagccaataccgaggttatcttcaccgtcgacggcttcagtttcagcggcagcggtcagaacgccggaatggccttcgtctcattgaaaaactggtcgcagcgcaaaggcgacgaaaataccgcgcaggccattgcgctgcgcgccaacaaagagctgggcgcgatccgcgacgccaccctgttcgccatgacgccgccatcggtggacggtcttgggcaaagtaacggcttcactttcgagctgatggccagcggggggaccgatcgcgatagcctgatgaagctgcgcagccaactgctggccgcagccaatcagagcggcgaactgcagtcggttcgcgccaacgatctgccacaaatgccacagctgcaggtggatatcgataacaataaagccgtctcgctggggctgtcgctcagcgacgtgaccgatacgctctccagcgcctggggcggcacgtacgtcaacgactttatcgatcgcggccgggtgaaaaaggtctacatccagggcgagagcgacgcgcgcgccgtgccgtccgatcttggtaaatggtttgtccgcgccagcgataacagcatgacgccgttcaccgcgttcgccaccacccattgggaatacggcccggaaagcctggtacgctacaacggctcggccgcctttgagatccagggggaaaacgccgcgggcttcagctcaggtgcggcaatggacaaaatggaaaaactggctgatagcctgccggcgggttccacctgggcatggagcggtatttcgctacaggaaaaactggccagcggccaggcgatgagcctgtacgccatttcgattctggtggtgttcctgtgcctggcggcgctgtatgaaagctggtcggtgccgttctcggtgatcatggtcatcccgttaggcctgcttggcgcggcgctggcggccacgctgcgcggcttaagtaacgacgtctatttccaggtggcgctgttgacgactattggcctgtcgtcgaagaacgccatccttatcgttgaattcgctgaatccgcggtggatgagggctattcgctctcgcgggcggcgatccgcgccgcgcagacccgtctgcgcccgattgtcatgacctcgctggcatttatcgccggagtactgccgctggccattgctaccggcgccggggccaacagccgcgtggcgattggtaccgggattatcggcggcaccctgacggcgacgctgctggcggtgttcttcgtcccgctgttctttgtgctggtgaagcgtctctttacccgcccacgtccttctcaggagtaa

SEQ ID NO: 74631 - protein, 1035 aa, Enterobacter aerogenes
MFSRFFVRRPVFAWVIAILIMLAGALAIRTLPVGQYPDVAPPAVKISATYTGASAETLENSVTQVIEQQLTGLDNLLYFTSTSSSDGTVSITVTFEQGTDPDTAQVQVQNKVQQAESRLPSEVQQSGVTVEKSQSSFLLILAVYDKTNRATSSDISDWLVSNMQDPLARVEGVGSLQVFGAEYAMRIWMDPTKLASYSLMPSDVQSAIEAQNVQVSAGKIGALPSSNTQQLTATVRAQSRLQTPDQFKAIIVKSQSDGSVVRLSDVARVEMGSEDYTATANLNGHPAAGIAVMMAPGANALDTATLVKSKIAEFQRQMPQGYDIAYPKDSTEFIKISVEDVIQTLFEAIILVVCVMYLFLQNFRATLIPAVAVPVVLLGTFGVLALFGYSINTLTLFAMVLAIGLLVDDAIVVVENVERIMRDEALPAREATEKSMGEISGALVAIALVLSAVFLPMAFFGGSTGVIYRQFSVTIISAMMLSVVVALTLTPALCGALLSHSKPHDKGFFGAFNRLWGRTEDGYQRRVLGGLRRGAVMMGAYALICGAMALAMWKLPGSFLPVEDQGEIMVQYTLPAGATAVRTAEVRRQVTDWFLTKEKANTEVIFTVDGFSFSGSGQNAGMAFVSLKNWSQRKGDENTAQAIALRANKELGAIRDATLFAMTPPSVDGLGQSNGFTFELMASGGTDRDSLMKLRSQLLAAANQSGELQSVRANDLPQMPQLQVDIDNNKAVSLGLSLSDVTDTLSSAWGGTYVNDFIDRGRVKKVYIQGESDARAVPSDLGKWFVRASDNSMTPFTAFATTHWEYGPESLVRYNGSAAFEIQGENAAGFSSGAAMDKMEKLADSLPAGSTWAWSGISLQEKLASGQAMSLYAISILVVFLCLAALYESWSVPFSVIMVIPLGLLGAALAATLRGLSNDVYFQVALLTTIGLSSKNAILIVEFAESAVDEGYSLSRAAIRAAQTRLRPIVMTSLAFIAGVLPLAIATGAGANSRVAIGTGIIGGTLTATLLAVFFVPLFFVLVKRLFTRPRPSQE

SEQ ID NO: 74632 - DNA, 3159 bp, Proteus mirabilis
  CDS (1)..(3159): transl_table=11
atgcctaagttttttatagacagaccaatatttgcgtgggtaattgccataattaccatgcttgctggtcttttggcactcatcaaactgcctgttgcacaatatccaacgattgcaccgccagcaatttccatctctgcggtctatccaggagctgatgcaaccacggtacagaatactgtaacccaagttatcgaacaaaatatgaatggtatcgataacatggtttatatgtcttcaaccagtgattctgcaggtatgatgaatatcacgctgacctttgaagctggtactgaccctgatattgcgcaagtccaagtgcaaaataaattgcaattggcaatgcctcttttacctcaggaagtacaacaacaagggattagtgtcgataaatcttctagttcattcttaatggttgcaggttttatctctggtgatggctcgatgtcacaagatgacatcgccgactatgtaggtgcaacaattaaagatccattaagccgtgtcacaggggtgggtgaaacgcagttatttggtacacaatacgcaatgcgtatttggttagatccagataaactggtgaaatataacatgaccacacttgatgttattaatgcgattaaatcgcaaaataaccaagtggcggcaggccaattaggtggtacgccaccagtgcctggtcagcgtttaaatgtatctatcattgcgcaaactcgacttaatacacctgagcaatttgctgatattctgatgaaagtcaatcaagacggttcacaggttaagctaaaagatctgggtattgttgagatgggggctgaaaactacagcacgattgctcgctttaatggcttaccggcagcaggtattggtattaaactggcaacaggtgctaacgcccttgataccgcaacagcagtacgtgcggcacttgctgatatggagccgttcttcccttctggattagaggtcgtttatccttacgatacaacaccatttgttaagatctctatttttgaagtggttaaaacgctcgttgaagccattatgctggtatttgtagtcatatatctgttcttacagaacttccgtgctacattaattccaaccattgctgtgcccgtcgtattattagggactttcgccatattgtccgcgtttggctattcgataaacaccttgacgatgttcgcgatggtactagccatcggtctactggttgatgatgctatcgttgtagtagaaaacgttgaacgtgtgatgcaagaggaaggactgtcacctaaagaagcgacacgtaagtctatgggacaaatccaaggtgcattggtgggtattgccctcgtgttatctgcggtatttattccaatggcattctttggtggttcaacgggtgcgatttaccgacagttctcagttactattgtatcagcgatggtgctgtctgttttcgtggcattgattttaacccctgcactttgtgcaacattgttaaaaccaatcccgaaaggcagccatggtgtacaaacaggtttctttggttggtttaaccgcgtttttgaaaaaagtagtcaccactatacagacagtgtttctcgtacactgcgtggtacaggtcgttacttactgatctacgtcttacttgttgctgctatggcaattatgtttgtgcgtttaccggcgtctttcttaccagaagaagaccaaggggtgttactgacagtggttcagttgcccgctggatcaacccaagagcaaactcaagacgtattaacacaagtcaatgactattttaatactaaagaaaaagatgtggttaagtcggtctttaccgtcagcggctttggttttggtggtcaaggtcaaaacatggggcttgctttcgtcgtattaaatgattgggatgagcgtaaatcagaccaagacaaagtccctgctattgtcggtcgtgctaaccaagctctttctcaaattaaagaagcctttgtttactcctttaatattccagcaattgttgagttaggctctgcaggtggttttgaattcgagttaatcgataatgccaacctgggacacgaaaaactcatggaagcaagaaaccaattgcttggaatggcagcacaagagccacaaatgttgacgggtgtgcgtcctaacggtcaagaagatacctctcagtatcgtctttatatcgacttagaaaaagcacaagctcaaggtgttgcggtcagtgatatctactcaacattaggtacgatgtttggtggtagctacgttaacgactttatcgaccgtggtcgtgtgaagaaagtttacgttcaagcagaatcacaattccgcatgttgccacaagatatcgctaatctttacgttcgtaacaatgcgggtcagatggtgcctttctcatccttcattgatactagtaaagatccttggttatatggctcaccacgcttagagcgttataatggtttaccagctgtccagatccaaggtagtgcaacaccgggacaaagtagtggtgatgcaatgctaatgatggaacaactcgccagcaaattaccaagtggtattggctacgagtggacgggtatgtcataccaagaacgtctatcaggtaaccaagcgccagcactgtatactatttcattaattgtagtattcctttgtttggcggcactctatgagagttggtcagtgcctttctcagttatgttagttgtacctttaggggtcattggtgcgttagcatttactacattgagagggcttgaaaacgacgtttactttaaggttgggctacttaccaccattgggttatcggcgaagaacgccatattgattgtcgaattcgccaaagacttaatggaaaaagagggtaaagggctagtagaagcgacgttagattccgttagaatgcgtctacgtccaattctaatgacatcgttagcctttatgcttggggttattcctctggtattaagtaacggtgcaggctctggtgcgcaaaactcggtaggtacaggggtattcggtggtatgattgccgcgacatcccttgctatttactttgttcctattttcttcgttgtgatccgcagaaggtttgcgaagaaaaacgaagacttagagcacccaaactatccgcaccaaactaagtaa

SEQ ID NO: 74633 - protein, 1052 aa, Proteus mirabilis
MPKFFIDRPIFAWVIAIITMLAGLLALIKLPVAQYPTIAPPAISISAVYPGADATTVQNTVTQVIEQNMNGIDNMVYMSSTSDSAGMMNITLTFEAGTDPDIAQVQVQNKLQLAMPLLPQEVQQQGISVDKSSSSFLMVAGFISGDGSMSQDDIADYVGATIKDPLSRVTGVGETQLFGTQYAMRIWLDPDKLVKYNMTTLDVINAIKSQNNQVAAGQLGGTPPVPGQRLNVSIIAQTRLNTPEQFADILMKVNQDGSQVKLKDLGIVEMGAENYSTIARFNGLPAAGIGIKLATGANALDTATAVRAALADMEPFFPSGLEVVYPYDTTPFVKISIFEVVKTLVEAIMLVFVVIYLFLQNFRATLIPTIAVPVVLLGTFAILSAFGYSINTLTMFAMVLAIGLLVDDAIVVVENVERVMQEEGLSPKEATRKSMGQIQGALVGIALVLSAVFIPMAFFGGSTGAIYRQFSVTIVSAMVLSVFVALILTPALCATLLKPIPKGSHGVQTGFFGWFNRVFEKSSHHYTDSVSRTLRGTGRYLLIYVLLVAAMAIMFVRLPASFLPEEDQGVLLTVVQLPAGSTQEQTQDVLTQVNDYFNTKEKDVVKSVFTVSGFGFGGQGQNMGLAFVVLNDWDERKSDQDKVPAIVGRANQALSQIKEAFVYSFNIPAIVELGSAGGFEFELIDNANLGHEKLMEARNQLLGMAAQEPQMLTGVRPNGQEDTSQYRLYIDLEKAQAQGVAVSDIYSTLGTMFGGSYVNDFIDRGRVKKVYVQAESQFRMLPQDIANLYVRNNAGQMVPFSSFIDTSKDPWLYGSPRLERYNGLPAVQIQGSATPGQSSGDAMLMMEQLASKLPSGIGYEWTGMSYQERLSGNQAPALYTISLIVVFLCLAALYESWSVPFSVMLVVPLGVIGALAFTTLRGLENDVYFKVGLLTTIGLSAKNAILIVEFAKDLMEKEGKGLVEATLDSVRMRLRPILMTSLAFMLGVIPLVLSNGAGSGAQNSVGTGVFGGMIAATSLAIYFVPIFFVVIRRRFAKKNEDLEHPNYPHQTK

SEQ ID NO: 74634 - DNA, 3108 bp, Acinetobacter baumannii
  CDS (1)..(3108): transl_table=11
atgtcacaattttttattcgtcgtcccgtttttgcttgggttattgcgatcttcattattatatttggattgctgagcattcctaaactgccaattgcacgttttccaagtgtggccccgccacaggtgaatattagtgcgacttatcctggtgctacagctaaaaccattaacgatagcgttgtaaccttaattgagcgcgaattatcgggtgtaaaaaatctactctactatagtgcgacaacagatacctccggtacagcagagattacggctacgtttaaaccaggcacagatgtggaaatggctcaggttgacgttcaaaataaaatcaaggctgtagaagctcgcttaccgcaagttgtacgtcagcaaggtttacaggttgaggcttcatcgtccggatttttaatgctggtcgggattaactctccaaataatcaatattccgaagttgatttgagtgattatttggttcgaaatgttgtagaagagctaaaacgtgtcgaaggtgtagggaaggttcaatctttcggtgccgagaaagctatgcgtatttgggtcgacccgaataagcttgtttcttacggtttatcgattagtgatgtgaataatgccattcgtgaaaataatgtcgaaattgcacccggccgacttggtgatttaccagctgaaaaaggccagctcattactattccattgtctgctcaagggcaattgtctagtctcgagcaatttaaaaatattagcttaaaaagtaaaactaacggtagcgtaattaagttatctgatgttgccaatgtagaaataggctcacaggcatataactttgccattttggaaaatggtaagcctgctaccgcggcagcaattcaattaagcccgggtgctaacgccgtgaaaactgccgaagttgttcgagcaaaaattgaagagttgaagctaaatttaccggaaggcatggagtttagtattccttacgacaccgcgccgtttgtcaaaatttcaattgaaaaggtaattcatacattacttgaagccatggttctggttttcattgtgatgtatctatttttacataatgtccgctatacgcttattccagcgattgtggcgcctattgccttactcggtacttttaccgtgatgttgcttgccggcttttcaattaacgtactcaccatgttcggtatggtgcttgccatcgggattattgtcgacgatgccattgtcgtggttgaaaacgtcgaaaggattatggcgacagaaggattatcgcctaaagatgcaacctctaaagcaatgaaagagattaccagcccgattattggtattacgctggtattggcggcagtatttttacctatggcatttgcgagtggttctgtaggggtaatctataaacagtttaccttgaccatgtcggtatctattttattttcagcgctattggcacttattttaacaccggcactttgtgccacgattttaaaaccaatcgatgggcatcaccagaagaagggcttctttgcatggtttgaccgtagtttcgataaagtcactaaaaagtatgaattgatgctgcttaaaatcatcaaacatacagttccaatgatggtgatctttttagtaattaccggtattacctttaccggaatgaaatattggccaacagcatttatgccagaggaagatcaaggttggttcatgacttcgttccagctaccttcagatgcaaccgctgagcgtactcggaatgtagtcaatcaatttgaaaataatttgaaagacaatcccgatgtaaaaagtaataccaccattttgggatggggttttagtggcgcaggacaaaatgtagctgtggcttttacgacacttaaagacttcaaagagcggactagctctgcatctaagatgacaagcgacgttaattcttctatggcgaacagtacggaaggcgagactatggccgtgttaccacccgctattgatgagttaggtactttttcaggtttcagtttacgtttacaagaccgcgctaacttaggtatgcctgctttactggctgctcaagatgaacttatggcaatggcagccaagaataaaaagttctatatggtttggaatgaagggttgccacaaggtgacaatatttctttaaaaattgaccgtgaaaagcttagtgcatttggtgttaagttttctgatgtttcagacatcatttctacatcaatgggttcaatgtatatcaatgacttccctaatcaaggacgtatgcaacaagtcattgtacaggttgaggctaaatcacgtatgcaattgaaagatatcttgaatctgaaagtcatgggttcaagcggtcaattagtctcgttatcagaagttgtaacgccacaatggaataaggcaccacaacaatataatcgttataacggacgaccatctttgagtattgctggtattcctaacttcgatacgtcatcgggtgaagcaatgcgtgaaatggaacaactgattgcgaaattaccgaaaggtattggctacgagtggacaggtatttccttacaggaaaagcagtctgaatcacaaatggcctttttacttggtttatccatgttagttgtcttccttgtcttggctgcactctatgaaagctgggcaattccactttctgtgatgctagttgtgccactcggtatttttggagcaatcattgccattatgtctagggggttaatgaatgatgtgttcttcaaaatcgggctaattaccattattggtctatcggcaaagaatgcgattttgattgttgaatttgcgaaaatgctgaaagaagaaggcatgagtttgattgaagccactgttgccgcagccaaacttcgcttacggccaattctgatgacatcacttgcatttacgtgtggtgtaattcctttggtgattgcctcaggtgcaagttcagaaactcaacatgctttaggcacaggggtttttggcggcatgatttcagccaccattctggctattttctttgttcccgtgttttttatcttcattttgggtgcagtagaaaagctattttcctctaagaaaaaaatctcatcttaa

SEQ ID NO: 74635 - protein, 1035 aa, Acinetobacter baumannii
MSQFFIRRPVFAWVIAIFIIIFGLLSIPKLPIARFPSVAPPQVNISATYPGATAKTINDSVVTLIERELSGVKNLLYYSATTDTSGTAEITATFKPGTDVEMAQVDVQNKIKAVEARLPQVVRQQGLQVEASSSGFLMLVGINSPNNQYSEVDLSDYLVRNVVEELKRVEGVGKVQSFGAEKAMRIWVDPNKLVSYGLSISDVNNAIRENNVEIAPGRLGDLPAEKGQLITIPLSAQGQLSSLEQFKNISLKSKTNGSVIKLSDVANVEIGSQAYNFAILENGKPATAAAIQLSPGANAVKTAEVVRAKIEELKLNLPEGMEFSIPYDTAPFVKISIEKVIHTLLEAMVLVFIVMYLFLHNVRYTLIPAIVAPIALLGTFTVMLLAGFSINVLTMFGMVLAIGIIVDDAIVVVENVERIMATEGLSPKDATSKAMKEITSPIIGITLVLAAVFLPMAFASGSVGVIYKQFTLTMSVSILFSALLALILTPALCATILKPIDGHHQKKGFFAWFDRSFDKVTKKYELMLLKIIKHTVPMMVIFLVITGITFTGMKYWPTAFMPEEDQGWFMTSFQLPSDATAERTRNVVNQFENNLKDNPDVKSNTTILGWGFSGAGQNVAVAFTTLKDFKERTSSASKMTSDVNSSMANSTEGETMAVLPPAIDELGTFSGFSLRLQDRANLGMPALLAAQDELMAMAAKNKKFYMVWNEGLPQGDNISLKIDREKLSAFGVKFSDVSDIISTSMGSMYINDFPNQGRMQQVIVQVEAKSRMQLKDILNLKVMGSSGQLVSLSEVVTPQWNKAPQQYNRYNGRPSLSIAGIPNFDTSSGEAMREMEQLIAKLPKGIGYEWTGISLQEKQSESQMAFLLGLSMLVVFLVLAALYESWAIPLSVMLVVPLGIFGAIIAIMSRGLMNDVFFKIGLITIIGLSAKNAILIVEFAKMLKEEGMSLIEATVAAAKLRLRPILMTSLAFTCGVIPLVIASGASSETQHALGTGVFGGMISATILAIFFVPVFFIFILGAVEKLFSSKKKISS

SEQ ID NO: 74636 - DNA, 3147 bp, Klebsiella pneumoniae
  CDS (1)..(3147): transl_table=11
atgcctaatttctttatcgatcgccccatatttgcatgggtgatcgccattatcatcatgctggctgggggactatcgatcctcaaattgccggtggcgcaatatccgacgattgcgccgccagcaatttccatttccgccatgtaccccggtgctgacccccaaacagtgcagaacaccgtaacacaggttatcgaacagaatatgaacggtatcgatcacctgatgtacatgtcctcaaatggggactccaccggtacggtaaacattacgctgaccttcgaatccggtaccgatccggatatcgcccatgttcaggttcagaacaagctggcgctggcgacgcctctgctgccgcaagaagtacagcagcaagggattagcgttgagaaagcgtccagcagcttcctgatggttgtcggcgtcattaacaccaacggcaccatgaaccaggacgatatttcggactacgtggcggccaacatgaaggatccgattagccgtaccagcggcgtcggcgacgttcagctattcggttcccagtatgcgatgcgtatctggatggatccaaacaaactgaacaactttcagcttacgccggtggatgtgatcagcgccctgaaagcgcagaacgcccaggtggccgcgggccagttaggcggtacgccgccggtgaaaggccagcagcttaacgcctcgatcatcgcgcagacgcgtctgaccaatacggaagagtttggcaacatcctgctgaaggtgaaccaggacggttcccaggttcgtctgcgtgatgtcgccaaaattgagctgggcggcgaaagctatgacgtagtggcgaagtttaacggccagccggcatccggtctgggtattaaactggctaccggcgcgaacgcgctggataccgccaacgctattcgcgctgaactggcgaagatggagccgtttttcccgtcggggatgaagatcgtttacccgtatgacaccaccccgttcgtgaaaatttctattcacgaagtggttaaaacgctggtggaagcgatcatcctggtgttcctggtcatgtatctgttcctgcagaacttccgcgccaccctgatccccaccatcgcggtaccggtggtcctgttaggcaccttcgcggtgctggcggcgtttggcttctcgataaacaccctgacgatgttcgggatggtgctcgccatcggcctgttggtggatgacgccatcgtggtggtagagaacgtcgagcgcgtgatggcggaagagggtctgccgccgaaagaagcgacgcgtaaatcgatgggacagattcagggcgcgctggttggtatcgcgatggtgctgtcggcggtatttatcccgatggcgttcttcggcggctcaaccggggccatctatcgccagttctccatcactatcgtttccgcgatggcgctgtcggtactggtggcgttaatcctgacgccggcgctgtgcgccacgatgctgaaacccattcagaaaggcagccatggcgcgaccaccggcttcttcggctggtttaaccgcatgtttgataagagcacgcaccattacaccgacagcgtaggcaacattctgcgcagcaccggtcgttatctggtgctgtatctgatcatcgtggtgggtatggcatggctgttcgtccgtctgccgagctcgttcctgccggacgaggaccagggtgtattcctgagtatggcgcagctgcctgccggcgccacccaggagcgtacgcagaaagtgctggatgagatgacgaattactatctcaccaaagagaaggacaacgtggaatccgtgtttgcggttaacggcttcggtttcgccggccgcggccagaacaccggtatcgcgttcgtttcgctgaaagactggagccagcgtccgggtgaggaaaacaaagttgaagcgatcaccgctagagcaatgggctacttctcgcagattaaagatgcgatggtcttcgcctttaacctgccggctatcgttgaactgggtaccgcgaccggctttgacttcgagctgattgaccaggcgggtctgggccacgaaaaactgacccaggcgcgtaaccaactgtttggcatggtggcgcagcatcctgacgtgctgaccggcgtgcgccctaacggtctggaagatacaccgcagtttaaaatcgatatcgatcaggagaaagctcaggcgctgggcgtctccatcagcgacattaacaccacgctgggcgcagcctggggcggaagctatgtcaacgactttatcgaccgcggccgcgtgaagaaagtgtacatcatgtccgaagcgaaataccgtatgctgccggaagatatcggcaagtggtatgttcgcggcagcgatggtcagatggtgccgttctctgctttctcgacctcgcgttgggaatacggttcgccgcgtctggaacgctacaacggtctgccgtcactggaaatcctcggtcaggccgcgccaggcaagagtaccggtgaggcgatggcgctgatggaagagctggcgggtaaactgccttccggtatcggctacgactggaccgggatgtcttatcaggagcgactgtccggcaaccaggcccctgccctgtatgccatctcgctgattgtcgtcttcctgtgtctggcggcgctgtatgagagctggtcgattccgttctcggttatgctggtcgtccccttgggtgtggtcggtgcgctgttagccgccaccttccgcgggctaaccaacgacgtttacttccaggtgggtctgctgaccaccatcggcctgtcggcgaagaacgcaatattgatcgttgaattcgccaaagacctgatggagaaagagggcaaagggctgattgaggcgacgcttgaagcagtacgtatgcgtctacgtccaatcctgatgacatctctggcgttcatcctcggggtaatgccgctagttatcagctccggcgccggctccggtgcgcagaacgccgtcggtacaggcgtaatgggcgggatggtgaccgcgacgatcctggcgatcttcttcgtgccggtgttctttgtggtggttcgtcgccgctttagcaaaaaatcggaagatatagagcacagccatcaggttgagcatcattaa

SEQ ID NO: 74637 - protein, 1048 aa, Klebsiella pneumoniae
MPNFFIDRPIFAWVIAIIIMLAGGLSILKLPVAQYPTIAPPAISISAMYPGADPQTVQNTVTQVIEQNMNGIDHLMYMSSNGDSTGTVNITLTFESGTDPDIAHVQVQNKLALATPLLPQEVQQQGISVEKASSSFLMVVGVINTNGTMNQDDISDYVAANMKDPISRTSGVGDVQLFGSQYAMRIWMDPNKLNNFQLTPVDVISALKAQNAQVAAGQLGGTPPVKGQQLNASIIAQTRLTNTEEFGNILLKVNQDGSQVRLRDVAKIELGGESYDVVAKFNGQPASGLGIKLATGANALDTANAIRAELAKMEPFFPSGMKIVYPYDTTPFVKISIHEVVKTLVEAIILVFLVMYLFLQNFRATLIPTIAVPVVLLGTFAVLAAFGFSINTLTMFGMVLAIGLLVDDAIVVVENVERVMAEEGLPPKEATRKSMGQIQGALVGIAMVLSAVFIPMAFFGGSTGAIYRQFSITIVSAMALSVLVALILTPALCATMLKPIQKGSHGATTGFFGWFNRMFDKSTHHYTDSVGNILRSTGRYLVLYLIIVVGMAWLFVRLPSSFLPDEDQGVFLSMAQLPAGATQERTQKVLDEMTNYYLTKEKDNVESVFAVNGFGFAGRGQNTGIAFVSLKDWSQRPGEENKVEAITARAMGYFSQIKDAMVFAFNLPAIVELGTATGFDFELIDQAGLGHEKLTQARNQLFGMVAQHPDVLTGVRPNGLEDTPQFKIDIDQEKAQALGVSISDINTTLGAAWGGSYVNDFIDRGRVKKVYIMSEAKYRMLPEDIGKWYVRGSDGQMVPFSAFSTSRWEYGSPRLERYNGLPSLEILGQAAPGKSTGEAMALMEELAGKLPSGIGYDWTGMSYQERLSGNQAPALYAISLIVVFLCLAALYESWSIPFSVMLVVPLGVVGALLAATFRGLTNDVYFQVGLLTTIGLSAKNAILIVEFAKDLMEKEGKGLIEATLEAVRMRLRPILMTSLAFILGVMPLVISSGAGSGAQNAVGTGVMGGMVTATILAIFFVPVFFVVVRRRFSKKSEDIEHSHQVEHH

SEQ ID NO: 74638 - DNA, 3147 bp, Enterobacter aerogenes
  CDS (1)..(3147): transl_table=11
atgcctaatttctttatcgatcgccccatatttgcatgggtgatcgccataatcatcatgttggcaggggggctttcgattatgaaactccccgtggcgcaatatccaacgattgcgccgccagcagtgacgatctcggccacctatccgggggctgatgcgaaaacggtgcaggacaccgtgacacaggttatcgaacagaacatgaacggtatcgataacctgatgtacatgtcctcgaacagtgactccaccggtacggtgcagatcaccctgaccttccagtccggtaccgacgcagatatcgcccaggtacaggtgcagaataagctgcagctggcgatgccgctgctgccgcaggaagtacaacaacagggcgtgagcgtggagaaatcctccagtagcttcctgatggttgtcggggttatcaacactaacggcaccatgacgcaggaggatatttccgactacgtgggcgccaatatgaaggatgccatcagccgtacttccggcgtcggcgacgttcagctgttcggttcccagtacgcaatgcgtatctggatggacccgacgaagctaaacaacttccagttaactccggtagatgtcatcaacgccattaaagcgcagaacgcccaggtcgcggcaggtcagttaggcggtacgccgccggtgaaaggccagcagttgaacgcctcgatcatcgcccaaacgcgtctgacttccgctgatgaattcagcaagattctgctgaaagtcaatcaggatggttcacaggttcgtctgcgcgacgtggcgaaagttgaactcggcggcgaaaactacgacatcatcgcgaagttcaacggccaaccggcttctggtctggggattaaactggccaccggcgctaacgccctggataccgccaacgccatccgcgccgagctggcgaagatggaaccgtacttcccgtcaggcctgaaaatcgtctacccgtacgatactaccccgttcgtgaaaatctctattcatgaagtggtaaaaacgctggtggaagcgatcatcctggtgttcctggtcatgtatctgttcctgcagaacttccgcgccacgctgatcccgaccattgcagtaccggtggtattgcttgggacattcgccatcctggcggtgtttggcttctcgataaacaccctgacgatgttcgggatggtgctggccatcggcttgctggtggatgacgccatcgtggtagtagaaaacgtcgagcgcgtaatggcggaggaaggattgccgccgaaagaagcgacccgtaagtcgatgggtcagattcagggcgcgttggtcggtattgcgatggtactgtcggcggtatttatcccgatggccttcttcggcggttcaaccggcgcgatttatcgccagttctcgatcacaatcgtttccgcgatggcgctatcggtactggtagcgctgattctgacgccagcgctgtgcgccaccatgctgaagccgattcagaaaggcggccatggcgagcacaaaggcttctttggctggtttaaccgcatgttcgataagagcacgcaccactacaccgacagcgtaggcaacattctgcgtagtaccggtcgttacctggtgctgtatctgattatcgtcgtcggtatggcttacctgttcgttcgtctgccaagctccttcctgccggacgaagaccagggcgtgttcctgagtatggcgcagcttccggcgggcgcgagtcaggaacgtacgcagaaagtcctcgacgagatgactgactactacctgaccaaagagaagaacaacgttgaatcggtgttcgcggttaacggttttggttttgcaggccgcggtcagaacaccggtatcgccttcgtgtcgttaaaagactggagcgaacgcccaggttcagaaaacaaagttgaagcgattaccggccgcgcgatggcccgtttctcgcagattaaagatgcgatggtcttcgcgtttaacctgccggcgatcgtcgaactgggtaccgctaccggctttgacttccagctcatcgatcagggtggtttagggcatgagaaattaactcaggcgcgtaaccagctgtttggtatggttgctcagcatcccgatctgctggttggcgtgcgtcctaacggcctggaagatacgccgcagttcaagatcgatatcgatcaggaaaaagcgcaggcgctgggcgtttcaattagcgacatcaacaccaccctcggcgcagcgtggggcggcagctacgtcaacgacttcatcgaccgcggtcgcgtgaagaaagtgtacgtcatgtctgaagcgaaataccgtatgctgccagaggatatcggcaactggtatgtacgcggcagcgatggccaaatggtgccgttctccgccttctccacttcccattgggaatatggttcaccgcgtctggaacgttacaacggtctgccgtcgatggaaatcctcggtcaggcagcgccgggccgcagtacgggtgaagcgatggcgatgatggaacagctggcaagcaaactgccttcaggcgtcggttacgactggaccggtatgtcctatcaggaacgcctgtcaggcaaccaggccccggcgctgtatgctatctcgcttatcgtcgtcttcctgtgtctggcagcattgtacgagagctggtcgattccgttctccgtcatgctggtggtaccgttgggtgttgttggcgcgctgttagcggcaaccttccgcgggctgactaacgacgtttacttccaggtcggcctgctgacgaccatcggcctgtcggcgaagaacgcgatacttatcgttgaattcgccaaagacctgatggaaaaagaaggcaaaggcctgattgaagcgacgctggaagcggtacgtatgcgtctgcgtccaatcctgatgacctctctggcgtttatcctcggggtcatgccgctggttatcagctctggcgcaggttccggcgcacagaacgccgtcggtaccggcgtaatgggcgggatggtgaccgcgacggttctggctatcttcttcgtgccggtgttcttcgtggtggttcgtcgccgcttcactaagaaaactgaagatattgagcataaccatccggttgagcatcattaa

SEQ ID NO: 74639 - protein, 1048 aa, Enterobacter aerogenes
MPNFFIDRPIFAWVIAIIIMLAGGLSIMKLPVAQYPTIAPPAVTISATYPGADAKTVQDTVTQVIEQNMNGIDNLMYMSSNSDSTGTVQITLTFQSGTDADIAQVQVQNKLQLAMPLLPQEVQQQGVSVEKSSSSFLMVVGVINTNGTMTQEDISDYVGANMKDAISRTSGVGDVQLFGSQYAMRIWMDPTKLNNFQLTPVDVINAIKAQNAQVAAGQLGGTPPVKGQQLNASIIAQTRLTSADEFSKILLKVNQDGSQVRLRDVAKVELGGENYDIIAKFNGQPASGLGIKLATGANALDTANAIRAELAKMEPYFPSGLKIVYPYDTTPFVKISIHEVVKTLVEAIILVFLVMYLFLQNFRATLIPTIAVPVVLLGTFAILAVFGFSINTLTMFGMVLAIGLLVDDAIVVVENVERVMAEEGLPPKEATRKSMGQIQGALVGIAMVLSAVFIPMAFFGGSTGAIYRQFSITIVSAMALSVLVALILTPALCATMLKPIQKGGHGEHKGFFGWFNRMFDKSTHHYTDSVGNILRSTGRYLVLYLIIVVGMAYLFVRLPSSFLPDEDQGVFLSMAQLPAGASQERTQKVLDEMTDYYLTKEKNNVESVFAVNGFGFAGRGQNTGIAFVSLKDWSERPGSENKVEAITGRAMARFSQIKDAMVFAFNLPAIVELGTATGFDFQLIDQGGLGHEKLTQARNQLFGMVAQHPDLLVGVRPNGLEDTPQFKIDIDQEKAQALGVSISDINTTLGAAWGGSYVNDFIDRGRVKKVYVMSEAKYRMLPEDIGNWYVRGSDGQMVPFSAFSTSHWEYGSPRLERYNGLPSMEILGQAAPGRSTGEAMAMMEQLASKLPSGVGYDWTGMSYQERLSGNQAPALYAISLIVVFLCLAALYESWSIPFSVMLVVPLGVVGALLAATFRGLTNDVYFQVGLLTTIGLSAKNAILIVEFAKDLMEKEGKGLIEATLEAVRMRLRPILMTSLAFILGVMPLVISSGAGSGAQNAVGTGVMGGMVTATVLAIFFVPVFFVVVRRRFTKKTEDIEHNHPVEHH

SEQ ID NO: 74640 - DNA, 3123 bp, Xanthomonas maltophilia
  CDS (1)..(3123): transl_table=11
atggcacgctttttcatcgatcgacccatctttgcgtgggtgatcgccatcatcatcatgctcgccggcggcctggcgctgttcaagctgccggtctcgatgtaccccaacgtcgcaccgccggcggtggaaatcagcgccacctacccgggtgcatcggccaaggtggtcgaggactcggtgacgcagatcatcgagcagaacatgaagggccttgatggcctgatctacttctcctccaacagctcgtccaacggccaggccaccatcaccctgaccttcgagagcggcaccaacccggatatcgcccaggtgcaggtgcagaacaagctgcagctggccatgccgctgctgccgcaggaagtgcagcggcagggcatcaacgtggccaagtccagctcgggcttcctgaacgccatcgcgttcgtgtccgagaacggcagcatggacgccaacgacatcgccgactacgtcggttccaatgtcgtcgaccgcctgagccgcgtgccgggcgtgggcaacatccaggtgttcggtggcaagtacgccatgcgcatctggctggacccgaacaagctgcatacctatggcctgtcggtgccggaagtgaccgccgcgatcaaggcgcagaacgcccaggtggcgatcggccagctcggcggtgcgccgtcggtgaagggccagcagctcaacgccaccatcaacgcgcagtcgcgcctgcagaccccggaacagttccgaaacatcatcgtgcgcggtgcgcaggacggtgccgagctgcgcctgggtgatgtcgcccgcgtcgagctgggtgccgagtcctacgacttcgtcacccgctacaacggccagccggccagtggcctggcggtcaccctggccaccggcgccaacgcgctggataccgcggccggtgtggatgccgcgctggaagacatgaagggcttcttcccggccggcctgaaggccgagatcccgtacgacaccaccccgttcgtgcgcgtgtcgatcaagggcgtggtgcagaccctgatcgaagcgatcgtgctggtgttcgtggtgatgtacctgttcctgcagaacttccgcgccacgctgatcccgaccatcgccgtgccggtggtgctgctgggtaccttcggcgtgctggcgatgctgggcttctcggtgaacatgctgaccatgttcgcgatggtgctggcgatcggcctgctggtggacgatgccatcgtggtggtggagaacgtcgagcgcatcatgtccgaggaagggctgtcgccgctcgaagcgacccgcaagtcgatgggccagatcaccggtgcgctggtgggtatcggcctggtgctgtcggcggtgttcgtgccgatggccttcatgagcggctccaccggcgtgatctatcgccagttctcggccacgattgtctctgcgatggcgttgtcggtgctggtggcgatcgtgctgaccccggcactgtgcgcgaccatgctcaagccgctgaagaagggtgagcaccacgtcgcccaccgtggcctggccggtcgcttcttcaatggcttcaaccgtggcttcgatcgcaccagcgaaagctaccagcgcggcgtgcgcggcatcatccaccgtccgtggcgcttcatgggcatcgtggcggccttgttcgtgctgatgggcgtgctgttcgtgcgcctgcccagctcgttcctgcccaacgaagaccagggtgtgctgatggcgctggtgcaggcgccggtcggtgccacccaggaacgcacgctggaatcgatcgcggcactggaaaaccacttcctgcagaacgagaaggatgcggtggactcggtgttctccgtgcagggcttcagcttcgccggcatgggccagaacgcgggcatggcgttcgtcaagctgaaggactggagcgagcgtgacgccgacaatggcgtgatgccgatcaccggacgtgcgatggcggccctgggccagatcaaggatgccttcatcttcgccttcccgccgccggccattccggagctggggaccgcctcgggctacaccttcttcctgaaggacaacagcggccagggccacgaggcactggtggccgcgcgcaaccagctgctcggcctggccgcaggcagcaagaagctggccaacgtacgcccgaacggccaggaagacacgccgcagttccgcatcgacatcgacgcggccaaggcgacctcgctgggactgtcgatcgaccagatcaacggcacgctggcggccgcgtggggcagctcgtacatcgatgacttcgtcgatcgtggccgcgtcaagcgcgtgttcgtgcaggccgaccaggcgttccgcatggtgccggaggacttcgatctctggtccgtgaagaacgacaagggtgagatggtgccgttcagcgccttcgctaccaagcactgggactacggttcgccgcgcctggaacgctacaacggtgtgtcggcaatggaaatccagggcgaaccggccccgggtgtcgcctccggtgatgccatggccgagatcgaacagctggccaagcagctgccggcgggtttcggcatcgaatggacggcgatgtcctaccaggaacgccaggccggctcgcagacgccgctgctgtacacgctgtcgctgatgatcgtgttcctgtgcctggccgcgatgtatgaaagctggagcgtaccgaccgcggtgctgctggcggccccgctgggtatcctcggcgcggtgctggccaacaccttcaagggcctggagcgcgacatctacttccaggtggcgatgctgaccacggtgggcctgaccagcaagaacgcgatcctgatcgtcgagttcgccaaggaaaacctggaaaagggcgccagcctgatcgagtcgatcatgcacgccgtgcgcgaccgcctgcgcccgatcgtgatgacctcgctcgccttcggcatgggcgtggtaccgctggcgatctccaccggtgccggctccggcgccaagcaggcgatcggcaccggcgtgctcggcggcatgatcgtcggcaccgtgctcggcgtgttcttcgtgccgctgttcttcgtggtggtgcagcgcgtgttcaagcgcagatccacgacgtga

SEQ ID NO: 74641 - protein, 1040 aa, Xanthomonas maltophilia
MARFFIDRPIFAWVIAIIIMLAGGLALFKLPVSMYPNVAPPAVEISATYPGASAKVVEDSVTQIIEQNMKGLDGLIYFSSNSSSNGQATITLTFESGTNPDIAQVQVQNKLQLAMPLLPQEVQRQGINVAKSSSGFLNAIAFVSENGSMDANDIADYVGSNVVDRLSRVPGVGNIQVFGGKYAMRIWLDPNKLHTYGLSVPEVTAAIKAQNAQVAIGQLGGAPSVKGQQLNATINAQSRLQTPEQFRNIIVRGAQDGAELRLGDVARVELGAESYDFVTRYNGQPASGLAVTLATGANALDTAAGVDAALEDMKGFFPAGLKAEIPYDTTPFVRVSIKGVVQTLIEAIVLVFVVMYLFLQNFRATLIPTIAVPVVLLGTFGVLAMLGFSVNMLTMFAMVLAIGLLVDDAIVVVENVERIMSEEGLSPLEATRKSMGQITGALVGIGLVLSAVFVPMAFMSGSTGVIYRQFSATIVSAMALSVLVAIVLTPALCATMLKPLKKGEHHVAHRGLAGRFFNGFNRGFDRTSESYQRGVRGIIHRPWRFMGIVAALFVLMGVLFVRLPSSFLPNEDQGVLMALVQAPVGATQERTLESIAALENHFLQNEKDAVDSVFSVQGFSFAGMGQNAGMAFVKLKDWSERDADNGVMPITGRAMAALGQIKDAFIFAFPPPAIPELGTASGYTFFLKDNSGQGHEALVAARNQLLGLAAGSKKLANVRPNGQEDTPQFRIDIDAAKATSLGLSIDQINGTLAAAWGSSYIDDFVDRGRVKRVFVQADQAFRMVPEDFDLWSVKNDKGEMVPFSAFATKHWDYGSPRLERYNGVSAMEIQGEPAPGVASGDAMAEIEQLAKQLPAGFGIEWTAMSYQERQAGSQTPLLYTLSLMIVFLCLAAMYESWSVPTAVLLAAPLGILGAVLANTFKGLERDIYFQVAMLTTVGLTSKNAILIVEFAKENLEKGASLIESIMHAVRDRLRPIVMTSLAFGMGVVPLAISTGAGSGAKQAIGTGVLGGMIVGTVLGVFFVPLFFVVVQRVFKRRSTT

SEQ ID NO: 74642 - DNA, 3150 bp, Xanthomonas maltophilia
  CDS (1)..(3150): transl_table=11
atggttcgtttcttcatcgaccggccgatcttcgcctgggtgatcgccatcgcggtcagcctgctcggcctgctcgcgatcctgatcctgccggtggaccgctacccgcagatcgccccgcccaccatcaccatccgcgccacctacaccggcgcctcgtcgcagaccgtggaaaacgcggtcacccaggtcatcgagcagtcccagcaaagcctcgatcacctgatgtacatgacctcgaccagtgcctccgacggctcggcgcaggtcaacctggtgttcgccaccggtaccaatccggataccgcgcaggtgcaggtgcagaaccagctgcaggccgccatggccacgctgccgcaggcggtgcagcagaacggcctgaccatcaccaagtccagtggttcgatcttcgaggtgctgtcgttcaccagcgaagacggcagcatggacaacttcgatgtcgccaacttcatggaagcgcgcatcgatgaccagatcagccgcgtcagcggtgtcggcaacatccagccgatcggccaggaatacgccatgcgcatctggctggatccggagaagatgcgccagtacgcgctgatgccctgggacatcgagaccgcattgcaggcacagaacaccgatgtctccgccggtgagctgggtggccagccggcgctgaagggccagcagctcgacgccacggtaaccgcgcgcagccgcctgcacacgcccgagcagttcgcgcaggtggtgctcaaggccgatgccaacggcagcgtggtgcgtctgggcgacgtggcaaagatcggcctcgggccggaaagctacgacagcatcagcaccttcaatggcaagccgtcggcgtcgctgggcattgaactcaatgccggtgccaacgcgatcgccgtctccaaggccatcgatgcacggcttcagcagctgcagaagtactggccgcatggctacaccgcccacgtggccttcaccaccaccccattcgtgaccatttcgctgaaggaagtggtgatcaccctgatcgaagcgatcatcctggtggtgctggtgatgtacctgttcctgcagaactggcgcgccacgctgatcccgaccatcgcggtgccggtggtgctgctgggcacgttcggcgtgctggctgcattcgggtattcgatcaacaccctgaccatgttcgcactggtgctggccatcggcctgctggtggacgatgccatcgtggtggtggagaacgtagagcgggtgatgaccttcgaagggctggcgccgaagccggccacgctgaaggcgatgggccagatcaccggcgcgctggtcggcatcgtgctggtgctgaccgcggtgttcctgccgatggcgttcttcagcggtgtaaccggggtgatctatcgccagttctcggtgacgatcgccgccgcgatgatcctgtcggtgctggtggcgatgaccatcaccccggcactgtgtggcagcatcctgcaccagattcccaagggcggccatccgcatggcgaccacggtggcgagccgagcctgctgggcaagttcttcatctggttcaaccaccgcttcgagcgcacctccaacggcctgcgccatcgcgtggatcgtttcctcggccgccgcacgctcggcgtgctgttctacctggtgctgagcgtggccaccggcctgttgctgtggcacctgccgggcgcgttcctgcccgatgaagaccagggcatgctcaacgcgctggtgaagctgccggccggttccacgctggagcagacgcgggcggtgatggatcgtctgagtgccgtcgcggtgaaggacgacggcgtgctctcgatccaggccaccgccggtttcagtgttaccggcagcggccagaacgtcggccaggccttcatccggctgaaggactgggatgaccgcaaggacgacgccgataccatcgccgcacgcttgacgcgggcgatggccagcgtgcccgatgcgcaggtgttcatcacctcgccaccggccatcctgggcctcggcgatgcgggtggcttcaccctggaactgcaggacgaaggcggtgcaggccatgccgccgccgtggccgcgcgcaacacgctgctgaaggaagccgccaaggacccgaagctggtcaacgtgcgctacgccagcctggaagacgcgccggtatacgcggtgaaggtggacgacgccaaggcgcaggcgatgggcgtgaacccgcaggacgtcaatgacaccttgaacgcggcgttgggcggcgacttcgtcaacaacttcatctacaaggggcgcatcaagaaggtgttcatccagggcaccgccgaagcacgcatgcagccgcaggacatcgagcgctggagcgtgcgcaaccaggccgggcagatggtgccgctgtcgtcgttgatcagcacgcattggaccagcgcgccggccgcagtgcagcgctacaacggcatctcggcgatggaaatcaccggccagccggcaccgggcgtcagctccggcgaggcgatggccgagatcgcgcgcctggccgacacgctgccggaaggcttcagccatgcctggtcggacatggcctaccaggaacagctgtcgggcaaccaggcgccgatgctgtacgccatctcgctgctgttcgtgttcctgtgcctggccgcgctgtatgaaagctgggcggtgccgttcgcggtgatgctggcggtgccggtgggcatgttcggcgccgtgctgatgatgaacctgcgtggcctcaacaacgacgtgtacttccaggtcggcctgctgaccacgattggtctggcagcgaagaacggcatcctgatcgtcgagttcgcgcgcatcctcgaacagcagggcaagagcacccgcgaagcgatcctgcaggcggtctacctgcggctgcggccgatcgtaatgacctcgctggcgttcctgatgggcgtactgccgctggtgttcgccaccggcgccggttcggctgcgcgccgttcgctgggtaccggcgtggccggtggtacggttgcctcgatggtgctgggcatgttcttcgtgccgttgttctacctgctggtgcgccgcctgttcccgggccgcgcgccggccgacgccactgtcccggagacaagcccatga

SEQ ID NO: 74643 - protein, 1049 aa, Xanthomonas maltophilia
MVRFFIDRPIFAWVIAIAVSLLGLLAILILPVDRYPQIAPPTITIRATYTGASSQTVENAVTQVIEQSQQSLDHLMYMTSTSASDGSAQVNLVFATGTNPDTAQVQVQNQLQAAMATLPQAVQQNGLTITKSSGSIFEVLSFTSEDGSMDNFDVANFMEARIDDQISRVSGVGNIQPIGQEYAMRIWLDPEKMRQYALMPWDIETALQAQNTDVSAGELGGQPALKGQQLDATVTARSRLHTPEQFAQVVLKADANGSVVRLGDVAKIGLGPESYDSISTFNGKPSASLGIELNAGANAIAVSKAIDARLQQLQKYWPHGYTAHVAFTTTPFVTISLKEVVITLIEAIILVVLVMYLFLQNWRATLIPTIAVPVVLLGTFGVLAAFGYSINTLTMFALVLAIGLLVDDAIVVVENVERVMTFEGLAPKPATLKAMGQITGALVGIVLVLTAVFLPMAFFSGVTGVIYRQFSVTIAAAMILSVLVAMTITPALCGSILHQIPKGGHPHGDHGGEPSLLGKFFIWFNHRFERTSNGLRHRVDRFLGRRTLGVLFYLVLSVATGLLLWHLPGAFLPDEDQGMLNALVKLPAGSTLEQTRAVMDRLSAVAVKDDGVLSIQATAGFSVTGSGQNVGQAFIRLKDWDDRKDDADTIAARLTRAMASVPDAQVFITSPPAILGLGDAGGFTLELQDEGGAGHAAAVAARNTLLKEAAKDPKLVNVRYASLEDAPVYAVKVDDAKAQAMGVNPQDVNDTLNAALGGDFVNNFIYKGRIKKVFIQGTAEARMQPQDIERWSVRNQAGQMVPLSSLISTHWTSAPAAVQRYNGISAMEITGQPAPGVSSGEAMAEIARLADTLPEGFSHAWSDMAYQEQLSGNQAPMLYAISLLFVFLCLAALYESWAVPFAVMLAVPVGMFGAVLMMNLRGLNNDVYFQVGLLTTIGLAAKNGILIVEFARILEQQGKSTREAILQAVYLRLRPIVMTSLAFLMGVLPLVFATGAGSAARRSLGTGVAGGTVASMVLGMFFVPLFYLLVRRLFPGRAPADATVPETSP

SEQ ID NO: 74644 - DNA, 3141 bp, Pseudomonas aeruginosa
  CDS (1)..(3141): transl_table=11
atggctcgtttcttcattgaccggccggtcttcgcctgggtgatctccctgctgatcgtgctcgccggggtcctggcgatccgcttcctgccggtcgcccagtacccggacatcgcgccgccggtggtcaacgtcagcgccacgtatcccggcgcctcggccaaggtggtcgaggaagcggtgaccgcgatcatcgagcgcgagatgaacggcgcgcccggcctgctctacaccaaggccaccagcagcaccggccaggcctcgctgaccctgaccttccgccagggcgtgaacgcgaacctcgccgcggtggaagtgcagaaccgcctgaagatcgtcgagtcgcgcctgcccgaatcggtgcggcgcgacggcatctacgtggagaaggcggcggacagcatccagctgatcgttacccttacctcctccagcggccgctacgacgccatggagctgggcgagatcgcctcgtccaacgtgttgcaggcgctgcgccgggtggagggcgtgggcaaggtcgagacctggggcgccgagtacgccatgcgcatctggcccgacccggccaagctgacctcgatgaacctcagcgccagcgacctggtcaacgccgtgcgccggcacaacgcccgcctcaccgtgggcgacatcggcaacctcggggtccccgactcggcgccgatcagcgccacggtgaaggtcgacgacaccctggtgacgcccgagcagttcggcgaaattccgctggcgcatccgcgcgacggcggcgcgatccgcctgcgcgacgtggcccgcgtcgagttcggccagagcgagtacggcttcgtctcgcgggtcaaccaaatgaccgccaccggcctggcggtgaagatggcgcccggctccaacgcggtggccaccgccaagcgcatccgcgccaccctcgacgagctgtcgcgctacttcccggagggcgtgagctacaacatcccctatgacacctcggcgttcgtcgagatctcgatcaggaaggtggtcagcaccctgctcgaggcgatgctgctggtgttcgccgtgatgtacctgttcatgcagaacttccgcgccaccctgatcccgacactggtggtgccggtggccctgctgggcaccttcacggtgatgctcggcctgggcttctcgatcaacgtgctgaccatgttcggcatggtcctggcgatcggcatcctggtggacgacgcgatcatcgtggtggagaacgtcgagcggctgatggccgaggaaggcctgtcgccgcacgacgccacggtcaaggcgatgcgccagatcagcggggccatcgtcggcatcaccgtagtgctggtctcggtgttcgtgccgatggcgttcttcagcggcgcggtgggcaacatctaccgccagttcgcggtgaccctggcggtctccatcggcttctcggcgttcctcgcgctgtcgctgaccccggccctgtgcgccaccctgctgcgcccgatcgacgccgaccaccacgagaagcgcggcttcttcggctggttcaaccgcgccttcctgcgcctgaccggacgctaccgcaacgcggtggccggcatcctcgcccggccgatccgctggatgctggtctacaccctggtcatcggcgtggtcgccctgctcttcgtgcgcctgccgcaggcgttcctgccggaagaggaccagggcgacttcatgatcatggtgatgcagcccgaaggcacgccgatggcggagaccatggccaacgtcggcgacgtcgagcgctacctggcggagcacgaaccggtggcctacgcctatgcggtcggcggcttcagcctgtacggcgacggcaccagctcggcgatgatcttcgccaccctgaaggactggtcggaacgccgggaggccagccagcacgtcggcgccatcgtcgagcgcatcaaccagcgcttcgccggcctgcccaaccgtacggtgtatgcgatgaactcgccgccgctgccggacctgggttccaccagcggcttcgacttccgcctgcaggaccgtggcggggttggctacgaggccctggtcaaggcccgcgaccagttgctggcgcgcgccgccgaggacccgcgcctggccaacgtgatgttcgccggccagggcgaggcgccgcagatccgcctggacatcgaccggcgcaaggcggagacccttggcgtgagcatggacgagatcaacaccaccctggcggtgatgttcggctcggactacatcggcgacttcatgcacggcagccaggtgcgcaaggtggtggtccaggccgaccggcgcaagcgcctgggcatcgacgacatcggccggcttcacgtgcgcaacgagcagggcgagatgggtgccgctggcgacgttcgccaaggccgcctggaccctcggcccgccgcaactgacccgctacaacggctatccctcgttcaacctcgagggccaggccgcgccgggctacagcagcgcgaagccatgcaggcgatggagcaattgatgcagggaactgcccgaggcattcgcccacgagtggtccggccagtccttcgaagaacgcctgttgccggcgcccaggcgccggcgctgttcgccctctcggtgttgatcgtgttcctcgccctggccgccctctacgaaagctggtcgatcccgctggcggtgatcctggtggtgccgctgggcgtactcggcgcactgctcggggtgagcctgcgcggtctgcccaacgacatctacttcaaggtcggcctgatcaccatcatcggcctctcggcgaagaacgccatcctcatcatcgaggtggccaaggaccattaccaggaaggcatgagcctgctgcaggcgaccctggaggccgcgcgcctgcgcctgcgaccgatcgtcatgacctcgctggcgttcggtttcggcgtggtcccgctggcgctctccagcggcgccggtatccgcgcccaggtcgccatcggcaccggggtgctcggcgggatcgtcaccgccacggtactcgcggtgttcctggtaccgctgttcttcctggtggtcgggcgcctgttccggttgcgcaaggcgccgcgcaccggcaactcgccccagatccccacggagcaagcctga

SEQ ID NO: 74645 - protein, 1046 aa, Pseudomonas aeruginosa
MARFFIDRPVFAWVISLLIVLAGVLAIRFLPVAQYPDIAPPVVNVSATYPGASAKVVEEAVTAIIEREMNGAPGLLYTKATSSTGQASLTLTFRQGVNANLAAVEVQNRLKIVESRLPESVRRDGIYVEKAADSIQLIVTLTSSSGRYDAMELGEIASSNVLQALRRVEGVGKVETWGAEYAMRIWPDPAKLTSMNLSASDLVNAVRRHNARLTVGDIGNLGVPDSAPISATVKVDDTLVTPEQFGEIPLAHPRDGGAIRLRDVARVEFGQSEYGFVSRVNQMTATGLAVKMAPGSNAVATAKRIRATLDELSRYFPEGVSYNIPYDTSAFVEISIRKVVSTLLEAMLLVFAVMYLFMQNFRATLIPTLVVPVALLGTFTVMLGLGFSINVLTMFGMVLAIGILVDDAIIVVENVERLMAEEGLSPHDATVKAMRQISGAIVGITVVLVSVFVPMAFFSGAVGNIYRQFAVTLAVSIGFSAFLALSLTPALCATLLRPIDADHHEKRGFFGWFNRAFLRLTGRYRNAVAGILARPIRWMLVYTLVIGVVALLFVRLPQAFLPEEDQGDFMIMVMQPEGTPMAETMANVGDVERYLAEHEPVAYAYAVGGFSLYGDGTSSAMIFATLKDWSERREASQHVGAIVERINQRFAGLPNRTVYAMNSPPLPDLGSTSGFDFRLQDRGGVGYEALVKARDQLLARAAEDPRLANVMFAGQGEAPQIRLDIDRRKAETLGVSMDEINTTLAVMFGSDYIGDFMHGSQVRKVVVQADRRKRLGIDDIGRLHVRNEQGEMGAAGDVRQGRLDPRPAATDPLQRLSLVQPRGPGRAGLQQREAMQAMEQLMQGTARGIRPRVVRPVLRRTPVAGAQAPALFALSVLIVFLALAALYESWSIPLAVILVVPLGVLGALLGVSLRGLPNDIYFKVGLITIIGLSAKNAILIIEVAKDHYQEGMSLLQATLEAARLRLRPIVMTSLAFGFGVVPLALSSGAGIRAQVAIGTGVLGGIVTATVLAVFLVPLFFLVVGRLFRLRKAPRTGNSPQIPTEQA

SEQ ID NO: 74646 - DNA, 3114 bp, Escherichia coli
  CDS (1)..(3114): transl_table=11
atggcgaatttctttattgatcgccccatttttgcctgggtgctggcaatcctgttgtgtctgacaggtaccctggcgattttttcattgcccgttgaacaataccccgatctcgcgccaccgaatgtgcgagtgaccgctaactatcccggcgcatcggcccagacgctggaaaacaccgtgacccaggttatcgagcaaaatatgaccggcctcgataatctcatgtatatgtcatctcagagcagtggcaccggtcaggcatctgtcactttaagttttaaagcaggcaccgatccggacgaagccgtgcagcaagtacaaaaccagctgcaatcagccatgcgaaagttaccgcaggcggtgcaaaatcagggcgtgacggtgcgtaaaaccggcgataccaacattctgaccattgccttcgtctctaccgatggttcgatggataaacaggatattgctgattatgttgccagtaatattcaggacccgttaagccgcgtgaatggcgtcggggatatcgatgcctatggttcgcaatattccatgcgtatctggctggacccggcgaaactcaacagtttccagatgacggctaaagatgtcactgatgccattgagtcacagaacgcgcagattgcggttgggcaacttggtggtacaccttccgtcgataagcaggcgctcaacgccaccattaacgcccagtcactgctgcaaacaccagaacagttccgcgatatcaccttgcgggtcaatcaggacggctcagaggtaaggctgggcgatgtcgccaccgtcgaaatgggggcggagaaatacgattatcttagccgcttcaatggtaagccagcctccgggctgggggtaaaactggcctccggcgctaacgaaatggcgacagcggagctggtgctcaatcgtctcgacgagctggcgcagtatttcccgcatggactggaatacaaggtggcgtatgaaaccacctcgtttgttaaagcctccattgaagacgtggtgaaaacgctgctggaagctatcgctctggttttcctcgttatgtatctgttcctgcaaaacttccgcgccacgctgatacccactatcgccgtgccggtggtgttgatgggaaccttctccgtactttacgccttcggttacagcgtcaacaccttaaccatgttcgcgatggtgctggcgatcggtctgctggtggatgacgccatcgtggtggtggaaaacgtcgaacgtattatgagtgaggaaggactcactcctcgcgaagccacacgtaaatcgatggggcagatccagggggcactggtcgggattgcgatggttctttcggcggtatttgtaccaatggccttcttcggcggcaccaccggtgccatctatcgccagttctctattaccattgttgcggcgatggtgctgtcagtactggtagcgatgatcctcactccggctctgtgtgccacactacttaagccactgaaaaaaggtgagcatcatgggcaaaaaggcttttttgcctggtttaaccagatgtttaaccgcaacgccgaacgctacgaaaaaggggtggcgaaaattctccaccgtagcctgcgctggattgtgatttatgtcctgctgcttggcggcatggtgttcctgttcctgcgtttgccgacgtcgttcttaccgctggaagaccgtggcatgtttactacctcggtacagttgcccagcggttcaacgcaacaacagaccctgaaagtcgttgagcaaatcgagaaatactacttcacccatgaaaaagacaacatcatgtcggtgtttgccaccgttggttctggccctgggggtaacgggcaaaacgtggcgcgaatgtttatccgcctgaaagactggagcgaacgcgacagtaagaccggcacctcgtttgccattatcgagcgtgcaacgaaggcgtttaaccaaattaaagaagctcgcgttatcgccagcagcccgccagcaattagcggtcttggtagttctgcaggttttgatatggagttgcaggaccacgctggagcgggtcacgatgcgctgatggcagcacgtaatcagttgctggcgctggcggcggaaaacccggagctaacccgtgtgcgccataacggcctcgacgacagtccgcagttgcagattgatatcgaccagcgtaaagctcaggcgctgggcgttgctatcgacgatattaacgacacactgcaaaccgcctggggttcgagctatgtgaatgactttatggatcgcggtcgcgtgaagaaagtctatgtgcaggcagctgcgccgtatcgcatgctgccagatgacatcaatctctggtatgtccgaaataaagatggcggcatggtgcccttctctgctttcgcgacctcacgctgggaaacaggctcgccgcgtctggaacgctataacggttattctgcggttgagattgttggggaagccgcaccgggggtcagtaccggtacggcgatggatattatggaatcgttagtgaagcagctgccaaacggctttggtctggagtggacggcgatgtcgtatcaggagcggctttccggcgcgcaggctccggcgctgtacgccatttccttgctggtggtattcctgtgtctggctgcgttgtatgaaagctggtcggtgccgttctcggtaatgctggtcgtgccgctgggggtaatcggcgcgctgctggcaacctggatgcgcgggctggaaaacgacgtttacttccaggtgggcctgttaacggtcattggtttatcggcgaaaaacgccatcctgatcgtcgagtttgctaacgagatgaaccaaaaaggccacgacctgtttgaagcgacgctccacgcctgccgtcagcgtttacgcccgattctgatgacctcgctggcatttatcttcggcgtattgccaatggcaaccagcacgggtgccggttccggtggtcagcatgcggtgggtactggcgtaatgggcgggatgatttcggccactattctggctatttacttcgtgccgctgttctttgtgctggtgcgccgccgcttcccgctgaagccgcgcccggaataa

SEQ ID NO: 74647 - protein, 1037 aa, Escherichia coli
MANFFIDRPIFAWVLAILLCLTGTLAIFSLPVEQYPDLAPPNVRVTANYPGASAQTLENTVTQVIEQNMTGLDNLMYMSSQSSGTGQASVTLSFKAGTDPDEAVQQVQNQLQSAMRKLPQAVQNQGVTVRKTGDTNILTIAFVSTDGSMDKQDIADYVASNIQDPLSRVNGVGDIDAYGSQYSMRIWLDPAKLNSFQMTAKDVTDAIESQNAQIAVGQLGGTPSVDKQALNATINAQSLLQTPEQFRDITLRVNQDGSEVRLGDVATVEMGAEKYDYLSRFNGKPASGLGVKLASGANEMATAELVLNRLDELAQYFPHGLEYKVAYETTSFVKASIEDVVKTLLEAIALVFLVMYLFLQNFRATLIPTIAVPVVLMGTFSVLYAFGYSVNTLTMFAMVLAIGLLVDDAIVVVENVERIMSEEGLTPREATRKSMGQIQGALVGIAMVLSAVFVPMAFFGGTTGAIYRQFSITIVAAMVLSVLVAMILTPALCATLLKPLKKGEHHGQKGFFAWFNQMFNRNAERYEKGVAKILHRSLRWIVIYVLLLGGMVFLFLRLPTSFLPLEDRGMFTTSVQLPSGSTQQQTLKVVEQIEKYYFTHEKDNIMSVFATVGSGPGGNGQNVARMFIRLKDWSERDSKTGTSFAIIERATKAFNQIKEARVIASSPPAISGLGSSAGFDMELQDHAGAGHDALMAARNQLLALAAENPELTRVRHNGLDDSPQLQIDIDQRKAQALGVAIDDINDTLQTAWGSSYVNDFMDRGRVKKVYVQAAAPYRMLPDDINLWYVRNKDGGMVPFSAFATSRWETGSPRLERYNGYSAVEIVGEAAPGVSTGTAMDIMESLVKQLPNGFGLEWTAMSYQERLSGAQAPALYAISLLVVFLCLAALYESWSVPFSVMLVVPLGVIGALLATWMRGLENDVYFQVGLLTVIGLSAKNAILIVEFANEMNQKGHDLFEATLHACRQRLRPILMTSLAFIFGVLPMATSTGAGSGGQHAVGTGVMGGMISATILAIYFVPLFFVLVRRRFPLKPRPE

SEQ ID NO: 74648 - DNA, 3105 bp, Escherichia coli
  CDS (1)..(3105): transl_table=11
atggcaaacttttttattcgacgaccgatatttgcatgggtgctggccattattctgatgatggcgggcgcactggcgatcctacaattgcccgtcgctcagtatccaacaattgcaccgcctgcggtttctgtttcagcaaactatccgggcgctgatgcgcagaccgtgcaggatacggtgacgcaggttatcgaacagaatatgaacggtatcgataacctgatgtatatgtcctccaccagcgattccgccggtagcgtgacaattacccttaccttccagtccgggaccgatcctgatatcgcgcaagtgcaggtgcagaacaaactccagctcgccacgccgttgctgccgcaggaggttcagcagcaggggatcagtgttgaaaagtccagtagcagctatttgatggtggcgggctttgtctctgataacccaggcaccacacaggacgatatctcggactatgtggcctctaacgttaaagatacgcttagccgtctgaatggcgtcggtgacgtacagcttttcggcgcacagtatgcgatgcgtatctggctggatgccgatctgctaaacaaatataaactgacaccggttgatgtgattaaccagttgaaggtacagaacgatcagatcgctgccggacagttgggcggaacgccagcgttaccagggcaacaattgaacgcctcgattattgctcagacgcggtttaaaaatccggaagaattcggcaaagtgaccctgcgcgtaaacagtgacggctcggtggtacgcctgaaagatgtcgcacgggttgaacttggcggtgaaaactataacgttatcgctcgtatcaacggaaaaccggcggcgggcctggggattaagctggcaaccggcgcgaatgctctcgataccgcgaaagccattaaggcaaaactggcggaattacagccattcttcccgcagggaatgaaggttctctacccttatgacaccacgccattcgtccagctttctattcacgaagtggtaaaaacgctgttcgaagccattatgctggtgttcctggtgatgtatctgttcttgcagaatatgcgagcaacgctgatccccaccattgcggtacccgtggtgttgttagggacgtttgccatcctcgccgcttttggttactccatcaacacactaacgatgttcgggatggtgcttgccatcgggctgctcgtcgatgatgcgatagtggtggtggagaacgtcgagcgcgtgatgatggaggataagctcccgccaaaagaagcgacggaaaaatcgatgtcgcaaattcagggcgcactggtgggtatcgcgatggtgctgtcagcggtatttattccgatggcattcttcggcggttctactggggcaatttatcgccagttctctatcaccatcgtttcggcaatggcgctttctgttctggtggcattgattcttacccctgcgttatgtgcaacgctgcttaaacccgtctctgctgagcatcacgaaaataagggcggtttcttcggttggtttaataccaccttcgatcatagcgttaaccactacaccaacagcgtcggcaaaatcctcggatccacaggacgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagttacggattactatctgaagaacgagaaagcgaacgttgaaagtgtctttacggttaacggctttagcttcagcggccaggcacaaaacgccggtatggccttcgtcagtctgaaaccgtgggaagagcgtaatggtgacgaaaacagtgcggaagcggtaatccatcgtgccaaaatggaattgggcaagatccgcgacggttttgtcattccattcaatatgccagccattgttgaactgggcacggcaacgggtttcgactttgagttaattgatcaggctgggctgggtcacgatgccctaacccaggcccgtaaccagttgcttggtatggcggcgcaacatcctgccagcttagtcagcgtgcgccctaatggcctggaagacaccgcgcagtttaaactggaagttgaccaggaaaaggcgcaggcattaggtgtttcactttctgacatcaatcagaccatttcaacggcgctgggtgggacttacgttaacgacttcatcgaccgtggccgcgtgaaaaagttgtatgttcaggcggatgccaaattccgtatgctgccagaagatgtcgataaactttatgtccgcagcgccaacggcgaaatggtgccattctcggcctttaccacttcacattgggtgtatggctctccgcgactggaacgctacaacggtctgccgtcaatggagattcagggggaagccgcgccaggaaccagttccggcgatgccatggcgttgatggaaaaccttgcgtcaaaattacctgcgggcattggttatgactggacgggtatgtcgtatcaggaacgcttatcgggaaaccaggctcccgctctggtagcaatttcctttgtggttgttttcctgtgccttgctgcactctatgaaagctggtcaattcctgtctcggttatgttggtagtgccgttagggattgtcggcgtgctgctggcggcgacactctttaatcaaaaaaatgacgtctactttatggtgggcttgctaacgacaattggcttgtcggccaaaaacgctattttgatcgttgagttcgctaaagatctcatggagaaagagggtaaaggtgttgttgaagcgacactgatggcagtacgtatgcgtctgcgtcctatcctgatgacctctctcgcctttattctcggcgtattaccgctagctatcagtaacggtgccggcagtggcgcgcagaacgctgtgggtatcggggtaatgggaggaatggtctctgcaacgttgctggcaatcttcttcgtaccggtgttctttgtggtgatccgccgttgctttaaaggataa

SEQ ID NO: 74649 - protein, 1034 aa, Escherichia coli
MANFFIRRPIFAWVLAIILMMAGALAILQLPVAQYPTIAPPAVSVSANYPGADAQTVQDTVTQVIEQNMNGIDNLMYMSSTSDSAGSVTITLTFQSGTDPDIAQVQVQNKLQLATPLLPQEVQQQGISVEKSSSSYLMVAGFVSDNPGTTQDDISDYVASNVKDTLSRLNGVGDVQLFGAQYAMRIWLDADLLNKYKLTPVDVINQLKVQNDQIAAGQLGGTPALPGQQLNASIIAQTRFKNPEEFGKVTLRVNSDGSVVRLKDVARVELGGENYNVIARINGKPAAGLGIKLATGANALDTAKAIKAKLAELQPFFPQGMKVLYPYDTTPFVQLSIHEVVKTLFEAIMLVFLVMYLFLQNMRATLIPTIAVPVVLLGTFAILAAFGYSINTLTMFGMVLAIGLLVDDAIVVVENVERVMMEDKLPPKEATEKSMSQIQGALVGIAMVLSAVFIPMAFFGGSTGAIYRQFSITIVSAMALSVLVALILTPALCATLLKPVSAEHHENKGGFFGWFNTTFDHSVNHYTNSVGKILGSTGRYLLIYALIVAGMVVLFLRLPSSFLPEEDQGVFLTMIQLPAGATQERTQKVLDQVTDYYLKNEKANVESVFTVNGFSFSGQAQNAGMAFVSLKPWEERNGDENSAEAVIHRAKMELGKIRDGFVIPFNMPAIVELGTATGFDFELIDQAGLGHDALTQARNQLLGMAAQHPASLVSVRPNGLEDTAQFKLEVDQEKAQALGVSLSDINQTISTALGGTYVNDFIDRGRVKKLYVQADAKFRMLPEDVDKLYVRSANGEMVPFSAFTTSHWVYGSPRLERYNGLPSMEIQGEAAPGTSSGDAMALMENLASKLPAGIGYDWTGMSYQERLSGNQAPALVAISFVVVFLCLAALYESWSIPVSVMLVVPLGIVGVLLAATLFNQKNDVYFMVGLLTTIGLSAKNAILIVEFAKDLMEKEGKGVVEATLMAVRMRLRPILMTSLAFILGVLPLAISNGAGSGAQNAVGIGVMGGMVSATLLAIFFVPVFFVVIRRCFKG

SEQ ID NO: 74650 - DNA, 3123 bp, Escherichia coli
  CDS (1)..(3123): transl_table=11
atgcaggtgttacccccgagcagcacaggcggcccgtcgcgcctgtttattatgcgtcctgtggccaccacgctgctgatggtggcgatcttactcgccgggattatcggttatcgcgccctgcccgtttcggcgctgccggaagtggactatccgaccattcaggtggtcacgctctacccaggtgccagcccggatgtcatgacctctgccgttaccgcgccgctagaacgccagttcgggcagatgtctggcctgaaacagatgtcgtcgcaaagttccggcggtgcgtcagttatcactttgcagttccagctaacattaccgctcgatgtcgccgagcaggaagtgcaggccgcgattaacgctgcgaccaacttgttgccgagcgatctgcctaacccgccggtttacagcaaagtgaacccggcagatccgccgatcatgacgctcgccgtcacctcaaccgccatgccgatgacgcaagtggaagatatggtggaaacccgcgtcgcgcagaaaatctcgcagatttccggcgtcggcctggtgacgctttccggcggtcagcgtccggctgttcgcgtcaaacttaacgctcaggcgattgccgccctcggcctgaccagcgaaaccgtgcgcaccgccattaccggcgctaacgttaactcggcaaaaggtagcctcgacggcccttcccgtgcggtcacgctttccgcgaacgaccagatgcaatccgccgaagagtatcgccagctaatcatcgcctaccagaacggcgcgccaattcgtctgggcgatgtcgcaactgtagagcaaggtgcagaaaacagctggctcggcgcgtgggcgaacaaagaacaggccattgtgatgaatgttcagcgccagcccggtgctaacattatctccaccgccgacagcattcggcagatgctgccacagctcactgagagtctgccgaaatcggtgaaggtgacagtgctttccgatcgcaccaccaatatccgcgcatccgtcgatgatactcagtttgaattgatgatggctatcgcgctggtagtcatgattatctacctgtttttgcgcaatattccggcgaccatcattcccggtgttgctgtaccgctgtcgttaatcggcactttcgcggttatggtgtttctcgatttttcaatcaataacctgacactgatggcgttaactatcgccaccggattcgtggtcgatgacgccatcgtggtgatcgaaaacatttcccgctatatcgaaaaaggcgaaaaaccgttggcggcggcgctcaagggcgcaggtgaaatcggctttaccattatctcgctgaccttctcactgattgcggtgttgatcccactgctgtttatgggcgatatcgtcgggcgactgttccgcgaatttgctattaccctggcggtagcgattttgatctcagcggtggtgtcgctgaccctgacaccgatgatgtgcgcgcggatgctcagccaggagtcgttgcgtaaacagaaccgcttctcccgtgcctcggaaaaaatgttcgacaggataatcgccgcctatggtcgtggactggcgaaagtgctgaatcatccgtggctgaccttaagcgtggcactcagcacgctgctgcttagcgtgctgctgtgggtgttcattccgaaaggtttcttcccggtacaggacaatggcattattcagggcactttgcaggcaccgcaatccagctcctttgccaatatggcccagcgacaacgccaggtcgcggacgtgattttgcaggatccggcagtgcaaagcctgacctcatttgttggcgttgatggcactaacccgtcgctgaacagtgcacgtttacaaatcaacctcaaaccgttggatgaacgtgatgatcgggtgcaaaaagtcatcgcccgtctgcaaacggcggtagataaagtgccgggcgtcgatctcttcctgcaaccaacgcaggatctgactattgatactcaggtcagccgcacccagtaccagtttaccttgcaggccacgtcactggatgcgctcagtacctgggtgccacagttgatggaaaaactccagcaactgccacagctttctgatgtctccagcgactggcaggacaaagggctggtggcgtatgtcaatgttgatcgcgacagcgccagccgtctggggatcagcatggcggatgtcgataacgccctgtacaacgcgtttggtcagcggctgatttccactatttatactcaggccaaccagtatcgcgtggtgctggagcacaacaccgaaaataccccaggcctcgcggcgctggataccattcgcctgaccagcagcgacggcggcgtggtgccgctaagctcaattgccaaaattgagcagcgttttgcgccgctctccatcaaccatctggatcagttcccggtaacgaccatctcctttaacgtgccggataactattcgctgggcgatgcggtgcaggcgattatggacaccgaaaagacgctgaatctgccggtggatatcaccacgcagttccagggcagcaccctcgccttccagtcggcgctgggcagcactgtctggctgattgtcgcggcggtggtggcgatgtatatcgtgctcggcattctgtacgagagctttattcacccgatcaccattctctcgacgctacccaccgcaggggttggcgcactgctggcgttgctgattgctggtagcgaactggatgtgattgcgattatcggcattattttgctgatcggtatcgtgaagaagaacgccatcatgatgatcgacttcgcgctggctgctgagcgcgagcaaggcatgtcgccgcgcgaggcaatctaccaggcttgtctgttgcgttttcgtccgatcctgatgaccactctggcggctctgcttggcgcgctgccgctgatgttgagtaccggggtcggcgcggaactgcgtcgtccgttaggtatcggcatggtcggcggtctgattgtcagccaggtgctgacgctgtttaccacgccggtgatttatttgctgttcgaccgcctggcattgtggaccaaaagccgctttgcccgtcatgaagaggaggcgtaa

SEQ ID NO: 74651 - protein, 1040 aa, Escherichia coli
MQVLPPSSTGGPSRLFIMRPVATTLLMVAILLAGIIGYRALPVSALPEVDYPTIQVVTLYPGASPDVMTSAVTAPLERQFGQMSGLKQMSSQSSGGASVITLQFQLTLPLDVAEQEVQAAINAATNLLPSDLPNPPVYSKVNPADPPIMTLAVTSTAMPMTQVEDMVETRVAQKISQISGVGLVTLSGGQRPAVRVKLNAQAIAALGLTSETVRTAITGANVNSAKGSLDGPSRAVTLSANDQMQSAEEYRQLIIAYQNGAPIRLGDVATVEQGAENSWLGAWANKEQAIVMNVQRQPGANIISTADSIRQMLPQLTESLPKSVKVTVLSDRTTNIRASVDDTQFELMMAIALVVMIIYLFLRNIPATIIPGVAVPLSLIGTFAVMVFLDFSINNLTLMALTIATGFVVDDAIVVIENISRYIEKGEKPLAAALKGAGEIGFTIISLTFSLIAVLIPLLFMGDIVGRLFREFAITLAVAILISAVVSLTLTPMMCARMLSQESLRKQNRFSRASEKMFDRIIAAYGRGLAKVLNHPWLTLSVALSTLLLSVLLWVFIPKGFFPVQDNGIIQGTLQAPQSSSFANMAQRQRQVADVILQDPAVQSLTSFVGVDGTNPSLNSARLQINLKPLDERDDRVQKVIARLQTAVDKVPGVDLFLQPTQDLTIDTQVSRTQYQFTLQATSLDALSTWVPQLMEKLQQLPQLSDVSSDWQDKGLVAYVNVDRDSASRLGISMADVDNALYNAFGQRLISTIYTQANQYRVVLEHNTENTPGLAALDTIRLTSSDGGVVPLSSIAKIEQRFAPLSINHLDQFPVTTISFNVPDNYSLGDAVQAIMDTEKTLNLPVDITTQFQGSTLAFQSALGSTVWLIVAAVVAMYIVLGILYESFIHPITILSTLPTAGVGALLALLIAGSELDVIAIIGIILLIGIVKKNAIMMIDFALAAEREQGMSPREAIYQACLLRFRPILMTTLAALLGALPLMLSTGVGAELRRPLGIGMVGGLIVSQVLTLFTTPVIYLLFDRLALWTKSRFARHEEEA

SEQ ID NO: 74652 - DNA, 3123 bp, Erwinia carotovora
  CDS (1)..(3123): transl_table=11
atgcaggataacgttccagccagcggcggcggaccgtctcgcctgtttattctgcgaccggtcgccaccacgctgctgatgatcgccattctattggccggtattatcggctatcgggcactgccggtttcagcactgcccgaggttgattatccgacgattcaggtcattactctgtatccgggggctagccccgacgtggtgacctcagcgattaccgcaccgctggagcggcaattcggccagatgtccgggctaaaacagatgtcgacgcagagcgcaggcggcgcatcagtcatcacgcttcagttccaacttgagctatcgctggacgtcgccgaacaggatgtgcaggccgctatcaacgcggcaagcaacctgctgccgaacgatctgccctacccaccgacctacagcaaagtgaatccggcggatccgccgattatgacgctggccgtcacctccagcgccatgtcgatgacgcaggtgcaggacatggtagacaatcgcatcgcgcagaaaatctcgcaggtggcgggtgtcgggttggtgtcattagccggtggacaacgccccgccgtgcgggtaaggctaaacgcgccagcgctggcggcttacggcctgaccagcgaaacaatccgcactgcgattaccgctgccaacgtgaattccgccaagggtagtctggatggtccgacacgttcggtaacgctctccgccaacgatcagatgaagtccgttgatgattatcgcaagctgattgtcgcgtggaagaatggcgcaccggtaaggcttcaggatgtcgccactattgagcaggccgccgagaatatttatcttggtgcctgggcgaaccggcagcaggcgatcattatcaacgttcagcgccagccgggtgccaacgtcattacgaccacggacagcattaacaagatgctgcctgcgttaaaagccagcctgccgaattccgttgaggtcgccacgctgaccgaccgcaccaccagcattcgcgcctcggtcaaagacgtccagttcgagctgctgctggctattgccctcgtcgtaatggtgatttatctgttcttgcgtaacgccgtcgccacgctaatcccaagcattgccgtaccgctgtcgctggttggcacctttgccgctatgtattttctcggtttttccatcaataacctgacgctgatggcgctcaccatcgccaccggtttcgtggtggatgatgccatcgtggtgattgaaaacatcgcccgctatatcgaaaaaggggaaaaaccgcttaacgcggcgctaaaaggcgcgggagaaattggctttaccattatttccctgacgttctccctcattgccgtcttgatcccactgctgtttatgggcgatatcgtcggacgcctgttccgcgagtttgccgtcacgctggcggtatctatcctgatttccgccgtcgtgtcgctcacgctcactccgatgatgtgcgcccggatgctaagtcatcagtcgctgcgtaaacagaaccgctttacccgcgccagcgagcgtttcttcacgcgcctgattgatacctacggcacgtggctgcgtaaagtactgaaccatccgtggctaacgctcagcgttgcactcggtacgctgctgctgaccatcctgctctatatctggatcccgaaaggcttcttcccgatacaggataacggcattatacagggcaccgtgcaggcaccgcagacggtctcgttcagcaatatggccgaccgccaacagcgcgttgcgtccattatcatgaaggatccgacggtggagagcgtgtcctcgttcatcggcgttgacggcaccaacgcggcgctgaacagtggtcgattgcaaatcaacctgaaaccgctcagtgaacgtagcgaacgcattccagagattatcagtcgcctgcaacagcaaaccgcacagattcccggtattcagctgtatctgcaaccggtgcaggatctcaccatcgacacccagattagccgcacgcaataccagtttacgttgcaggcgatgtcgctggacgaactcagcgtctgggtgccgaagctgatgaccgaattgaaaaagctgccgcagctagaggatgtcagcagcgactggcaagacggtgccgcagtcgcctatgtcaacgtcgatcgtgacagcgccagccgtctgggtatcacgatgtcgcaggttgacagcgcgctgtacaacgcctttggtcagcggttggtttccaccatctatacgcaggcaagccagtaccgcgtggtactggaacatgatacgaccaacaacacggggctggacgcgctaaacgatgtgcgcctcatcagcagcgacggtggtacgattccgctcagcagcattgccaccattgaagagcgtcaggggccactggcgatcaaccatatcgaccagttcccgtcgacgacgatctctttcaacgtcgccagcggctatgcactgggcgaagcggttgatgccatcactcaggccgagcagcagatgaatctacctgcggatatcaccacccgttttcagggcagcacgctggcgttccagtcggcgctgagcagcaccgtgtggctcatcgtcgcggcgattgtcgccatgtatatcgtgctcggcgtgctgtacgaaagctttatccatccgatcacgatcttgtctacgctgccaacggcgggggtcggcgcgctactggcactgatgatggcggggaaagatctggatgtgatcgccattatcgggatcatcttgctcatcgggatcgtgaagaagaacgccatcatgatgatcgacttcgcgctggcggcagagcgagaacagggtatgaaaccctatgacgccatttatcaggcttgtctgctgcgtttccggccgattttgatgaccacgatggccgcactgctaagtgcactgccgctgatgctcagtaccggcgttggcgctgagctacgccagccgctaggggtctgtatggtcggtggcctgatcatgagccagattctgacgctgtttaccacaccggtgatttacctgctgtttgaccgcttagcgacacgcttccgtcgtgtaccgcgtcaggaggaagaaaccgagtga

SEQ ID NO: 74653 - protein, 1040 aa, Erwinia carotovora
MQDNVPASGGGPSRLFILRPVATTLLMIAILLAGIIGYRALPVSALPEVDYPTIQVITLYPGASPDVVTSAITAPLERQFGQMSGLKQMSTQSAGGASVITLQFQLELSLDVAEQDVQAAINAASNLLPNDLPYPPTYSKVNPADPPIMTLAVTSSAMSMTQVQDMVDNRIAQKISQVAGVGLVSLAGGQRPAVRVRLNAPALAAYGLTSETIRTAITAANVNSAKGSLDGPTRSVTLSANDQMKSVDDYRKLIVAWKNGAPVRLQDVATIEQAAENIYLGAWANRQQAIIINVQRQPGANVITTTDSINKMLPALKASLPNSVEVATLTDRTTSIRASVKDVQFELLLAIALVVMVIYLFLRNAVATLIPSIAVPLSLVGTFAAMYFLGFSINNLTLMALTIATGFVVDDAIVVIENIARYIEKGEKPLNAALKGAGEIGFTIISLTFSLIAVLIPLLFMGDIVGRLFREFAVTLAVSILISAVVSLTLTPMMCARMLSHQSLRKQNRFTRASERFFTRLIDTYGTWLRKVLNHPWLTLSVALGTLLLTILLYIWIPKGFFPIQDNGIIQGTVQAPQTVSFSNMADRQQRVASIIMKDPTVESVSSFIGVDGTNAALNSGRLQINLKPLSERSERIPEIISRLQQQTAQIPGIQLYLQPVQDLTIDTQISRTQYQFTLQAMSLDELSVWVPKLMTELKKLPQLEDVSSDWQDGAAVAYVNVDRDSASRLGITMSQVDSALYNAFGQRLVSTIYTQASQYRVVLEHDTTNNTGLDALNDVRLISSDGGTIPLSSIATIEERQGPLAINHIDQFPSTTISFNVASGYALGEAVDAITQAEQQMNLPADITTRFQGSTLAFQSALSSTVWLIVAAIVAMYIVLGVLYESFIHPITILSTLPTAGVGALLALMMAGKDLDVIAIIGIILLIGIVKKNAIMMIDFALAAEREQGMKPYDAIYQACLLRFRPILMTTMAALLSALPLMLSTGVGAELRQPLGVCMVGGLIMSQILTLFTTPVIYLLFDRLATRFRRVPRQEEETE

SEQ ID NO: 74654 - DNA, 3111 bp, Photorhabdus luminescens
  CDS (1)..(3111): transl_table=11
gtgaaattttttgccttatttatccaacgccctgttgccaccacgctattgagtttagccataaccctatgtggggtattgggatttaccctgttgccggtttctcctttaccacaagtggattttccggtgatctcggtttacgcctcattaccgggcgcttcaccggaaacaatggcctcatctgtcgcgacgccattggagcacgccctaggccgaattgccggagtcaatgaaatgacctccagtagctcccttggtagtaccaatatcacgctcgaatttgatctcaatcgtgatattaacagtgcagcacgggatgtacaggcagcgctgaatgccgctcaaagtctgttgccttcaggtatgcctagccggccgcattattacaaagtcaacccgactgatgccccaatcatgatcctcacattgacttccgatacctataatcaggggcagctttatgattttgcctctactcaactggctcagaaaatcgcccaagttgaaggcgtcagtgaagtctctgttggcggcagttcattaccggcagtcagagttgaattgaatcctggcgtcctgtttcatcagggggtttcgctagatgcggtacgcaaagctatcagcaatgccaatgttcgccgcccacaaggatatgtggattccgagcagcaacactggcaaattcaaatgaatgatgagttaaaaacagccgaaaactatcgcccgatcatcgttcactacaacaacaattcaccggtgcgattgcaggatgtagcaaatgtaaaagattctgttcagaatgtcagagcagccggaatgtctggcggtgagccggctattttgttgatcattcgccgtgaggctggcgcgaatattatcgccacagtaaaccgtatccgtgaacaattacctgcattacatgaatctattcctgccagtattcaacttaaagttgctcaagaccgcacacccactattcgtgcttcaatagtggaagtagaacgagcattggtgattgctatcgggctggtcattctggtggtattcctgttcttgcgttctggtcgcgcaacattgatccctgccattgctgtaccggtttcactcattggcacctttaccgctatgtatctgtgcggtttcagtttgaacaatctttccttaatggcgctgacggttgccacaggatttgtggtagatgatgcgattgtggtactggagaatatttcccgccaccttgaagccggcataaaacccatgcaagcggccctacagggtgtccgggaagtgggttttacggtcctctcaatgagtatttcactggtagccgtctttatcccgcttctgctcatggatggattggttggtcggctgttccgtgaatttgccattaccctaaccacatcaatcagcatctcattattggtttctctaacactaacgccaatgatgtgcgctcatttactaaaatctcagcgtcccaaagcacagaagaaaatacgaggattcggtaaagttctactgaaaattcagcaagtttacgggcgctccctgatgtgggttcttaatcatagccgttgggtattgttaattttggccggcatcattgccctaaatgtttggctctatatcaatatccccaaaactttcttcccagagcaggataccggtcggttactagggtttgttcgggcagatcaaagtatctctttccagtctatgcgtgaaaaaatgaaaaacttcatgcagacaatcaatgcagatcctacggtagacagcgttatcggttttaccggtggtgggcgggtaaataatggctttatgtttatctctctaaagccattgaaagagcgttcagaaaacgctgaacagattatctcgcgcctgagaattaaacttgccaatgaaccgggagcaaatctatttctcattccggtacaagatatcagggctggcggtcgccaggctaatgccagctatcaattcacattgctggcagatgatctgaatgatcttcgcaaatgggagcctgttatccgtaaagcattagggcaattgccgcaactgactgacgtgaattcagataaggaggataaaggcgctgaaatggcaataatctatgaccgcgataccatgtctcgtctgggcattaatgtcagtgaagccaataatttgctgaataatgcttttggtcagcgacaaatatccaccatttatcaaccacttaatcagtacaaggtggtgatggaagttgcaccagaatatacacaggatgtcagcgcactggaaaaaatgtttgtgattaataatcaaggaaaagccattccgctctcctattttgctcactggcaaccggctaacgcgccgctaagtgtcaatcatcaagggctttctgctgcttcaaccattgctttcaatgtacccgaaggctataccctctctgatgctatcaatgcgattgaaagaaccacaaccgaacttagggtaccttcaacggttcgtggcacttttgcaggcaccgcccagatttttcaggaaaccctgaaatcacaattattcttgattctggcggccattattaccgtctatctggtgctagggatactgtatgaaagttatatccatccattgactattctctctaccctgccttccgccggtattggtgccctgctggcattagaactgtttgacacaccattcagcctgatagcattaatcggcatcatgttattgattggtatcgtgaaaaagaatgccattattatggtggactttgcgattgaagctcaacgtaacggtaatatctgcgcccgtgatgcgatattccaagccagcctattacgtttccgtccgattctgatgaccacactggccgccttgtttggttccctgccactggttttgagtagtggcgacggtacggaattacgccaacctttaggaatcaccattgtgggtggtttggttatgagccagcttttaacactatataccacaccggttgtctatctctgttttgatcgactaagagcctatcccaataggcgtaattgttgcaggcagtttgaacacggacagcgcggaaaaaccggaacgtacacgtag

SEQ ID NO: 74655 - protein, 1036 aa, Photorhabdus luminescens
MKFFALFIQRPVATTLLSLAITLCGVLGFTLLPVSPLPQVDFPVISVYASLPGASPETMASSVATPLEHALGRIAGVNEMTSSSSLGSTNITLEFDLNRDINSAARDVQAALNAAQSLLPSGMPSRPHYYKVNPTDAPIMILTLTSDTYNQGQLYDFASTQLAQKIAQVEGVSEVSVGGSSLPAVRVELNPGVLFHQGVSLDAVRKAISNANVRRPQGYVDSEQQHWQIQMNDELKTAENYRPIIVHYNNNSPVRLQDVANVKDSVQNVRAAGMSGGEPAILLIIRREAGANIIATVNRIREQLPALHESIPASIQLKVAQDRTPTIRASIVEVERALVIAIGLVILVVFLFLRSGRATLIPAIAVPVSLIGTFTAMYLCGFSLNNLSLMALTVATGFVVDDAIVVLENISRHLEAGIKPMQAALQGVREVGFTVLSMSISLVAVFIPLLLMDGLVGRLFREFAITLTTSISISLLVSLTLTPMMCAHLLKSQRPKAQKKIRGFGKVLLKIQQVYGRSLMWVLNHSRWVLLILAGIIALNVWLYINIPKTFFPEQDTGRLLGFVRADQSISFQSMREKMKNFMQTINADPTVDSVIGFTGGGRVNNGFMFISLKPLKERSENAEQIISRLRIKLANEPGANLFLIPVQDIRAGGRQANASYQFTLLADDLNDLRKWEPVIRKALGQLPQLTDVNSDKEDKGAEMAIIYDRDTMSRLGINVSEANNLLNNAFGQRQISTIYQPLNQYKVVMEVAPEYTQDVSALEKMFVINNQGKAIPLSYFAHWQPANAPLSVNHQGLSAASTIAFNVPEGYTLSDAINAIERTTTELRVPSTVRGTFAGTAQIFQETLKSQLFLILAAIITVYLVLGILYESYIHPLTILSTLPSAGIGALLALELFDTPFSLIALIGIMLLIGIVKKNAIIMVDFAIEAQRNGNICARDAIFQASLLRFRPILMTTLAALFGSLPLVLSSGDGTELRQPLGITIVGGLVMSQLLTLYTTPVVYLCFDRLRAYPNRRNCCRQFEHGQRGKTGTYT

SEQ ID NO: 74656 - DNA, 3114 bp, Escherichia coli
  CDS (1)..(3114): transl_table=11
atggctaactattttattgatcgcccggtttttgcctgggtacttgccattattatgatgcttgcaggtggtctggcgatcatgaacttaccggttgcgcagtatccgcagattgcgccaccgaccattaccgtcagcgctacctatccaggtgccgatgcgcaaacggtagaagactcggtcactcaggtgattgagcaaaatatgaatgggcttgatggcctgatgtacatgtcttcaaccagtgatgcggcgggcaatgcctctatcactctgaccttcgagactgggacatctcctgatatcgcacaggttcaagtgcaaaataaactgcaactcgctatgccttcattacctgaagcagtgcagcagcaggggattagcgtcgataagtcgagcagtaatatcctgatggtagcggcgtttatttctgataacggcagcctcaaccagtacgatatcgcggactatgtagcgtctaatatcaaagacccgctaagccgtaccgcgggcgttggtagcgtacaactctttggttccgagtatgccatgcgtatctggctggacccgcaaaaactcaataaatataacctggtaccttccgatgttatttcccagattaaggtgcaaaacaaccagatttccggtggtcaactgggtggcatgccacaggcggcagaccagcagctaaacgcctcgatcattgtgcagacgcgtctgcaaacgccggaagaatttggcaaaatcctgttgaaagttcagcaagatggttcgcaagtgctgctgcgtgatgtcgctcgcgtcgaacttggggcggaagattattccaccgtggcacgctataacggcaaacctgctgccgggatcgccatcaaactggctgccggagcaaacgccctggatacctcgcgggcagtcaaagaggaactgaaccgcttatcagcctatttcccggcaagtctgaagacggtttatccttacgacaccacgccgtttatcgaaatttctattcaggaagttttcaaaacactggttgaggctatcatcctagtcttcctggtcatgtatctgtttttgcagaatttccgtgccacaatcatcccgacgattgccgtaccggtggttattctcgggacgtttgcgatcttgtcggcggtcggtttcaccatcaacacgttgactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcggtattgccgttgttctttccgcagtgtttatgccgatggcctttatgagcggtgcaaccggggagatctaccgccagttctccatcacgctgatctcctccatgctgctttcagtatttgtggcaatgagcctgacccctgccctgtgcgccaccattctgaaagccgcgccggaaggcggtcacaaacctaacgccctgttcgcacgcttcaacacgctgtttgaaaaatcaactcaacactataccgatagcacccgctcgctgttgcgttgtaccggtcgctacatggtggtctacctgctgatttgcgccgggatggcggtgctgttcctgcgcacgccgacctctttcttaccagaagaggatcagggggtatttatgaccaccgcgcagttaccttccggtgccaccatggttaacaccacgaaagtgctgcaacaggtgacggattattatctgactaaagagaaagataatgtccagtcggtgtttaccgttggcggctttggcttcagcggtcaggggcaaaacaacggcctggcgtttatcagtctcaagccgtggtctgaacgtgtcggtgaggaaaactcggttaccgcgatcattcagcgggcaatgattgcgttaagcagtatcaataaagccgtcgtcttcccgttcaacttacccgcggtggctgaactgggtaccgcgtcaggttttgatatggaactgctggacaacggtaacctggggcacgaaaaactaacccaggcgcgaaacgagctgttatcactggcagcgcaatcaccgaatcaggtcaccggggtacgcccgaacggcctggaagatacgccgatgttcaaagtgaacgtcaacgctgcgaaagctgaagcgatgggcgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctactcgtctaccgaatggacctatggttcaccgcgactggaacgctacaacggcatcccgtcaatggagattttaggtgaagcggcggccgggaaaagtaccggtgacgccatgaaatttatggcagacctggtcgctaaacttccggcaggcgtcggctactcatggaccggactatcgtatcaggaagcgttatcctcaaatcaggctcctgcgctgtatgcgatttcactggtcgtggtgttcctcgccctcgccgcactctatgagagctggtcaattccgttctcggtgatgttggttgttccgttaggcgtcgttggcgcattactggccaccgatctgcgcggcttaagtaatgacgtctacttccaggttggtttgctgaccaccatcgggctttccgccaaaaacgccatcctgattgtcgaatttgccgttgagatgatgcagaaagaagggaaaacgccgatagaggcaatcatcgaagcggcgcggatgcgtttacgcccaatcctgatgacctctctggcctttattctcggcgtgctgccgctggttatcagtcatggtgccggttctggcgcgcaaaacgcggtaggtaccggcgtgatgggcgggatgtttgccgcaacagtgctggcaatttacttcgttccggtctttttcgttgtagtggaacatctctttgcccgctttaaaaaagcgtaa

SEQ ID NO: 74657 - protein, 1037 aa, Escherichia coli
MANYFIDRPVFAWVLAIIMMLAGGLAIMNLPVAQYPQIAPPTITVSATYPGADAQTVEDSVTQVIEQNMNGLDGLMYMSSTSDAAGNASITLTFETGTSPDIAQVQVQNKLQLAMPSLPEAVQQQGISVDKSSSNILMVAAFISDNGSLNQYDIADYVASNIKDPLSRTAGVGSVQLFGSEYAMRIWLDPQKLNKYNLVPSDVISQIKVQNNQISGGQLGGMPQAADQQLNASIIVQTRLQTPEEFGKILLKVQQDGSQVLLRDVARVELGAEDYSTVARYNGKPAAGIAIKLAAGANALDTSRAVKEELNRLSAYFPASLKTVYPYDTTPFIEISIQEVFKTLVEAIILVFLVMYLFLQNFRATIIPTIAVPVVILGTFAILSAVGFTINTLTMFGMVLAIGLLVDDAIVVVENVERVIAEDKLPPKEATHKSMGQIQRALVGIAVVLSAVFMPMAFMSGATGEIYRQFSITLISSMLLSVFVAMSLTPALCATILKAAPEGGHKPNALFARFNTLFEKSTQHYTDSTRSLLRCTGRYMVVYLLICAGMAVLFLRTPTSFLPEEDQGVFMTTAQLPSGATMVNTTKVLQQVTDYYLTKEKDNVQSVFTVGGFGFSGQGQNNGLAFISLKPWSERVGEENSVTAIIQRAMIALSSINKAVVFPFNLPAVAELGTASGFDMELLDNGNLGHEKLTQARNELLSLAAQSPNQVTGVRPNGLEDTPMFKVNVNAAKAEAMGVALSDINQTISTAFGSSYVNDFLNQGRVKKVYVQAGTPFRMLPDNINQWYVRNASGTMAPLSAYSSTEWTYGSPRLERYNGIPSMEILGEAAAGKSTGDAMKFMADLVAKLPAGVGYSWTGLSYQEALSSNQAPALYAISLVVVFLALAALYESWSIPFSVMLVVPLGVVGALLATDLRGLSNDVYFQVGLLTTIGLSAKNAILIVEFAVEMMQKEGKTPIEAIIEAARMRLRPILMTSLAFILGVLPLVISHGAGSGAQNAVGTGVMGGMFAATVLAIYFVPVFFVVVEHLFARFKKA

SEQ ID NO: 74658 - DNA, 3099 bp, Haemophilus influenzae
  CDS (1)..(3099): transl_table=11
atgtatgaggaaatccgaatgaaatttaccgatatatttattcgtcgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaaccacagttttttaccattgagggtgttgccgaagtacaggtatttggtgcagctgaatatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgactttgcttgctttaattcttgccataggtttagttgtagatgatgctattgtggtgctggagaatattgatcgtcatattaaagcgggagaaacgccattccgagcagcaattattggtacgcgtgaaattgcagtccctgttatttctatgactatcgcattgatcgcagtttactcaccaatggctttaatggggggcattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaacgcgccatctagcgtaaatgtggattacattcaaaatgcaatgcaaccatatatgaaaaatgtaatggaaacacccgaagtttcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggccctccagtctctattgtattgaaaactgcacaagattataaatctttggcaaacaccgcagagaaattcctcagtgcgatgaaagcctctggcaaatttatttatacaaatttagatttgacctatgacactgcacaaatgactatttctgtggataaagaaaaagcgggaacttacggtattacaatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagtcagttaaattcggctgaaatcagtgctgtaccaatgccgggtatatcaagtggtgatgccattgcttggcttcaacaacaggcaacagacaatttaccgcaaggctatacgtttgattttaaatctgaagcacgtcaattagtccaagaaggcaacgcattagccgtcacttttgcattggctgttatcatcatattcttggtacttgccattcagtttgaatctatacgtgacccaatggtaattatgatttctgtaccattagccgtaagtggtgcattggtgagcttaaatattttatccttctttagcatcgcaggaacaacattaaatatctactctcaagttgggttgattactctcgtgggattaatcaccaaacacggtatcttaatgtgcgaagtggcaaaagaagaacagcttaaccatggtaaaactcgaattgaggcaatcactcatgctgcaaaagtacgtttacgcccaatcctaatgacaacggcggcaatggtagctggcttaattccattactctatgcaacgggtgcaggagcggtatctcgctttagtattgggatagtgattgtagcgggattatccattggtactattttcaccttgttcgtcttgcctgtagtatatagctatgtcgcaactgaacacaaaccattaccggtttttgatgaaaataaaacaacccactaa

SEQ ID NO: 74659 - protein, 1032 aa, Haemophilus influenzae
MYEEIRMKFTDIFIRRPVLAVSISLLMIILGLQAISKLAVREYPKMTTTVITVSTAYPGADANLIQAFVTSKLEESIAQADNIDYMSSTSAPSSSTITIKMKLNTDPAGALADVLAKVNAVKSALPNGIEDPSVSSSSGGSGIMYISFRSKKLDSSQVTDYINRVVKPQFFTIEGVAEVQVFGAAEYALRIWLDPQKMAAQNLSVPTVMSALSANNVQTAAGNDNGYYVSYRNKVETTTKSVEQLSNLIISSNGDDLVRLRDIATVELNKENDNSRATANGAESVVLAINPTSTANPLTVAEKIRPLYESIKTQLPDSMESDILYDRTIAINSSIHEVIKTIGEATLIVLVVILMFIGSFRAILIPILAIPISLIGVLMLLQSFNFSINLMTLLALILAIGLVVDDAIVVLENIDRHIKAGETPFRAAIIGTREIAVPVISMTIALIAVYSPMALMGGITGTLFKEFALTLAGAVFISGVVALTLSPMMSSKLLKSNAKPTWMEERVEHTLGKVNRVYEYMLDLVMLNRKSMLAFAVVIFSTLPFLFNSLSSELTPNEDKGAFIAIGNAPSSVNVDYIQNAMQPYMKNVMETPEVSFGMSIAGAPTSNSSLNIITLKDWKERSRKQSAIMNEINEKAKSIPEVSVSAFNIPEIDTGEQGPPVSIVLKTAQDYKSLANTAEKFLSAMKASGKFIYTNLDLTYDTAQMTISVDKEKAGTYGITMQQISNTLGSFLSGATVTRVDVDGRAYKVISQVKRDDRLSPESFQNYYLTASNGQSVPLSSVISMKLETQPTSLPRFSQLNSAEISAVPMPGISSGDAIAWLQQQATDNLPQGYTFDFKSEARQLVQEGNALAVTFALAVIIIFLVLAIQFESIRDPMVIMISVPLAVSGALVSLNILSFFSIAGTTLNIYSQVGLITLVGLITKHGILMCEVAKEEQLNHGKTRIEAITHAAKVRLRPILMTTAAMVAGLIPLLYATGAGAVSRFSIGIVIVAGLSIGTIFTLFVLPVVYSYVATEHKPLPVFDENKTTH

SEQ ID NO: 74660 - DNA, 24 bp, Primer
atgcctaatttctttatcgatcgc

SEQ ID NO: 74661 - DNA, 26 bp, Primer
ttaatgatgatcgacagtatggctgt

SEQ ID NO: 74662 - protein, 1210 aa, consensus
  MISC_FEATURE (1)..(1210): consensus for the disclosure of xaa see table XV
FIXRPXXXXXXXXXXXXXGXXXXXXLXXXXXPXXXXPXXXXXXXYXGAXXXXXXXXVXXXXEXXXXXXXXXXXXXSXXXXXGXXXXXXXFXXXXXXXXAXXXVXXXXXXXXXXLPXXXXXXXXXXXXXXXXXXXXXXXXXXXXXXXXXXXXXXXXXXXXXXXXXXXXXXXXXXGVXXXXXXGXXXXXXRXXXXPXXXXXXXXXXXXXXXAXXXXNXXXXXGXXXXXXXXXXXXXXXXXXXXXXXXXXXXXXXXXXXXXXXXXXXXXXXXXXXXXXXXXLXDXXXXXXXXXXXXXXXXXXXXXXXXXXXXXXXXXXXXXXXXXNXXXXXXXXXXXXXXXXXXXXXPXXXXXXXXXDXXXXXXXSXXXVXXTLXXAXXLVXXVXXXFLXXXRXXXIPXXXXPXXXXGXXXXXXXXGXSXNXLXXXXXXLAXGXXVDDAIVVXENXXRXXXXXXXXXXXXXXXXXPXXAXXXXXXXXXXXXXXXXXXLXAVFXPXXFXXGXXGXXXXXFXXTXXXXXXXSXXXXLXLXPXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXPXXDXGXXXXXXXXPXXXXXXXXXXXXXXXXXXXXXXXXXXXXXXXXXXXXXXXXXXXXXXXXXXXXXXXLXXXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXAXXXGXXXXXXXXXXXXXXGXXXXXXXXXXXXXXXXXXVXXXXXXXXXXXXXXXXXXXXXXXXXXXXXXXXXGXXXPXXXXXXXXXXXXXXXXXXXXXXXXXXXXXXXXXXXXXXXXGXXXXXGXAXXXXXXXXXXXXXXXXXXXXXXXXXXXXXXXXXXXXXXXXXXXXXXXXLXLXXXXESXXXPXXXXXXXXPXXXXGAXXXXXXXXXXXXXXXXXXXXXXXXXXXXXXXXXXGXXXXXGXXXKNXILXXEFAXXXXXXXGXXXXXAXXXAXXXRXRPIXMTXXXXXXGXXPLXXXXGXGXXXXXXXXXGXXXXXGXXXXXXXXXXXXP

SEQ ID NO: 74663 - protein, 114 aa, consensus
  MISC_FEATURE (1)..(114): consensus for the disclosure of xaa see table XV
XXXPXXXXXXXXXXXXXGXXXXXXXXXXXXPXXXXXXXXXXXXXXGAXXXXXXXXXXXXXXXXXXXXXXXXXXXXXXXXXXXXXXXXXXXXXXXXXXXXXXXXXXXXXXXXXXP

SEQ ID NO: 74664 - protein, 110 aa, consensus
  MISC_FEATURE (1)..(110): consensus for the disclosure of xaa see table XV
GXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXX

SEQ ID NO: 74665 - protein, 134 aa, consensus
  MISC_FEATURE (1)..(134): consensus for the disclosure of xaa see table XV
XXXXXXXXXNXXXXXXXXXXXXXXXXXXXXXPXXXXXXXXXXXXXXXXXXXXXXXXXXXXXXXXXXXXXXXFXXXXXXXXXXXXXXXXXXXXXXXXXXXXXXXXXXXXXXXXXXXXGXXXDDXIXXXEXXXXXX

SEQ ID NO: 74666 - protein, 68 aa, consensus
  MISC_FEATURE (1)..(68): consensus for the disclosure of xaa see table XV
XXXXXXXXXXXXXXXXXXXXXXXXXPXXXXXXXXGXXXXXFXXXXXXXXXXSXXXXXXXXPXXXXXXX

SEQ ID NO: 74667 - protein, 166 aa, consensus
  MISC_FEATURE (1)..(166): consensus for the disclosure of xaa see table XV
XXXXXXXXXXXXXXXXXXXXXXXXXXPXXXXXXXXXXXXXXXXXXXXXXXXXXXXXXXXXXXXXXXXXXXXXXXXXXKXXXXXXXXXXXXXXXXXXXXXXXXXXXXXXRXRXXXXTXXXXXXXXXPXXXXXGXXXXXXXXXXXXXXXXXGXXXXXXXXXXXXPXXX

SEQ ID NO: 74668 - DNA, 1293 bp, Escherichia coli; identical to SEQ ID NO: 36320
  CDS (1)..(1293)

SEQ ID NO: 74669 - protein, 430 aa, Escherichia coli; identical to SEQ ID NO: 36321

SEQ ID NO: 74670 - DNA, 1524 bp, Anopheles gambiae str. PEST; identical to SEQ ID NO: 36322
  CDS (1)..(1524)

SEQ ID NO: 74671 - protein, 507 aa, Anopheles gambiae str. PEST; identical to SEQ ID NO: 36323

SEQ ID NO: 74672 - DNA, 2106 bp, Anopheles gambiae str. PEST; identical to SEQ ID NO: 36324
  CDS (1)..(1392)

SEQ ID NO: 74673 - protein, 463 aa, Anopheles gambiae str. PEST; identical to SEQ ID NO: 36325

SEQ ID NO: 74674 - DNA, 2001 bp, Anopheles gambiae str. PEST; identical to SEQ ID NO: 36326
  CDS (1)..(2001)

SEQ ID NO: 74675 - protein, 666 aa, Anopheles gambiae str. PEST; identical to SEQ ID NO: 36327

SEQ ID NO: 74676 - DNA, 2034 bp, Danio rerio; identical to SEQ ID NO: 36328
  CDS (1)..(2034)

SEQ ID NO: 74677 - protein, 677 aa, Danio rerio; identical to SEQ ID NO: 36329

SEQ ID NO: 74678 - DNA, 1428 bp, Danio rerio; identical to SEQ ID NO: 36330
  CDS (1)..(1428)

SEQ ID NO: 74679 - protein, 475 aa, Danio rerio; identical to SEQ ID NO: 36331

SEQ ID NO: 74680 - DNA, 1923 bp, Danio rerio; identical to SEQ ID NO: 36332
  CDS (1)..(1923)

SEQ ID NO: 74681 - protein, 640 aa, Danio rerio; identical to SEQ ID NO: 36333

SEQ ID NO: 74682 - DNA, 2211 bp, Archaeoglobus fulgidus DSM 4304; identical to SEQ ID NO: 36334
  CDS (1)..(2211): transl_table=11

SEQ ID NO: 74683 - protein, 736 aa, Archaeoglobus fulgidus DSM 4304; identical to SEQ ID NO: 36335

SEQ ID NO: 74684 - DNA, 1596 bp, Archaeoglobus fulgidus DSM 4304; identical to SEQ ID NO: 36336
  CDS (1)..(1596): transl_table=11

SEQ ID NO: 74685 - protein, 531 aa, Archaeoglobus fulgidus DSM 4304; identical to SEQ ID NO: 36337

SEQ ID NO: 74686 - DNA, 1692 bp, Thermoplasma volcanium GSS1; identical to SEQ ID NO: 36338
  CDS (1)..(1692): transl_table=11

SEQ ID NO: 74687 - protein, 563 aa, Thermoplasma volcanium GSS1; identical to SEQ ID NO: 36339

SEQ ID NO: 74688 - DNA, 1617 bp, Aeropyrum pernix K1; identical to SEQ ID NO: 36340
  CDS (1)..(1617): transl_table=11

SEQ ID NO: 74689 - protein, 538 aa, Aeropyrum pernix K1; identical to SEQ ID NO: 36341

SEQ ID NO: 74690 - DNA, 1773 bp, Arabidopsis thaliana; identical to SEQ ID NO: 36342
  CDS (1)..(1773)

SEQ ID NO: 74691 - protein, 590 aa, Arabidopsis thaliana; identical to SEQ ID NO: 36343

SEQ ID NO: 74692 - DNA, 1710 bp, Arabidopsis thaliana; identical to SEQ ID NO: 36344
  CDS (1)..(1710)

SEQ ID NO: 74693 - protein, 569 aa, Arabidopsis thaliana; identical to SEQ ID NO: 36345

SEQ ID NO: 74694 - DNA, 1803 bp, Arabidopsis thaliana; identical to SEQ ID NO: 36346
  CDS (1)..(1803)

SEQ ID NO: 74695 - protein, 600 aa, Arabidopsis thaliana; identical to SEQ ID NO: 36347

SEQ ID NO: 74696 - DNA, 1755 bp, Arabidopsis thaliana; identical to SEQ ID NO: 36348
  CDS (1)..(1755)

SEQ ID NO: 74697 - protein, 584 aa, Arabidopsis thaliana; identical to SEQ ID NO: 36349

SEQ ID NO: 74698 - DNA, 1752 bp, Arabidopsis thaliana; identical to SEQ ID NO: 36350
  CDS (1)..(1752)

SEQ ID NO: 74699 - protein, 583 aa, Arabidopsis thaliana; identical to SEQ ID NO: 36351

SEQ ID NO: 74700 - DNA, 1830 bp, Arabidopsis thaliana; identical to SEQ ID NO: 36352
  CDS (1)..(1830)

SEQ ID NO: 74701 - protein, 609 aa, Arabidopsis thaliana; identical to SEQ ID NO: 36353

SEQ ID NO: 74702 - DNA, 1434 bp, Pseudomonas aeruginosa PAO1; identical to SEQ ID NO: 36354
  CDS (1)..(1434): transl_table=11

SEQ ID NO: 74703 - protein, 477 aa, Pseudomonas aeruginosa PAO1; identical to SEQ ID NO: 36355

SEQ ID NO: 74704 - DNA, 1356 bp, Pseudomonas aeruginosa PAO1; identical to SEQ ID NO: 36356
  CDS (1)..(1356): transl_table=11

SEQ ID NO: 74705 - protein, 451 aa, Pseudomonas aeruginosa PAO1; identical to SEQ ID NO: 36357

SEQ ID NO: 74706 - DNA, 1410 bp, Lactococcus lactis subsp. lactis Il1403; identical to SEQ ID NO: 36358
  CDS (1)..(1410): transl_table=11

SEQ ID NO: 74707 - protein, 469 aa, Lactococcus lactis subsp. lactis Il1403; identical to SEQ ID NO: 36359

SEQ ID NO: 74708 - DNA, 1344 bp, Streptococcus pyogenes M1 GAS; identical to SEQ ID NO: 36360
  CDS (1)..(1344): transl_table=11

SEQ ID NO: 74709 - protein, 447 aa, Streptococcus pyogenes M1 GAS; identical to SEQ ID NO: 36361

SEQ ID NO: 74710 - DNA, 1275 bp, Methanothermobacter thermautotrophicus str. Delta H; identical to SEQ ID NO: 36362
  CDS (1)..(1275): transl_table=11

SEQ ID NO: 74711 - protein, 424 aa, Methanothermobacter thermautotrophicus str. Delta H; identical to SEQ ID NO: 36363

SEQ ID NO: 74712 - DNA, 2331 bp, Halobacterium salinarum NRC-1; identical to SEQ ID NO: 36364
  CDS (1)..(2331): transl_table=11

SEQ ID NO: 74713 - protein, 776 aa, Halobacterium salinarum NRC-1; identical to SEQ ID NO: 36365

SEQ ID NO: 74714 - DNA, 1530 bp, Xylella fastidiosa 9a5c; identical to SEQ ID NO: 36366
  CDS (1)..(1530): transl_table=11

SEQ ID NO: 74715 - protein, 509 aa, Xylella fastidiosa 9a5c; identical to SEQ ID NO: 36367

SEQ ID NO: 74716 - DNA, 1434 bp, Xylella fastidiosa 9a5c; identical to SEQ ID NO: 36368
  CDS (1)..(1434): transl_table=11

SEQ ID NO: 74717 - protein, 477 aa, Xylella fastidiosa 9a5c; identical to SEQ ID NO: 36369

SEQ ID NO: 74718 - DNA, 1518 bp, Mycobacterium leprae TN; identical to SEQ ID NO: 36370
  CDS (1)..(1518): transl_table=11

SEQ ID NO: 74719 - protein, 505 aa, Mycobacterium leprae TN; identical to SEQ ID NO: 36371

SEQ ID NO: 74720 - DNA, 1719 bp, Mycobacterium leprae TN; identical to SEQ ID NO: 36372
  CDS (1)..(1719): transl_table=11

SEQ ID NO: 74721 - protein, 572 aa, Mycobacterium leprae TN; identical to SEQ ID NO: 36373

SEQ ID NO: 74722 - DNA, 1305 bp, Mycobacterium tuberculosis CDC1551; identical to SEQ ID NO: 9113
  CDS (1)..(1305): transl_table=11

SEQ ID NO: 74723 - protein, 434 aa, Mycobacterium tuberculosis CDC1551; identical to SEQ ID NO: 9114

SEQ ID NO: 74724 - DNA, 1416 bp, Mycobacterium tuberculosis CDC1551; identical to SEQ ID NO: 36376
  CDS (1)..(1416): transl_table=11

SEQ ID NO: 74725 - protein, 471 aa, Mycobacterium tuberculosis CDC1551; identical to SEQ ID NO: 36377

SEQ ID NO: 74726 - DNA, 1488 bp, Mycobacterium tuberculosis CDC1551; identical to SEQ ID NO: 36378
  CDS (1)..(1488): transl_table=11

SEQ ID NO: 74727 - protein, 495 aa, Mycobacterium tuberculosis CDC1551; identical to SEQ ID NO: 36379

SEQ ID NO: 74728 - DNA, 1254 bp, Sulfolobus solfataricus P2; identical to SEQ ID NO: 36380
  CDS (1)..(1254): transl_table=11

SEQ ID NO: 74729 - protein, 417 aa, Sulfolobus solfataricus P2; identical to SEQ ID NO: 36381

SEQ ID NO: 74730 - DNA, 1401 bp, Clostridium acetobutylicum ATCC 824; identical to SEQ ID NO: 36382
  CDS (1)..(1401): transl_table=11

SEQ ID NO: 74731 - protein, 466 aa, Clostridium acetobutylicum ATCC 824; identical to SEQ ID NO: 36383

SEQ ID NO: 74732 - DNA, 1404 bp, Streptococcus pneumoniae R6; identical to SEQ ID NO: 36384
  CDS (1)..(1404): transl_table=11

SEQ ID NO: 74733 - protein, 467 aa, Streptococcus pneumoniae R6; identical to SEQ ID NO: 36385

SEQ ID NO: 74734 - DNA, 1398 bp, Rickettsia conorii str. Malish 7; identical to SEQ ID NO: 36386
  CDS (1)..(1398): transl_table=11

SEQ ID NO: 74735 - protein, 465 aa, Rickettsia conorii str. Malish 7; identical to SEQ ID NO: 36387

SEQ ID NO: 74736 - DNA, 1638 bp, Staphylococcus aureus subsp. aureus Mu50; identical to SEQ ID NO: 36388
  CDS (1)..(1638): transl_table=11

SEQ ID NO: 74737 - protein, 545 aa, Staphylococcus aureus subsp. aureus Mu50; identical to SEQ ID NO: 36389

SEQ ID NO: 74738 - DNA, 1449 bp, Staphylococcus aureus subsp. aureus Mu50; identical to SEQ ID NO: 36390
  CDS (1)..(1449): transl_table=11

SEQ ID NO: 74739 - protein, 482 aa, Staphylococcus aureus subsp. aureus Mu50; identical to SEQ ID NO: 36391

SEQ ID NO: 74740 - DNA, 1278 bp, Sulfolobus tokodaii str. 7; identical to SEQ ID NO: 36392
  CDS (1)..(1278): transl_table=11

SEQ ID NO: 74741 - protein, 425 aa, Sulfolobus tokodaii str. 7; identical to SEQ ID NO: 36393

SEQ ID NO: 74742 - DNA, 1386 bp, Bacillus subtilis subsp. subtilis str. 168; identical to SEQ ID NO: 36394
  CDS (1)..(1386): transl_table=11

SEQ ID NO: 74743 - protein, 461 aa, Bacillus subtilis subsp. subtilis str. 168; identical to SEQ ID NO: 36395

SEQ ID NO: 74744 - DNA, 1464 bp, Halobacterium salinarum NRC-1; identical to SEQ ID NO: 36396
  CDS (1)..(1464): transl_table=11

SEQ ID NO: 74745 - protein, 487 aa, Halobacterium salinarum NRC-1; identical to SEQ ID NO: 36397

SEQ ID NO: 74746 - DNA, 1527 bp, Yersinia pestis CO92; identical to SEQ ID NO: 36398
  CDS (1)..(1527)

SEQ ID NO: 74747 - protein, 508 aa, Yersinia pestis CO92; identical to SEQ ID NO: 36399

SEQ ID NO: 74748 - DNA, 1392 bp, Yersinia pestis CO92; identical to SEQ ID NO: 9051
  CDS (1)..(1392)

SEQ ID NO: 74749 - protein, 463 aa, Yersinia pestis CO92; identical to SEQ ID NO: 9052

SEQ ID NO: 74750 - DNA, 1551 bp, Escherichia coli K12; identical to SEQ ID NO: 36402
  CDS (1)..(1551): transl_table=11

SEQ ID NO: 74751 - protein, 516 aa, Escherichia coli K12; identical to SEQ ID NO: 36403

SEQ ID NO: 74752 - DNA, 1389 bp, Escherichia coli K12; identical to SEQ ID NO: 36404
  CDS (1)..(1389): transl_table=11

SEQ ID NO: 74753 - protein, 462 aa, Escherichia coli K12; identical to SEQ ID NO: 36405

SEQ ID NO: 74754 - DNA, 1503 bp, Caulobacter crescentus CB15; identical to SEQ ID NO: 36406
  CDS (1)..(1503): transl_table=11

SEQ ID NO: 74755 - protein, 500 aa, Caulobacter crescentus CB15; identical to SEQ ID NO: 36407

SEQ ID NO: 74756 - DNA, 1641 bp, Caulobacter crescentus CB15; identical to SEQ ID NO: 36408
  CDS (1)..(1641): transl_table=11

SEQ ID NO: 74757 - protein, 546 aa, Caulobacter crescentus CB15; identical to SEQ ID NO: 36409

SEQ ID NO: 74758 - DNA, 1302 bp, Caulobacter crescentus CB15; identical to SEQ ID NO: 36410
  CDS (1)..(1302): transl_table=11

SEQ ID NO: 74759 - protein, 433 aa, Caulobacter crescentus CB15; identical to SEQ ID NO: 36411

SEQ ID NO: 74760 - DNA, 1326 bp, Sinorhizobium meliloti 1021; identical to SEQ ID NO: 36412
  CDS (1)..(1326): transl_table=11

SEQ ID NO: 74761 - protein, 441 aa, Sinorhizobium meliloti 1021; identical to SEQ ID NO: 36413

SEQ ID NO: 74762 - DNA, 1392 bp, Listeria monocytogenes EGD-e; identical to SEQ ID NO: 36414
  CDS (1)..(1392): transl_table=11

SEQ ID NO: 74763 - protein, 463 aa, Listeria monocytogenes EGD-e; identical to SEQ ID NO: 36415

SEQ ID NO: 74764 - DNA, 1368 bp, Nostoc sp. PCC 7120; identical to SEQ ID NO: 36416
  CDS (1)..(1368): transl_table=11

SEQ ID NO: 74765 - protein, 455 aa, Nostoc sp. PCC 7120; identical to SEQ ID NO: 36417

SEQ ID NO: 74766 - DNA, 1626 bp, Caenorhabditis elegans; identical to SEQ ID NO: 36418
  CDS (1)..(1626)

SEQ ID NO: 74767 - protein, 541 aa, Caenorhabditis elegans; identical to SEQ ID NO: 36419

SEQ ID NO: 74768 - DNA, 1752 bp, Caenorhabditis elegans; identical to SEQ ID NO: 36420
  CDS (1)..(1752)

SEQ ID NO: 74769 - protein, 583 aa, Caenorhabditis elegans; identical to SEQ ID NO: 36421

SEQ ID NO: 74770 - DNA, 1770 bp, Caenorhabditis elegans; identical to SEQ ID NO: 36422
  CDS (1)..(1770)

SEQ ID NO: 74771 - protein, 589 aa, Caenorhabditis elegans; identical to SEQ ID NO: 36423

SEQ ID NO: 74772 - DNA, 1482 bp, Caenorhabditis elegans; identical to SEQ ID NO: 36424
  CDS (1)..(1482)

SEQ ID NO: 74773 - protein, 493 aa, Caenorhabditis elegans; identical to SEQ ID NO: 36425

SEQ ID NO: 74774 - DNA, 1431 bp, Ralstonia solanacearum GMI1000; identical to SEQ ID NO: 36426
  CDS (1)..(1431): transl_table=11

SEQ ID NO: 74775 - protein, 476 aa, Ralstonia solanacearum GMI1000; identical to SEQ ID NO: 36427

SEQ ID NO: 74776 - DNA, 1458 bp, Agrobacterium tumefaciens str. C58; identical to SEQ ID NO: 9087
  CDS (1)..(1458): transl_table=11

SEQ ID NO: 74777 - protein, 485 aa, Agrobacterium tumefaciens str. C58; identical to SEQ ID NO: 9088

SEQ ID NO: 74778 - DNA, 1323 bp, Clostridium perfringens str. 13; identical to SEQ ID NO: 36430
  CDS (1)..(1323): transl_table=11

SEQ ID NO: 74779 - protein, 440 aa, Clostridium perfringens str. 13; identical to SEQ ID NO: 36431

SEQ ID NO: 74780 - DNA, 1383 bp, Clostridium perfringens str. 13; identical to SEQ ID NO: 36432
  CDS (1)..(1383): transl_table=11

SEQ ID NO: 74781 - protein, 460 aa, Clostridium perfringens str. 13; identical to SEQ ID NO: 36433

SEQ ID NO: 74782 - DNA, 1710 bp, Arabidopsis thaliana; identical to SEQ ID NO: 36434
  CDS (1)..(1710)

SEQ ID NO: 74783 - protein, 569 aa, Arabidopsis thaliana; identical to SEQ ID NO: 36435

SEQ ID NO: 74784 - DNA, 1503 bp, Drosophila melanogaster; identical to SEQ ID NO: 36436
  CDS (1)..(1503)

SEQ ID NO: 74785 - protein, 500 aa, Drosophila melanogaster; identical to SEQ ID NO: 36437

SEQ ID NO: 74786 - DNA, 1320 bp, Methanosarcina acetivorans C2A; identical to SEQ ID NO: 36438
  CDS (1)..(1320): transl_table=11

SEQ ID NO: 74787 - protein, 439 aa, Methanosarcina acetivorans C2A; identical to SEQ ID NO: 36439

SEQ ID NO: 74788 - DNA, 1293 bp, Methanosarcina acetivorans C2A; identical to SEQ ID NO: 36440
  CDS (1)..(1293): transl_table=11

SEQ ID NO: 74789 - protein, 430 aa, Methanosarcina acetivorans C2A; identical to SEQ ID NO: 36441

SEQ ID NO: 74790 - DNA, 1320 bp, Methanosarcina acetivorans C2A; identical to SEQ ID NO: 36442
  CDS (1)..(1320): transl_table=11

SEQ ID NO: 74791 - protein, 439 aa, Methanosarcina acetivorans C2A; identical to SEQ ID NO: 36443

SEQ ID NO: 74792 - DNA, 1380 bp, Thermoanaerobacter tengcongensis MB4; identical to SEQ ID NO: 36444
  CDS (1)..(1380): transl_table=11

SEQ ID NO: 74793 - protein, 459 aa, Thermoanaerobacter tengcongensis MB4; identical to SEQ ID NO: 36445

SEQ ID NO: 74794 - DNA, 1440 bp, Thermoanaerobacter tengcongensis MB4; identical to SEQ ID NO: 36446
  CDS (1)..(1440): transl_table=11

SEQ ID NO: 74795 - protein, 479 aa, Thermoanaerobacter tengcongensis MB4; identical to SEQ ID NO: 36447

SEQ ID NO: 74796 - DNA, 1428 bp, Thermoanaerobacter tengcongensis MB4; identical to SEQ ID NO: 36448
  CDS (1)..(1428): transl_table=11

SEQ ID NO: 74797 - protein, 475 aa, Thermoanaerobacter tengcongensis MB4; identical to SEQ ID NO: 36449

SEQ ID NO: 74798 - DNA, 1491 bp, Streptomyces coelicolor A3(2); identical to SEQ ID NO: 36450
  CDS (1)..(1491)

SEQ ID NO: 74799 - protein, 496 aa, Streptomyces coelicolor A3(2); identical to SEQ ID NO: 36451

SEQ ID NO: 74800 - DNA, 1440 bp, Streptomyces coelicolor A3(2); identical to SEQ ID NO: 36452
  CDS (1)..(1440)

SEQ ID NO: 74801 - protein, 479 aa, Streptomyces coelicolor A3(2); identical to SEQ ID NO: 36453

SEQ ID NO: 74802 - DNA, 2238 bp, Methanosarcina mazei Go1; identical to SEQ ID NO: 36454
  CDS (1)..(2238): transl_table=11

SEQ ID NO: 74803 - protein, 745 aa, Methanosarcina mazei Go1; identical to SEQ ID NO: 36455

SEQ ID NO: 74804 - DNA, 1281 bp, Methanosarcina mazei Go1; identical to SEQ ID NO: 36456
  CDS (1)..(1281): transl_table=11

SEQ ID NO: 74805 - protein, 426 aa, Methanosarcina mazei Go1; identical to SEQ ID NO: 36457

SEQ ID NO: 74806 - DNA, 1431 bp, Xanthomonas campestris pv. campestris str. ATCC 33913; identical to SEQ ID NO: 36458
  CDS (1)..(1431): transl_table=11

SEQ ID NO: 74807 - protein, 476 aa, Xanthomonas campestris pv. campestris str. ATCC 33913; identical to SEQ ID NO: 36459

SEQ ID NO: 74808 - DNA, 1482 bp, Xanthomonas campestris pv. campestris str. ATCC 33913; identical to SEQ ID NO: 36460
  CDS (1)..(1482): transl_table=11

SEQ ID NO: 74809 - protein, 493 aa, Xanthomonas campestris pv. campestris str. ATCC 33913; identical to SEQ ID NO: 36461

SEQ ID NO: 74810 - DNA, 1587 bp, Xanthomonas campestris pv. campestris str. ATCC 33913; identical to SEQ ID NO: 36462
  CDS (1)..(1587): transl_table=11

SEQ ID NO: 74811 - protein, 528 aa, Xanthomonas campestris pv. campestris str. ATCC 33913; identical to SEQ ID NO: 36463

SEQ ID NO: 74812 - DNA, 1302 bp, Xanthomonas campestris pv. campestris str. ATCC 33913; identical to SEQ ID NO: 36464
  CDS (1)..(1302): transl_table=11

SEQ ID NO: 74813 - protein, 433 aa, Xanthomonas campestris pv. campestris str. ATCC 33913; identical to SEQ ID NO: 36465

SEQ ID NO: 74814 - DNA, 1413 bp, Xanthomonas campestris pv. campestris str. ATCC 33913; identical to SEQ ID NO: 36466
  CDS (1)..(1413): transl_table=11

SEQ ID NO: 74815 - protein, 470 aa, Xanthomonas campestris pv. campestris str. ATCC 33913; identical to SEQ ID NO: 36467

SEQ ID NO: 74816 - DNA, 1431 bp, Xanthomonas axonopodis pv. citri str. 306; identical to SEQ ID NO: 36468
  CDS (1)..(1431): transl_table=11

SEQ ID NO: 74817 - protein, 476 aa, Xanthomonas axonopodis pv. citri str. 306; identical to SEQ ID NO: 36469

SEQ ID NO: 74818 - DNA, 1482 bp, Xanthomonas axonopodis pv. citri str. 306; identical to SEQ ID NO: 36470
  CDS (1)..(1482): transl_table=11

SEQ ID NO: 74819 - protein, 493 aa, Xanthomonas axonopodis pv. citri str. 306; identical to SEQ ID NO: 36471

SEQ ID NO: 74820 - DNA, 1587 bp, Xanthomonas axonopodis pv. citri str. 306; identical to SEQ ID NO: 36472
  CDS (1)..(1587): transl_table=11

SEQ ID NO: 74821 - protein, 528 aa, Xanthomonas axonopodis pv. citri str. 306; identical to SEQ ID NO: 36473

SEQ ID NO: 74822 - DNA, 1317 bp, Xanthomonas axonopodis pv. citri str. 306; identical to SEQ ID NO: 36474
  CDS (1)..(1317): transl_table=11

SEQ ID NO: 74823 - protein, 438 aa, Xanthomonas axonopodis pv. citri str. 306; identical to SEQ ID NO: 36475

SEQ ID NO: 74824 - DNA, 1416 bp, Xanthomonas axonopodis pv. citri str. 306; identical to SEQ ID NO: 36476
  CDS (1)..(1416): transl_table=11

SEQ ID NO: 74825 - protein, 471 aa, Xanthomonas axonopodis pv. citri str. 306; identical to SEQ ID NO: 36477

SEQ ID NO: 74826 - DNA, 2010 bp, Drosophila melanogaster; identical to SEQ ID NO: 36478
  CDS (1)..(2010)

SEQ ID NO: 74827 - protein, 669 aa, Drosophila melanogaster; identical to SEQ ID NO: 36479

SEQ ID NO: 74828 - DNA, 1815 bp, Drosophila melanogaster; identical to SEQ ID NO: 36480
  CDS (1)..(1815)

SEQ ID NO: 74829 - protein, 604 aa, Drosophila melanogaster; identical to SEQ ID NO: 36481

SEQ ID NO: 74830 - DNA, 1518 bp, Drosophila melanogaster; identical to SEQ ID NO: 36482
  CDS (1)..(1518)

SEQ ID NO: 74831 - protein, 505 aa, Drosophila melanogaster; identical to SEQ ID NO: 36483

SEQ ID NO: 74832 - DNA, 1416 bp, Bacillus anthracis str. A2012; identical to SEQ ID NO: 36484
  CDS (1)..(1416): transl_table=11

SEQ ID NO: 74833 - protein, 471 aa, Bacillus anthracis str. A2012; identical to SEQ ID NO: 36485

SEQ ID NO: 74834 - DNA, 1404 bp, Bacillus anthracis str. A2012; identical to SEQ ID NO: 36486
  CDS (1)..(1404): transl_table=11

SEQ ID NO: 74835 - protein, 467 aa, Bacillus anthracis str. A2012; identical to SEQ ID NO: 36487

SEQ ID NO: 74836 - DNA, 1287 bp, Bacillus anthracis str. A2012; identical to SEQ ID NO: 36488
  CDS (1)..(1287): transl_table=11

SEQ ID NO: 74837 - protein, 428 aa, Bacillus anthracis str. A2012; identical to SEQ ID NO: 36489

SEQ ID NO: 74838 - DNA, 1359 bp, Mus musculus; identical to SEQ ID NO: 36490
  CDS (1)..(1359)

SEQ ID NO: 74839 - protein, 452 aa, Mus musculus; identical to SEQ ID NO: 36491

SEQ ID NO: 74840 - DNA, 1488 bp, Chlorobium tepidum TLS; identical to SEQ ID NO: 36492
  CDS (1)..(1488): transl_table=11

SEQ ID NO: 74841 - protein, 495 aa, Chlorobium tepidum TLS; identical to SEQ ID NO: 36493

SEQ ID NO: 74842 - DNA, 1392 bp, Streptococcus pyogenes MGAS315; identical to SEQ ID NO: 36494
  CDS (1)..(1392): transl_table=11

SEQ ID NO: 74843 - protein, 463 aa, Streptococcus pyogenes MGAS315; identical to SEQ ID NO: 36495

SEQ ID NO: 74844 - DNA, 1137 bp, Thermosynechococcus elongatus BP-1; identical to SEQ ID NO: 36496
  CDS (1)..(1137): transl_table=11

SEQ ID NO: 74845 - protein, 378 aa, Thermosynechococcus elongatus BP-1; identical to SEQ ID NO: 36497

SEQ ID NO: 74846 - DNA, 1374 bp, Shigella flexneri 2a str. 301; identical to SEQ ID NO: 9205
  CDS (1)..(1374): transl_table=11

SEQ ID NO: 74847 - protein, 457 aa, Shigella flexneri 2a str. 301; identical to SEQ ID NO: 9206

SEQ ID NO: 74848 - DNA, 1293 bp, Shigella flexneri 2a str. 301; identical to SEQ ID NO: 36500
  CDS (1)..(1293): transl_table=11

SEQ ID NO: 74849 - protein, 430 aa, Shigella flexneri 2a str. 301; identical to SEQ ID NO: 36501

SEQ ID NO: 74850 - DNA, 1257 bp, Shigella flexneri 2a str. 301; identical to SEQ ID NO: 36502
  CDS (1)..(1257): transl_table=11

SEQ ID NO: 74851 - protein, 418 aa, Shigella flexneri 2a str. 301; identical to SEQ ID NO: 36503

SEQ ID NO: 74852 - DNA, 1626 bp, Drosophila melanogaster; identical to SEQ ID NO: 36504
  CDS (1)..(1626)

SEQ ID NO: 74853 - protein, 541 aa, Drosophila melanogaster; identical to SEQ ID NO: 36505

SEQ ID NO: 74854 - DNA, 1866 bp, Drosophila melanogaster; identical to SEQ ID NO: 36506
  CDS (1)..(1866)

SEQ ID NO: 74855 - protein, 621 aa, Drosophila melanogaster; identical to SEQ ID NO: 36507

SEQ ID NO: 74856 - DNA, 1353 bp, Streptococcus agalactiae NEM316; identical to SEQ ID NO: 36508
  CDS (1)..(1353): transl_table=11

SEQ ID NO: 74857 - protein, 450 aa, Streptococcus agalactiae NEM316; identical to SEQ ID NO: 36509

SEQ ID NO: 74858 - DNA, 1452 bp, Staphylococcus epidermidis ATCC 12228; identical to SEQ ID NO: 36510
  CDS (1)..(1452): transl_table=11

SEQ ID NO: 74859 - protein, 483 aa, Staphylococcus epidermidis ATCC 12228; identical to SEQ ID NO: 36511

SEQ ID NO: 74860 - DNA, 1368 bp, Bradyrhizobium japonicum USDA 110; identical to SEQ ID NO: 36512
  CDS (1)..(1368)

SEQ ID NO: 74861 - protein, 455 aa, Bradyrhizobium japonicum USDA 110; identical to SEQ ID NO: 36513

SEQ ID NO: 74862 - DNA, 1434 bp, Xylella fastidiosa Temecula1; identical to SEQ ID NO: 36514
  CDS (1)..(1434): transl_table=11

SEQ ID NO: 74863 - protein, 477 aa, Xylella fastidiosa Temecula1; identical to SEQ ID NO: 36515

SEQ ID NO: 74864 - DNA, 1443 bp, Xylella fastidiosa Temecula1; identical to SEQ ID NO: 36516
  CDS (1)..(1443): transl_table=11

SEQ ID NO: 74865 - protein, 480 aa, Xylella fastidiosa Temecula1; identical to SEQ ID NO: 36517

SEQ ID NO: 74866 - DNA, 1398 bp, Lactobacillus plantarum WCFS1; identical to SEQ ID NO: 36518
  CDS (1)..(1398): transl_table=11

SEQ ID NO: 74867 - protein, 465 aa, Lactobacillus plantarum WCFS1; identical to SEQ ID NO: 36519

SEQ ID NO: 74868 - DNA, 1332 bp, Lactobacillus plantarum WCFS1; identical to SEQ ID NO: 36520
  CDS (1)..(1332): transl_table=11

SEQ ID NO: 74869 - protein, 443 aa, Lactobacillus plantarum WCFS1; identical to SEQ ID NO: 36521

SEQ ID NO: 74870 - DNA, 1428 bp, Lactobacillus plantarum WCFS1; identical to SEQ ID NO: 36522
  CDS (1)..(1428): transl_table=11

SEQ ID NO: 74871 - protein, 475 aa, Lactobacillus plantarum WCFS1; identical to SEQ ID NO: 36523

SEQ ID NO: 74872 - DNA, 1500 bp, Lactobacillus plantarum WCFS1; identical to SEQ ID NO: 36524
  CDS (1)..(1500): transl_table=11

SEQ ID NO: 74873 - protein, 499 aa, Lactobacillus plantarum WCFS1; identical to SEQ ID NO: 36525

SEQ ID NO: 74874 - DNA, 1341 bp, Lactobacillus plantarum WCFS1; identical to SEQ ID NO: 9305
  CDS (1)..(1341): transl_table=11

SEQ ID NO: 74875 - protein, 446 aa, Lactobacillus plantarum WCFS1; identical to SEQ ID NO: 9306

SEQ ID NO: 74876 - DNA, 1425 bp, Lactobacillus plantarum WCFS1; identical to SEQ ID NO: 36528
  CDS (1)..(1425): transl_table=11

SEQ ID NO: 74877 - protein, 474 aa, Lactobacillus plantarum WCFS1; identical to SEQ ID NO: 36529

SEQ ID NO: 74878 - DNA, 1290 bp, Salmonella enterica subsp. enterica serovar Typhi Ty2; identical to SEQ ID NO: 36530
  CDS (1)..(1290): transl_table=11

SEQ ID NO: 74879 - protein, 429 aa, Salmonella enterica subsp. enterica serovar Typhi Ty2; identical to SEQ ID NO: 36531

SEQ ID NO: 74880 - DNA, 1392 bp, Enterococcus faecalis V583; identical to SEQ ID NO: 36532
  CDS (1)..(1392): transl_table=11

SEQ ID NO: 74881 - protein, 463 aa, Enterococcus faecalis V583; identical to SEQ ID NO: 36533

SEQ ID NO: 74882 - DNA, 1500 bp, Enterococcus faecalis V583; identical to SEQ ID NO: 36534
  CDS (1)..(1500): transl_table=11

SEQ ID NO: 74883 - protein, 499 aa, Enterococcus faecalis V583; identical to SEQ ID NO: 36535

SEQ ID NO: 74884 - DNA, 1314 bp, Coxiella burnetii RSA 493; identical to SEQ ID NO: 36536
  CDS (1)..(1314): transl_table=11

SEQ ID NO: 74885 - protein, 437 aa, Coxiella burnetii RSA 493; identical to SEQ ID NO: 36537

SEQ ID NO: 74886 - DNA, 1464 bp, Streptomyces avermitilis MA-4680; identical to SEQ ID NO: 9239
  CDS (1)..(1464)

SEQ ID NO: 74887 - protein, 487 aa, Streptomyces avermitilis MA-4680; identical to SEQ ID NO: 9240

SEQ ID NO: 74888 - DNA, 1479 bp, Streptomyces avermitilis MA-4680; identical to SEQ ID NO: 36540
  CDS (1)..(1479)

SEQ ID NO: 74889 - protein, 492 aa, Streptomyces avermitilis MA-4680; identical to SEQ ID NO: 36541

SEQ ID NO: 74890 - DNA, 1416 bp, Bacillus cereus ATCC 14579; identical to SEQ ID NO: 36542
  CDS (1)..(1416): transl_table=11

SEQ ID NO: 74891 - protein, 471 aa, Bacillus cereus ATCC 14579; identical to SEQ ID NO: 36543

SEQ ID NO: 74892 - DNA, 1311 bp, Bacillus cereus ATCC 14579; identical to SEQ ID NO: 36544
  CDS (1)..(1311): transl_table=11

SEQ ID NO: 74893 - protein, 436 aa, Bacillus cereus ATCC 14579; identical to SEQ ID NO: 36545

SEQ ID NO: 74894 - DNA, 1257 bp, Shigella flexneri 2a str. 2457T; identical to SEQ ID NO: 36546
  CDS (1)..(1257): transl_table=11

SEQ ID NO: 74895 - protein, 418 aa, Shigella flexneri 2a str. 2457T; identical to SEQ ID NO: 36547

SEQ ID NO: 74896 - DNA, 1563 bp, Nitrosomonas europaea ATCC 19718; identical to SEQ ID NO: 36548
  CDS (1)..(1563): transl_table=11

SEQ ID NO: 74897 - protein, 520 aa, Nitrosomonas europaea ATCC 19718; identical to SEQ ID NO: 36549

SEQ ID NO: 74898 - DNA, 1446 bp, Mycobacterium bovis AF2122/97; identical to SEQ ID NO: 36550
  CDS (1)..(1446): transl_table=11

SEQ ID NO: 74899 - protein, 481 aa, Mycobacterium bovis AF2122/97; identical to SEQ ID NO: 36551

SEQ ID NO: 74900 - DNA, 1470 bp, Mycobacterium bovis AF2122/97; identical to SEQ ID NO: 36552
  CDS (1)..(1470): transl_table=11

SEQ ID NO: 74901 - protein, 489 aa, Mycobacterium bovis AF2122/97; identical to SEQ ID NO: 9208

SEQ ID NO: 74902 - DNA, 1329 bp, Rhodopirellula baltica SH 1; identical to SEQ ID NO: 36554
  CDS (1)..(1329): transl_table=11

SEQ ID NO: 74903 - protein, 442 aa, Rhodopirellula baltica SH 1; identical to SEQ ID NO: 36555

SEQ ID NO: 74904 - DNA, 2190 bp, Rhodopirellula baltica SH 1; identical to SEQ ID NO: 36556
  CDS (1)..(2190): transl_table=11

SEQ ID NO: 74905 - protein, 729 aa, Rhodopirellula baltica SH 1; identical to SEQ ID NO: 36557

SEQ ID NO: 74906 - DNA, 1455 bp, Rhodopirellula baltica SH 1; identical to SEQ ID NO: 36558
  CDS (1)..(1455): transl_table=11

SEQ ID NO: 74907 - protein, 484 aa, Rhodopirellula baltica SH 1; identical to SEQ ID NO: 36559

SEQ ID NO: 74908 - DNA, 1338 bp, Bordetella parapertussis 12822; identical to SEQ ID NO: 36560
  CDS (1)..(1338): transl_table=11

SEQ ID NO: 74909 - protein, 445 aa, Bordetella parapertussis 12822; identical to SEQ ID NO: 36561

SEQ ID NO: 74910 - DNA, 1338 bp, Bordetella bronchiseptica RB50; identical to SEQ ID NO: 36562
  CDS (1)..(1338): transl_table=11

SEQ ID NO: 74911 - protein, 445 aa, Bordetella bronchiseptica RB50; identical to SEQ ID NO: 36563

SEQ ID NO: 74912 - DNA, 1398 bp, Chromobacterium violaceum ATCC 12472; identical to SEQ ID NO: 36564
  CDS (1)..(1398): transl_table=11

SEQ ID NO: 74913 - protein, 465 aa, Chromobacterium violaceum ATCC 12472; identical to SEQ ID NO: 36565

SEQ ID NO: 74914 - DNA, 1332 bp, Chromobacterium violaceum ATCC 12472; identical to SEQ ID NO: 36566
  CDS (1)..(1332): transl_table=11

SEQ ID NO: 74915 - protein, 443 aa, Chromobacterium violaceum ATCC 12472; identical to SEQ ID NO: 36567

SEQ ID NO: 74916 - DNA, 1851 bp, Oryza sativa (japonica cultivar-group); identical to SEQ ID NO: 36568
  CDS (1)..(1851)

SEQ ID NO: 74917 - protein, 616 aa, Oryza sativa (japonica cultivar-group); identical to SEQ ID NO: 36569

SEQ ID NO: 74918 - DNA, 1332 bp, Gloeobacter violaceus PCC 7421; identical to SEQ ID NO: 36570
  CDS (1)..(1332): transl_table=11

SEQ ID NO: 74919 - protein, 443 aa, Gloeobacter violaceus PCC 7421; identical to SEQ ID NO: 36571

SEQ ID NO: 74920 - DNA, 1416 bp, Gloeobacter violaceus PCC 7421; identical to SEQ ID NO: 36572
  CDS (1)..(1416): transl_table=11

SEQ ID NO: 74921 - protein, 471 aa, Gloeobacter violaceus PCC 7421; identical to SEQ ID NO: 36573

SEQ ID NO: 74922 - DNA, 1371 bp, Gloeobacter violaceus PCC 7421; identical to SEQ ID NO: 36574
  CDS (1)..(1371): transl_table=11

SEQ ID NO: 74923 - protein, 456 aa, Gloeobacter violaceus PCC 7421; identical to SEQ ID NO: 36575

SEQ ID NO: 74924 - DNA, 1602 bp, Photorhabdus luminescens subsp. laumondii TTO1; identical to SEQ ID NO: 36576
  CDS (1)..(1602): transl_table=11

SEQ ID NO: 74925 - protein, 533 aa, Photorhabdus luminescens subsp. laumondii TTO1; identical to SEQ ID NO: 36577

SEQ ID NO: 74926 - DNA, 1413 bp, Corynebacterium diphtheriae NCTC 13129; identical to SEQ ID NO: 9471
  CDS (1)..(1413): transl_table=11

SEQ ID NO: 74927 - protein, 470 aa, Corynebacterium diphtheriae NCTC 13129; identical to SEQ ID NO: 9472

SEQ ID NO: 74928 - DNA, 1482 bp, Rhodopseudomonas palustris CGA009; identical to SEQ ID NO: 36580
  CDS (1)..(1482): transl_table=11

SEQ ID NO: 74929 - protein, 493 aa, Rhodopseudomonas palustris CGA009; identical to SEQ ID NO: 36581

SEQ ID NO: 74930 - DNA, 1518 bp, Mycobacterium avium subsp. paratuberculosis str. k10; identical to SEQ ID NO: 36582
  CDS (1)..(1518): transl_table=11

SEQ ID NO: 74931 - protein, 505 aa, Mycobacterium avium subsp. paratuberculosis str. k10; identical to SEQ ID NO: 36583

SEQ ID NO: 74932 - DNA, 1353 bp, Lactobacillus johnsonii NCC 533; identical to SEQ ID NO: 36584
  CDS (1)..(1353): transl_table=11

SEQ ID NO: 74933 - protein, 450 aa, Lactobacillus johnsonii NCC 533; identical to SEQ ID NO: 36585

SEQ ID NO: 74934 - DNA, 1377 bp, Lactobacillus johnsonii NCC 533; identical to SEQ ID NO: 36586
  CDS (1)..(1377): transl_table=11

SEQ ID NO: 74935 - protein, 458 aa, Lactobacillus johnsonii NCC 533; identical to SEQ ID NO: 36587

SEQ ID NO: 74936 - DNA, 1311 bp, Lactobacillus johnsonii NCC 533; identical to SEQ ID NO: 36588
  CDS (1)..(1311): transl_table=11

SEQ ID NO: 74937 - protein, 436 aa, Lactobacillus johnsonii NCC 533; identical to SEQ ID NO: 36589

SEQ ID NO: 74938 - DNA, 1353 bp, Lactobacillus johnsonii NCC 533; identical to SEQ ID NO: 36590
  CDS (1)..(1353): transl_table=11

SEQ ID NO: 74939 - protein, 450 aa, Lactobacillus johnsonii NCC 533; identical to SEQ ID NO: 36591

SEQ ID NO: 74940 - DNA, 1389 bp, Lactobacillus johnsonii NCC 533; identical to SEQ ID NO: 36592
  CDS (1)..(1389): transl_table=11

SEQ ID NO: 74941 - protein, 462 aa, Lactobacillus johnsonii NCC 533; identical to SEQ ID NO: 36593

SEQ ID NO: 74942 - DNA, 1401 bp, Lactobacillus johnsonii NCC 533; identical to SEQ ID NO: 36594
  CDS (1)..(1401): transl_table=11

SEQ ID NO: 74943 - protein, 466 aa, Lactobacillus johnsonii NCC 533; identical to SEQ ID NO: 36595

SEQ ID NO: 74944 - DNA, 1398 bp, Lactobacillus johnsonii NCC 533; identical to SEQ ID NO: 36596
  CDS (1)..(1398): transl_table=11

SEQ ID NO: 74945 - protein, 465 aa, Lactobacillus johnsonii NCC 533; identical to SEQ ID NO: 36597

SEQ ID NO: 74946 - DNA, 1239 bp, Bdellovibrio bacteriovorus HD100; identical to SEQ ID NO: 36598
  CDS (1)..(1239): transl_table=11

SEQ ID NO: 74947 - protein, 412 aa, Bdellovibrio bacteriovorus HD100; identical to SEQ ID NO: 36599

SEQ ID NO: 74948 - DNA, 1281 bp, Treponema denticola ATCC 35405; identical to SEQ ID NO: 36600
  CDS (1)..(1281): transl_table=11

SEQ ID NO: 74949 - protein, 426 aa, Treponema denticola ATCC 35405; identical to SEQ ID NO: 36601

SEQ ID NO: 74950 - DNA, 1404 bp, Bacillus cereus ATCC 10987; identical to SEQ ID NO: 36602
  CDS (1)..(1404): transl_table=11

SEQ ID NO: 74951 - protein, 467 aa, Bacillus cereus ATCC 10987; identical to SEQ ID NO: 36603

SEQ ID NO: 74952 - DNA, 1416 bp, Bacillus cereus ATCC 10987; identical to SEQ ID NO: 36604
  CDS (1)..(1416): transl_table=11

SEQ ID NO: 74953 - protein, 471 aa, Bacillus cereus ATCC 10987; identical to SEQ ID NO: 36605

SEQ ID NO: 74954 - DNA, 1590 bp, Xenopus tropicalis; identical to SEQ ID NO: 36606
  CDS (1)..(1590)

SEQ ID NO: 74955 - protein, 529 aa, Xenopus tropicalis; identical to SEQ ID NO: 36607

SEQ ID NO: 74956 - DNA, 1527 bp, Xenopus tropicalis; identical to SEQ ID NO: 36608
  CDS (1)..(1527)

SEQ ID NO: 74957 - protein, 508 aa, Xenopus tropicalis; identical to SEQ ID NO: 36609

SEQ ID NO: 74958 - DNA, 1827 bp, Rattus norvegicus; identical to SEQ ID NO: 36610
  CDS (1)..(1827)

SEQ ID NO: 74959 - protein, 608 aa, Rattus norvegicus; identical to SEQ ID NO: 36611

SEQ ID NO: 74960 - DNA, 1908 bp, Rattus norvegicus; identical to SEQ ID NO: 36612
  CDS (1)..(1908)

SEQ ID NO: 74961 - protein, 635 aa, Rattus norvegicus; identical to SEQ ID NO: 36613

SEQ ID NO: 74962 - DNA, 1467 bp, Rattus norvegicus; identical to SEQ ID NO: 36614
  CDS (1)..(1467)

SEQ ID NO: 74963 - protein, 488 aa, Rattus norvegicus; identical to SEQ ID NO: 36615

SEQ ID NO: 74964 - DNA, 1575 bp, Anopheles gambiae str. PEST; identical to SEQ ID NO: 36616
  CDS (1)..(1575)

SEQ ID NO: 74965 - protein, 524 aa, Anopheles gambiae str. PEST; identical to SEQ ID NO: 36617

SEQ ID NO: 74966 - DNA, 1707 bp, Apis mellifera; identical to SEQ ID NO: 36618
  CDS (1)..(1707)

SEQ ID NO: 74967 - protein, 568 aa, Apis mellifera; identical to SEQ ID NO: 36619

SEQ ID NO: 74968 - DNA, 1656 bp, Apis mellifera; identical to SEQ ID NO: 36620
  CDS (1)..(1656)

SEQ ID NO: 74969 - protein, 551 aa, Apis mellifera; identical to SEQ ID NO: 36621

SEQ ID NO: 74970 - DNA, 2163 bp, Apis mellifera; identical to SEQ ID NO: 36622
  CDS (1)..(2163)

SEQ ID NO: 74971 - protein, 720 aa, Apis mellifera; identical to SEQ ID NO: 36623

SEQ ID NO: 74972 - DNA, 1446 bp, Apis mellifera; identical to SEQ ID NO: 36624
  CDS (1)..(1446)

SEQ ID NO: 74973 - protein, 481 aa, Apis mellifera; identical to SEQ ID NO: 36625

SEQ ID NO: 74974 - DNA, 2076 bp, Ustilago maydis 521; identical to SEQ ID NO: 36626
  CDS (1)..(2076)

SEQ ID NO: 74975 - protein, 691 aa, Ustilago maydis 521; identical to SEQ ID NO: 36627

SEQ ID NO: 74976 - DNA, 2328 bp, Gallus gallus; identical to SEQ ID NO: 36628
  CDS (1)..(2328)

SEQ ID NO: 74977 - protein, 775 aa, Gallus gallus; identical to SEQ ID NO: 36629

SEQ ID NO: 74978 - DNA, 1818 bp, Oryza sativa (japonica cultivar-group); identical to SEQ ID NO: 36630
  CDS (1)..(1818)

SEQ ID NO: 74979 - protein, 605 aa, Oryza sativa (japonica cultivar-group); identical to SEQ ID NO: 36631

SEQ ID NO: 74980 - DNA, 1920 bp, Oryza sativa (japonica cultivar-group); identical to SEQ ID NO: 36632
  CDS (1)..(1920)

SEQ ID NO: 74981 - protein, 639 aa, Oryza sativa (japonica cultivar-group); identical to SEQ ID NO: 36633

SEQ ID NO: 74982 - DNA, 1686 bp, Oryza sativa (japonica cultivar-group); identical to SEQ ID NO: 36634
  CDS (1)..(1686)

SEQ ID NO: 74983 - protein, 561 aa, Oryza sativa (japonica cultivar-group); identical to SEQ ID NO: 36635

SEQ ID NO: 74984 - DNA, 1599 bp, Yarrowia lipolytica CLIB99; identical to SEQ ID NO: 36636
  CDS (1)..(1599)

SEQ ID NO: 74985 - protein, 532 aa, Yarrowia lipolytica CLIB99; identical to SEQ ID NO: 36637

SEQ ID NO: 74986 - DNA, 1656 bp, Canis familiaris; identical to SEQ ID NO: 36638
  CDS (1)..(1656)

SEQ ID NO: 74987 - protein, 551 aa, Canis familiaris; identical to SEQ ID NO: 36639

SEQ ID NO: 74988 - DNA, 1599 bp, Canis familiaris; identical to SEQ ID NO: 36640
  CDS (1)..(1599)

SEQ ID NO: 74989 - protein, 532 aa, Canis familiaris; identical to SEQ ID NO: 36641

SEQ ID NO: 74990 - DNA, 1308 bp, Parachlamydia sp. UWE25; identical to SEQ ID NO: 36642
  CDS (1)..(1308): transl_table=11

SEQ ID NO: 74991 - protein, 435 aa, Parachlamydia sp. UWE25; identical to SEQ ID NO: 36643

SEQ ID NO: 74992 - DNA, 1332 bp, Picrophilus torridus DSM 9790; identical to SEQ ID NO: 36644
  CDS (1)..(1332): transl_table=11

SEQ ID NO: 74993 - protein, 443 aa, Picrophilus torridus DSM 9790; identical to SEQ ID NO: 36645

SEQ ID NO: 74994 - DNA, 1338 bp, Picrophilus torridus DSM 9790; identical to SEQ ID NO: 36646
  CDS (1)..(1338): transl_table=11

SEQ ID NO: 74995 - protein, 445 aa, Picrophilus torridus DSM 9790; identical to SEQ ID NO: 36647

SEQ ID NO: 74996 - DNA, 1404 bp, Bacillus thuringiensis serovar konkukian str. 97-27; identical to SEQ ID NO: 36648
  CDS (1)..(1404): transl_table=11

SEQ ID NO: 74997 - protein, 467 aa, Bacillus thuringiensis serovar konkukian str. 97-27; identical to SEQ ID NO: 36649

SEQ ID NO: 74998 - DNA, 1317 bp, Bacillus thuringiensis serovar konkukian str. 97-27; identical to SEQ ID NO: 36650
  CDS (1)..(1317): transl_table=11

SEQ ID NO: 74999 - protein, 438 aa, Bacillus thuringiensis serovar konkukian str. 97-27; identical to SEQ ID NO: 36651

SEQ ID NO: 75000 - DNA, 1485 bp, Acinetobacter sp. ADP1; identical to SEQ ID NO: 36652
  CDS (1)..(1485): transl_table=11

SEQ ID NO: 75001 - protein, 494 aa, Acinetobacter sp. ADP1; identical to SEQ ID NO: 36653

SEQ ID NO: 75002 - DNA, 1377 bp, Erwinia carotovora subsp. atroseptica SCRI1043; identical to SEQ ID NO: 36654
  CDS (1)..(1377)

SEQ ID NO: 75003 - protein, 458 aa, Erwinia carotovora subsp. atroseptica SCRI1043; identical to SEQ ID NO: 36655

SEQ ID NO: 75004 - DNA, 1449 bp, Propionibacterium acnes KPA171202; identical to SEQ ID NO: 36656
  CDS (1)..(1449): transl_table=11

SEQ ID NO: 75005 - protein, 482 aa, Propionibacterium acnes KPA171202; identical to SEQ ID NO: 36657

SEQ ID NO: 75006 - DNA, 1407 bp, Propionibacterium acnes KPA171202; identical to SEQ ID NO: 36658
  CDS (1)..(1407): transl_table=11

SEQ ID NO: 75007 - protein, 468 aa, Propionibacterium acnes KPA171202; identical to SEQ ID NO: 36659

SEQ ID NO: 75008 - DNA, 1461 bp, Streptococcus pyogenes MGAS10394; identical to SEQ ID NO: 36660
  CDS (1)..(1461): transl_table=11

SEQ ID NO: 75009 - protein, 486 aa, Streptococcus pyogenes MGAS10394; identical to SEQ ID NO: 36661

SEQ ID NO: 75010 - DNA, 1518 bp, Desulfotalea psychrophila LSv54; identical to SEQ ID NO: 36662
  CDS (1)..(1518): transl_table=11

SEQ ID NO: 75011 - protein, 505 aa, Desulfotalea psychrophila LSv54; identical to SEQ ID NO: 36663

SEQ ID NO: 75012 - DNA, 1407 bp, Rickettsia typhi str. Wilmington; identical to SEQ ID NO: 36664
  CDS (1)..(1407): transl_table=11

SEQ ID NO: 75013 - protein, 468 aa, Rickettsia typhi str. Wilmington; identical to SEQ ID NO: 36665

SEQ ID NO: 75014 - DNA, 1416 bp, Bacillus cereus ZK; identical to SEQ ID NO: 36666
  CDS (1)..(1416): transl_table=11

SEQ ID NO: 75015 - protein, 471 aa, Bacillus cereus ZK; identical to SEQ ID NO: 36667

SEQ ID NO: 75016 - DNA, 1404 bp, Bacillus cereus ZK; identical to SEQ ID NO: 36668
  CDS (1)..(1404): transl_table=11

SEQ ID NO: 75017 - protein, 467 aa, Bacillus cereus ZK; identical to SEQ ID NO: 36669

SEQ ID NO: 75018 - DNA, 1416 bp, Bacillus cereus ZK; identical to SEQ ID NO: 36670
  CDS (1)..(1416): transl_table=11

SEQ ID NO: 75019 - protein, 471 aa, Bacillus cereus ZK; identical to SEQ ID NO: 36671

SEQ ID NO: 75020 - DNA, 1287 bp, Bacillus cereus ZK; identical to SEQ ID NO: 36672
  CDS (1)..(1287): transl_table=11

SEQ ID NO: 75021 - protein, 428 aa, Bacillus cereus ZK; identical to SEQ ID NO: 36673

SEQ ID NO: 75022 - DNA, 1317 bp, Bacillus cereus ZK; identical to SEQ ID NO: 36674
  CDS (1)..(1317): transl_table=11

SEQ ID NO: 75023 - protein, 438 aa, Bacillus cereus ZK; identical to SEQ ID NO: 36675

SEQ ID NO: 75024 - DNA, 1329 bp, Bacillus licheniformis ATCC 14580; identical to SEQ ID NO: 36676
  CDS (1)..(1329): transl_table=11

SEQ ID NO: 75025 - protein, 442 aa, Bacillus licheniformis ATCC 14580; identical to SEQ ID NO: 36677

SEQ ID NO: 75026 - DNA, 1578 bp, Bacillus licheniformis ATCC 14580; identical to SEQ ID NO: 36678
  CDS (1)..(1578): transl_table=11

SEQ ID NO: 75027 - protein, 525 aa, Bacillus licheniformis ATCC 14580; identical to SEQ ID NO: 36679

SEQ ID NO: 75028 - DNA, 1668 bp, Bacteroides fragilis YCH46; identical to SEQ ID NO: 36680
  CDS (1)..(1668): transl_table=11

SEQ ID NO: 75029 - protein, 555 aa, Bacteroides fragilis YCH46; identical to SEQ ID NO: 36681

SEQ ID NO: 75030 - DNA, 1404 bp, Burkholderia mallei ATCC 23344; identical to SEQ ID NO: 36682
  CDS (1)..(1404): transl_table=11

SEQ ID NO: 75031 - protein, 467 aa, Burkholderia mallei ATCC 23344; identical to SEQ ID NO: 36683

SEQ ID NO: 75032 - DNA, 1404 bp, Burkholderia pseudomallei K96243; identical to SEQ ID NO: 36684
  CDS (1)..(1404): transl_table=11

SEQ ID NO: 75033 - protein, 467 aa, Burkholderia pseudomallei K96243; identical to SEQ ID NO: 36685

SEQ ID NO: 75034 - DNA, 1296 bp, Burkholderia pseudomallei K96243; identical to SEQ ID NO: 36686
  CDS (1)..(1296): transl_table=11

SEQ ID NO: 75035 - protein, 431 aa, Burkholderia pseudomallei K96243; identical to SEQ ID NO: 36687

SEQ ID NO: 75036 - DNA, 1398 bp, Methylococcus capsulatus str. Bath; identical to SEQ ID NO: 36688
  CDS (1)..(1398): transl_table=11

SEQ ID NO: 75037 - protein, 465 aa, Methylococcus capsulatus str. Bath; identical to SEQ ID NO: 36689

SEQ ID NO: 75038 - DNA, 1422 bp, Methylococcus capsulatus str. Bath; identical to SEQ ID NO: 36690
  CDS (1)..(1422): transl_table=11

SEQ ID NO: 75039 - protein, 473 aa, Methylococcus capsulatus str. Bath; identical to SEQ ID NO: 36691

SEQ ID NO: 75040 - DNA, 1293 bp, Methylococcus capsulatus str. Bath; identical to SEQ ID NO: 36692
  CDS (1)..(1293): transl_table=11

SEQ ID NO: 75041 - protein, 430 aa, Methylococcus capsulatus str. Bath; identical to SEQ ID NO: 36693

SEQ ID NO: 75042 - DNA, 1338 bp, Nocardia farcinica IFM 10152; identical to SEQ ID NO: 36694
  CDS (1)..(1338): transl_table=11

SEQ ID NO: 75043 - protein, 445 aa, Nocardia farcinica IFM 10152; identical to SEQ ID NO: 36695

SEQ ID NO: 75044 - DNA, 1488 bp, Nocardia farcinica IFM 10152; identical to SEQ ID NO: 36696
  CDS (1)..(1488): transl_table=11

SEQ ID NO: 75045 - protein, 495 aa, Nocardia farcinica IFM 10152; identical to SEQ ID NO: 36697

SEQ ID NO: 75046 - DNA, 1296 bp, Legionella pneumophila str. Paris; identical to SEQ ID NO: 36698
  CDS (1)..(1296): transl_table=11

SEQ ID NO: 75047 - protein, 431 aa, Legionella pneumophila str. Paris; identical to SEQ ID NO: 36699

SEQ ID NO: 75048 - DNA, 1185 bp, Legionella pneumophila str. Paris; identical to SEQ ID NO: 36700
  CDS (1)..(1185): transl_table=11

SEQ ID NO: 75049 - protein, 394 aa, Legionella pneumophila str. Paris; identical to SEQ ID NO: 36701

SEQ ID NO: 75050 - DNA, 1185 bp, Legionella pneumophila str. Lens; identical to SEQ ID NO: 36702
  CDS (1)..(1185): transl_table=11

SEQ ID NO: 75051 - protein, 394 aa, Legionella pneumophila str. Lens; identical to SEQ ID NO: 36703

SEQ ID NO: 75052 - DNA, 1455 bp, Haloarcula marismortui ATCC 43049; identical to SEQ ID NO: 36704
  CDS (1)..(1455): transl_table=11

SEQ ID NO: 75053 - protein, 484 aa, Haloarcula marismortui ATCC 43049; identical to SEQ ID NO: 36705

SEQ ID NO: 75054 - DNA, 2265 bp, Haloarcula marismortui ATCC 43049; identical to SEQ ID NO: 36706
  CDS (1)..(2265): transl_table=11

SEQ ID NO: 75055 - protein, 754 aa, Haloarcula marismortui ATCC 43049; identical to SEQ ID NO: 36707

SEQ ID NO: 75056 - DNA, 2205 bp, Haloarcula marismortui ATCC 43049; identical to SEQ ID NO: 36708
  CDS (1)..(2205): transl_table=11

SEQ ID NO: 75057 - protein, 734 aa, Haloarcula marismortui ATCC 43049; identical to SEQ ID NO: 36709

SEQ ID NO: 75058 - DNA, 1386 bp, Streptococcus thermophilus LMG 18311; identical to SEQ ID NO: 36710
  CDS (1)..(1386): transl_table=11

SEQ ID NO: 75059 - protein, 461 aa, Streptococcus thermophilus LMG 18311; identical to SEQ ID NO: 36711

SEQ ID NO: 75060 - DNA, 1386 bp, Streptococcus thermophilus CNRZ1066; identical to SEQ ID NO: 36712
  CDS (1)..(1386): transl_table=11

SEQ ID NO: 75061 - protein, 461 aa, Streptococcus thermophilus CNRZ1066; identical to SEQ ID NO: 36713

SEQ ID NO: 75062 - DNA, 1416 bp, Geobacillus kaustophilus HTA426; identical to SEQ ID NO: 36714
  CDS (1)..(1416): transl_table=11

SEQ ID NO: 75063 - protein, 471 aa, Geobacillus kaustophilus HTA426; identical to SEQ ID NO: 36715

SEQ ID NO: 75064 - DNA, 1365 bp, Geobacillus kaustophilus HTA426; identical to SEQ ID NO: 36716
  CDS (1)..(1365): transl_table=11

SEQ ID NO: 75065 - protein, 454 aa, Geobacillus kaustophilus HTA426; identical to SEQ ID NO: 36717

SEQ ID NO: 75066 - DNA, 1407 bp, Salmonella enterica subsp. enterica serovar Paratypi A str. ATCC; identical to SEQ ID NO: 36718
  CDS (1)..(1407): transl_table=11

SEQ ID NO: 75067 - protein, 468 aa, Salmonella enterica subsp. enterica serovar Paratypi A str. ATCC; identical to SEQ ID NO: 36719

SEQ ID NO: 75068 - DNA, 1371 bp, Salmonella enterica subsp. enterica serovar Paratypi A str. ATCC; identical to SEQ ID NO: 36720
  CDS (1)..(1371): transl_table=11

SEQ ID NO: 75069 - protein, 456 aa, Salmonella enterica subsp. enterica serovar Paratypi A str. ATCC; identical to SEQ ID NO: 36721

SEQ ID NO: 75070 - DNA, 1311 bp, Idiomarina loihiensis L2TR; identical to SEQ ID NO: 36722
  CDS (1)..(1311): transl_table=11

SEQ ID NO: 75071 - protein, 436 aa, Idiomarina loihiensis L2TR; identical to SEQ ID NO: 36723

SEQ ID NO: 75072 - DNA, 1221 bp, Idiomarina loihiensis L2TR; identical to SEQ ID NO: 36724
  CDS (1)..(1221): transl_table=11

SEQ ID NO: 75073 - protein, 406 aa, Idiomarina loihiensis L2TR; identical to SEQ ID NO: 36725

SEQ ID NO: 75074 - DNA, 1497 bp, Zymomonas mobilis subsp. mobilis ZM4; identical to SEQ ID NO: 36726
  CDS (1)..(1497): transl_table=11

SEQ ID NO: 75075 - protein, 498 aa, Zymomonas mobilis subsp. mobilis ZM4; identical to SEQ ID NO: 36727

SEQ ID NO: 75076 - DNA, 1434 bp, Zymomonas mobilis subsp. mobilis ZM4; identical to SEQ ID NO: 36728
  CDS (1)..(1434): transl_table=11

SEQ ID NO: 75077 - protein, 477 aa, Zymomonas mobilis subsp. mobilis ZM4; identical to SEQ ID NO: 36729

SEQ ID NO: 75078 - DNA, 1347 bp, Silicibacter pomeroyi DSS-3; identical to SEQ ID NO: 36730
  CDS (1)..(1347): transl_table=11

SEQ ID NO: 75079 - protein, 448 aa, Silicibacter pomeroyi DSS-3; identical to SEQ ID NO: 36731

SEQ ID NO: 75080 - DNA, 1209 bp, Silicibacter pomeroyi DSS-3; identical to SEQ ID NO: 36732
  CDS (1)..(1209): transl_table=11

SEQ ID NO: 75081 - protein, 402 aa, Silicibacter pomeroyi DSS-3; identical to SEQ ID NO: 36733

SEQ ID NO: 75082 - DNA, 1443 bp, Xylella fastidiosa Dixon; identical to SEQ ID NO: 36734
  CDS (1)..(1443)

SEQ ID NO: 75083 - protein, 480 aa, Xylella fastidiosa Dixon; identical to SEQ ID NO: 36735

SEQ ID NO: 75084 - DNA, 1443 bp, Xylella fastidiosa Ann-1; identical to SEQ ID NO: 36736
  CDS (1)..(1443)

SEQ ID NO: 75085 - protein, 480 aa, Xylella fastidiosa Ann-1; identical to SEQ ID NO: 36737

SEQ ID NO: 75086 - DNA, 1437 bp, Xylella fastidiosa Ann-1; identical to SEQ ID NO: 36738
  CDS (1)..(1437)

SEQ ID NO: 75087 - protein, 478 aa, Xylella fastidiosa Ann-1; identical to SEQ ID NO: 36739

SEQ ID NO: 75088 - DNA, 1491 bp, Xylella fastidiosa Ann-1; identical to SEQ ID NO: 36740
  CDS (1)..(1491)

SEQ ID NO: 75089 - protein, 496 aa, Xylella fastidiosa Ann-1; identical to SEQ ID NO: 36741

SEQ ID NO: 75090 - DNA, 1329 bp, Lactobacillus gasseri; identical to SEQ ID NO: 36742
  CDS (1)..(1329)

SEQ ID NO: 75091 - protein, 442 aa, Lactobacillus gasseri; identical to SEQ ID NO: 36743

SEQ ID NO: 75092 - DNA, 1401 bp, Lactobacillus gasseri; identical to SEQ ID NO: 36744
  CDS (1)..(1401)

SEQ ID NO: 75093 - protein, 466 aa, Lactobacillus gasseri; identical to SEQ ID NO: 36745

SEQ ID NO: 75094 - DNA, 1332 bp, Leuconostoc mesenteroides subsp. mesenteroides ATCC 8293; identical to SEQ ID NO: 36746
  CDS (1)..(1332)

SEQ ID NO: 75095 - protein, 443 aa, Leuconostoc mesenteroides subsp. mesenteroides ATCC 8293; identical to SEQ ID NO: 36747

SEQ ID NO: 75096 - DNA, 1401 bp, Leuconostoc mesenteroides subsp. mesenteroides ATCC 8293; identical to SEQ ID NO: 36748
  CDS (1)..(1401)

SEQ ID NO: 75097 - protein, 466 aa, Leuconostoc mesenteroides subsp. mesenteroides ATCC 8293; identical to SEQ ID NO: 36749

SEQ ID NO: 75098 - DNA, 1332 bp, Leuconostoc mesenteroides subsp. mesenteroides ATCC 8293; identical to SEQ ID NO: 36750
  CDS (1)..(1332)

SEQ ID NO: 75099 - protein, 443 aa, Leuconostoc mesenteroides subsp. mesenteroides ATCC 8293; identical to SEQ ID NO: 36751

SEQ ID NO: 75100 - DNA, 1314 bp, Pseudomonas syringae pv. syringae B728a; identical to SEQ ID NO: 36752
  CDS (1)..(1314)

SEQ ID NO: 75101 - protein, 437 aa, Pseudomonas syringae pv. syringae B728a; identical to SEQ ID NO: 36753

SEQ ID NO: 75102 - DNA, 1284 bp, Rickettsia sibirica 246; identical to SEQ ID NO: 36754
  CDS (1)..(1284): transl_table=11

SEQ ID NO: 75103 - protein, 427 aa, Rickettsia sibirica 246; identical to SEQ ID NO: 36755

SEQ ID NO: 75104 - DNA, 1443 bp, Psychrobacter sp. 273-4; identical to SEQ ID NO: 36756
  CDS (1)..(1443)

SEQ ID NO: 75105 - protein, 480 aa, Psychrobacter sp. 273-4; identical to SEQ ID NO: 36757

SEQ ID NO: 75106 - DNA, 1446 bp, Rickettsia rickettsii; identical to SEQ ID NO: 36758
  CDS (1)..(1446)

SEQ ID NO: 75107 - protein, 481 aa, Rickettsia rickettsii; identical to SEQ ID NO: 36759

SEQ ID NO: 75108 - DNA, 1284 bp, Rickettsia rickettsii; identical to SEQ ID NO: 36760
  CDS (1)..(1284)

SEQ ID NO: 75109 - protein, 427 aa, Rickettsia rickettsii; identical to SEQ ID NO: 36761

SEQ ID NO: 75110 - DNA, 1359 bp, Anabaena variabilis ATCC 29413; identical to SEQ ID NO: 36762
  CDS (1)..(1359)

SEQ ID NO: 75111 - protein, 452 aa, Anabaena variabilis ATCC 29413; identical to SEQ ID NO: 36763

SEQ ID NO: 75112 - DNA, 1365 bp, Ralstonia eutropha JMP134; identical to SEQ ID NO: 36764
  CDS (1)..(1365)

SEQ ID NO: 75113 - protein, 454 aa, Ralstonia eutropha JMP134; identical to SEQ ID NO: 36765

SEQ ID NO: 75114 - DNA, 1383 bp, Ralstonia eutropha JMP134; identical to SEQ ID NO: 36766
  CDS (1)..(1383)

SEQ ID NO: 75115 - protein, 460 aa, Ralstonia eutropha JMP134; identical to SEQ ID NO: 36767

SEQ ID NO: 75116 - DNA, 1398 bp, Ralstonia eutropha JMP134; identical to SEQ ID NO: 36768
  CDS (1)..(1398)

SEQ ID NO: 75117 - protein, 465 aa, Ralstonia eutropha JMP134; identical to SEQ ID NO: 36769

SEQ ID NO: 75118 - DNA, 1407 bp, Methylobacillus flagellatus KT; identical to SEQ ID NO: 36770
  CDS (1)..(1407)

SEQ ID NO: 75119 - protein, 468 aa, Methylobacillus flagellatus KT; identical to SEQ ID NO: 36771

SEQ ID NO: 75120 - DNA, 1389 bp, Exiguobacterium sp. 255-15; identical to SEQ ID NO: 36772
  CDS (1)..(1389)

SEQ ID NO: 75121 - protein, 462 aa, Exiguobacterium sp. 255-15; identical to SEQ ID NO: 36773

SEQ ID NO: 75122 - DNA, 1401 bp, Exiguobacterium sp. 255-15; identical to SEQ ID NO: 36774
  CDS (1)..(1401)

SEQ ID NO: 75123 - protein, 466 aa, Exiguobacterium sp. 255-15; identical to SEQ ID NO: 36775

SEQ ID NO: 75124 - DNA, 1506 bp, Rubrobacter xylanophilus DSM 9941; identical to SEQ ID NO: 36776
  CDS (1)..(1506)

SEQ ID NO: 75125 - protein, 501 aa, Rubrobacter xylanophilus DSM 9941; identical to SEQ ID NO: 36777

SEQ ID NO: 75126 - DNA, 1341 bp, Rubrobacter xylanophilus DSM 9941; identical to SEQ ID NO: 36778
  CDS (1)..(1341)

SEQ ID NO: 75127 - protein, 446 aa, Rubrobacter xylanophilus DSM 9941; identical to SEQ ID NO: 36779

SEQ ID NO: 75128 - DNA, 1422 bp, Rubrobacter xylanophilus DSM 9941; identical to SEQ ID NO: 36780
  CDS (1)..(1422)

SEQ ID NO: 75129 - protein, 473 aa, Rubrobacter xylanophilus DSM 9941; identical to SEQ ID NO: 36781

SEQ ID NO: 75130 - DNA, 1302 bp, Methanococcoides burtonii DSM 6242; identical to SEQ ID NO: 36782
  CDS (1)..(1302)

SEQ ID NO: 75131 - protein, 433 aa, Methanococcoides burtonii DSM 6242; identical to SEQ ID NO: 36783

SEQ ID NO: 75132 - DNA, 1374 bp, Burkholderia cepacia R18194; identical to SEQ ID NO: 36784
  CDS (1)..(1374)

SEQ ID NO: 75133 - protein, 457 aa, Burkholderia cepacia R18194; identical to SEQ ID NO: 36785

SEQ ID NO: 75134 - DNA, 1275 bp, Burkholderia cepacia R18194; identical to SEQ ID NO: 36786
  CDS (1)..(1275)

SEQ ID NO: 75135 - protein, 424 aa, Burkholderia cepacia R18194; identical to SEQ ID NO: 36787

SEQ ID NO: 75136 - DNA, 1359 bp, Burkholderia cepacia R18194; identical to SEQ ID NO: 36788
  CDS (1)..(1359)

SEQ ID NO: 75137 - protein, 452 aa, Burkholderia cepacia R18194; identical to SEQ ID NO: 36789

SEQ ID NO: 75138 - DNA, 1407 bp, Burkholderia cepacia R1808; identical to SEQ ID NO: 36790
  CDS (1)..(1407)

SEQ ID NO: 75139 - protein, 468 aa, Burkholderia cepacia R1808; identical to SEQ ID NO: 36791

SEQ ID NO: 75140 - DNA, 1392 bp, Listeria monocytogenes str. 1/2a F6854; identical to SEQ ID NO: 36792
  CDS (1)..(1392): transl_table=11

SEQ ID NO: 75141 - protein, 463 aa, Listeria monocytogenes str. 1/2a F6854; identical to SEQ ID NO: 36793

SEQ ID NO: 75142 - DNA, 1461 bp, Bacillus cereus G9241; identical to SEQ ID NO: 36794
  CDS (1)..(1461): transl_table=11

SEQ ID NO: 75143 - protein, 486 aa, Bacillus cereus G9241; identical to SEQ ID NO: 36795

SEQ ID NO: 75144 - DNA, 1317 bp, Bacillus cereus G9241; identical to SEQ ID NO: 36796
  CDS (1)..(1317): transl_table=11

SEQ ID NO: 75145 - protein, 438 aa, Bacillus cereus G9241; identical to SEQ ID NO: 36797

SEQ ID NO: 75146 - DNA, 1320 bp, Bacillus cereus G9241; identical to SEQ ID NO: 36798
  CDS (1)..(1320): transl_table=11

SEQ ID NO: 75147 - protein, 439 aa, Bacillus cereus G9241; identical to SEQ ID NO: 36799

SEQ ID NO: 75148 - DNA, 1416 bp, Bacillus cereus G9241; identical to SEQ ID NO: 36800
  CDS (1)..(1416): transl_table=11

SEQ ID NO: 75149 - protein, 471 aa, Bacillus cereus G9241; identical to SEQ ID NO: 36801

SEQ ID NO: 75150 - DNA, 1377 bp, Bacillus cereus G9241; identical to SEQ ID NO: 36802
  CDS (1)..(1377): transl_table=11

SEQ ID NO: 75151 - protein, 458 aa, Bacillus cereus G9241; identical to SEQ ID NO: 36803

SEQ ID NO: 75152 - DNA, 1410 bp, Ralstonia metallidurans CH34; identical to SEQ ID NO: 36804
  CDS (1)..(1410)

SEQ ID NO: 75153 - protein, 469 aa, Ralstonia metallidurans CH34; identical to SEQ ID NO: 36805

SEQ ID NO: 75154 - DNA, 1392 bp, Burkholderia fungorum LB400; identical to SEQ ID NO: 36806
  CDS (1)..(1392)

SEQ ID NO: 75155 - protein, 463 aa, Burkholderia fungorum LB400; identical to SEQ ID NO: 36807

SEQ ID NO: 75156 - DNA, 1350 bp, Enterococcus faecium; identical to SEQ ID NO: 36808
  CDS (1)..(1350)

SEQ ID NO: 75157 - protein, 449 aa, Enterococcus faecium; identical to SEQ ID NO: 36809

SEQ ID NO: 75158 - DNA, 1356 bp, Enterococcus faecium; identical to SEQ ID NO: 36810
  CDS (1)..(1356)

SEQ ID NO: 75159 - protein, 451 aa, Enterococcus faecium; identical to SEQ ID NO: 36811

SEQ ID NO: 75160 - DNA, 1377 bp, Enterococcus faecium; identical to SEQ ID NO: 36812
  CDS (1)..(1377)

SEQ ID NO: 75161 - protein, 458 aa, Enterococcus faecium; identical to SEQ ID NO: 36813

SEQ ID NO: 75162 - DNA, 1503 bp, Thermobifida fusca; identical to SEQ ID NO: 36814
  CDS (1)..(1503)

SEQ ID NO: 75163 - protein, 500 aa, Thermobifida fusca; identical to SEQ ID NO: 36815

SEQ ID NO: 75164 - DNA, 1269 bp, Methanosarcina barkeri str. fusaro; identical to SEQ ID NO: 36816
  CDS (1)..(1269)

SEQ ID NO: 75165 - protein, 422 aa, Methanosarcina barkeri str. fusaro; identical to SEQ ID NO: 36817

SEQ ID NO: 75166 - DNA, 1578 bp, Novosphingobium aromaticivorans DSM 12444; identical to SEQ ID NO: 36818
  CDS (1)..(1578)

SEQ ID NO: 75167 - protein, 525 aa, Novosphingobium aromaticivorans DSM 12444; identical to SEQ ID NO: 36819

SEQ ID NO: 75168 - DNA, 1317 bp, Novosphingobium aromaticivorans DSM 12444; identical to SEQ ID NO: 36820
  CDS (1)..(1317)

SEQ ID NO: 75169 - protein, 438 aa, Novosphingobium aromaticivorans DSM 12444; identical to SEQ ID NO: 36821

SEQ ID NO: 75170 - DNA, 1596 bp, Ferroplasma acidarmanus; identical to SEQ ID NO: 36822
  CDS (1)..(1596)

SEQ ID NO: 75171 - protein, 531 aa, Ferroplasma acidarmanus; identical to SEQ ID NO: 36823

SEQ ID NO: 75172 - DNA, 1323 bp, Ferroplasma acidarmanus; identical to SEQ ID NO: 36824
  CDS (1)..(1323)

SEQ ID NO: 75173 - protein, 440 aa, Ferroplasma acidarmanus; identical to SEQ ID NO: 36825

SEQ ID NO: 75174 - DNA, 1365 bp, Ferroplasma acidarmanus; identical to SEQ ID NO: 36826
  CDS (1)..(1365)

SEQ ID NO: 75175 - protein, 454 aa, Ferroplasma acidarmanus; identical to SEQ ID NO: 36827

SEQ ID NO: 75176 - DNA, 1560 bp, Ferroplasma acidarmanus; identical to SEQ ID NO: 36828
  CDS (1)..(1560)

SEQ ID NO: 75177 - protein, 519 aa, Ferroplasma acidarmanus; identical to SEQ ID NO: 36829

SEQ ID NO: 75178 - DNA, 1443 bp, Cytophaga hutchinsonii; identical to SEQ ID NO: 36830
  CDS (1)..(1443)

SEQ ID NO: 75179 - protein, 480 aa, Cytophaga hutchinsonii; identical to SEQ ID NO: 36831

SEQ ID NO: 75180 - DNA, 1314 bp, Microbulbifer degradans 2-40; identical to SEQ ID NO: 36832
  CDS (1)..(1314)

SEQ ID NO: 75181 - protein, 437 aa, Microbulbifer degradans 2-40; identical to SEQ ID NO: 36833

SEQ ID NO: 75182 - DNA, 1359 bp, Oenococcus oeni PSU-1; identical to SEQ ID NO: 36834
  CDS (1)..(1359)

SEQ ID NO: 75183 - protein, 452 aa, Oenococcus oeni PSU-1; identical to SEQ ID NO: 36835

SEQ ID NO: 75184 - DNA, 1437 bp, Oenococcus oeni PSU-1; identical to SEQ ID NO: 36836
  CDS (1)..(1437)

SEQ ID NO: 75185 - protein, 478 aa, Oenococcus oeni PSU-1; identical to SEQ ID NO: 36837

SEQ ID NO: 75186 - DNA, 1422 bp, Pediococcus pentosaceus ATCC 25745; identical to SEQ ID NO: 36838
  CDS (1)..(1422)

SEQ ID NO: 75187 - protein, 473 aa, Pediococcus pentosaceus ATCC 25745; identical to SEQ ID NO: 36839

SEQ ID NO: 75188 - DNA, 1302 bp, Trichodesmium erythraeum IMS101; identical to SEQ ID NO: 36840
  CDS (1)..(1302)

SEQ ID NO: 75189 - protein, 433 aa, Trichodesmium erythraeum IMS101; identical to SEQ ID NO: 36841

SEQ ID NO: 75190 - DNA, 1566 bp, Moorella thermoacetica ATCC 39073; identical to SEQ ID NO: 36842
  CDS (1)..(1566)

SEQ ID NO: 75191 - protein, 521 aa, Moorella thermoacetica ATCC 39073; identical to SEQ ID NO: 36843

SEQ ID NO: 75192 - DNA, 1521 bp, Moorella thermoacetica ATCC 39073; identical to SEQ ID NO: 36844
  CDS (1)..(1521)

SEQ ID NO: 75193 - protein, 506 aa, Moorella thermoacetica ATCC 39073; identical to SEQ ID NO: 36845

SEQ ID NO: 75194 - DNA, 1401 bp, Moorella thermoacetica ATCC 39073; identical to SEQ ID NO: 36846
  CDS (1)..(1401)

SEQ ID NO: 75195 - protein, 466 aa, Moorella thermoacetica ATCC 39073; identical to SEQ ID NO: 36847

SEQ ID NO: 75196 - DNA, 1392 bp, Rickettsia akari str. Hartford; identical to SEQ ID NO: 36848
  CDS (1)..(1392)

SEQ ID NO: 75197 - protein, 463 aa, Rickettsia akari str. Hartford; identical to SEQ ID NO: 36849

SEQ ID NO: 75198 - DNA, 1290 bp, Rickettsia akari str. Hartford; identical to SEQ ID NO: 36850
  CDS (1)..(1290)

SEQ ID NO: 75199 - protein, 429 aa, Rickettsia akari str. Hartford; identical to SEQ ID NO: 36851

SEQ ID NO: 75200 - DNA, 1356 bp, Pseudomonas aeruginosa UCBPP-PA14; identical to SEQ ID NO: 36852
  CDS (1)..(1356)

SEQ ID NO: 75201 - protein, 451 aa, Pseudomonas aeruginosa UCBPP-PA14; identical to SEQ ID NO: 36853

SEQ ID NO: 75202 - DNA, 1389 bp, Bacillus subtilis; identical to SEQ ID NO: 36854
  CDS (1)..(1389): transl_table=11

SEQ ID NO: 75203 - protein, 462 aa, Bacillus subtilis; identical to SEQ ID NO: 36855

SEQ ID NO: 75204 - DNA, 1512 bp, Schistosoma mansoni; identical to SEQ ID NO: 36856
  CDS (1)..(1512)

SEQ ID NO: 75205 - protein, 503 aa, Schistosoma mansoni; identical to SEQ ID NO: 36857

SEQ ID NO: 75206 - DNA, 1281 bp, Aeromonas salmonicida; identical to SEQ ID NO: 36858
  CDS (1)..(1281): transl_table=11

SEQ ID NO: 75207 - protein, 426 aa, Aeromonas salmonicida; identical to SEQ ID NO: 36859

SEQ ID NO: 75208 - DNA, 1608 bp, Pongo pygmaeus; identical to SEQ ID NO: 36860
  CDS (1)..(1608)

SEQ ID NO: 75209 - protein, 535 aa, Pongo pygmaeus; identical to SEQ ID NO: 36861

SEQ ID NO: 75210 - DNA, 1608 bp, Pongo pygmaeus; identical to SEQ ID NO: 36862
  CDS (1)..(1608)

SEQ ID NO: 75211 - protein, 535 aa, Pongo pygmaeus; identical to SEQ ID NO: 36863

SEQ ID NO: 75212 - DNA, 1455 bp, Xenopus tropicalis; identical to SEQ ID NO: 36864
  CDS (1)..(1455)

SEQ ID NO: 75213 - protein, 484 aa, Xenopus tropicalis; identical to SEQ ID NO: 36865

SEQ ID NO: 75214 - DNA, 1791 bp, Oryza sativa; identical to SEQ ID NO: 36866
  CDS (1)..(1791)

SEQ ID NO: 75215 - protein, 596 aa, Oryza sativa; identical to SEQ ID NO: 36867

SEQ ID NO: 75216 - DNA, 1581 bp, Gallus gallus; identical to SEQ ID NO: 36868
  CDS (1)..(1581)

SEQ ID NO: 75217 - protein, 526 aa, Gallus gallus; identical to SEQ ID NO: 36869

SEQ ID NO: 75218 - DNA, 1869 bp, Xenopus laevis; identical to SEQ ID NO: 36870
  CDS (1)..(1869)

SEQ ID NO: 75219 - protein, 622 aa, Xenopus laevis [sequence omitted]

SEQ ID NO: 75220 - DNA, 1908 bp, Homo sapiens; identical to SEQ ID NO: 36872
  CDS (1)..(1908)

SEQ ID NO: 75221 - protein, 635 aa, Homo sapiens [sequence omitted]

SEQ ID NO: 75222 - DNA, 1986 bp, Xenopus laevis; identical to SEQ ID NO: 36874
  CDS (1)..(1986)

SEQ ID NO: 75223 - protein, 661 aa, Xenopus laevis; identical to SEQ ID NO: 36875

SEQ ID NO: 75224 - DNA, 1245 bp, Xenopus laevis; identical to SEQ ID NO: 36876
  CDS (1)..(1245)

SEQ ID NO: 75225 - protein, 414 aa, Xenopus laevis; identical to SEQ ID NO: 36877

SEQ ID NO: 75226 - DNA, 1713 bp, Rhodococcus erythropolis; identical to SEQ ID NO: 36878
  CDS (1)..(1713)

SEQ ID NO: 75227 - protein, 570 aa, Rhodococcus erythropolis; identical to SEQ ID NO: 36879

SEQ ID NO: 75228 - DNA, 1611 bp, Didelphis marsupialis virginiana; identical to SEQ ID NO: 36880
  CDS (1)..(1611)

SEQ ID NO: 75229 - protein, 536 aa, Didelphis marsupialis virginiana; identical to SEQ ID NO: 36881

SEQ ID NO: 75230 - DNA, 1584 bp, Xenopus laevis; identical to SEQ ID NO: 36882
  CDS (1)..(1584)

SEQ ID NO: 75231 - protein, 527 aa, Xenopus laevis; identical to SEQ ID NO: 36883

SEQ ID NO: 75232 - DNA, 1590 bp, Xenopus laevis; identical to SEQ ID NO: 36884
  CDS (1)..(1590)

SEQ ID NO: 75233 - protein, 529 aa, Xenopus laevis; identical to SEQ ID NO: 36885

SEQ ID NO: 75234 - DNA, 1317 bp, Shigella flexneri; identical to SEQ ID NO: 36886
  CDS (1)..(1317)

SEQ ID NO: 75235 - protein, 438 aa, Shigella flexneri; identical to SEQ ID NO: 36887

SEQ ID NO: 75236 - DNA, 1377 bp, Shigella flexneri; identical to SEQ ID NO: 36888
  CDS (1)..(1377)

SEQ ID NO: 75237 - protein, 458 aa, Shigella flexneri; identical to SEQ ID NO: 36889

SEQ ID NO: 75238 - DNA, 1908 bp, Arabidopsis thaliana; identical to SEQ ID NO: 36890
  CDS (1)..(1908)

SEQ ID NO: 75239 - protein, 635 aa, Arabidopsis thaliana; identical to SEQ ID NO: 36891

SEQ ID NO: 75240 - DNA, 1497 bp, Rhodococcus sp; identical to SEQ ID NO: 36892
  CDS (1)..(1497): transl_table=11

SEQ ID NO: 75241 - protein, 498 aa, Rhodococcus sp; identical to SEQ ID NO: 36893

SEQ ID NO: 75242 - DNA, 1857 bp, Oryza sativa; identical to SEQ ID NO: 36894
  CDS (1)..(1857)

SEQ ID NO: 75243 - protein, 618 aa, Oryza sativa; identical to SEQ ID NO: 36895

SEQ ID NO: 75244 - DNA, 1602 bp, Arabidopsis thaliana; identical to SEQ ID NO: 36896
  CDS (1)..(1602)

SEQ ID NO: 75245 - protein, 533 aa, Arabidopsis thaliana; identical to SEQ ID NO: 36897

SEQ ID NO: 75246 - DNA, 1524 bp, Homo sapiens; identical to SEQ ID NO: 36898
  CDS (1)..(1524)

SEQ ID NO: 75247 - protein, 507 aa, Homo sapiens; identical to SEQ ID NO: 36899

SEQ ID NO: 75248 - DNA, 1485 bp, Homo sapiens; identical to SEQ ID NO: 36900
  CDS (1)..(1485)

SEQ ID NO: 75249 - protein, 494 aa, Homo sapiens; identical to SEQ ID NO: 36901

SEQ ID NO: 75250 - DNA, 1851 bp, Arabidopsis thaliana; identical to SEQ ID NO: 36902
  CDS (1)..(1851)

SEQ ID NO: 75251 - protein, 616 aa, Arabidopsis thaliana; identical to SEQ ID NO: 36903

SEQ ID NO: 75252 - DNA, 1845 bp, Arabidopsis thaliana; identical to SEQ ID NO: 36904
  CDS (1)..(1845)

SEQ ID NO: 75253 - protein, 614 aa, Arabidopsis thaliana; identical to SEQ ID NO: 36905

SEQ ID NO: 75254 - DNA, 1608 bp, Oryctolagus cuniculus; identical to SEQ ID NO: 36906
  CDS (1)..(1608)

SEQ ID NO: 75255 - protein, 535 aa, Oryctolagus cuniculus; identical to SEQ ID NO: 36907

SEQ ID NO: 75256 - DNA, 1845 bp, Arabidopsis thaliana; identical to SEQ ID NO: 36908
  CDS (1)..(1845)

SEQ ID NO: 75257 - protein, 614 aa, Arabidopsis thaliana; identical to SEQ ID NO: 36909

SEQ ID NO: 75258 - DNA, 1593 bp, Mus musculus; identical to SEQ ID NO: 36910
  CDS (1)..(1593)

SEQ ID NO: 75259 - protein, 530 aa, Mus musculus; identical to SEQ ID NO: 36911

SEQ ID NO: 75260 - DNA, 1500 bp, Escherichia coli; identical to SEQ ID NO: 36912
  CDS (1)..(1500)

SEQ ID NO: 75261 - protein, 499 aa, Escherichia coli; identical to SEQ ID NO: 9412

SEQ ID NO: 75262 - DNA, 1494 bp, Salmonella typhimurium; identical to SEQ ID NO: 36914
  CDS (1)..(1494): transl_table=11

SEQ ID NO: 75263 - protein, 497 aa, Salmonella typhimurium; identical to SEQ ID NO: 36915

SEQ ID NO: 75264 - DNA, 1470 bp, Streptomyces coelicolor; identical to SEQ ID NO: 36916
  CDS (1)..(1470): transl_table=11

SEQ ID NO: 75265 - protein, 489 aa, Streptomyces coelicolor; identical to SEQ ID NO: 9150

SEQ ID NO: 75266 - DNA, 1563 bp, Bacillus subtilis; identical to SEQ ID NO: 36918
  CDS (1)..(1563): transl_table=11

SEQ ID NO: 75267 - protein, 520 aa, Bacillus subtilis; identical to SEQ ID NO: 36919

SEQ ID NO: 75268 - DNA, 1602 bp, Rattus norvegicus; identical to SEQ ID NO: 36920
  CDS (1)..(1602)

SEQ ID NO: 75269 - protein, 533 aa, Rattus norvegicus; identical to SEQ ID NO: 36921

SEQ ID NO: 75270 - DNA, 1374 bp, Escherichia coli; identical to SEQ ID NO: 36922
  CDS (1)..(1374): transl_table=11

SEQ ID NO: 75271 - protein, 457 aa, Escherichia coli; identical to SEQ ID NO: 9056

SEQ ID NO: 75272 - DNA, 1371 bp, Salmonella typhimurium; identical to SEQ ID NO: 36924
  CDS (1)..(1371): transl_table=11

SEQ ID NO: 75273 - protein, 456 aa, Salmonella typhimurium; identical to SEQ ID NO: 9418

SEQ ID NO: 75274 - DNA, 1509 bp, Mus musculus; identical to SEQ ID NO: 36926
  CDS (1)..(1509)

SEQ ID NO: 75275 - protein, 502 aa, Mus musculus; identical to SEQ ID NO: 36927

SEQ ID NO: 75276 - DNA, 1308 bp, Methanococcus jannaschii; identical to SEQ ID NO: 36928
  CDS (1)..(1308): transl_table=11

SEQ ID NO: 75277 - protein, 435 aa, Methanococcus jannaschii; identical to SEQ ID NO: 36929

SEQ ID NO: 75278 - DNA, 1323 bp, Mycobacterium tuberculosis; identical to SEQ ID NO: 36930
  CDS (1)..(1323): transl_table=11

SEQ ID NO: 75279 - protein, 440 aa, Mycobacterium tuberculosis; identical to SEQ ID NO: 36931

SEQ ID NO: 75280 - DNA, 1257 bp, Escherichia coli; identical to SEQ ID NO: 36932
  CDS (1)..(1257)

SEQ ID NO: 75281 - protein, 418 aa, Escherichia coli; identical to SEQ ID NO: 36933

SEQ ID NO: 75282 - DNA, 24 bp, Primer
atgatgaacacggaaggtaataac

SEQ ID NO: 75283 - DNA, 24 bp, Primer
ttatacggttttattgcgcttcat

SEQ ID NO: 75284 - protein, 78 aa, consensus; identical to SEQ ID NO: 36936
  MISC_FEATURE (1)..(78): consensus for the disclosure of xaa see table XV

SEQ ID NO: 75285 - protein, 38 aa, consensus; identical to SEQ ID NO: 36937
  MISC_FEATURE (1)..(38): consensus for the disclosure of xaa see table XV

SEQ ID NO: 75286 - DNA, 1248 bp, Escherichia coli; identical to SEQ ID NO: 44655
  CDS (1)..(1248)

SEQ ID NO: 75287 - protein, 415 aa, Escherichia coli; identical to SEQ ID NO: 44656

SEQ ID NO: 75288 - DNA, 1239 bp, Vibrio cholerae O1 biovar eltor str. N16961; identical to SEQ ID NO: 44657
  CDS (1)..(1239): transl_table=11

SEQ ID NO: 75289 - protein, 412 aa, Vibrio cholerae O1 biovar eltor str. N16961; identical to SEQ ID NO: 44658

SEQ ID NO: 75290 - DNA, 1329 bp, Pseudomonas aeruginosa PAO1; identical to SEQ ID NO: 44659
  CDS (1)..(1329): transl_table=11

SEQ ID NO: 75291 - protein, 442 aa, Pseudomonas aeruginosa PAO1; identical to SEQ ID NO: 44660

SEQ ID NO: 75292 - DNA, 1248 bp, Salmonella typhimurium LT2; identical to SEQ ID NO: 44661
  CDS (1)..(1248): transl_table=11

SEQ ID NO: 75293 - protein, 415 aa, Salmonella typhimurium LT2; identical to SEQ ID NO: 44662

SEQ ID NO: 75294 - DNA, 1227 bp, Brucella melitensis 16M; identical to SEQ ID NO: 44663
  CDS (1)..(1227): transl_table=11

SEQ ID NO: 75295 - protein, 408 aa, Brucella melitensis 16M; identical to SEQ ID NO: 44664

SEQ ID NO: 75296 - DNA, 1248 bp, Chlorobium tepidum TLS; identical to SEQ ID NO: 44665
  CDS (1)..(1248): transl_table=11

SEQ ID NO: 75297 - protein, 415 aa, Chlorobium tepidum TLS; identical to SEQ ID NO: 44666

SEQ ID NO: 75298 - DNA, 1248 bp, Yersinia pestis KIM; identical to SEQ ID NO: 44667
  CDS (1)..(1248): transl_table=11

SEQ ID NO: 75299 - protein, 415 aa, Yersinia pestis KIM; identical to SEQ ID NO: 44668

SEQ ID NO: 75300 - DNA, 1032 bp, Shigella flexneri 2a str. 301; identical to SEQ ID NO: 44669
  CDS (1)..(1032): transl_table=11

SEQ ID NO: 75301 - protein, 343 aa, Shigella flexneri 2a str. 301; identical to SEQ ID NO: 44670

SEQ ID NO: 75302 - DNA, 1179 bp, Shewanella oneidensis MR-1; identical to SEQ ID NO: 44671
  CDS (1)..(1179): transl_table=11

SEQ ID NO: 75303 - protein, 392 aa, Shewanella oneidensis MR-1; identical to SEQ ID NO: 44672

SEQ ID NO: 75304 - DNA, 1302 bp, Pseudomonas putida KT2440; identical to SEQ ID NO: 44673
  CDS (1)..(1302): transl_table=11

SEQ ID NO: 75305 - protein, 433 aa, Pseudomonas putida KT2440; identical to SEQ ID NO: 44674

SEQ ID NO: 75306 - DNA, 1311 bp, Pseudomonas syringae pv. tomato str. DC3000; identical to SEQ ID NO: 44675
  CDS (1)..(1311): transl_table=11

SEQ ID NO: 75307 - protein, 436 aa, Pseudomonas syringae pv. tomato str. DC3000; identical to SEQ ID NO: 44676

SEQ ID NO: 75308 - DNA, 1098 bp, Vibrio parahaemolyticus RIMD 2210633; identical to SEQ ID NO: 44677
  CDS (1)..(1098): transl_table=11

SEQ ID NO: 75309 - protein, 365 aa, Vibrio parahaemolyticus RIMD 2210633; identical to SEQ ID NO: 44678

SEQ ID NO: 75310 - DNA, 1176 bp, Bacteroides thetaiotaomicron VPI-5482; identical to SEQ ID NO: 44679
  CDS (1)..(1176): transl_table=11

SEQ ID NO: 75311 - protein, 391 aa, Bacteroides thetaiotaomicron VPI-5482; identical to SEQ ID NO: 44680

SEQ ID NO: 75312 - DNA, 1332 bp, Bacteroides thetaiotaomicron VPI-5482; identical to SEQ ID NO: 44681
  CDS (1)..(1332): transl_table=11

SEQ ID NO: 75313 - protein, 443 aa, Bacteroides thetaiotaomicron VPI-5482; identical to SEQ ID NO: 44682

SEQ ID NO: 75314 - DNA, 1152 bp, Coxiella burnetii RSA 493; identical to SEQ ID NO: 44683
  CDS (1)..(1152): transl_table=11

SEQ ID NO: 75315 - protein, 383 aa, Coxiella burnetii RSA 493; identical to SEQ ID NO: 44684

SEQ ID NO: 75316 - DNA, 1347 bp, Bordetella bronchiseptica RB50; identical to SEQ ID NO: 44685
  CDS (1)..(1347): transl_table=11

SEQ ID NO: 75317 - protein, 448 aa, Bordetella bronchiseptica RB50; identical to SEQ ID NO: 44686

SEQ ID NO: 75318 - DNA, 1104 bp, Vibrio vulnificus YJ016; identical to SEQ ID NO: 44687
  CDS (1)..(1104): transl_table=11

SEQ ID NO: 75319 - protein, 367 aa, Vibrio vulnificus YJ016; identical to SEQ ID NO: 44688

SEQ ID NO: 75320 - DNA, 1863 bp, Rhodopseudomonas palustris CGA009; identical to SEQ ID NO: 44689
  CDS (1)..(1863): transl_table=11

SEQ ID NO: 75321 - protein, 620 aa, Rhodopseudomonas palustris CGA009; identical to SEQ ID NO: 44690

SEQ ID NO: 75322 - DNA, 1221 bp, Treponema denticola ATCC 35405; identical to SEQ ID NO: 44691
  CDS (1)..(1221): transl_table=11

SEQ ID NO: 75323 - protein, 406 aa, Treponema denticola ATCC 35405; identical to SEQ ID NO: 44692

SEQ ID NO: 75324 - DNA, 1218 bp, Bartonella henselae str. Houston-1; identical to SEQ ID NO: 44693
  CDS (1)..(1218): transl_table=11

SEQ ID NO: 75325 - protein, 405 aa, Bartonella henselae str. Houston-1; identical to SEQ ID NO: 44694

SEQ ID NO: 75326 - DNA, 1281 bp, Acinetobacter sp. ADP1; identical to SEQ ID NO: 44695
  CDS (1)..(1281): transl_table=11

SEQ ID NO: 75327 - protein, 426 aa, Acinetobacter sp. ADP1; identical to SEQ ID NO: 44696

SEQ ID NO: 75328 - DNA, 1275 bp, Erwinia carotovora subsp. atroseptica SCRI1043; identical to SEQ ID NO: 44697
  CDS (1)..(1275)

SEQ ID NO: 75329 - protein, 424 aa, Erwinia carotovora subsp. atroseptica SCRI1043; identical to SEQ ID NO: 44698

SEQ ID NO: 75330 - DNA, 1251 bp, Desulfotalea psychrophila LSv54; identical to SEQ ID NO: 44699
  CDS (1)..(1251): transl_table=11

SEQ ID NO: 75331 - protein, 416 aa, Desulfotalea psychrophila LSv54; identical to SEQ ID NO: 44700

SEQ ID NO: 75332 - DNA, 1167 bp, Rickettsia typhi str. Wilmington; identical to SEQ ID NO: 44701
  CDS (1)..(1167): transl_table=11

SEQ ID NO: 75333 - protein, 388 aa, Rickettsia typhi str. Wilmington; identical to SEQ ID NO: 44702

SEQ ID NO: 75334 - DNA, 1248 bp, Bacteroides fragilis YCH46; identical to SEQ ID NO: 44703
  CDS (1)..(1248): transl_table=11

SEQ ID NO: 75335 - protein, 415 aa, Bacteroides fragilis YCH46; identical to SEQ ID NO: 44704

SEQ ID NO: 75336 - DNA, 1170 bp, Bacteroides fragilis YCH46; identical to SEQ ID NO: 44705
  CDS (1)..(1170): transl_table=11

SEQ ID NO: 75337 - protein, 389 aa, Bacteroides fragilis YCH46; identical to SEQ ID NO: 44706

SEQ ID NO: 75338 - DNA, 1098 bp, Photobacterium profundum SS9; identical to SEQ ID NO: 44707
  CDS (1)..(1098): transl_table=11

SEQ ID NO: 75339 - protein, 365 aa, Photobacterium profundum SS9; identical to SEQ ID NO: 44708

SEQ ID NO: 75340 - DNA, 1272 bp, Idiomarina loihiensis L2TR; identical to SEQ ID NO: 44709
  CDS (1)..(1272): transl_table=11

SEQ ID NO: 75341 - protein, 423 aa, Idiomarina loihiensis L2TR; identical to SEQ ID NO: 44710

SEQ ID NO: 75342 - DNA, 1236 bp, Idiomarina loihiensis L2TR; identical to SEQ ID NO: 44711
  CDS (1)..(1236): transl_table=11

SEQ ID NO: 75343 - protein, 411 aa, Idiomarina loihiensis L2TR; identical to SEQ ID NO: 44712

SEQ ID NO: 75344 - DNA, 1257 bp, Azoarcus sp. EbN1; identical to SEQ ID NO: 44713
  CDS (1)..(1257): transl_table=11

SEQ ID NO: 75345 - protein, 418 aa, Azoarcus sp. EbN1; identical to SEQ ID NO: 44714

SEQ ID NO: 75346 - DNA, 1191 bp, Francisella tularensis subsp. tularensis Schu 4; identical to SEQ ID NO: 44715
  CDS (1)..(1191): transl_table=11

SEQ ID NO: 75347 - protein, 396 aa, Francisella tularensis subsp. tularensis Schu 4; identical to SEQ ID NO: 44716

SEQ ID NO: 75348 - DNA, 1332 bp, Xylella fastidiosa Ann-1; identical to SEQ ID NO: 44717
  CDS (1)..(1332)

SEQ ID NO: 75349 - protein, 443 aa, Xylella fastidiosa Ann-1; identical to SEQ ID NO: 44718

SEQ ID NO: 75350 - DNA, 1152 bp, Rickettsia sibirica 246; identical to SEQ ID NO: 44719
  CDS (1)..(1152): transl_table=11

SEQ ID NO: 75351 - protein, 383 aa, Rickettsia sibirica 246; identical to SEQ ID NO: 44720

SEQ ID NO: 75352 - DNA, 1953 bp, Psychrobacter sp. 273-4; identical to SEQ ID NO: 44721
  CDS (1)..(1953)

SEQ ID NO: 75353 - protein, 650 aa, Psychrobacter sp. 273-4; identical to SEQ ID NO: 44722

SEQ ID NO: 75354 - DNA, 1104 bp, Crocosphaera watsonii WH 8501; identical to SEQ ID NO: 44723
  CDS (1)..(1104)

SEQ ID NO: 75355 - protein, 367 aa, Crocosphaera watsonii WH 8501; identical to SEQ ID NO: 44724

SEQ ID NO: 75356 - DNA, 1251 bp, Burkholderia cepacia R18194; identical to SEQ ID NO: 44725
  CDS (1)..(1251)

SEQ ID NO: 75357 - protein, 416 aa, Burkholderia cepacia R18194; identical to SEQ ID NO: 44726

SEQ ID NO: 75358 - DNA, 1344 bp, Ralstonia metallidurans CH34; identical to SEQ ID NO: 44727
  CDS (1)..(1344)

SEQ ID NO: 75359 - protein, 447 aa, Ralstonia metallidurans CH34; identical to SEQ ID NO: 44728

SEQ ID NO: 75360 - DNA, 1110 bp, Microbulbifer degradans 2-40; identical to SEQ ID NO: 44729
  CDS (1)..(1110)

SEQ ID NO: 75361 - protein, 369 aa, Microbulbifer degradans 2-40; identical to SEQ ID NO: 44730

SEQ ID NO: 75362 - DNA, 1155 bp, Rickettsia akari str. Hartford; identical to SEQ ID NO: 44731
  CDS (1)..(1155)

SEQ ID NO: 75363 - protein, 384 aa, Rickettsia akari str. Hartford; identical to SEQ ID NO: 44732

SEQ ID NO: 75364 - DNA, 1188 bp, Methylobacillus flagellatus KT; identical to SEQ ID NO: 44733
  CDS (1)..(1188)

SEQ ID NO: 75365 - protein, 395 aa, Methylobacillus flagellatus KT; identical to SEQ ID NO: 44734

SEQ ID NO: 75366 - DNA, 25 bp, Primer
atgcaggatttaatatcccaggttg

SEQ ID NO: 75367 - DNA, 23 bp, Primer
ttactgcttaaatgcacccgcca

SEQ ID NO: 75368 - protein, 220 aa, consensus; identical to SEQ ID NO: 44737
  MISC_FEATURE (1)..(220): consensus for the disclosure of xaa see table XV

SEQ ID NO: 75369 - protein, 112 aa, consensus; identical to SEQ ID NO: 44738
  MISC_FEATURE (1)..(112): consensus for the disclosure of xaa see table XV

SEQ ID NO: 75370 - protein, 68 aa, consensus; identical to SEQ ID NO: 44739
  MISC_FEATURE (1)..(68): consensus for the disclosure of xaa see table XV

SEQ ID NO: 75371 - DNA, 660 bp, Escherichia coli; identical to SEQ ID NO: 58632
  CDS (1)..(660)

SEQ ID NO: 75372 - protein, 219 aa, Escherichia coli; identical to SEQ ID NO: 58633

SEQ ID NO: 75373 - DNA, 977 bp, Cryptococcus neoformans var. neoformans JEC21; identical to SEQ ID NO: 58634
  CDS (27)..(878)

SEQ ID NO: 75374 - protein, 283 aa, Cryptococcus neoformans var. neoformans JEC21; identical to SEQ ID NO: 58635

SEQ ID NO: 75375 - DNA, 663 bp, Azoarcus sp. EbN1; identical to SEQ ID NO: 58636
  CDS (1)..(663)

SEQ ID NO: 75376 - protein, 220 aa, Azoarcus sp. EbN1; identical to SEQ ID NO: 58637

SEQ ID NO: 75377 - DNA, 705 bp, Ehrlichia ruminantium str. Welgevonden; identical to SEQ ID NO: 58638
  CDS (1)..(705)

SEQ ID NO: 75378 - protein, 234 aa, Ehrlichia ruminantium str. Welgevonden; identical to SEQ ID NO: 58639

SEQ ID NO: 75379 - DNA, 723 bp, Wolbachia endosymbiont strain TRS of Brugia malayi; identical to SEQ ID NO: 58640
  CDS (1)..(723)

SEQ ID NO: 75380 - protein, 240 aa, Wolbachia endosymbiont strain TRS of Brugia malayi; identical to SEQ ID NO: 58641

SEQ ID NO: 75381 - DNA, 663 bp, Vibrio fischeri ES114; identical to SEQ ID NO: 58642
  CDS (1)..(663)

SEQ ID NO: 75382 - protein, 220 aa, Vibrio fischeri ES114; identical to SEQ ID NO: 58643

SEQ ID NO: 75383 - DNA, 684 bp, Neisseria gonorrhoeae FA 1090; identical to SEQ ID NO: 58644
  CDS (1)..(684)

SEQ ID NO: 75384 - protein, 227 aa, Neisseria gonorrhoeae FA 1090; identical to SEQ ID NO: 58645

SEQ ID NO: 75385 - DNA, 708 bp, Xenopus tropicalis; identical to SEQ ID NO: 58646
  CDS (1)..(708)

SEQ ID NO: 75386 - protein, 235 aa, Xenopus tropicalis; identical to SEQ ID NO: 58647

SEQ ID NO: 75387 - DNA, 714 bp, Sus scrofa; identical to SEQ ID NO: 58648
  CDS (1)..(714)

SEQ ID NO: 75388 - protein, 237 aa, Sus scrofa; identical to SEQ ID NO: 58649

SEQ ID NO: 75389 - DNA, 975 bp, Danio rerio; identical to SEQ ID NO: 58650
  CDS (1)..(975)

SEQ ID NO: 75390 - protein, 324 aa, Danio rerio; identical to SEQ ID NO: 58651

SEQ ID NO: 75391 - DNA, 1116 bp, Homo sapiens; identical to SEQ ID NO: 58652
  CDS (1)..(1116)

SEQ ID NO: 75392 - protein, 371 aa, Homo sapiens; identical to SEQ ID NO: 58653

SEQ ID NO: 75393 - DNA, 714 bp, Mus musculus; identical to SEQ ID NO: 58654
  CDS (1)..(714)

SEQ ID NO: 75394 - protein, 237 aa, Mus musculus; identical to SEQ ID NO: 58655

SEQ ID NO: 75395 - DNA, 774 bp, Mesorhizobium loti MAFF303099; identical to SEQ ID NO: 58656
  CDS (1)..(774): transl_table=11

SEQ ID NO: 75396 - protein, 257 aa, Mesorhizobium loti MAFF303099; identical to SEQ ID NO: 58657

SEQ ID NO: 75397 - DNA, 744 bp, Arabidopsis thaliana; identical to SEQ ID NO: 58658
  CDS (1)..(744)

SEQ ID NO: 75398 - protein, 247 aa, Arabidopsis thaliana; identical to SEQ ID NO: 58659

SEQ ID NO: 75399 - DNA, 720 bp, Arabidopsis thaliana; identical to SEQ ID NO: 58660
  CDS (1)..(720)

SEQ ID NO: 75400 - protein, 239 aa, Arabidopsis thaliana; identical to SEQ ID NO: 58661

SEQ ID NO: 75401 - DNA, 747 bp, Arabidopsis thaliana; identical to SEQ ID NO: 58662
  CDS (1)..(747)

SEQ ID NO: 75402 - protein, 248 aa, Arabidopsis thaliana; identical to SEQ ID NO: 58663

SEQ ID NO: 75403 - DNA, 708 bp, Arabidopsis thaliana; identical to SEQ ID NO: 58664
  CDS (1)..(708)

SEQ ID NO: 75404 - protein, 235 aa, Arabidopsis thaliana; identical to SEQ ID NO: 58665

SEQ ID NO: 75405 - DNA, 744 bp, Arabidopsis thaliana; identical to SEQ ID NO: 58666
  CDS (1)..(744)

SEQ ID NO: 75406 - protein, 247 aa, Arabidopsis thaliana; identical to SEQ ID NO: 58667

SEQ ID NO: 75407 - DNA, 714 bp, Lactococcus lactis subsp. lactis Il1403; identical to SEQ ID NO: 58668
  CDS (1)..(714): transl_table=11

SEQ ID NO: 75408 - protein, 237 aa, Lactococcus lactis subsp. lactis Il1403; identical to SEQ ID NO: 58669

SEQ ID NO: 75409 - DNA, 705 bp, Escherichia coli O157:H7; identical to SEQ ID NO: 58670
  CDS (1)..(705): transl_table=11

SEQ ID NO: 75410 - protein, 234 aa, Escherichia coli O157:H7; identical to SEQ ID NO: 58671

SEQ ID NO: 75411 - DNA, 696 bp, Clostridium acetobutylicum ATCC 824; identical to SEQ ID NO: 58672
  CDS (1)..(696): transl_table=11

SEQ ID NO: 75412 - protein, 231 aa, Clostridium acetobutylicum ATCC 824; identical to SEQ ID NO: 58673

SEQ ID NO: 75413 - DNA, 708 bp, Streptococcus pneumoniae R6; identical to SEQ ID NO: 58674
  CDS (1)..(708): transl_table=11

SEQ ID NO: 75414 - protein, 235 aa, Streptococcus pneumoniae R6; identical to SEQ ID NO: 58675

SEQ ID NO: 75415 - DNA, 738 bp, Sinorhizobium meliloti 1021; identical to SEQ ID NO: 58676
  CDS (1)..(738): transl_table=11

SEQ ID NO: 75416 - protein, 245 aa, Sinorhizobium meliloti 1021; identical to SEQ ID NO: 58677

SEQ ID NO: 75417 - DNA, 645 bp, Bacillus subtilis subsp. subtilis str. 168; identical to SEQ ID NO: 58678
  CDS (1)..(645): transl_table=11

SEQ ID NO: 75418 - protein, 214 aa, Bacillus subtilis subsp. subtilis str. 168; identical to SEQ ID NO: 58679

SEQ ID NO: 75419 - DNA, 705 bp, Salmonella typhimurium LT2; identical to SEQ ID NO: 58680
  CDS (1)..(705): transl_table=11

SEQ ID NO: 75420 - protein, 234 aa, Salmonella typhimurium LT2; identical to SEQ ID NO: 58681

SEQ ID NO: 75421 - DNA, 660 bp, Salmonella typhimurium LT2; identical to SEQ ID NO: 58682
  CDS (1)..(660): transl_table=11

SEQ ID NO: 75422 - protein, 219 aa, Salmonella typhimurium LT2; identical to SEQ ID NO: 58683

SEQ ID NO: 75423 - DNA, 678 bp, Listeria innocua Clip11262; identical to SEQ ID NO: 58684
  CDS (1)..(678): transl_table=11

SEQ ID NO: 75424 - protein, 225 aa, Listeria innocua Clip11262; identical to SEQ ID NO: 58685

SEQ ID NO: 75425 - DNA, 702 bp, Ralstonia solanacearum GMI1000; identical to SEQ ID NO: 58686
  CDS (1)..(702): transl_table=11

SEQ ID NO: 75426 - protein, 233 aa, Ralstonia solanacearum GMI1000; identical to SEQ ID NO: 58687

SEQ ID NO: 75427 - DNA, 783 bp, Agrobacterium tumefaciens str. C58; identical to SEQ ID NO: 58688
  CDS (1)..(783): transl_table=11

SEQ ID NO: 75428 - protein, 260 aa, Agrobacterium tumefaciens str. C58; identical to SEQ ID NO: 58689

SEQ ID NO: 75429 - DNA, 771 bp, Arabidopsis thaliana; identical to SEQ ID NO: 58690
  CDS (1)..(771)

SEQ ID NO: 75430 - protein, 256 aa, Arabidopsis thaliana; identical to SEQ ID NO: 58691

SEQ ID NO: 75431 - DNA, 714 bp, Camelpox virus; identical to SEQ ID NO: 58692
  CDS (1)..(714)

SEQ ID NO: 75432 - protein, 237 aa, Camelpox virus; identical to SEQ ID NO: 58693

SEQ ID NO: 75433 - DNA, 690 bp, Streptococcus pyogenes MGAS8232; identical to SEQ ID NO: 58694
  CDS (1)..(690): transl_table=11

SEQ ID NO: 75434 - protein, 229 aa, Streptococcus pyogenes MGAS8232; identical to SEQ ID NO: 58695

SEQ ID NO: 75435 - DNA, 795 bp, Drosophila melanogaster; identical to SEQ ID NO: 58696
  CDS (1)..(795)

SEQ ID NO: 75436 - protein, 264 aa, Drosophila melanogaster; identical to SEQ ID NO: 58697

SEQ ID NO: 75437 - DNA, 711 bp, Yersinia pestis KIM; identical to SEQ ID NO: 58698
  CDS (1)..(711): transl_table=11

SEQ ID NO: 75438 - protein, 236 aa, Yersinia pestis KIM; identical to SEQ ID NO: 58699

SEQ ID NO: 75439 - DNA, 690 bp, Streptococcus agalactiae 2603V/R; identical to SEQ ID NO: 58700
  CDS (1)..(690): transl_table=11

SEQ ID NO: 75440 - protein, 229 aa, Streptococcus agalactiae 2603V/R; identical to SEQ ID NO: 58701

SEQ ID NO: 75441 - DNA, 900 bp, Bifidobacterium longum NCC2705; identical to SEQ ID NO: 58702
  CDS (1)..(900): transl_table=11

SEQ ID NO: 75442 - protein, 299 aa, Bifidobacterium longum NCC2705; identical to SEQ ID NO: 58703

SEQ ID NO: 75443 - DNA, 738 bp, Brucella suis 1330; identical to SEQ ID NO: 58704
  CDS (1)..(738): transl_table=11

SEQ ID NO: 75444 - protein, 245 aa, Brucella suis 1330; identical to SEQ ID NO: 58705

SEQ ID NO: 75445 - DNA, 870 bp, Plasmodium falciparum 3D7; identical to SEQ ID NO: 58706
  CDS (1)..(870)

SEQ ID NO: 75446 - protein, 289 aa, Plasmodium falciparum 3D7; identical to SEQ ID NO: 58707

SEQ ID NO: 75447 - DNA, 705 bp, Shigella flexneri 2a str. 301; identical to SEQ ID NO: 58708
  CDS (1)..(705): transl_table=11

SEQ ID NO: 75448 - protein, 234 aa, Shigella flexneri 2a str. 301; identical to SEQ ID NO: 58709

SEQ ID NO: 75449 - DNA, 660 bp, Shewanella oneidensis MR-1; identical to SEQ ID NO: 58710
  CDS (1)..(660): transl_table=11

SEQ ID NO: 75450 - protein, 219 aa, Shewanella oneidensis MR-1; identical to SEQ ID NO: 58711

SEQ ID NO: 75451 - DNA, 825 bp, Drosophila melanogaster; identical to SEQ ID NO: 58712
  CDS (1)..(825)

SEQ ID NO: 75452 - protein, 274 aa, Drosophila melanogaster; identical to SEQ ID NO: 58713

SEQ ID NO: 75453 - DNA, 714 bp, Drosophila melanogaster; identical to SEQ ID NO: 58714
  CDS (1)..(714)

SEQ ID NO: 75454 - protein, 237 aa, Drosophila melanogaster; identical to SEQ ID NO: 58715

SEQ ID NO: 75455 - DNA, 672 bp, Pseudomonas putida KT2440; identical to SEQ ID NO: 58716
  CDS (1)..(672): transl_table=11

SEQ ID NO: 75456 - protein, 223 aa, Pseudomonas putida KT2440; identical to SEQ ID NO: 58717

SEQ ID NO: 75457 - DNA, 663 bp, Vibrio vulnificus CMCP6; identical to SEQ ID NO: 58718
  CDS (1)..(663): transl_table=11

SEQ ID NO: 75458 - protein, 220 aa, Vibrio vulnificus CMCP6; identical to SEQ ID NO: 58719

SEQ ID NO: 75459 - DNA, 837 bp, Bradyrhizobium japonicum USDA 110; identical to SEQ ID NO: 58720
  CDS (1)..(837)

SEQ ID NO: 75460 - protein, 278 aa, Bradyrhizobium japonicum USDA 110; identical to SEQ ID NO: 58721

SEQ ID NO: 75461 - DNA, 699 bp, Bradyrhizobium japonicum USDA 110; identical to SEQ ID NO: 58722
  CDS (1)..(699)

SEQ ID NO: 75462 - protein, 232 aa, Bradyrhizobium japonicum USDA 110; identical to SEQ ID NO: 58723

SEQ ID NO: 75463 - DNA, 690 bp, Streptococcus pyogenes SSI-1; identical to SEQ ID NO: 58724
  CDS (1)..(690): transl_table=11

SEQ ID NO: 75464 - protein, 229 aa, Streptococcus pyogenes SSI-1; identical to SEQ ID NO: 58725

SEQ ID NO: 75465 - DNA, 687 bp, Enterococcus faecalis V583; identical to SEQ ID NO: 58726
  CDS (1)..(687): transl_table=11

SEQ ID NO: 75466 - protein, 228 aa, Enterococcus faecalis V583; identical to SEQ ID NO: 58727

SEQ ID NO: 75467 - DNA, 720 bp, Coxiella burnetii RSA 493; identical to SEQ ID NO: 58728
  CDS (1)..(720): transl_table=11

SEQ ID NO: 75468 - protein, 239 aa, Coxiella burnetii RSA 493; identical to SEQ ID NO: 58729

SEQ ID NO: 75469 - DNA, 696 bp, Nitrosomonas europaea ATCC 19718; identical to SEQ ID NO: 58730
  CDS (1)..(696): transl_table=11

SEQ ID NO: 75470 - protein, 231 aa, Nitrosomonas europaea ATCC 19718; identical to SEQ ID NO: 58731

SEQ ID NO: 75471 - DNA, 693 bp, Helicobacter hepaticus ATCC 51449; identical to SEQ ID NO: 58732
  CDS (1)..(693): transl_table=11

SEQ ID NO: 75472 - protein, 230 aa, Helicobacter hepaticus ATCC 51449; identical to SEQ ID NO: 58733

SEQ ID NO: 75473 - DNA, 660 bp, Wigglesworthia glossinidia endosymbiont of Glossina brevipalpis; identical to SEQ ID NO: 58734
  CDS (1)..(660): transl_table=11

SEQ ID NO: 75474 - protein, 219 aa, Wigglesworthia glossinidia endosymbiont of Glossina brevipalpis; identical to SEQ ID NO: 58735

SEQ ID NO: 75475 - DNA, 711 bp, Candidatus Blochmannia floridanus; identical to SEQ ID NO: 58736
  CDS (1)..(711): transl_table=11

SEQ ID NO: 75476 - protein, 236 aa, Candidatus Blochmannia floridanus; identical to SEQ ID NO: 58737

SEQ ID NO: 75477 - DNA, 711 bp, Bordetella bronchiseptica RB50; identical to SEQ ID NO: 58738
  CDS (1)..(711): transl_table=11

SEQ ID NO: 75478 - protein, 236 aa, Bordetella bronchiseptica RB50; identical to SEQ ID NO: 58739

SEQ ID NO: 75479 - DNA, 690 bp, Chromobacterium violaceum ATCC 12472; identical to SEQ ID NO: 58740
  CDS (1)..(690): transl_table=11

SEQ ID NO: 75480 - protein, 229 aa, Chromobacterium violaceum ATCC 12472; identical to SEQ ID NO: 58741

SEQ ID NO: 75481 - DNA, 717 bp, Wolinella succinogenes DSM 1740; identical to SEQ ID NO: 58742
  CDS (1)..(717): transl_table=11

SEQ ID NO: 75482 - protein, 238 aa, Wolinella succinogenes DSM 1740; identical to SEQ ID NO: 58743

SEQ ID NO: 75483 - DNA, 711 bp, Photorhabdus luminescens subsp. laumondii TTO1; identical to SEQ ID NO: 58744
  CDS (1)..(711): transl_table=11

SEQ ID NO: 75484 - protein, 236 aa, Photorhabdus luminescens subsp. laumondii TTO1; identical to SEQ ID NO: 58745

SEQ ID NO: 75485 - DNA, 669 bp, Vibrio vulnificus YJ016; identical to SEQ ID NO: 58746
  CDS (1)..(669): transl_table=11

SEQ ID NO: 75486 - protein, 222 aa, Vibrio vulnificus YJ016; identical to SEQ ID NO: 58747

SEQ ID NO: 75487 - DNA, 792 bp, Rhodopseudomonas palustris CGA009; identical to SEQ ID NO: 58748
  CDS (1)..(792): transl_table=11

SEQ ID NO: 75488 - protein, 263 aa, Rhodopseudomonas palustris CGA009; identical to SEQ ID NO: 58749

SEQ ID NO: 75489 - DNA, 714 bp, Lactobacillus johnsonii NCC 533; identical to SEQ ID NO: 58750
  CDS (1)..(714): transl_table=11

SEQ ID NO: 75490 - protein, 237 aa, Lactobacillus johnsonii NCC 533; identical to SEQ ID NO: 58751

SEQ ID NO: 75491 - DNA, 723 bp, Wolbachia endosymbiont of Drosophila melanogaster; identical to SEQ ID NO: 58752
  CDS (1)..(723): transl_table=11

SEQ ID NO: 75492 - protein, 240 aa, Wolbachia endosymbiont of Drosophila melanogaster; identical to SEQ ID NO: 58753

SEQ ID NO: 75493 - DNA, 864 bp, Neurospora crassa; identical to SEQ ID NO: 58754
  CDS (1)..(864)

SEQ ID NO: 75494 - protein, 287 aa, Neurospora crassa; identical to SEQ ID NO: 58755

SEQ ID NO: 75495 - DNA, 849 bp, Magnaporthe grisea 70-15; identical to SEQ ID NO: 58756
  CDS (1)..(849)

SEQ ID NO: 75496 - protein, 282 aa, Magnaporthe grisea 70-15; identical to SEQ ID NO: 58757

SEQ ID NO: 75497 - DNA, 831 bp, Gibberella zeae PH-1; identical to SEQ ID NO: 58758
  CDS (1)..(831)

SEQ ID NO: 75498 - protein, 276 aa, Gibberella zeae PH-1; identical to SEQ ID NO: 58759

SEQ ID NO: 75499 - DNA, 822 bp, Ustilago maydis 521; identical to SEQ ID NO: 58760
  CDS (1)..(822)

SEQ ID NO: 75500 - protein, 273 aa, Ustilago maydis 521; identical to SEQ ID NO: 58761

SEQ ID NO: 75501 - DNA, 813 bp, Aspergillus nidulans FGSC A4; identical to SEQ ID NO: 58762
  CDS (1)..(813)

SEQ ID NO: 75502 - protein, 270 aa, Aspergillus nidulans FGSC A4; identical to SEQ ID NO: 58763

SEQ ID NO: 75503 - DNA, 555 bp, Oryza sativa (japonica cultivar-group); identical to SEQ ID NO: 58764
  CDS (1)..(555)

SEQ ID NO: 75504 - protein, 184 aa, Oryza sativa (japonica cultivar-group); identical to SEQ ID NO: 58765

SEQ ID NO: 75505 - DNA, 690 bp, Oryza sativa (japonica cultivar-group); identical to SEQ ID NO: 58766
  CDS (1)..(690)

SEQ ID NO: 75506 - protein, 229 aa, Oryza sativa (japonica cultivar-group); identical to SEQ ID NO: 58767

SEQ ID NO: 75507 - DNA, 672 bp, Oryza sativa (japonica cultivar-group); identical to SEQ ID NO: 58768
  CDS (1)..(672)

SEQ ID NO: 75508 - protein, 223 aa, Oryza sativa (japonica cultivar-group); identical to SEQ ID NO: 58769

SEQ ID NO: 75509 - DNA, 735 bp, Oryza sativa (japonica cultivar-group); identical to SEQ ID NO: 58770
  CDS (1)..(735)

SEQ ID NO: 75510 - protein, 244 aa, Oryza sativa (japonica cultivar-group); identical to SEQ ID NO: 58771

SEQ ID NO: 75511 - DNA, 786 bp, Yarrowia lipolytica CLIB99; identical to SEQ ID NO: 58772
  CDS (1)..(786)

SEQ ID NO: 75512 - protein, 261 aa, Yarrowia lipolytica CLIB99; identical to SEQ ID NO: 58773

SEQ ID NO: 75513 - DNA, 657 bp, Pan troglodytes; identical to SEQ ID NO: 58774
  CDS (1)..(657)

SEQ ID NO: 75514 - protein, 218 aa, Pan troglodytes; identical to SEQ ID NO: 58775

SEQ ID NO: 75515 - DNA, 702 bp, Desulfovibrio vulgaris subsp. vulgaris str. Hildenborough; identical to SEQ ID NO: 58776
  CDS (1)..(702): transl_table=11

SEQ ID NO: 75516 - protein, 233 aa, Desulfovibrio vulgaris subsp. vulgaris str. Hildenborough; identical to SEQ ID NO: 58777

SEQ ID NO: 75517 - DNA, 774 bp, Bartonella quintana str. Toulouse; identical to SEQ ID NO: 58778
  CDS (1)..(774): transl_table=11

SEQ ID NO: 75518 - protein, 257 aa, Bartonella quintana str. Toulouse; identical to SEQ ID NO: 58779

SEQ ID NO: 75519 - DNA, 774 bp, Bartonella henselae str. Houston-1; identical to SEQ ID NO: 58780
  CDS (1)..(774): transl_table=11

SEQ ID NO: 75520 - protein, 257 aa, Bartonella henselae str. Houston-1; identical to SEQ ID NO: 58781

SEQ ID NO: 75521 - DNA, 660 bp, Erwinia carotovora subsp. atroseptica SCRI1043; identical to SEQ ID NO: 58782
  CDS (1)..(660)

SEQ ID NO: 75522 - protein, 219 aa, Erwinia carotovora subsp. atroseptica SCRI1043; identical to SEQ ID NO: 58783

SEQ ID NO: 75523 - DNA, 708 bp, Erwinia carotovora subsp. atroseptica SCRI1043; identical to SEQ ID NO: 58784
  CDS (1)..(708)

SEQ ID NO: 75524 - protein, 235 aa, Erwinia carotovora subsp. atroseptica SCRI1043; identical to SEQ ID NO: 58785

SEQ ID NO: 75525 - DNA, 723 bp, Desulfotalea psychrophila LSv54; identical to SEQ ID NO: 58786
  CDS (1)..(723): transl_table=11

SEQ ID NO: 75526 - protein, 240 aa, Desulfotalea psychrophila LSv54; identical to SEQ ID NO: 58787

SEQ ID NO: 75527 - DNA, 711 bp, Yersinia pseudotuberculosis IP 32953; identical to SEQ ID NO: 58788
  CDS (1)..(711): transl_table=11

SEQ ID NO: 75528 - protein, 236 aa, Yersinia pseudotuberculosis IP 32953; identical to SEQ ID NO: 58789

SEQ ID NO: 75529 - DNA, 699 bp, Borrelia garinii PBi; identical to SEQ ID NO: 58790
  CDS (1)..(699): transl_table=11

SEQ ID NO: 75530 - protein, 232 aa, Borrelia garinii PBi; identical to SEQ ID NO: 58791

SEQ ID NO: 75531 - DNA, 672 bp, Mannheimia succiniciproducens MBEL55E; identical to SEQ ID NO: 58792
  CDS (1)..(672): transl_table=11

SEQ ID NO: 75532 - protein, 223 aa, Mannheimia succiniciproducens MBEL55E; identical to SEQ ID NO: 58793

SEQ ID NO: 75533 - DNA, 675 bp, Legionella pneumophila subsp. pneumophila str. Philadelphia 1; identical to SEQ ID NO: 58794
  CDS (1)..(675): transl_table=11

SEQ ID NO: 75534 - protein, 224 aa, Legionella pneumophila subsp. pneumophila str. Philadelphia 1; identical to SEQ ID NO: 58795

SEQ ID NO: 75535 - DNA, 714 bp, Burkholderia pseudomallei K96243; identical to SEQ ID NO: 58796
  CDS (1)..(714): transl_table=11

SEQ ID NO: 75536 - protein, 237 aa, Burkholderia pseudomallei K96243; identical to SEQ ID NO: 58797

SEQ ID NO: 75537 - DNA, 678 bp, Methylococcus capsulatus str. Bath; identical to SEQ ID NO: 58798
  CDS (1)..(678): transl_table=11

SEQ ID NO: 75538 - protein, 225 aa, Methylococcus capsulatus str. Bath; identical to SEQ ID NO: 58799

SEQ ID NO: 75539 - DNA, 666 bp, Photobacterium profundum SS9; identical to SEQ ID NO: 58800
  CDS (1)..(666): transl_table=11

SEQ ID NO: 75540 - protein, 221 aa, Photobacterium profundum SS9; identical to SEQ ID NO: 58801

SEQ ID NO: 75541 - DNA, 690 bp, Streptococcus thermophilus CNRZ1066; identical to SEQ ID NO: 58802
  CDS (1)..(690): transl_table=11

SEQ ID NO: 75542 - protein, 229 aa, Streptococcus thermophilus CNRZ1066; identical to SEQ ID NO: 58803

SEQ ID NO: 75543 - DNA, 639 bp, Geobacillus kaustophilus HTA426; identical to SEQ ID NO: 58804
  CDS (1)..(639): transl_table=11

SEQ ID NO: 75544 - protein, 212 aa, Geobacillus kaustophilus HTA426; identical to SEQ ID NO: 58805

SEQ ID NO: 75545 - DNA, 705 bp, Salmonella enterica subsp. enterica serovar Paratypi A str. ATCC; identical to SEQ ID NO: 58806
  CDS (1)..(705): transl_table=11

SEQ ID NO: 75546 - protein, 234 aa, Salmonella enterica subsp. enterica serovar Paratypi A str. ATCC; identical to SEQ ID NO: 58807

SEQ ID NO: 75547 - DNA, 702 bp, Anaplasma marginale str. St. Maries; identical to SEQ ID NO: 58808
  CDS (1)..(702): transl_table=11

SEQ ID NO: 75548 - protein, 233 aa, Anaplasma marginale str. St. Maries; identical to SEQ ID NO: 58809

SEQ ID NO: 75549 - DNA, 669 bp, Idiomarina loihiensis L2TR; identical to SEQ ID NO: 58810
  CDS (1)..(669): transl_table=11

SEQ ID NO: 75550 - protein, 222 aa, Idiomarina loihiensis L2TR; identical to SEQ ID NO: 58811

SEQ ID NO: 75551 - DNA, 666 bp, Azoarcus sp. EbN1; identical to SEQ ID NO: 58812
  CDS (1)..(666): transl_table=11

SEQ ID NO: 75552 - protein, 221 aa, Azoarcus sp. EbN1; identical to SEQ ID NO: 58813

SEQ ID NO: 75553 - DNA, 705 bp, Zymomonas mobilis subsp. mobilis ZM4; identical to SEQ ID NO: 58814
  CDS (1)..(705): transl_table=11

SEQ ID NO: 75554 - protein, 234 aa, Zymomonas mobilis subsp. mobilis ZM4; identical to SEQ ID NO: 58815

SEQ ID NO: 75555 - DNA, 687 bp, Francisella tularensis subsp. tularensis Schu 4; identical to SEQ ID NO: 58816
  CDS (1)..(687): transl_table=11

SEQ ID NO: 75556 - protein, 228 aa, Francisella tularensis subsp. tularensis Schu 4; identical to SEQ ID NO: 58817

SEQ ID NO: 75557 - DNA, 705 bp, Ehrlichia ruminantium str. Welgevonden; identical to SEQ ID NO: 58818
  CDS (1)..(705): transl_table=11

SEQ ID NO: 75558 - protein, 234 aa, Ehrlichia ruminantium str. Welgevonden; identical to SEQ ID NO: 58819

SEQ ID NO: 75559 - DNA, 714 bp, Rhodobacter sphaeroides 2.4.1; identical to SEQ ID NO: 58820
  CDS (1)..(714)

SEQ ID NO: 75560 - protein, 237 aa, Rhodobacter sphaeroides 2.4.1; identical to SEQ ID NO: 58821

SEQ ID NO: 75561 - DNA, 732 bp, Lactobacillus gasseri; identical to SEQ ID NO: 58822
  CDS (1)..(732)

SEQ ID NO: 75562 - protein, 243 aa, Lactobacillus gasseri; identical to SEQ ID NO: 58823

SEQ ID NO: 75563 - DNA, 768 bp, Magnetospirillum magnetotacticum MS-1; identical to SEQ ID NO: 58824
  CDS (1)..(768)

SEQ ID NO: 75564 - protein, 255 aa, Magnetospirillum magnetotacticum MS-1; identical to SEQ ID NO: 58825

SEQ ID NO: 75565 - DNA, 696 bp, Magnetospirillum magnetotacticum MS-1; identical to SEQ ID NO: 58826
  CDS (1)..(696)

SEQ ID NO: 75566 - protein, 231 aa, Magnetospirillum magnetotacticum MS-1; identical to SEQ ID NO: 58827

SEQ ID NO: 75567 - DNA, 720 bp, Leuconostoc mesenteroides subsp. mesenteroides ATCC 8293; identical to SEQ ID NO: 58828
  CDS (1)..(720)

SEQ ID NO: 75568 - protein, 239 aa, Leuconostoc mesenteroides subsp. mesenteroides ATCC 8293; identical to SEQ ID NO: 58829

SEQ ID NO: 75569 - DNA, 672 bp, Azotobacter vinelandii; identical to SEQ ID NO: 58830
  CDS (1)..(672)

SEQ ID NO: 75570 - protein, 223 aa, Azotobacter vinelandii; identical to SEQ ID NO: 58831

SEQ ID NO: 75571 - DNA, 702 bp, Desulfovibrio desulfuricans G20; identical to SEQ ID NO: 58832
  CDS (1)..(702)

SEQ ID NO: 75572 - protein, 233 aa, Desulfovibrio desulfuricans G20; identical to SEQ ID NO: 58833

SEQ ID NO: 75573 - DNA, 711 bp, Rickettsia sibirica 246; identical to SEQ ID NO: 58834
  CDS (1)..(711): transl_table=11

SEQ ID NO: 75574 - protein, 236 aa, Rickettsia sibirica 246; identical to SEQ ID NO: 58835

SEQ ID NO: 75575 - DNA, 693 bp, Dechloromonas aromatica RCB; identical to SEQ ID NO: 58836
  CDS (1)..(693)

SEQ ID NO: 75576 - protein, 230 aa, Dechloromonas aromatica RCB; identical to SEQ ID NO: 58837

SEQ ID NO: 75577 - DNA, 711 bp, Rickettsia rickettsii; identical to SEQ ID NO: 58838
  CDS (1)..(711)

SEQ ID NO: 75578 - protein, 236 aa, Rickettsia rickettsii; identical to SEQ ID NO: 58839

SEQ ID NO: 75579 - DNA, 702 bp, Ralstonia eutropha JMP134; identical to SEQ ID NO: 58840
  CDS (1)..(702)

SEQ ID NO: 75580 - protein, 233 aa, Ralstonia eutropha JMP134; identical to SEQ ID NO: 58841

SEQ ID NO: 75581 - DNA, 606 bp, Methylobacillus flagellatus KT; identical to SEQ ID NO: 58842
  CDS (1)..(606)

SEQ ID NO: 75582 - protein, 201 aa, Methylobacillus flagellatus KT; identical to SEQ ID NO: 58843

SEQ ID NO: 75583 - DNA, 645 bp, Exiguobacterium sp. 255-15; identical to SEQ ID NO: 58844
  CDS (1)..(645)

SEQ ID NO: 75584 - protein, 214 aa, Exiguobacterium sp. 255-15; identical to SEQ ID NO: 58845

SEQ ID NO: 75585 - DNA, 705 bp, Ehrlichia canis str. Jake; identical to SEQ ID NO: 58846
  CDS (1)..(705)

SEQ ID NO: 75586 - protein, 234 aa, Ehrlichia canis str. Jake; identical to SEQ ID NO: 58847

SEQ ID NO: 75587 - DNA, 699 bp, Burkholderia cepacia R18194; identical to SEQ ID NO: 58848
  CDS (1)..(699)

SEQ ID NO: 75588 - protein, 232 aa, Burkholderia cepacia R18194; identical to SEQ ID NO: 58849

SEQ ID NO: 75589 - DNA, 831 bp, Burkholderia cepacia R1808; identical to SEQ ID NO: 58850
  CDS (1)..(831)

SEQ ID NO: 75590 - protein, 276 aa, Burkholderia cepacia R1808; identical to SEQ ID NO: 58851

SEQ ID NO: 75591 - DNA, 696 bp, Rubrivivax gelatinosus PM1; identical to SEQ ID NO: 58852
  CDS (1)..(696)

SEQ ID NO: 75592 - protein, 231 aa, Rubrivivax gelatinosus PM1; identical to SEQ ID NO: 58853

SEQ ID NO: 75593 - DNA, 609 bp, Rubrivivax gelatinosus PM1; identical to SEQ ID NO: 58854
  CDS (1)..(609)

SEQ ID NO: 75594 - protein, 202 aa, Rubrivivax gelatinosus PM1; identical to SEQ ID NO: 58855

SEQ ID NO: 75595 - DNA, 753 bp, Rhodospirillum rubrum; identical to SEQ ID NO: 58856
  CDS (1)..(753)

SEQ ID NO: 75596 - protein, 250 aa, Rhodospirillum rubrum; identical to SEQ ID NO: 58857

SEQ ID NO: 75597 - DNA, 708 bp, Ralstonia metallidurans CH34; identical to SEQ ID NO: 58858
  CDS (1)..(708)

SEQ ID NO: 75598 - protein, 235 aa, Ralstonia metallidurans CH34; identical to SEQ ID NO: 58859

SEQ ID NO: 75599 - DNA, 699 bp, Burkholderia fungorum LB400; identical to SEQ ID NO: 58860
  CDS (1)..(699)

SEQ ID NO: 75600 - protein, 232 aa, Burkholderia fungorum LB400; identical to SEQ ID NO: 58861

SEQ ID NO: 75601 - DNA, 705 bp, Magnetococcus sp. MC-1; identical to SEQ ID NO: 58862
  CDS (1)..(705)

SEQ ID NO: 75602 - protein, 234 aa, Magnetococcus sp. MC-1; identical to SEQ ID NO: 58863

SEQ ID NO: 75603 - DNA, 744 bp, Novosphingobium aromaticivorans DSM 12444; identical to SEQ ID NO: 58864
  CDS (1)..(744)

SEQ ID NO: 75604 - protein, 247 aa, Novosphingobium aromaticivorans DSM 12444; identical to SEQ ID NO: 58865

SEQ ID NO: 75605 - DNA, 627 bp, Microbulbifer degradans 2-40; identical to SEQ ID NO: 58866
  CDS (1)..(627)

SEQ ID NO: 75606 - protein, 208 aa, Microbulbifer degradans 2-40; identical to SEQ ID NO: 58867

SEQ ID NO: 75607 - DNA, 639 bp, Pediococcus pentosaceus ATCC 25745; identical to SEQ ID NO: 58868
  CDS (1)..(639)

SEQ ID NO: 75608 - protein, 212 aa, Pediococcus pentosaceus ATCC 25745; identical to SEQ ID NO: 58869

SEQ ID NO: 75609 - DNA, 666 bp, Thiobacillus denitrificans ATCC 25259; identical to SEQ ID NO: 58870
  CDS (1)..(666)

SEQ ID NO: 75610 - protein, 221 aa, Thiobacillus denitrificans ATCC 25259; identical to SEQ ID NO: 58871

SEQ ID NO: 75611 - DNA, 711 bp, Rickettsia akari str. Hartford; identical to SEQ ID NO: 58872
  CDS (1)..(711)

SEQ ID NO: 75612 - protein, 236 aa, Rickettsia akari str. Hartford; identical to SEQ ID NO: 58873

SEQ ID NO: 75613 - DNA, 690 bp, Polaromonas sp. JS666; identical to SEQ ID NO: 58874
  CDS (1)..(690)

SEQ ID NO: 75614 - protein, 229 aa, Polaromonas sp. JS666; identical to SEQ ID NO: 58875

SEQ ID NO: 75615 - DNA, 702 bp, Campylobacter lari RM2100; identical to SEQ ID NO: 58876
  CDS (1)..(702): transl_table=11

SEQ ID NO: 75616 - protein, 233 aa, Campylobacter lari RM2100; identical to SEQ ID NO: 58877

SEQ ID NO: 75617 - DNA, 633 bp, Cowpox virus; identical to SEQ ID NO: 58878
  CDS (1)..(633)

SEQ ID NO: 75618 - protein, 210 aa, Cowpox virus; identical to SEQ ID NO: 58879

SEQ ID NO: 75619 - DNA, 711 bp, Brachydanio rerio; identical to SEQ ID NO: 58880
  CDS (1)..(711)

SEQ ID NO: 75620 - protein, 236 aa, Brachydanio rerio; identical to SEQ ID NO: 58881

SEQ ID NO: 75621 - DNA, 1008 bp, Xenopus laevis; identical to SEQ ID NO: 58882
  CDS (1)..(1008)

SEQ ID NO: 75622 - protein, 335 aa, Xenopus laevis; identical to SEQ ID NO: 58883

SEQ ID NO: 75623 - DNA, 795 bp, Oryza sativa; identical to SEQ ID NO: 58884
  CDS (1)..(795)

SEQ ID NO: 75624 - protein, 264 aa, Oryza sativa; identical to SEQ ID NO: 58885

SEQ ID NO: 75625 - DNA, 714 bp, Xenopus laevis; identical to SEQ ID NO: 58886
  CDS (1)..(714)

SEQ ID NO: 75626 - protein, 237 aa, Xenopus laevis; identical to SEQ ID NO: 58887

SEQ ID NO: 75627 - DNA, 726 bp, Oryza sativa; identical to SEQ ID NO: 58888
  CDS (1)..(726)

SEQ ID NO: 75628 - protein, 241 aa, Oryza sativa; identical to SEQ ID NO: 58889

SEQ ID NO: 75629 - DNA, 747 bp, Chlamydomonas reinhardtii; identical to SEQ ID NO: 58890
  CDS (1)..(747)

SEQ ID NO: 75630 - protein, 248 aa, Chlamydomonas reinhardtii; identical to SEQ ID NO: 58891

SEQ ID NO: 75631 - DNA, 747 bp, Lycopersicon esculentum; identical to SEQ ID NO: 58892
  CDS (1)..(747)

SEQ ID NO: 75632 - protein, 248 aa, Lycopersicon esculentum; identical to SEQ ID NO: 58893

SEQ ID NO: 75633 - DNA, 744 bp, Brassica oleracea; identical to SEQ ID NO: 58894
  CDS (1)..(744)

SEQ ID NO: 75634 - protein, 247 aa, Brassica oleracea; identical to SEQ ID NO: 58895

SEQ ID NO: 75635 - DNA, 741 bp, Cryptosporidium parvum; identical to SEQ ID NO: 58896
  CDS (1)..(741)

SEQ ID NO: 75636 - protein, 246 aa, Cryptosporidium parvum; identical to SEQ ID NO: 58897

SEQ ID NO: 75637 - DNA, 714 bp, Xenopus laevis; identical to SEQ ID NO: 58898
  CDS (1)..(714)

SEQ ID NO: 75638 - protein, 237 aa, Xenopus laevis; identical to SEQ ID NO: 58899

SEQ ID NO: 75639 - DNA, 660 bp, Schistosoma japonicum; identical to SEQ ID NO: 58900
  CDS (1)..(660)

SEQ ID NO: 75640 - protein, 219 aa, Schistosoma japonicum; identical to SEQ ID NO: 58901

SEQ ID NO: 75641 - DNA, 744 bp, Arabidopsis thaliana; identical to SEQ ID NO: 58902
  CDS (1)..(744)

SEQ ID NO: 75642 - protein, 247 aa, Arabidopsis thaliana; identical to SEQ ID NO: 58903

SEQ ID NO: 75643 - DNA, 714 bp, Camelpox virus; identical to SEQ ID NO: 58904
  CDS (1)..(714)

SEQ ID NO: 75644 - protein, 237 aa, Camelpox virus; identical to SEQ ID NO: 58905

SEQ ID NO: 75645 - DNA, 741 bp, Brassica oleracea; identical to SEQ ID NO: 58906
  CDS (1)..(741)

SEQ ID NO: 75646 - protein, 246 aa, Brassica oleracea; identical to SEQ ID NO: 58907

SEQ ID NO: 75647 - DNA, 750 bp, Nicotiana tabacum; identical to SEQ ID NO: 58908
  CDS (1)..(750)

SEQ ID NO: 75648 - protein, 249 aa, Nicotiana tabacum; identical to SEQ ID NO: 58909

SEQ ID NO: 75649 - DNA, 744 bp, Hordeum vulgare; identical to SEQ ID NO: 58910
  CDS (1)..(744)

SEQ ID NO: 75650 - protein, 247 aa, Hordeum vulgare; identical to SEQ ID NO: 58911

SEQ ID NO: 75651 - DNA, 744 bp, Arabidopsis thaliana; identical to SEQ ID NO: 58912
  CDS (1)..(744)

SEQ ID NO: 75652 - protein, 247 aa, Arabidopsis thaliana; identical to SEQ ID NO: 58913

SEQ ID NO: 75653 - DNA, 750 bp, Oryza sativa; identical to SEQ ID NO: 58914
  CDS (1)..(750)

SEQ ID NO: 75654 - protein, 249 aa, Oryza sativa; identical to SEQ ID NO: 58915

SEQ ID NO: 75655 - DNA, 714 bp, Paralichthys olivaceus; identical to SEQ ID NO: 58916
  CDS (1)..(714): n means a or g or c or t/u

SEQ ID NO: 75656 - protein, 237 aa, Paralichthys olivaceus; identical to SEQ ID NO: 58917
  misc_feature (187)..(187): Xaa can be Cys or Phe or Ser or Tyr

SEQ ID NO: 75657 - DNA, 663 bp, Haemophilus influenzae; identical to SEQ ID NO: 58918
  CDS (1)..(663): transl_table=11

SEQ ID NO: 75658 - protein, 220 aa, Haemophilus influenzae; identical to SEQ ID NO: 58919

SEQ ID NO: 75659 - DNA, 672 bp, Vibrio cholerae; identical to SEQ ID NO: 58920
  CDS (1)..(672): transl_table=11

SEQ ID NO: 75660 - protein, 223 aa, Vibrio cholerae; identical to SEQ ID NO: 58921

SEQ ID NO: 75661 - DNA, 711 bp, Rickettsia prowazekii; identical to SEQ ID NO: 58922
  CDS (1)..(711): transl_table=11

SEQ ID NO: 75662 - protein, 236 aa, Rickettsia prowazekii; identical to SEQ ID NO: 58923

SEQ ID NO: 75663 - DNA, 696 bp, Campylobacter jejuni; identical to SEQ ID NO: 58924
  CDS (1)..(696): transl_table=11

SEQ ID NO: 75664 - protein, 231 aa, Campylobacter jejuni; identical to SEQ ID NO: 58925

SEQ ID NO: 75665 - DNA, 669 bp, Pseudomonas aeruginosa; identical to SEQ ID NO: 58926
  CDS (1)..(669): transl_table=11

SEQ ID NO: 75666 - protein, 222 aa, Pseudomonas aeruginosa; identical to SEQ ID NO: 58927

SEQ ID NO: 75667 - DNA, 663 bp, Pasteurella multocida; identical to SEQ ID NO: 58928
  CDS (1)..(663): transl_table=11

SEQ ID NO: 75668 - protein, 220 aa, Pasteurella multocida; identical to SEQ ID NO: 58929

SEQ ID NO: 75669 - DNA, 699 bp, Borrelia burgdorferi; identical to SEQ ID NO: 58930
  CDS (1)..(699): transl_table=11

SEQ ID NO: 75670 - protein, 232 aa, Borrelia burgdorferi; identical to SEQ ID NO: 58931

SEQ ID NO: 75671 - DNA, 696 bp, Deinococcus radiodurans; identical to SEQ ID NO: 58932
  CDS (1)..(696): transl_table=11

SEQ ID NO: 75672 - protein, 231 aa, Deinococcus radiodurans; identical to SEQ ID NO: 58933

SEQ ID NO: 75673 - DNA, 693 bp, Helicobacter pylori J99; identical to SEQ ID NO: 58934
  CDS (1)..(693): transl_table=11

SEQ ID NO: 75674 - protein, 230 aa, Helicobacter pylori J99; identical to SEQ ID NO: 58935

SEQ ID NO: 75675 - DNA, 705 bp, Escherichia coli; identical to SEQ ID NO: 58936
  CDS (1)..(705): transl_table=11

SEQ ID NO: 75676 - protein, 234 aa, Escherichia coli; identical to SEQ ID NO: 58937

SEQ ID NO: 75677 - DNA, 705 bp, Lactococcus lactis; identical to SEQ ID NO: 58938
  CDS (1)..(705)

SEQ ID NO: 75678 - protein, 234 aa, Lactococcus lactis; identical to SEQ ID NO: 58939

SEQ ID NO: 75679 - DNA, 809 bp, Mus musculus; identical to SEQ ID NO: 58940
  CDS (22)..(738)

SEQ ID NO: 75680 - protein, 238 aa, Mus musculus; identical to SEQ ID NO: 58941

SEQ ID NO: 75681 - DNA, 25 bp, Primer
atggatcgtattgttagttcttcac

SEQ ID NO: 75682 - DNA, 22 bp, Primer
ttaatcgcggctagcgaagccc

SEQ ID NO: 75683 - protein, 228 aa, consensus; identical to SEQ ID NO: 58944
  MISC_FEATURE (1)..(228): consensus for the disclosure of xaa see table XV

SEQ ID NO: 75684 - DNA, 276 bp, Escherichia coli
  CDS (1)..(276)
atggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttgattgcggattcgtttgagaattccggggcttttgaaagtgatggtggtgggggaaggattactcagcgctgcgcgcttcgcccttcgggtcgttgcctgcggcaacgctctctcgctgacgctcgagccgaaccttag

SEQ ID NO: 75685 - protein, 91 aa, Escherichia coli
MVVGEGLLSAARFALRVVACGNALSLALKSNLGRSFSSFPAWAEYLIADSFENSGAFESDGGGGRITQRCALRPSGRCLRQRSLADARAEP

SEQ ID NO: 75686 - DNA, 570 bp, Escherichia coli O157:H7 EDL933
  CDS (1)..(570): transl_table=11
gtgatggtggtgggggaaggattactcagcgctgcgcgcttcgcccttcaggtcgttgcctgcggcaacgctctctcgctggcgctcgagtcgaaccttagtcgaagcttctcatccttctccgcttgggcagaatatttatttacggattcgcttgagagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggcggtggggaaaggattattcgtcgcttcgctcctcacccttcgggccgttgcctgtgaaaacgttctctcgctttcgctcgagtcgaaccttagtcgaaggttctcacccttccccgatgagtgcaaactttcacaatctcaccgaagttaccacatcgctgtggtgaatcatggtggtgggggaaggattcgaaccttcgaagtcgatgacggcagatttacagtctgctccctttggccgctcgggaaccccaccacggggtaa

SEQ ID NO: 75687 - protein, 189 aa, Escherichia coli O157:H7 EDL933
MMVVGEGLLSAARFALQVVACGNALSLALESNLSRSFSSFSAWAEYLFTDSLESSGTFESDGGGGRIRTFEVDDGRFTVCSLWPLGNPTRGNSNFEVMLEMAVGKGLFVASLLTLRAVACENVLSLSLESNLSRRFSPFPDECKLSQSHRSYHIAVVNHGGGGRIRTFEVDDGRFTVCSLWPLGNPTTG

SEQ ID NO: 75688 - DNA, 276 bp, Escherichia coli O157:H7
  CDS (1)..(276): transl_table=11
atggtggtgggggaaggattactcagcgctgcgcgcttcgcccttcgggtcgttgcctgcggcaacgctctctcgctggcgctcaagtcgaaccttggtcgaagcttctcatccttccccgcttgggcagaatatttaattacggattcgtttgagagttcagggacttttgaaagtgatggtggtgggggaaggattactcagcgctgcgcgcttcgcccttcaggtcgttgcctgcggcaacgctctctcgctggcgctcgagtcgaaccttag

SEQ ID NO: 75689 - protein, 91 aa, Escherichia coli O157:H7
MVVGEGLLSAARFALRVVACGNALSLALKSNLGRSFSSFPAWAEYLITDSFESSGTFESDGGGGRITQRCALRPSGRCLRQRSLAGARVEP

SEQ ID NO: 75690 - DNA, 570 bp, Escherichia coli K12
  CDS (1)..(570): transl_table=11
gtgatggtggtgggggaaggattactcagcgctgcgcgcttcgcccttcgggtcgttgcctgcggcaacgctctctcgctggcgctcgagtcgaaccttggtcgaagcttctcatccttccccgcatgggcagaatatttaattgcggattcgttgggaagttcagggacttttgaaagtgatggtggtgggggaaggattcgaaccttcgaagtcgatgacggcagatttacagtctgctccctttggccgctcgggaaccccaccaggggtaattcaaattttgaggtaatgcttgagatggtggtgggggaaggattattcgtcgcttcgctcctcacccttcgggccgttgcctgtggcaacgttctctcgctttcgctcgaatcgaaccttagtcgaaggttctcacccttccccgatgagtgcaaactttcacaatctcaccgaagttaccacatcgctgtggtgaattatggtggtgggggaaggattcgaaccttcgaagtcgatgacggcagatttacagtctgctccctttggccgctcgggaaccccaccacggggtaa

SEQ ID NO: 75691 - protein, 189 aa, Escherichia coli K12
MMVVGEGLLSAARFALRVVACGNALSLALESNLGRSFSSFPAWAEYLIADSLGSSGTFESDGGGGRIRTFEVDDGRFTVCSLWPLGNPTRGNSNFEVMLEMVVGEGLFVASLLTLRAVACGNVLSLSLESNLSRRFSPFPDECKLSQSHRSYHIAVVNYGGGGRIRTFEVDDGRFTVCSLWPLGNPTTG

SEQ ID NO: 75692 - DNA, 22 bp, Primer
atggtggtgggggaaggattac

SEQ ID NO: 75693 - DNA, 23 bp, Primer
ttaaggttcggctcgagcgtcag

SEQ ID NO: 75694 - protein, 99 aa, consensus
  MISC_FEATURE (1)..(99): consensus for the disclosure of xaa see table XV
MVVGEGLLSAARFALXVVACGNALSLALXSNLXRSFSSFXAWAEYLXXDSXXXSGXFESDGGGGRIXXXXXXXXXXXXCXLXPXGXXXRXXSXXXXXXE

SEQ ID NO: 75695 - protein, 66 aa, consensus
  MISC_FEATURE (1)..(66): consensus for the disclosure of xaa see table XV
MVVGEGLLSAARFALXVVACGNALSLALXSNLXRSFSSFXAWAEYLXXDSXXXSGXFESDGGGGRI

SEQ ID NO: 75696 - DNA, 975 bp, Escherichia coli
  CDS (1)..(975)
atgaaattacaacaacttcgctatattgttgaggtggtcaatcataacctgaatgtctcatcaacagcggaaggactttacacatcacaacccgggatcagtaaacaagtcagaatgctggaagacgagctaggcattcaaattttttcccgaagcggcaagcacctgacgcaggtaacgccagcaggacaagaaataattcgtatcgctcgcgaagtcctgtcgaaagttgatgccataaaatcggttgccggtgagcacacctggccggataaaggctcgctgtatatcgccaccacgcatacccaggcacgctacgcgttaccaaacgtcatcaaaggctttattgagcgttatccccgcgtttctttgcatatgcaccagggttcgccgacacaaattgctgatgccgtctctaaaggtaatgcagatttcgctatcgccacagaagcgctgcatctgtatgaagatttagtgatgttaccgtgctaccactggaatcgggctattgtagtcactccggatcacccgctggcaggcaaaaaagccattaccattgaagaactggcgcaatatccgttggtgacatataccttcggctttactggacgttcagaactggatactgcctttaatcgcgcagggttaacgccgcgtatcgttttcacggcaacggatgctgacgtcattaaaacttacgtccggttagggctgggggtaggggtcattgccagcatggcggtggatccggtcgccgatccggaccttgtgcgtgttgatgctcacgatatcttcagccacagtacaaccaaaattggttttcgccgtagtacttttttgcgcagttatatgtatgatttcattcagcgttttgcaccgcatttaacgcgtgatgtcgttgatgcggctgtcgcattgcgctccaatgaagaaattgaggtcatgtttaaagatataaaactgccggaaaaataa

SEQ ID NO: 75697 - protein, 324 aa, Escherichia coli
MKLQQLRYIVEVVNHNLNVSSTAEGLYTSQPGISKQVRMLEDELGIQIFSRSGKHLTQVTPAGQEIIRIAREVLSKVDAIKSVAGEHTWPDKGSLYIATTHTQARYALPNVIKGFIERYPRVSLHMHQGSPTQIADAVSKGNADFAIATEALHLYEDLVMLPCYHWNRAIVVTPDHPLAGKKAITIEELAQYPLVTYTFGFTGRSELDTAFNRAGLTPRIVFTATDADVIKTYVRLGLGVGVIASMAVDPVADPDLVRVDAHDIFSHSTTKIGFRRSTFLRSYMYDFIQRFAPHLTRDVVDAAVALRSNEEIEVMFKDIKLPEK

SEQ ID NO: 75698 - DNA, 984 bp, Xanthomonas oryzae pv. oryzae KACC10331
  CDS (1)..(984)
atgacgctgacccaacttcgctatctggtggccatcgccgatgccgagctgaacatcacgctggccgctggacgcgtgcacgcgacccagcccggcctgtccaagcagctcaagcagctggaggacgagctgggctttctgttgttcgtgcgcaaggggcgcagcctggatggggcaacgccagccggtgtggaagtgatcgagcgtgcgcgtgcggtgctgtcggaggtcaacaatatccgcacctatgcggccaaccagcgccgcgaaagccagggccagctgaccctgaccaccacccacacccaggcgcgcttcgtgctgccgccggcagtggcgcagatcaagaacgcctacccgcaggtcagcgtgcatttgcaacaggctgccgaaagtgcggcgctggatctgctcggccagggcgatgcggatattgccgtggtcagcactgccggcggcgagccgagtgccgggattgcagtgccgctgtaccgctggcggcggctggtggtggtgccgcgcgggcatgcgttggatcacccgcgcacggcgccggaaatgcacgcgttgtccgagcatccgctgatcagctacgactcttccacgcgtccgggctcatcgctgcagcgcgcgtttgcgcagatgggtctggagccgagcatcgcgttgaccgcgctggacgcggatctcatcaaaacgtacgtacgtgccgggctcggcgtgggcctggtggcggagatggcggtcaatgccttcgacaaagatctacgcgcctggccggcgcccgcaccgattgcagagtgcatcgcctgggcggtgctgccacgcgaccgcgtgctgcgcgactacgcattggacctggtgcatgtgctcgcgccgcaaatcgacaagcgcgacctgcgccgcgtactggacggcaatcaggcgccgaactggccattgccgccgacctgggaatcgctgacccagaccatcaccagctga

SEQ ID NO: 75699 - protein, 327 aa, Xanthomonas oryzae pv. oryzae KACC10331
MTLTQLRYLVAIADAELNITLAAGRVHATQPGLSKQLKQLEDELGFLLFVRKGRSLDGATPAGVEVIERARAVLSEVNNIRTYAANQRRESQGQLTLTTTHTQARFVLPPAVAQIKNAYPQVSVHLQQAAESAALDLLGQGDADIAVVSTAGGEPSAGIAVPLYRWRRLVVVPRGHALDHPRTAPEMHALSEHPLISYDSSTRPGSSLQRAFAQMGLEPSIALTALDADLIKTYVRAGLGVGLVAEMAVNAFDKDLRAWPAPAPIAECIAWAVLPRDRVLRDYALDLVHVLAPQIDKRDLRRVLDGNQAPNWPLPPTWESLTQTITS

SEQ ID NO: 75700 - DNA, 972 bp, Pasteurella multocida subsp. multocida str. Pm70
  CDS (1)..(972): transl_table=11
atgaaaatacaacaattacgttatattgtagaaattgttaatcaaaatttaaatgtaacagaggcagcaaacgcgctttttacttctcaaccggggatcagcaaacaagtccgtttattagaagatgaactcggtttagaaatttttgaacgcaatgggaagcatattaaatccttaacgccggcaggacaaaaaatcgtagcgattgcacgggagctcttagtcaaaacacaaagtattagagcggtagcaaatgaatacactcaacccaaccatggcgttttgcgtattgctaccactaatacacaagcacgatatgtgttaccgccagtgattgaacgtttttcaaagaagtatcctgatgtcagtttacatattcatcaaggttcaccaacgcagatttatgatgcgttgttatctggtgaagtggatattgcgattaccactgaagcgcagtatttatttgatgatgtggtgcttttaccttgttatatgtggaatcgttcggtactgattaagcatgatcatccccttgcacaatgtaaaaacctgaccattgaagaattaggaaaatatcctcttgtgacctatacctttggttttacgggagtgtccgatttggattatgcttttaatcgtgctgggattttacctaatatcgtttttacggctaccgatgcggatgtgatcaaaacctatgtccgtttaggtttaggggtgggcattatggcgtctatggcacatacaaaagatgatggtgatttacttgctttaaatgcggatcatctctttaatccaagtacggtacaaattgcatttaaacacagcactttcttacgtgcgtacatgtatgattttattcagtatttctcaccgcacttaacacgtgaattagttgaaaaagcagagcgattacgtgataacaatgcagtgaaaaaactgtttgaaggcattgaattagcgatacgttag

SEQ ID NO: 75701 - protein, 323 aa, Pasteurella multocida subsp. multocida str. Pm70
MKIQQLRYIVEIVNQNLNVTEAANALFTSQPGISKQVRLLEDELGLEIFERNGKHIKSLTPAGQKIVAIARELLVKTQSIRAVANEYTQPNHGVLRIATTNTQARYVLPPVIERFSKKYPDVSLHIHQGSPTQIYDALLSGEVDIAITTEAQYLFDDVVLLPCYMWNRSVLIKHDHPLAQCKNLTIEELGKYPLVTYTFGFTGVSDLDYAFNRAGILPNIVFTATDADVIKTYVRLGLGVGIMASMAHTKDDGDLLALNADHLFNPSTVQIAFKHSTFLRAYMYDFIQYFSPHLTRELVEKAERLRDNNAVKKLFEGIELAIR

SEQ ID NO: 75702 - DNA, 951 bp, Neisseria meningitidis MC58
  CDS (1)..(951): transl_table=11
atgaaattacaacaattgaaatacgccttagaagtttaccagcacaacctgaacgtttccgaagcggccgaagccttgtttacttcgcaacccggcatctccaaacaaatcaaattgctggaagaagaaatcggcattcagatttttatccgcagcggcaagcgcgtggtttcggtctcgcagccgggcaaggtggttttggatattgcggaacgtattttgcgcgatgttcagaacattaaaaatatcggcagcgagtttaccggacaggacagcggttcgctgacggttgccacgacgcatactcaggcacgctatgccctacccttgattgttgccgattttgtgaaacgctatccgaaagtcaacctgaccatcaaacaggggagccctgccgccatcgcacgtatggttacctcaggcgaggcggacttggcgattgttacggaacggatagacgaccatcccgaactgggaaaacttccctgctatgactggactcatgcggttatcgtaccgaacgaccaccccttgctcgaatgcagaaaccccctccgtattgaagatttggcgaggtttccgctgattacttatgaatttgcattcaatgcgggcagcagcatcgcgcgggcattttccaaagcccgtttggaacaacccgatgtcgcattggctgcggcagatacggacgtattgaagacttatgtgcgcttgggtttgggcgtgggactgatggcgaaaatggcgtacaacccggatacggacggcgatttgcagcttgtggatgcggcacacctgttcgagccgtcgccgacgtggattgctttgcgcagcgatacttatttgcgcggatatgcctacgactttatccaagcgttcgcgccgcacctgacacgcgagaaggtggataggattctgtacacgcccatcagcgaggatttttcgatttag

SEQ ID NO: 75703 - protein, 316 aa, Neisseria meningitidis MC58
MKLQQLKYALEVYQHNLNVSEAAEALFTSQPGISKQIKLLEEEIGIQIFIRSGKRVVSVSQPGKVVLDIAERILRDVQNIKNIGSEFTGQDSGSLTVATTHTQARYALPLIVADFVKRYPKVNLTIKQGSPAAIARMVTSGEADLAIVTERIDDHPELGKLPCYDWTHAVIVPNDHPLLECRNPLRIEDLARFPLITYEFAFNAGSSIARAFSKARLEQPDVALAAADTDVLKTYVRLGLGVGLMAKMAYNPDTDGDLQLVDAAHLFEPSPTWIALRSDTYLRGYAYDFIQAFAPHLTREKVDRILYTPISEDFSI

SEQ ID NO: 75704 - DNA, 951 bp, Neisseria meningitidis Z2491
  CDS (1)..(951): transl_table=11
atgaaattacaacaattgaaatacgccttagaagtttaccggcacaacctgaacgtttccgaagcggccgaagccttgtttacttcgcaacccggcatctccaaacaaatcaaattgctggaagaagaaatcggcattcagatttttatccgcagcggcaagcgcgtggtttcggtctcgcagccgggcaaggtggttttggatattgcagaacgtattttgcgcgatgttcagaacattaaaaatatcggcagcgagtttaccggacaggacagcggttcgctgacggttgccacgacgcatactcaggcacgctatgccctacccttgattgttgccgattttgtgaaacgctatccgaaagtcaacctgaccatcaaacaggggagccctgccgccatcgcccaaatggttacttcgggagagtctgatttggcaattgttacggaacgtatagacgaccaccccgaactgggaagactttcctgctacgactggacacacgcggttatcgtaccgaacgaccaccccttgctcgaatgcagaaaccccctccgtattgaagatttggcgaggtttccgctgattacttatgaatttgcattcaatgcgggcagcagcatcgcgcgggcattttccaaagcccgtttggaacagccggatgtcgcattggcggcggcggatacggacgtattgaagacttatgtgcgcttgggtttgggcgtgggactgatggcgaaaatggcgtacaacccggatacggacggcgatttgcagcttgtggatgcggcacacctgttcgagccgtcgccgacgtggattgctttgcgcagcgatacttatttgcgcggatatgcctacgactttatccaagcgtttgcgccgcacctgacacgcgagaaggtggataggattctgtacacgcccatcagcgaggatttttcgatttag

SEQ ID NO: 75705 - protein, 316 aa, Neisseria meningitidis Z2491
MKLQQLKYALEVYRHNLNVSEAAEALFTSQPGISKQIKLLEEEIGIQIFIRSGKRVVSVSQPGKVVLDIAERILRDVQNIKNIGSEFTGQDSGSLTVATTHTQARYALPLIVADFVKRYPKVNLTIKQGSPAAIAQMVTSGESDLAIVTERIDDHPELGRLSCYDWTHAVIVPNDHPLLECRNPLRIEDLARFPLITYEFAFNAGSSIARAFSKARLEQPDVALAAADTDVLKTYVRLGLGVGLMAKMAYNPDTDGDLQLVDAAHLFEPSPTWIALRSDTYLRGYAYDFIQAFAPHLTREKVDRILYTPISEDFSI

SEQ ID NO: 75706 - DNA, 1032 bp, Xylella fastidiosa 9a5c
  CDS (1)..(1032): transl_table=11
atggaagtgatctacagtcgtttttggttttgcgatatttcgcctgtcatgacgttgactcaacttcgctaccttgtggctattgccgatgccgatctcaatattacgcttgctgcggcacgtatacatgccacgcagccgggcctgtccaagcaattgaaaaagctggaggatgaactcggctttctgttgtttgtgcgccggggccgcagtttggagtcagtgacgcctgcgggggaggaggtgattgagcgggcgcgggcgatgttggttgaagtgaacaacatacgtacttatgccgccaatcagcgccgtgagcaccaagggcaattgacgttgagtaccacccacactcaggcgcgttttgtgctgccgcctgccgtggcgttgatcaagcaggcttatccggaggttactgtgcatttgcagcaggctgccgagagcgctgtgctggatgagttggatcagggaggggccgatattgcaatcgtgagtacggcgggcagcgcgccttcagcagggcttgcggtccctttgtatcggtggcggcgtttggtggttgtgccgtgtggtcatcctttggacacagtgggccgcactctggatttggcagcgctggcggagtatccgttggtcagttatgactcttcaatccggccaatgtcttcgctgcaacgtgctttcgccagtttagggttggagtcgcgcattgtgttgacggctctggatgctgatttgatcaagacctatgtgcgtgccggtgtgggtgtgggcattcttgcggagatggcggttaatgcggtcgataccgatttgcgtgcttggccggtcccggcgcccattcctgaatgtattgcttgggcggtgctgccacgtgatcgtgtcttgcgtgactacgtgttggagttggtgcatgcgcttgcgccgcagatcgacaagcgtgatttgcggcgtgtgctcaatggtcatcaggagcctgactggccgtcgcctcctagctggcaatcattgacacagaccattaccaattga

SEQ ID NO: 75707 - protein, 343 aa, Xylella fastidiosa 9a5c
MEVIYSRFWFCDISPVMTLTQLRYLVAIADADLNITLAAARIHATQPGLSKQLKKLEDELGFLLFVRRGRSLESVTPAGEEVIERARAMLVEVNNIRTYAANQRREHQGQLTLSTTHTQARFVLPPAVALIKQAYPEVTVHLQQAAESAVLDELDQGGADIAIVSTAGSAPSAGLAVPLYRWRRLVVVPCGHPLDTVGRTLDLAALAEYPLVSYDSSIRPMSSLQRAFASLGLESRIVLTALDADLIKTYVRAGVGVGILAEMAVNAVDTDLRAWPVPAPIPECIAWAVLPRDRVLRDYVLELVHALAPQIDKRDLRRVLNGHQEPDWPSPPSWQSLTQTITN

SEQ ID NO: 75708 - DNA, 942 bp, Ralstonia solanacearum GMI1000
  CDS (1)..(942): transl_table=11
atgaacctgcaccaatttcgcttcgtgcgtgaagccgtgcggcagaaattcaatctgaccgaggcggcgaaagcgctctatacatcacaacccggtgtctccaaggccatcatcgagctggaggaagaactgggtgtcgatatcttcacccggcatggcaagcgcatccgggggctcaccgagcccgggcggcgcatcctggcatcggtcgagcgcgtgttgcaggaggtggacacgctcaagcgcgtcggcaaagactacgccgcgcaggaccagggcaatttcaccatcgccaccacgcacacgcaggcgcgctatgcactgcccaaggcgatcgccgaattcacgcgccggtatccgaaggtgcgcctgtcgatccagcagggcacgcccgcgcagatcgccgagatggtcctgcacgaccgcgccgacatcgccatcgccacagaagggctgtcgcagatcaaggacctgatctccatccccggctaccagtggcagcacgtggtggtgacgccggccgaccacccgctgctgtcgcgccagcacctgacgctggaagacctgaagaactatccgatcatcacctacgaccagcacttcgccgggcgccccaagatcgaccacgccttcgagctgcgccagctcaagcccgacatcgtgctggaggccatcgacgcggacgtcatcaagacctacgtggaggtcgggctgggcatcggcatcgtggccggcgtggcgttcgacccggagcgcgaccgcaacctgcgcgcgatcccggccggccacctgttcggcaccaacgtcacccacctggggatcaagcagggggcctacctgcgcggcttcgtctacaccttcatcgaactgttcgcgccggcgctcacgcgcaagctgctcgagcagctgctggcgggcgagcacgaagcgtacgaactgtga

SEQ ID NO: 75709 - protein, 313 aa, Ralstonia solanacearum GMI1000
MNLHQFRFVREAVRQKFNLTEAAKALYTSQPGVSKAIIELEEELGVDIFTRHGKRIRGLTEPGRRILASVERVLQEVDTLKRVGKDYAAQDQGNFTIATTHTQARYALPKAIAEFTRRYPKVRLSIQQGTPAQIAEMVLHDRADIAIATEGLSQIKDLISIPGYQWQHVVVTPADHPLLSRQHLTLEDLKNYPIITYDQHFAGRPKIDHAFELRQLKPDIVLEAIDADVIKTYVEVGLGIGIVAGVAFDPERDRNLRAIPAGHLFGTNVTHLGIKQGAYLRGFVYTFIELFAPALTRKLLEQLLAGEHEAYEL

SEQ ID NO: 75710 - DNA, 981 bp, Xanthomonas campestris pv. campestris str. ATCC 33913
  CDS (1)..(981): transl_table=11
atgacgctgacccaacttcgctacctggtggccatcgccgatgccgagctgaacatcacgctggccgcggcgcgtgtgcacgcgacccagccgggcctgtccaaacagctcaaacagctggaggacgagctgggctttttgctgttcgtgcgcaaggggcgcagcctggatgcggtgaccccggccggcgtggaagtgatcgaacgtgcccgcgcggtgctgtccgaagccaacaacatccgcacctacgccgccaaccagcgccgcgaaagccagggccagctgaccttgaccaccacccatacccaggcgcgcttcgtgttgccgcctgcggtggcacagatcaagcaggcctaccctcaggtcagcgtgcatctgcagcaggcggccgagagcgcggcgctggatctgctcagccagggcgatgcggacattgccgtggtcagcaccgcgggcggcgagcccacggccggcatcgcggtgccgctgtaccgctggcgccggttggtagtcgtgccgcgcgggcatgcactggacacgcgcgtggcgccggacatgcaggcgctgtctgcgcacccgctgatcagttacgaatcctccacgcgcgccggctcctcgctgcaacgggcgtttgcgcaggtgggcctggagccgagcattgcgctgaccgcgctggatgcggacctgatcaagacctacgtgcgtgctggcctgggcgtggggctggtggccgaaatggccgtcagtgccaacgacgaggatctgcgcgcgtggccggccccggcgccgatcgccgagtgcatcgcctgggcggtgctgccgcgcgaccgcgtgttgcgcgattacgcattggacctggtgcatgtgttggcaccacagatcgacaagcgcgacctgcgccgggtgctggacggcaaccaggcgccgaactggccgctgccgccgacctgggaagcgctgacccagaccatcaccagctga

SEQ ID NO: 75711 - protein, 326 aa, Xanthomonas campestris pv. campestris str. ATCC 33913
MTLTQLRYLVAIADAELNITLAAARVHATQPGLSKQLKQLEDELGFLLFVRKGRSLDAVTPAGVEVIERARAVLSEANNIRTYAANQRRESQGQLTLTTTHTQARFVLPPAVAQIKQAYPQVSVHLQQAAESAALDLLSQGDADIAVVSTAGGEPTAGIAVPLYRWRRLVVVPRGHALDTRVAPDMQALSAHPLISYESSTRAGSSLQRAFAQVGLEPSIALTALDADLIKTYVRAGLGVGLVAEMAVSANDEDLRAWPAPAPIAECIAWAVLPRDRVLRDYALDLVHVLAPQIDKRDLRRVLDGNQAPNWPLPPTWEALTQTITS

SEQ ID NO: 75712 - DNA, 975 bp, Yersinia pestis KIM
  CDS (1)..(975): transl_table=11
atgaaattgcagcagcttcgctatattgttgaggttgttaaccataaccttaatgtgtcctctacggcagaaggcctgtacacctcgcaaccggggatcagcaaacaggtaagaatgctggaagatgagttaggtatccagatttttgcccgtagcggtaaacatctcacgcaggtaacccccgcagggctggaaatcatccgtattgcccgtgaagtcttgtcgaaagtggatgccattaaagctgttgctggtgaacatacctatccggataaaggttcattgtatgtagcgaccacccatacacaggcacgttacgctttacctaatgttattaaaggttttattgagcgttatcctcgagtgtctctgcatatgcatcaaggatctcccacgcaaattgccgaggcagtctctaaggggaatgccgatttcgctatcgccaccgaagcattacatctttatgacgaccttatcatgttgccgtgctatcactggaaccgggcagtagttgtaaaacctgatcatccgttagccggtaaaacgcatgtcagtattgaagagctggcagcctatcctatcgtcacttatacctttggttttacggggcgttcagagctagataccgctttcaatcgcgcaggccttacgccgcgtattgtgtttactgcgaccgatgcagatgtgattaaaacttatgtacggttaggtttaggggtaggggttatcgccagtatggcggttgatccggttcaagatcctgatttggtgacagttgatgccagagatatctttacctacagcacgaccaagattggtttccgtcgtagtacgttcctgcggagttatatgtatgactttatcctgcgttttgccccacatttaactcgtgatgtggtcgataaggcggttgccttgcgctctaatgaggatatagaggccatgtttaatgatattaaattgccagtgaaatga

SEQ ID NO: 75713 - protein, 324 aa, Yersinia pestis KIM
MKLQQLRYIVEVVNHNLNVSSTAEGLYTSQPGISKQVRMLEDELGIQIFARSGKHLTQVTPAGLEIIRIAREVLSKVDAIKAVAGEHTYPDKGSLYVATTHTQARYALPNVIKGFIERYPRVSLHMHQGSPTQIAEAVSKGNADFAIATEALHLYDDLIMLPCYHWNRAVVVKPDHPLAGKTHVSIEELAAYPIVTYTFGFTGRSELDTAFNRAGLTPRIVFTATDADVIKTYVRLGLGVGVIASMAVDPVQDPDLVTVDARDIFTYSTTKIGFRRSTFLRSYMYDFILRFAPHLTRDVVDKAVALRSNEDIEAMFNDIKLPVK

SEQ ID NO: 75714 - DNA, 951 bp, Shigella flexneri 2a str. 301
  CDS (1)..(951): transl_table=11
gtgaatttccaacaactaaagataatccgcgaggctgcacgtcaggattacaacctgacagaggttgcgaatatgctttttacctcacagtcaggcgttagccgtcatattcgggaactggaggatgaatttggcatcgaaatatttgttcgacgaggtaagcgactgctggggatgactgaaccgggcaaagcattactggtcattgcagaacgtattctgaatgaagccagtaatgttcgtcggcttgcagacctgtttaccaacgatacgtctggtgttctcactattgcaacgacgcatactcaggcacgttatagcttgccagaggtcattaaagcttttcgcgaacttttcccggaggttcggctcgagctaatccagggttcgccacaggaaattgcgacgttgttgcaaaatggcgaagctgatattggtatcgccagcgagcgtttgagtaatgacccgcagctcgtcgccttcccatggttttgttggcaccatagtttgcttgttccactcgatcatcccttaacgcaaattacaccattgacgctggaatcaatagcgaagtggccgttaattacttaccgacagggaattacggggcgctcacgcactgatgacgcatttacccgcaaaggtttgccggcagatattgtattaagtgcacaggattctgatgtcattaaaacctatgttgctcttgggcttgggatcggattagttgccgaacaatccagcggcgaacaagaggaagagaatttaatccgcctggatacgcggcatcttttcgatgctaatactgtctggttgggactgaagcgaggacaacttcagcgtaactatgtttggcgctttctggaactttgtaatgcaggactgtcagttgaggatatcaagcgccaggtgatggaaaacagtgaagaggaaattgattatcagatatag

SEQ ID NO: 75715 - protein, 316 aa, Shigella flexneri 2a str. 301
MNFQQLKIIREAARQDYNLTEVANMLFTSQSGVSRHIRELEDEFGIEIFVRRGKRLLGMTEPGKALLVIAERILNEASNVRRLADLFTNDTSGVLTIATTHTQARYSLPEVIKAFRELFPEVRLELIQGSPQEIATLLQNGEADIGIASERLSNDPQLVAFPWFCWHHSLLVPLDHPLTQITPLTLESIAKWPLITYRQGITGRSRTDDAFTRKGLPADIVLSAQDSDVIKTYVALGLGIGLVAEQSSGEQEEENLIRLDTRHLFDANTVWLGLKRGQLQRNYVWRFLELCNAGLSVEDIKRQVMENSEEEIDYQI

SEQ ID NO: 75716 - DNA, 975 bp, Shewanella oneidensis MR-1
  CDS (1)..(975): transl_table=11
atgaaactgcaacagctcaggtatattgctgaggtcgtaaagcataaccttaacgtatcggccacagcggaaaatttatacacatcgcagcctgggatcagtaagcaagttcgcatgttggaagatgaattaggcattcaaatttttggtcgcagcggtaaacacctaacccatgtgacgcctgcaggacaacaggtgattaatatcgccaacgacatcttaggtaaagttgaaagcattaaaaaagtgtccgaggaatatactaaacctgatcaaggtgaattgaatattgcgacaacggatacccaagctcgttatgctttacctaacattattcgccaatttatcgaccgttatccaaaagttaacctacacatgcaccaaggcacgccatcgcagatcagtgaacaggcggcccgtggcgatgctgatttcgccatcgctactgaagcgatgcatttgtattcagatttaattatgttgccttgttatcattggaatcgctctgtcgttgtgcctaaagatcaccccttagcgacgcgaactcaaattagcattgaagatttagctcgtttcccattagtgacttatgtgtttgggtttgatcgcgcctcagaaattgagaaagcgtttaatcgagcaaacttggagccgcgggtcgtgtttagtgccaccagtgccgatgtgctaaaaacctatgtacgtttaggcttaggggtgggggtgattgcttctatggccattgaccctaacattgataaagacttagtcgccatcgatgccggtcatttgtttgcccacagcacaaccaaaattggttttagaaaaggcagttttttacgtagttatatgtatgattttattcagcattttgcgccacatttaactcgtgatgtggttgaaaaggccgtcgcattgcgtgatcaacaattaattgatgaaatgtttgctgataagaatctgccaatgcgctga

SEQ ID NO: 75717 - protein, 324 aa, Shewanella oneidensis MR-1
MKLQQLRYIAEVVKHNLNVSATAENLYTSQPGISKQVRMLEDELGIQIFGRSGKHLTHVTPAGQQVINIANDILGKVESIKKVSEEYTKPDQGELNIATTDTQARYALPNIIRQFIDRYPKVNLHMHQGTPSQISEQAARGDADFAIATEAMHLYSDLIMLPCYHWNRSVVVPKDHPLATRTQISIEDLARFPLVTYVFGFDRASEIEKAFNRANLEPRVVFSATSADVLKTYVRLGLGVGVIASMAIDPNIDKDLVAIDAGHLFAHSTTKIGFRKGSFLRSYMYDFIQHFAPHLTRDVVEKAVALRDQQLIDEMFADKNLPMR

SEQ ID NO: 75718 - DNA, 975 bp, Pseudomonas putida KT2440
  CDS (1)..(975): transl_table=11
atgaagcttcaacaactgcgctacatctgggaagtggcgcaccatgacctcaacgtctccgcgacggcgcagagcctgtatacctcccagccaggtatcagcaagcagatccgcctgctcgaagacgaattgggtgttgaagtctttgcccgcagcggcaagcatctgacccgcgttaccccggccggtgagcgcatcatcaataccgcaggcgaaatcctgcgcaaggtcgagagcatcaagcagattgcccaggagttctccaacgagaagaagggcacgctgtccatcgccaccacccacacccaggcgcgctatgcgttgccgccggttatcagcagcttcatcaagcagtatccggaggtgtccctgcacatgcatcagggttcgcccatgcagattgccgagatggctgcggacggtacggtcgatttcgccatcgccaccgaggcgctggagctgttcggcgacctgatcatgatgccgtgctacaagtggaaccgttgcgttgtggtgccgcaggggcacccgctggccaagctgccgaaactgaccctggaagccgtcgccgagtacccgatcgtcacctacgtgttcggtttcaccgggcgctcaaagctggatgaagctttcaatcaccgtggcctcacgccaaaagtggtcttcaccgcggctgacgccgacgtgatcaagacgtatgtgcgcctggggttgggcgtgggtatcgttgccggcatggctgtggacgccaagctcgacagtgacttggtggcgctggatgccagtgagctgtttgaagccagcatcaccaagatcggcttccgtcgtggcaccttcctgcgcggcttcatgtgcgacttcatcgagaagtttgccccgcacctgacccgtgaagtgatggccaaggccattcagtgccataacaagcaagagctggaagaattgttcgaaggcgtcgaactgccggtgcactga

SEQ ID NO: 75719 - protein, 324 aa, Pseudomonas putida KT2440
MKLQQLRYIWEVAHHDLNVSATAQSLYTSQPGISKQIRLLEDELGVEVFARSGKHLTRVTPAGERIINTAGEILRKVESIKQIAQEFSNEKKGTLSIATTHTQARYALPPVISSFIKQYPEVSLHMHQGSPMQIAEMAADGTVDFAIATEALELFGDLIMMPCYKWNRCVVVPQGHPLAKLPKLTLEAVAEYPIVTYVFGFTGRSKLDEAFNHRGLTPKVVFTAADADVIKTYVRLGLGVGIVAGMAVDAKLDSDLVALDASELFEASITKIGFRRGTFLRGFMCDFIEKFAPHLTREVMAKAIQCHNKQELEELFEGVELPVH

SEQ ID NO: 75720 - DNA, 975 bp, Vibrio parahaemolyticus RIMD 2210633
  CDS (1)..(975): transl_table=11
atgaaactgcagcagctgaagtacattgttgaggttgtgaaccataatctaaacgtttctgcgacggcggagagtttatacacctctcagcctggtattagtaagcaggttcgtttactagaggatgagctgggaatccagatcttcgaacgaagtggtaaacatttaacgcaagtgacaccagcaggtgaagagatcgttcgtatttcccaagaaatccttgctcgtgttgagagcatcaaagcggtagcgggcgagcatactcaccctgaaatgggcacgttaaatatttcaacaacccatactcaagcgcgctatgcattgcccgatgtcatcaaaggttttacggcacgttacccgaaagtgtctttgcacatgcatcaaggtacgccttctcaaatgtctgaagcgattgcaaaaggtacagccaactttgcgattgcgacagaagctctccatctttaccaagatgctatcatgttgccttgttaccactggaatcgctctattgtggtgccaaaagatcatccgttggcgaagaaagacttagttactattcacgatttagctgcttatcctttggtgacttatgtgtttggctttactggtcgctctgagttagataccgctttcaaccgtgaaggtttgacgccgcgagtcgtgttcactgcaaccgatgcggatgtgattaaaacgtatgtgcgcatgggtatcggtgttggtgtgattgcgagcatggccgtcgatgaagagcaagaccgcgatttagttgctattgatgcgagtcatttgtttggtgcgagtacaaccagtattggtttccgccgtggcacgttcctgcgttcttacatgtttgactttatggagcgtttcgcaccgcacttaacgcgccctgttgtagaacaggcgatttctcttaagtcgaatgctgaaattgaagagatgtttaaagacatcgagcttccggtaagataa

SEQ ID NO: 75721 - protein, 324 aa, Vibrio parahaemolyticus RIMD 2210633
MKLQQLKYIVEVVNHNLNVSATAESLYTSQPGISKQVRLLEDELGIQIFERSGKHLTQVTPAGEEIVRISQEILARVESIKAVAGEHTHPEMGTLNISTTHTQARYALPDVIKGFTARYPKVSLHMHQGTPSQMSEAIAKGTANFAIATEALHLYQDAIMLPCYHWNRSIVVPKDHPLAKKDLVTIHDLAAYPLVTYVFGFTGRSELDTAFNREGLTPRVVFTATDADVIKTYVRMGIGVGVIASMAVDEEQDRDLVAIDASHLFGASTTSIGFRRGTFLRSYMFDFMERFAPHLTRPVVEQAISLKSNAEIEEMFKDIELPVR

SEQ ID NO: 75722 - DNA, 918 bp, Nitrosomonas europaea ATCC 19718
  CDS (1)..(918): transl_table=11
gtgaattttcagcaactccgcatcatcagtgaaacaattcggcagaattacaatttgacggaagtggccaatgccctgtttacctcgcaatccggggtcagcaagcatatcaaagatctggaagatgaactgaacatcgatctgttcatccgaaagggcaaacgcctgaccggactgaccgcaccgggcaaggaactggtcaaaatcgttgaccgcattctgctggataccagaaatatcaaacgactggcagaacagttcagtcagcatgaccagggtgaactgaccgtggctaccacccacacccaggcacaatacgccttaccggatgttgttaggcaattcaaggaaatattcccaaaagtacatctcgtacttcacgaatccagtcccggcgagatcgtatccatgctgctgaatggccaggcggatattggcatcgcaaccgaagcgctggagagtacttctgaactggtatcgtttccgtactatacctggcatcatgcgatcatcgtaccggcagaacatccgctgcaatcgatacaccctctcacactcgaagctgttgcgcaatttccgatcattacctatcacaagggttttaccgggcgttcccgaatcgatcaggcgttctctcgcgcggaattgacacccaatatcgccatgtccgctctcgatgcagatgtcatcaaaacctatgtcactctgggtatgggaattggtatcgttgcatctgtcgcatttacaccggaacgggatacaaaactgatcaaactggatggttctcatctgttcgagcagaataccacctgcatatccatacgacgtaaccactatctgcgcggatacgcctaccggttcatcgagctgtgcatcccttcactgagcagagataccatctgctcagaaatacaatag

SEQ ID NO: 75723 - protein, 305 aa, Nitrosomonas europaea ATCC 19718
MNFQQLRIISETIRQNYNLTEVANALFTSQSGVSKHIKDLEDELNIDLFIRKGKRLTGLTAPGKELVKIVDRILLDTRNIKRLAEQFSQHDQGELTVATTHTQAQYALPDVVRQFKEIFPKVHLVLHESSPGEIVSMLLNGQADIGIATEALESTSELVSFPYYTWHHAIIVPAEHPLQSIHPLTLEAVAQFPIITYHKGFTGRSRIDQAFSRAELTPNIAMSALDADVIKTYVTLGMGIGIVASVAFTPERDTKLIKLDGSHLFEQNTTCISIRRNHYLRGYAYRFIELCIPSLSRDTICSEIQ

SEQ ID NO: 75724 - DNA, 957 bp, Nitrosomonas europaea ATCC 19718
  CDS (1)..(957): transl_table=11
atgaaacttcagcaattaaaatatcttcatgaaattgcaaaacaaaagctgaatttatccaaggcagcaaatgccctgcatacttcacaacctgggatcagccgacagatccagctactggaacaagaactgggggttgagattttcacacgtcacggcaaacgtattatcggcattacgcagccagggctggcgatcctgcaaactgctcagcggatgctgcaggacgcagacaacctgaaaaaaattggaaatgaatttaatgataaggaaagcggtacatttattattgcgactactcacacacaagcacgatatgtacttcctcctgtaatcaagcgctttatcgaacactacccgaaaatcaggctgtccttacgacagggaagtcccatagagatagccacctgggtttcatctggtgaagccgatttagctatagcaaccgaagctatcgaattattcgataaacttgtcatgctgccttgctacgaatggaaccgctgcatcgttgttccaccccgacatccattactccagcttaaggagttaacacttgaatccatcgcccaatacgctatcgttacctatgattttgcctttaccggccgctccaaaatcaaccaggcattcgaatccaaagggctgaaacccaatgtggtactgaccgcacttgatgcggacgtaatcaaaacctatgtagaaataggtttaggcgtaggcattctggcaaagatggcctttgatccagttcgcgataaaaagctacgggctattgatgccgcacatctgtttgaacccagcactacccgcatcggcatctgtcgtaacagttacattcgtcactatgtttacgattttatcgagatgttcgctgctcatctcgacatggaaacagttaataaattactcaaaaaccccgaaaatcaacagttatctatagccaacgataaataa

SEQ ID NO: 75725 - protein, 318 aa, Nitrosomonas europaea ATCC 19718
MKLQQLKYLHEIAKQKLNLSKAANALHTSQPGISRQIQLLEQELGVEIFTRHGKRIIGITQPGLAILQTAQRMLQDADNLKKIGNEFNDKESGTFIIATTHTQARYVLPPVIKRFIEHYPKIRLSLRQGSPIEIATWVSSGEADLAIATEAIELFDKLVMLPCYEWNRCIVVPPRHPLLQLKELTLESIAQYAIVTYDFAFTGRSKINQAFESKGLKPNVVLTALDADVIKTYVEIGLGVGILAKMAFDPVRDKKLRAIDAAHLFEPSTTRIGICRNSYIRHYVYDFIEMFAAHLDMETVNKLLKNPENQQLSIANDK

SEQ ID NO: 75726 - DNA, 954 bp, Bordetella pertussis Tohama I
  CDS (1)..(954): transl_table=11
atgaacctgcagcaattccgttttgtgcgcgaaaccatccggcgcgacttcaaccttaccgaagccgcccggatgctctatacctcgcagccgggcgtctcgaaggcgatcatcgaattcgaggacgagctcggcatcaagatcttcgagcggcacggcaagcgcatcaaggggctgaccaagcccgggctggccgtttcgcaggtgatcgaccgcatcatgcgcgaagtcgacaacctgaagaaggtcagcgacgagttcgcccgccgcgacgagggcgggctggtgatcgcctgcacccatacgcaggcgcgctacctgctgccgcgcgtgattccggcctttcgcaagcagtttcccaaggtgcacctgtcggtggcagagggcagcccgtcgcagctggccgaaatggtgctgcacgagcaggccgacctggcgctggccaccgagtcgctggcgctgacgcccggcctggcgaccctgccggtctacacctgggagcacacggtggtggtgcgccccgaccacccgcttaccgaactgacctccagccaggcgcggcgcctgacgctggcccagctggccgaataccccatcgtgacgtacgaccgggcctttaccggccgtaccacgatcgacgagatattcgccaaccagggcatccacccggatatcgtgctcgaagccatcgacgccgacgtgatcaagacctatgtcgacgtggggctgggcatcggcatcatcgccggcgtcgcgtacgacccgcgccgcgacgccaacctggtcggcctgccggtggggcacctgttcggcacgcacaccacgcgcgtgggggtgaagtcgggggtgttcctgcgcgattacgtgtacaccttcatggaaatgatggcccccggcctgacgcgccaggtggtcagcgaagcggtgcagggccgggccggcctgaacggctag

SEQ ID NO: 75727 - protein, 317 aa, Bordetella pertussis Tohama I
MNLQQFRFVRETIRRDFNLTEAARMLYTSQPGVSKAIIEFEDELGIKIFERHGKRIKGLTKPGLAVSQVIDRIMREVDNLKKVSDEFARRDEGGLVIACTHTQARYLLPRVIPAFRKQFPKVHLSVAEGSPSQLAEMVLHEQADLALATESLALTPGLATLPVYTWEHTVVVRPDHPLTELTSSQARRLTLAQLAEYPIVTYDRAFTGRTTIDEIFANQGIHPDIVLEAIDADVIKTYVDVGLGIGIIAGVAYDPRRDANLVGLPVGHLFGTHTTRVGVKSGVFLRDYVYTFMEMMAPGLTRQVVSEAVQGRAGLNG

SEQ ID NO: 75728 - DNA, 930 bp, Chromobacterium violaceum ATCC 12472
  CDS (1)..(930): transl_table=11
atgaacttccagcagctgcgcatcatccgcgaaaccgtgcgccagggtttcaacctgaccgaggtggccaacgcgctgttcacctcgcagtccggcgtcagcaagcacatcaaggacctggaggacgagctgggcgtggagctgttcatccgcaagggcaaacgcttcctcggcttgaccgatcccggcaaggaactgctgatcatcgtcgagcgcatgctgctggacgccggcaacatcaagcgcctggcgcagcagttcagcctgcgcgacgagggccagctgaccatcgccaccacccacacccaggcgcgctacgcgctgccgcaggtggtgaccgagttcaagcgcgccttcccacgcgtgcacctggtgctgcaccaggccagcccggaggagctggtgcggctgttgctggccggcgacgccgatatcggcatcgccaccgaggcggtgaccgaagtgccggaactggtgtccttcccctactacagctggcaccactgcgtgatcgccccgcccgagcacccgctgcaccgcgagccgctgacgctggaggcgctggccgagcacccgatcgtcacctaccaccacggtttcaccggccgggccaagatagacaacaccttcgccgaggccggcctggcgcccgacatcgtgatggcggcgctggacgccgatgtgatcaagacctatgtcgagctggagctgggcgtcggcatcgtcgcctcgatggcggtggatccgcgccgcgacgccggcgtcaaggtggtggaaggcccgccgctgttcggccagcagaccagccgcatcgcgatacgccgcggccattacctgcgcagctacgcctaccgcttcatcgagctgtgcgcgccggcgctgaacgagcagagcgtgcgccaggcgctcagcccggcgctgcaggaatag

SEQ ID NO: 75729 - protein, 309 aa, Chromobacterium violaceum ATCC 12472
MNFQQLRIIRETVRQGFNLTEVANALFTSQSGVSKHIKDLEDELGVELFIRKGKRFLGLTDPGKELLIIVERMLLDAGNIKRLAQQFSLRDEGQLTIATTHTQARYALPQVVTEFKRAFPRVHLVLHQASPEELVRLLLAGDADIGIATEAVTEVPELVSFPYYSWHHCVIAPPEHPLHREPLTLEALAEHPIVTYHHGFTGRAKIDNTFAEAGLAPDIVMAALDADVIKTYVELELGVGIVASMAVDPRRDAGVKVVEGPPLFGQQTSRIAIRRGHYLRSYAYRFIELCAPALNEQSVRQALSPALQE

SEQ ID NO: 75730 - DNA, 945 bp, Chromobacterium violaceum ATCC 12472
  CDS (1)..(945): transl_table=11
atgaagctacaacaactccgctacctggtcgaggtggccaagcagggcctcaacgtttccgaggccgccgagaagctgcatacctcgcagccgggcatttccaagcagatccgcctgctggaggacgaactgggcatccaggtgttcatccgcaacggcaagcgggtggtgtcggtatccgagccgggcaaggaagtgctgcgcatctccgagcgcatcctgcgcgaggcgcagaacctgaaacgggtcggcgacgagttctcccgcgagtctgaaggcgcgctgaccatcgccaccacccacacccaggcccgctacgcgctgccgcaggcgatcgccgaattcgtgcgccgctaccccaaggtgcggctgtcgctgaagcagggcagcccgacgcagatctgcgacatggtggtgtccggcgaggccgatctcgccatcgccaccgagggcatcgcgctgtacaaggagctggcgacgctgccttgctacgaatggaaccgctcgctggtggtgcccaagggccacccgctggccgcgctggaacgcgaaatcaccctggcggacatcgctcaatacccgatcgtcacctacgacttcgccttcgccggccgctccaagatcaacaagtcgttcgccgaacagggcctgacgcccaacgtggtgctgaccgcgatcgacaccgacgtgatcaagacctatgtctcgctggggctgggcatcggcatcatcgccagcatggccttcgagccggagcgcgaccacaacctgacggcgatcgacgccggccacctgttcgagccgtccaccaccaagatcggcatccgcaaggacgcctacctgcgcggcttcgcctacaccttcatcgagctgttcgcgccgcatctgcaccgccgcgaggtagactcggcgctgctggcgcacgatgtcgacgacgaggaatga

SEQ ID NO: 75731 - protein, 314 aa, Chromobacterium violaceum ATCC 12472
MKLQQLRYLVEVAKQGLNVSEAAEKLHTSQPGISKQIRLLEDELGIQVFIRNGKRVVSVSEPGKEVLRISERILREAQNLKRVGDEFSRESEGALTIATTHTQARYALPQAIAEFVRRYPKVRLSLKQGSPTQICDMVVSGEADLAIATEGIALYKELATLPCYEWNRSLVVPKGHPLAALEREITLADIAQYPIVTYDFAFAGRSKINKSFAEQGLTPNVVLTAIDTDVIKTYVSLGLGIGIIASMAFEPERDHNLTAIDAGHLFEPSTTKIGIRKDAYLRGFAYTFIELFAPHLHRREVDSALLAHDVDDEE

SEQ ID NO: 75732 - DNA, 975 bp, Photorhabdus luminescens subsp. laumondii TTO1
  CDS (1)..(975): transl_table=11
atgaaattgcaacagcttcgttacatcgtggaggtggtaaaccacaaccttaatgtttcatctacggcagaaggactgtatacatctcaacccgggatcagtaagcaggttagaatgcttgaagatgaattaggcattcagattttttcccgtagtggtaaacacctgacgcatgttactcccgcaggtgaagaggttgtccgaatttctcgtgaagtattatctaaggttgatgcaatacggtcagttgctagtgaacatacttatccgaatcgtggttcgctatatattgctactacccacacacaggcccgttatgcattacctcctgtgattaaaggttttattgaacgttatccgcaggtctctttacacatgcatcaggggtcgccaacgcaaattgctgaagctgtgagtaaaggtagtgctgattttgctattgcaactgaggcactgcatttatatgaagatttgataatgttgccttgttaccattggaacaggacgctggtggtgacgtcggatcacccgctggcaggtaaagagagtgtttcaattgaagaattggctgaatatcaactggtcacttatacgtttggctttaccggtcgttctgagttagatgtcgcattcgataaagtgggcttaaagcctaaaattgttttcactgcgacggatgctgatgttattaaaacttatgtccggttaggattaggtgtaggggttattgccaacatggcggttgatccggtgcaggataacgacctggtttgcattgatatgcgtgataaatttagctacagcacaactaagattggttttcgtcgcagtagtttcttgcgcagctacatgtatgattttatgtggcgttttgcgcctcacctgacgcgtgatgttattgatcaggcagttgctttacgctcaaatgaagatatcgaagtcatgttcaaagatatcaaattaccaatcgtataa

SEQ ID NO: 75733 - protein, 324 aa, Photorhabdus luminescens subsp. laumondii TTO1
MKLQQLRYIVEVVNHNLNVSSTAEGLYTSQPGISKQVRMLEDELGIQIFSRSGKHLTHVTPAGEEVVRISREVLSKVDAIRSVASEHTYPNRGSLYIATTHTQARYALPPVIKGFIERYPQVSLHMHQGSPTQIAEAVSKGSADFAIATEALHLYEDLIMLPCYHWNRTLVVTSDHPLAGKESVSIEELAEYQLVTYTFGFTGRSELDVAFDKVGLKPKIVFTATDADVIKTYVRLGLGVGVIANMAVDPVQDNDLVCIDMRDKFSYSTTKIGFRRSSFLRSYMYDFMWRFAPHLTRDVIDQAVALRSNEDIEVMFKDIKLPIV

SEQ ID NO: 75734 - DNA, 924 bp, Acinetobacter sp. ADP1
  CDS (1)..(924): transl_table=11
atgaattttcaacagcttagaattattcgggaaaccgttcgtcaaaactttaatctgaccgaggcatctgctgcgttatatacgtctcagtctggggtaagtaaacacattaaagacttagaagatgaactaggtgtacaactgttcatcagaaaaggcaaacgcttacttggcctgaccgaacctggacaatccttgctggggattgtagagcgtatgctggtcgatgcagaaaatatcaaacgtttggctgatgattttaataaagtcgatgaaggtactcttactatcgccactacacatactcaagcacgctatgtccttccgcctattgtcaatcagtttaaaaaactgtttcccaaagttcatctaattttgcagcaggccagccctaccgaaatttcagagatgctgttacagggggaagcagatattggaattgcaactgaatctcttactacagaagaaaatttggcaagcattccttattatcagtgggaacacagtattattaccccacaaaatcatccccttacccaagtgcctgaaattaccttagaaacattggcgcattatccaatcattacctatcatggcggctttacaggtcgttctaaaattgacaaagcatttgatgatgcaggcattgatgttgatattgtcatgtctgcacttgatgcggatgtgatcaaaacctatgtagagctaaatatgggggtgggtattgtcaatgatgtggcttacgacaaagaacgggattatcgtctcaatcaaatcaagacaggtatctttggtctaaataccacttggattgctgtgcgcaaaggacatcttttgcgtggatatggctatgagttcatttctctatgctcacctgaagccaatattaaagagcttaaaaaaattgcctaccctgaagattaa

SEQ ID NO: 75735 - protein, 307 aa, Acinetobacter sp. ADP1
MNFQQLRIIRETVRQNFNLTEASAALYTSQSGVSKHIKDLEDELGVQLFIRKGKRLLGLTEPGQSLLGIVERMLVDAENIKRLADDFNKVDEGTLTIATTHTQARYVLPPIVNQFKKLFPKVHLILQQASPTEISEMLLQGEADIGIATESLTTEENLASIPYYQWEHSIITPQNHPLTQVPEITLETLAHYPIITYHGGFTGRSKIDKAFDDAGIDVDIVMSALDADVIKTYVELNMGVGIVNDVAYDKERDYRLNQIKTGIFGLNTTWIAVRKGHLLRGYGYEFISLCSPEANIKELKKIAYPED

SEQ ID NO: 75736 - DNA, 954 bp, Erwinia carotovora subsp. atroseptica SCRI1043
  CDS (1)..(954)
atgaactttcagcaactgaagattattcgtgaatcagcacggtgcaactacaacctgaccgaggtagcgaatacgctgtttacctctcaatccggcgtgagccgccacatccgcgagttggaagaagagctggggattgaaatttttatccgtcgcggtaagcgtctgttagggatgaccgagccgggaaaagagctgctggtggtggcagagcgcattctgaatgacgccagcaacattcgtcggctggcgaatgtcttcaccaataacgacactggccagttggtgatcgcgaccacgcatacgcaggcgcgctacagtctaccgccggtaattaaagccttccgctcgctgtatccgcaggttcgcttggtgctgaatcagggcacgccggatgaaatcgtggcgatgcttcattctggcgaagccgatatcggtattgccagtgagcaattgattaacgatccctcgttggcggcattctcctattaccgctggcaccattcggtgattgtgccggaacaccatccgctgacgcagaagccgcttattacgctggaaatgctcaacgcagaaccactgattacctatcgtcaggggattacggggcgttcgcgcttggatcgggcgtttcaggcggtgggcatgtcgccggatattacgctcagcgcgcaggattcggatgtgattaaaacctatgttgaactggggctcggcgttgggattgtcgccgatatgtcatacgatccagtgcgtgacaaggggctggtacggttgaatgctgagcacttgtttgaagccaacacagtttggctgggactgaaaaaaggtcagttacagcgtaactatgcctggaaatttattcagctgtgtaatacagagctgtcgctggatgatattaaggacaaggtcttttctgataacgatgaagcggtgattgattaccaaatctga

SEQ ID NO: 75737 - protein, 317 aa, Erwinia carotovora subsp. atroseptica SCRI1043
MNFQQLKIIRESARCNYNLTEVANTLFTSQSGVSRHIRELEEELGIEIFIRRGKRLLGMTEPGKELLVVAERILNDASNIRRLANVFTNNDTGQLVIATTHTQARYSLPPVIKAFRSLYPQVRLVLNQGTPDEIVAMLHSGEADIGIASEQLINDPSLAAFSYYRWHHSVIVPEHHPLTQKPLITLEMLNAEPLITYRQGITGRSRLDRAFQAVGMSPDITLSAQDSDVIKTYVELGLGVGIVADMSYDPVRDKGLVRLNAEHLFEANTVWLGLKKGQLQRNYAWKFIQLCNTELSLDDIKDKVFSDNDEAVIDYQI

SEQ ID NO: 75738 - DNA, 975 bp, Erwinia carotovora subsp. atroseptica SCRI1043
  CDS (1)..(975)
atgaaactacaacagcttcgttatattgttgaagttgttaatcacaacctgaatgtgtcttctaccgcagaagggttgtacacctcccagccggggatcagtaaacaggtccgcatgctggaggatgagttgggtattcagattttcgcccgtagtggaaaacacctgacacaggtgacacccgctggacaggaagtcatccgcatcgcacgtgaagtgttgtcgaaagtcgaggctatcaaagcggttgccggagagcacacctatcccgataaagggtcgctgtacgtcgcaactacccatacgcaggctcgctacgcgctgccaagcgttatcaaaggtttcatcgatcgctatcctcgcgtatcgctgcacatgcatcagggttcaccgacgcagattgccgaggctgttgctaaagggtctgcggattttgctattgcgacagaagctctgcatctgtacgacgatctgatcatgctgccgtgctaccactggaatcgcgccgtggtggtaacacccgatcatccgctagcgtccaaaacagacatcactattgaagagttggctgcttatcctattgtcacctacacctttggttttacggggcgttctgagctggataccgcgtttaaccgtgctggtctgacgccgcgcatcgtctttaccgcaacggatgctgatgtgattaagacctacgtgcgtttagggctgggcgtaggggtgattgccaacatggcggtcgatccgcagacggaaaccgatctggtgaccatcaacgcgaacagcattttcagctatagcacgacgaaaatcggctttcgtcgcagtacgttcctgcgcagctacatgtacgatttcatccagcgttttgccccgcacttaacgcgtgatgttgtcgattctgccgttgcactgcgttcgaatgatgaaattgaagcgatgtttaaagacgttacgctgccagtgaagtaa

SEQ ID NO: 75739 - protein, 324 aa, Erwinia carotovora subsp. atroseptica SCRI1043
MKLQQLRYIVEVVNHNLNVSSTAEGLYTSQPGISKQVRMLEDELGIQIFARSGKHLTQVTPAGQEVIRIAREVLSKVEAIKAVAGEHTYPDKGSLYVATTHTQARYALPSVIKGFIDRYPRVSLHMHQGSPTQIAEAVAKGSADFAIATEALHLYDDLIMLPCYHWNRAVVVTPDHPLASKTDITIEELAAYPIVTYTFGFTGRSELDTAFNRAGLTPRIVFTATDADVIKTYVRLGLGVGVIANMAVDPQTETDLVTINANSIFSYSTTKIGFRRSTFLRSYMYDFIQRFAPHLTRDVVDSAVALRSNDEIEAMFKDVTLPVK

SEQ ID NO: 75740 - DNA, 972 bp, Mannheimia succiniciproducens MBEL55E
  CDS (1)..(972): transl_table=11
atgaaaattcaacaacttcgttatattgtcgaaatcgttaatcagaatttaaatgtgaccgaagctgcaaatgcgctttatacttcacagccggggatcagtaaacaagtgcgtttgctggaagatgagttaggattagaaatttttgagcgaaatggtaaacatatcaaaaccgttacgccggcgggtaaaaaaattgttgcgattgctcgcgagttattggtaaaaacacaggccattaaagcggttgccaacgaatttactcaacctaatcacggtgttttacgcatagcgaccagtaatacgcaagcacgttatatgctgcctgccgttattgagcgcttttctaaacaatatcctaatgtaagtttgcatgtgcaccagggttcgccgaatcagttatatgatgcgctgctgtccagcgaagtggatttggctattaccacggaagcgcaatatctatttgacgatgtggtgttattaccttgctatatgtggaaccgttctatcattgtgaaagcggatcatcctttagcgaagttgagtcatgtcaccattgaggatttgggtaaatatcctttgattacttacactttcggttttaccggagtatccgatttggatcaggcgtttaacagtgcgggtattttgccgaatatcgtatttaccgctacagatgcggatgtaattaaaacctatgtgcgtctcggtttgggcgtggggattattgcttccatggcgcataccgatgcggacacggatttgattcgaattgacgcaagccatctgtttaaatccagtatgactcaaattgcgtttaaacacagcaccttcttacgcaattatatgtatgattttattaattatttttcacctcacctaacaagagcaaaagtggaaaaagcagagcgggcacgtgataatactgccgtgcagaaattatttgaaggcattgatctggaagtcagataa

SEQ ID NO: 75741 - protein, 323 aa, Mannheimia succiniciproducens MBEL55E
MKIQQLRYIVEIVNQNLNVTEAANALYTSQPGISKQVRLLEDELGLEIFERNGKHIKTVTPAGKKIVAIARELLVKTQAIKAVANEFTQPNHGVLRIATSNTQARYMLPAVIERFSKQYPNVSLHVHQGSPNQLYDALLSSEVDLAITTEAQYLFDDVVLLPCYMWNRSIIVKADHPLAKLSHVTIEDLGKYPLITYTFGFTGVSDLDQAFNSAGILPNIVFTATDADVIKTYVRLGLGVGIIASMAHTDADTDLIRIDASHLFKSSMTQIAFKHSTFLRNYMYDFINYFSPHLTRAKVEKAERARDNTAVQKLFEGIDLEVR

SEQ ID NO: 75742 - DNA, 975 bp, Methylococcus capsulatus str. Bath
  CDS (1)..(975): transl_table=11
gtgaagctacagcaactgcgttacatctgggaggtctctcagcacgatctcaacgtttcctcgacggcggacgccttgtttacgtcccagccgggtatcagcaagcagatcaagctgctggaggaggagctgggaatctccatcttcgcccgcagcggcaaacatttgaccgagatcacgccagccggcaaatacgtcgtggaactcgctggacagattctcagcaaggttcaggacatccgcagcgtcgcccaggaattccgtgacaaccgggtcggttcgctatccattgccaccacccatacccaggctcgctatgccttgccgccggtggtgcgtgaattcatgcagcgttatccgggtatcaagctcaacatgcatcagggcacgcctgtgcagatcgccgaggaggcatcacgcggtctggtggatatcgccatcgcgaccgaggcgatcgaactgttcggcaacttggtcatgctgccctgctaccgatggaaccggatcgctctggttccaaagggacaccccctgaccgaaaagccgggcctgaccctggaggacctcggcgagcaccctttggtcacttatgtcttcggcttcaccggtcggtcgcatctggatcaagcgttcaacagggcgggtatcaagccgcggctggccctgaccgccgtcgacgccgacgtcatcaagacctatgtacggctgggactgggggtcggcatcatcgccagaatggcctacaaccccgagaccgatgcggatctggtggcgctcgatgcttcgcatctgttcgaaagcagcgtgaccaacatcggcctgcggagggacattttcgtccgcggcttcctctacgactttatcgagctgttcgcgccgcatctgacccgcgaggtggtggaccgggcgctgagcacgcgtgaacccaaggaactggaggctttgtttgccgggctgacgctgcccgtgcggtag

SEQ ID NO: 75743 - protein, 324 aa, Methylococcus capsulatus str. Bath
MKLQQLRYIWEVSQHDLNVSSTADALFTSQPGISKQIKLLEEELGISIFARSGKHLTEITPAGKYVVELAGQILSKVQDIRSVAQEFRDNRVGSLSIATTHTQARYALPPVVREFMQRYPGIKLNMHQGTPVQIAEEASRGLVDIAIATEAIELFGNLVMLPCYRWNRIALVPKGHPLTEKPGLTLEDLGEHPLVTYVFGFTGRSHLDQAFNRAGIKPRLALTAVDADVIKTYVRLGLGVGIIARMAYNPETDADLVALDASHLFESSVTNIGLRRDIFVRGFLYDFIELFAPHLTREVVDRALSTREPKELEALFAGLTLPVR

SEQ ID NO: 75744 - DNA, 987 bp, Photobacterium profundum SS9
  CDS (1)..(987): transl_table=11
ttgggcggtatcatgaaattacaacaaataagatatatcgttgagattgtggaccataatcttaatgtttcctctactgcagagagtttatatacgtcacagcctggcatcagtaagcaagtacgtttactggaagatgagctaggtgttcaaatttttgaacgcagcggtaagcacttaacaaaagtgactcctgcaggtgttgatatagtacgtatttctcgtgatattttatctcgagttgaaagtattaaagccgttgccggtgagcatactcatcctgaaataggtacattaaatatagcaacgacacatacccaagctcgttatgcattacctcatgttattaagtattttacggctcgatatcccaaagtgtcgttacacatgcatcaaggtacgccttcacagatagcagatgctgtcggtaatggtacgacagattttgctatcgcaactgaagctctgcatttatatcaagatataattatgttgccttgttatcactggaatcgttcgattgttgtcagagctgatcacccattagcgaaaaaagcagatattactattcatgatttagccgcttattcgttggtgacctatgtgtttggttttacggggcgttctgagcttgatagtgcatttaatcgttctggtttaacaccgcgaattgtttttacagcaaccgatgcagacgttattaaaacctatgtacgcttaggtattggtgttggtgttattgcaagtatggcgatggatcctgaggtggatagcgatcttgttaagattgatgcgagtcatatctttgaagcaagcacgactaacattggctttaagaaaggtacatttttacgtgcctatatgtatgattttatggaacgctttgctccgcatttaacacgtgaaacggttgatcaagccgttgcattgaaaacgaatgaagatattgaagccttgtttgcaagtatggatttacctgtacgctaa

SEQ ID NO: 75745 - protein, 328 aa, Photobacterium profundum SS9
MGGIMKLQQIRYIVEIVDHNLNVSSTAESLYTSQPGISKQVRLLEDELGVQIFERSGKHLTKVTPAGVDIVRISRDILSRVESIKAVAGEHTHPEIGTLNIATTHTQARYALPHVIKYFTARYPKVSLHMHQGTPSQIADAVGNGTTDFAIATEALHLYQDIIMLPCYHWNRSIVVRADHPLAKKADITIHDLAAYSLVTYVFGFTGRSELDSAFNRSGLTPRIVFTATDADVIKTYVRLGIGVGVIASMAMDPEVDSDLVKIDASHIFEASTTNIGFKKGTFLRAYMYDFMERFAPHLTRETVDQAVALKTNEDIEALFASMDLPVR

SEQ ID NO: 75746 - DNA, 972 bp, Photobacterium profundum SS9
  CDS (1)..(972): transl_table=11
atgaaactacaacagctacgctatctaagagcgatagtaaatcatgatctaaatatctcagctgcatcaaaaagtatctataccacgcagccaggagtaagtaagcaaataggcctgcttgaagcagaacttggtgttaagatcttcgagcgtaaaggtaaaaatctaaacgcgattaccagtattggtaaacagataattgacgaaggcatgaaaatgctggctgtggaagagcggatatacgctatctccagagattatctcaatcctgaaggtggatgcttgaacatctatacaaccaatacgattgcacgtttcttattgcctaagaccgtcaacaaatttgtaaagaaacaccctgacattactttccacattggagccgcacatcccgatgagaatggcgctattatcaaaaaaggtcactctgacttttctattgttgcgcaagatgtagaacgagataaagatcttatcgttcttccagcttataaatggtcactaagcctaatactcccatcgaatcacccattgagaaaagaaaaagacataactctcgaaatgatcagtaaatacaacctgattagttatgaatcgggatcgacagggaaaatagcgcaggataaagcgtttgcagaacaaggtataaatccaacttacttcatgaccgctatggatgttgacgtaataaagcaatacgtaagcatggatcttggtatcggtataattgcaacaattgccgctaaacaaatttgcgacggtgatatcgttgctattcctcttaaaggaatcatacctgattgcgacgcttggatttgttatagcagaaatgtcttcttgcaaaagcacatgtatgacttcattgaaagctttgctccgcacttgaaacaagaagtaatggaagtgattgcacactcaacgaacaatgaaatagttaagatatctcaagaatttgagttaccacgctactaa

SEQ ID NO: 75747 - protein, 323 aa, Photobacterium profundum SS9
MKLQQLRYLRAIVNHDLNISAASKSIYTTQPGVSKQIGLLEAELGVKIFERKGKNLNAITSIGKQIIDEGMKMLAVEERIYAISRDYLNPEGGCLNIYTTNTIARFLLPKTVNKFVKKHPDITFHIGAAHPDENGAIIKKGHSDFSIVAQDVERDKDLIVLPAYKWSLSLILPSNHPLRKEKDITLEMISKYNLISYESGSTGKIAQDKAFAEQGINPTYFMTAMDVDVIKQYVSMDLGIGIIATIAAKQICDGDIVAIPLKGIIPDCDAWICYSRNVFLQKHMYDFIESFAPHLKQEVMEVIAHSTNNEIVKISQEFELPRY

SEQ ID NO: 75748 - DNA, 975 bp, Idiomarina loihiensis L2TR
  CDS (1)..(975): transl_table=11
atgaaattacagcagttacgttacattgttgaagtaacaaatcataacctgaatgtttctgctacggctgaaagcttattcacctcgcagccgggcattagtaaacaagtcagaatgctggaagacgagctgggcgtgcagatatttggacgaacaggcaaacacctgactcacataacgcccgcgggtaaagacatcatagcagttgctcagcaggttctggataacgtccagtcgattaagacggttgctgctgagcacaccttgccaaaccaaggcaaacttaatattgcgacgacccatactcaggctcgttatgccttgccgtccgttattcagcgatttattcagcaatatcccaaagtgtcactgcatatgcatcaggggtctccagagcaaattagtgaggcggcggcgaaagggcgggcagattttgccattgcgaccgaggcgctgcatttatatcacgaccttattatgttgccctgctatcactggaaccgctctatagtggtgcctaaatcgcacccgctgacgcaactgagtaagctaactattgatgatattgctcagtttcctttggtcacttatgtgcatggttttaccggtcgttccgagttggataaagcctttgccgatgcgggacatgagcctaaaattgtctttacagcaaccgatgccgatgtgataaaaacctacgtcagaatgggattgggtattggggttctggcaagtatggcttacgaccctaaagaagataccgatttagtggcgatacctgcggagcacatgtttgctcatagtacgactaagataggtttccggcgcggaacatttttacgtacttatatgtacgattttattgagaattttgcaccacacttaactcgcgatagggtgcaaaaagctactcagctaaaaagtcaggatgagattgataaactctttgatagttgctcactgccgatgcgctaa

SEQ ID NO: 75749 - protein, 324 aa, Idiomarina loihiensis L2TR
MKLQQLRYIVEVTNHNLNVSATAESLFTSQPGISKQVRMLEDELGVQIFGRTGKHLTHITPAGKDIIAVAQQVLDNVQSIKTVAAEHTLPNQGKLNIATTHTQARYALPSVIQRFIQQYPKVSLHMHQGSPEQISEAAAKGRADFAIATEALHLYHDLIMLPCYHWNRSIVVPKSHPLTQLSKLTIDDIAQFPLVTYVHGFTGRSELDKAFADAGHEPKIVFTATDADVIKTYVRMGLGIGVLASMAYDPKEDTDLVAIPAEHMFAHSTTKIGFRRGTFLRTYMYDFIENFAPHLTRDRVQKATQLKSQDEIDKLFDSCSLPMR

SEQ ID NO: 75750 - DNA, 942 bp, Azoarcus sp. EbN1
  CDS (1)..(942): transl_table=11
atgaacctccagcaactgcgttacatctacgaagtcgcccgacgcgggttgaacgtgtcggaagctgccgaggcgctgttcacgtcgcagccgggagtgtccaagcagatccggctgttcgagacggagctcggcgtcgacgtgttcgtgcgccacggcaagcgtctcgtcgcagtcaccgatcccggtcgccaggttctcgcgctcgccgaacgggtgctgcgcgacatcgacaacctgcggcaggtaggcgacgagtttaccaacgagtcgaccgggagtctttcgattgcgaccacgcacacgcaggcccgctacgtgctgccgcggatcatccgcgatttcatgcagcgcttcccgcaggtcaagctgtcgctgcaccagggcaacccacgccaggtgtgcgacatggtgatgtcgggcgaagccgacctcgcgatcgcgaccgaggcgatcgccgactacgacgagctcgtgatgctgccctgctaccagtggaaccgctgcatcgtcgcgacgccgcgccacccgatcctcaaggagcatccgctgactctcgaggcgatcgcgcgctacccgctcatcacttacgacgacgctttcaccggccgcagcctgatcaacaaggctttcctcggccgcggtctgcgcccgaacgtcgtgctcaccgcgctcgactcggacgtcatcaagacttacgtgtcgatggatctgggcatcggcatcctcgcgcgcatggcgttcgatgccgcggccgacaagacgctcggcatgagcgatgcggcgcacctgttcgagtcgagcacgacgcgcgtcggcttgcgccgcaatgcctacttgcgcggctatgtgtacgcattcatcgaactgttcgcgccgcacctgacgcgccgcatgatcgacgtcgcgctcgccggcggcggcgaggactacggcatgtga

SEQ ID NO: 75751 - protein, 313 aa, Azoarcus sp. EbN1
MNLQQLRYIYEVARRGLNVSEAAEALFTSQPGVSKQIRLFETELGVDVFVRHGKRLVAVTDPGRQVLALAERVLRDIDNLRQVGDEFTNESTGSLSIATTHTQARYVLPRIIRDFMQRFPQVKLSLHQGNPRQVCDMVMSGEADLAIATEAIADYDELVMLPCYQWNRCIVATPRHPILKEHPLTLEAIARYPLITYDDAFTGRSLINKAFLGRGLRPNVVLTALDSDVIKTYVSMDLGIGILARMAFDAAADKTLGMSDAAHLFESSTTRVGLRRNAYLRGYVYAFIELFAPHLTRRMIDVALAGGGEDYGM

SEQ ID NO: 75752 - DNA, 975 bp, Azotobacter vinelandii
  CDS (1)..(975)
atgaagcttcagcaactgcgttacatctgggaagtggcgcatcacgatctcaatgtttcggccacggctcagagcctctacacatcgcagcccggcatcagcaagcagatccgccttctggaggatgaactgggggtggaggtttttgcgcgtagtggcaagcatctgacacgtgtgacgccggccggcgagcgaatcatcaccactgccggggaaatcctgcgcaaggtggaaagcatcaagcagatcgcccaggaattttccaacgagaagaaaggcaccctgtccatcgcgacgacccatacgcaggcgcgctatgccttgccgtcggtcatcagcgccttcattcgccagtatccggaggtttccctgcacatgcaccaggggacgccgacccagatcgccgaaatggcggccgatggaaccgtcgacttcgccatcgccactgagggattggagttgttcagcgacctcctcatgatgccctgttaccgctggaatcgctgtgtggtggtgccgcaggggcatccgttgaccaagctgtccaagctgacgctggaggcggtggccgaatatcccatcgttacctatgtgttcggctttaccgggcgttccaagctggacgaggcctttttcaatcgtggcctgactcccaaggtggtgttcaccgccgccgatgccgacgtcatcaagacctatgttcggctcggtctcggtgtaggcatcgtcgctcggatggcggtggacgaaaagctcgacggcgatctggtggcgctcgatgccagtgagctcttcgagcccagcgtcaccaagatcgcttttcgccgcggaaccttcctgcgcgggttcatgtgcgatttcatcgagcgattcgccccgcacctcacccggcccgttttgagcaaagccatgcagtgccacaacaaggccgagctggacgaactgttcgagggcatcgaactgccgttgtattga

SEQ ID NO: 75753 - protein, 324 aa, Azotobacter vinelandii
MKLQQLRYIWEVAHHDLNVSATAQSLYTSQPGISKQIRLLEDELGVEVFARSGKHLTRVTPAGERIITTAGEILRKVESIKQIAQEFSNEKKGTLSIATTHTQARYALPSVISAFIRQYPEVSLHMHQGTPTQIAEMAADGTVDFAIATEGLELFSDLLMMPCYRWNRCVVVPQGHPLTKLSKLTLEAVAEYPIVTYVFGFTGRSKLDEAFFNRGLTPKVVFTAADADVIKTYVRLGLGVGIVARMAVDEKLDGDLVALDASELFEPSVTKIAFRRGTFLRGFMCDFIERFAPHLTRPVLSKAMQCHNKAELDELFEGIELPLY

SEQ ID NO: 75754 - DNA, 948 bp, Actinobacillus pleuropneumoniae serovar 1 str. 4074
  CDS (1)..(948)
ttgaaatcaaaatctgaatttaccgaagcggcggaaacactttacacttctcaaccgggcattagtaagcaggtacgtctattggaaagcgaactcggaattaatattttcgaacgaaacggtaagcatattaaaggattaacgccggcgggagaaaaaattgtcgcgattgcgcgcgaattactggtaaaagcgcagagtattaaatcggtggcggaagaacagactcgtccgaatcgaggcgtcttacgcattgcaacgccgaatacgcaagcgcgctatgttttgccgccgattattgagaaattcaaagcgaagtatccggaggtcagcctacaattacatcaaggttcgccaagtcaaatttacgatgccttaatggcgggcgaagtggatctggcgattacgaccgaagcgcagcatttatttgaagatgcgatcttattgccgtgttatttatggaatcgttccgtcattgtgaagccggatcatccgttagtaaaatttgtgaaccaaagcgagaatttaacggtcgaagaactcggtaaatatgatttgattacttatactttcggctttaccggacaatccgatctcgaccatgcgtttaataaagaaggtatcttaccgcatatcgtgtttactgcgacggatgccgacgtcattaaaacttacgtgcgtttaggcttaggggtcgggattatggcgtcaatggcgcatacgcccgcggacagtgatttggtggcgattgatgcaagtcatttattccaatcgagtatgacgcaaatcgcatttaaacgcggcactttcttacgtaattatatgtatgattttattaactatttctcgccgcatttaacaaagatgcaagtagagaaagcggaacaattaagagagagcaatgctattcttcgtttgttcgaaagcactaaattagaggaaaaatag

SEQ ID NO: 75755 - protein, 315 aa, Actinobacillus pleuropneumoniae serovar 1 str. 4074
MKSKSEFTEAAETLYTSQPGISKQVRLLESELGINIFERNGKHIKGLTPAGEKIVAIARELLVKAQSIKSVAEEQTRPNRGVLRIATPNTQARYVLPPIIEKFKAKYPEVSLQLHQGSPSQIYDALMAGEVDLAITTEAQHLFEDAILLPCYLWNRSVIVKPDHPLVKFVNQSENLTVEELGKYDLITYTFGFTGQSDLDHAFNKEGILPHIVFTATDADVIKTYVRLGLGVGIMASMAHTPADSDLVAIDASHLFQSSMTQIAFKRGTFLRNYMYDFINYFSPHLTKMQVEKAEQLRESNAILRLFESTKLEEK

SEQ ID NO: 75756 - DNA, 930 bp, Psychrobacter sp. 273-4
  CDS (1)..(930)
atggcaatcgacgtagtggtcaatcagcggcatctgcaaattcagcttaagcagttagagacagtgtggcatacagtcatcaacggctataacttaagtcaggcagccacagtactgcacaccagccaatcaagtctatcaaagcatattgctgcgcttgagaatcagctcaaaactgaagtatttgtgcgccaaggcaaacgattaactggacttacgacaatgggcactgcgctcatgccgcatattgagtctatctttgctgaaattcgtacgattgaaaatctcagcctcgactttaacaatccaaatgtgggtacattgacgattgccacgactcatactcaggcacgttatgtattaccagaagtcgtgaaagagtttaaagagcgctttcctaaggttaatctcatcctacaacaggcagatcctgaaaccatcgcacagatggtgatacgtgggcaggccgatattggcattgccaccgagtccttgctacataacaactatctacgctgctaccgctattatgactggacgcatcgcgtcatcgtaccaagcgatcatgaacttgcaggactggaatctattgatttaccgaccctggctagctatccaattgtgacttatcacggcggctttacggggcgcggcgccattgacaaaacctttagtgacgccggtcttgagccagatatcgtactggctgctcttgatgccgatgtgattagtacttatgtaggcttaggtttggggattggcattattgccgaaatggcatttgagccaagccattatcagaatctaacggccattccggtcgaccattttgggcgctttaccagttggatggcagtacgtgatgacgcagaaattcgtcagtatggtcgagcctttatggagctgtgtcaaaaacaattcaacaactaa

SEQ ID NO: 75757 - protein, 309 aa, Psychrobacter sp. 273-4
MAIDVVVNQRHLQIQLKQLETVWHTVINGYNLSQAATVLHTSQSSLSKHIAALENQLKTEVFVRQGKRLTGLTTMGTALMPHIESIFAEIRTIENLSLDFNNPNVGTLTIATTHTQARYVLPEVVKEFKERFPKVNLILQQADPETIAQMVIRGQADIGIATESLLHNNYLRCYRYYDWTHRVIVPSDHELAGLESIDLPTLASYPIVTYHGGFTGRGAIDKTFSDAGLEPDIVLAALDADVISTYVGLGLGIGIIAEMAFEPSHYQNLTAIPVDHFGRFTSWMAVRDDAEIRQYGRAFMELCQKQFNN

SEQ ID NO: 75758 - DNA, 936 bp, Dechloromonas aromatica RCB
  CDS (1)..(936)
atgaatttccagcaactcagaatcatccgggaaacggtacgtcaggatttcaacctgaccgaagtggccaatgccctgtacacctcgcaacccggggtcagcaagcacatcaaggatctcgaagacgaactcgggattgaggtcttcatacgtcgcggcaagcgtcttctcggcctgaccgaaccgggcaaggaactggtcggcgtagtcgaacgcatcctgctcgatacgcagaatctgcggcgcattgccgatcagttcgccagccgggaaactggccattttgtcgtggcgacaacacatacccaggcccgttatgcgctgcccaagatcatccagtggttcaaggccgattaccccaaggtgcacttgacgctcttacaaggcagtccgcgcgaaatcgccgagctgctcgagacaggtcaggccgacgttggtatcgccaccgaatcactcgacaatgtgccggaactcgcttccttcccgttctattcgtggcatcacgcggtgatcgtgcctgacggccacccgctgctcaatctcgaaaaggtcacgctcgaggctctgggtgaatacccgatcatcacctatcacgaaggattcacggggcgggcgcatgtcgacaagggcttcgccgatgcgggcatcgtcccggatatcgtgctgtcggccatcgatgccgatgtgatcaagacctacgtcagtcttggcttgggcgtcggtatcgtcgcctcagtagcctacgatcaggagcaggatcgcaatctcgccctgattccggttcccgacctgttcccggcgaacacaacgcgcatcgccgtgcgtcgtggcacctatctgcgcagctatgttcatgcctttatcgagaaggtttgcccggatctcggcgaggatgcgatcaaggcagccctcaaaccgcagtccggcaacgattga

SEQ ID NO: 75759 - protein, 311 aa, Dechloromonas aromatica RCB
MNFQQLRIIRETVRQDFNLTEVANALYTSQPGVSKHIKDLEDELGIEVFIRRGKRLLGLTEPGKELVGVVERILLDTQNLRRIADQFASRETGHFVVATTHTQARYALPKIIQWFKADYPKVHLTLLQGSPREIAELLETGQADVGIATESLDNVPELASFPFYSWHHAVIVPDGHPLLNLEKVTLEALGEYPIITYHEGFTGRAHVDKGFADAGIVPDIVLSAIDADVIKTYVSLGLGVGIVASVAYDQEQDRNLALIPVPDLFPANTTRIAVRRGTYLRSYVHAFIEKVCPDLGEDAIKAALKPQSGND

SEQ ID NO: 75760 - DNA, 942 bp, Dechloromonas aromatica RCB
  CDS (1)..(942)
atgaaactccaacaactgcgttacatcgtcgaaattcagcgtcagggcttgaatgtctcggaggcagctgaatcgctttacacatcccagccggggatctccaaacaggtcaagttgctggaggatgagctcggtgtttcgattttcgagcgtagcggcaagcgttttaccggggtcaccgaaccgggcaaggtcgtgctgggcatcgccgaacgcatcctgcgcgaagcggaaaatctgaagcgggcgagcggtgagttcgcctccggtaacaccggccggctggtgttggcggcaacgcatacccaggcccgttacgcgctgcccatcgtggtccgcgatttcatggcgcaacacccggacgtcaagctggaaatgcaccagggtagcccgacgcagattgccgagtgggttgtcgctggcgaggcagacattggcattgccaccgaagcgctcgatcagtatccacagttgattaccttgccggttcgccagtggacgcactgtgtcattgctcccgaggggcatcccatcctgcaatcagtgccgctgtcgctgaacgaactggcgcgctggccgttgatcacctatgacacggcatttaccggtcgctcgcggatcaatcgggctttcgaacgcatcaacgtccagcccaatgttgcattgactgcccttgatgccgacgtgatcaagacctatgtcagcctcggtcttggtcttggcatcatttcagccctggcgttcgatgcgcagcgcgacgcggggctggtcgccatagacgccgctcacctgttcgagtccaacaccacgcgcctcgccttgcgtcgtggcacctatctcaggcgttacgactacgacctgatcaccctgtttgcgccacagttgtcaaagcatgtggtcgaaatggccatgcagggcggcggtgacgaataccagctatga

SEQ ID NO: 75761 - protein, 313 aa, Dechloromonas aromatica RCB
MKLQQLRYIVEIQRQGLNVSEAAESLYTSQPGISKQVKLLEDELGVSIFERSGKRFTGVTEPGKVVLGIAERILREAENLKRASGEFASGNTGRLVLAATHTQARYALPIVVRDFMAQHPDVKLEMHQGSPTQIAEWVVAGEADIGIATEALDQYPQLITLPVRQWTHCVIAPEGHPILQSVPLSLNELARWPLITYDTAFTGRSRINRAFERINVQPNVALTALDADVIKTYVSLGLGLGIISALAFDAQRDAGLVAIDAAHLFESNTTRLALRRGTYLRRYDYDLITLFAPQLSKHVVEMAMQGGGDEYQL

SEQ ID NO: 75762 - DNA, 942 bp, Ralstonia eutropha JMP134
  CDS (1)..(942)
atgaacctgcaccagtttcgctttgtgcgtgaggcggtacgccagaactacaatctgacggaggccgccaaagcgctctacacatcacaacccggtgtgtccaaggccatcatcgagctggaggaagagctcggcgtcgatatcttcacgcgccatggcaagcgcatccgcagcctgacggagccggggcgccgcatcctgaactcggtggaaaaaattcttcaggaggtggaaagcctcaagcgtgtcggcatggactatgcggcacaggaccagggcaatttcaccattgcgaccacgcacacgcaggcgcgctacgcgctgccgcgcgtgatcagcgagttcaccaagcgctacccgaaggtccggctgtcgatccagcagggcaatccttcgcagattgccgacatgctgcttcatgaccaggcggatatcggcatcgccaccgaaggcatcacccacgagaagaccttggtctccctgcctggctaccaatggcagcacgtggtgattacgccacccgatcacccgctactggaaaaaaagcatctggcgctcgaagacctgatgagctacccgctcatcacctacgacccgaattttgccgggcggcccaagatcaacaaggcgttcgagctgcggcacttgcagcctgacatcatcctggaagcgatcgatgcggacgtgatcaagacctatgtggagatcggcctcggcatcggtatcgttgcggggcttgcctatgacgctgagcgcgaccgcaacctgcgcggcattcccgccgggcacctgttcggcaccaatgtgacgcatctggccgtcaagcagggcgcctacctgcgcagcttcgtctataccttcatcgagttgttctcgcccacgctgaaccgcaagctggtcgaacaggcgatgtcgggcgaccacgaggcgtacgaactctga

SEQ ID NO: 75763 - protein, 313 aa, Ralstonia eutropha JMP134
MNLHQFRFVREAVRQNYNLTEAAKALYTSQPGVSKAIIELEEELGVDIFTRHGKRIRSLTEPGRRILNSVEKILQEVESLKRVGMDYAAQDQGNFTIATTHTQARYALPRVISEFTKRYPKVRLSIQQGNPSQIADMLLHDQADIGIATEGITHEKTLVSLPGYQWQHVVITPPDHPLLEKKHLALEDLMSYPLITYDPNFAGRPKINKAFELRHLQPDIILEAIDADVIKTYVEIGLGIGIVAGLAYDAERDRNLRGIPAGHLFGTNVTHLAVKQGAYLRSFVYTFIELFSPTLNRKLVEQAMSGDHEAYEL

SEQ ID NO: 75764 - DNA, 924 bp, Methylobacillus flagellatus KT
  CDS (1)..(924)
ttgcggtatatccgtgaggtcgcccgtcagggcttgagtgtatctcttgcggctgatgccttgcacacttcgcagccgggtgtaagcaagcagatccagctgcttgaggacgagctcaacctgcagatattcaagcgcaatggcaagaggctgatcggtgtcactgagccgggcaagattatactgcagttggccgagcgcgtcatgatcgagatggacaacatcaagcgtgtcggcgacgagttttctcatgaggactcgggtaccctgaccattgccactacccatacccaggcgcgttaccgtttgcctgcggcggtaaaagagttcatgcagcgctaccccaaggtcaagctgaccatccatcagggcaatcccactcaggtggccgagcaggtgcagaaaggcgaagcggatatcgggattgcgacggagtccatcagcagttattccgatctgctttgcctgccttgctaccaatggaaccgttgcatcgtaatgccgcaaggccaccccttgttggcggagcaacccatcacactggagaaaatcacgcgctatcccttgatcacgtatgattttgcttttaccggcggctcgttggtcagcaaggttttcgagaaggccggcctgaaccccaacgtggtactgaccgcaatcgatgcggatgtgatcaagacctacgtcaatctcgggcttggtgtgggcctggttgccaacatggcctatgacccacagcgtgatagccacttggccatgctggatgtgagcgatctattcccgcccagcacaacttatatcggcttgcggcgcgacgcttacctgcgtgggtatgcttatgctttcattgagttgttggcgccgcattacccccgcaaggcagtggaggctgagctcaagattggttacagcgcgccggagtga

SEQ ID NO: 75765 - protein, 307 aa, Methylobacillus flagellatus KT
MRYIREVARQGLSVSLAADALHTSQPGVSKQIQLLEDELNLQIFKRNGKRLIGVTEPGKIILQLAERVMIEMDNIKRVGDEFSHEDSGTLTIATTHTQARYRLPAAVKEFMQRYPKVKLTIHQGNPTQVAEQVQKGEADIGIATESISSYSDLLCLPCYQWNRCIVMPQGHPLLAEQPITLEKITRYPLITYDFAFTGGSLVSKVFEKAGLNPNVVLTAIDADVIKTYVNLGLGVGLVANMAYDPQRDSHLAMLDVSDLFPPSTTYIGLRRDAYLRGYAYAFIELLAPHYPRKAVEAELKIGYSAPE

SEQ ID NO: 75766 - DNA, 912 bp, Burkholderia cepacia R18194
  CDS (1)..(912)
ttgcggttcgtgcgcgaagcggtgcgccagaacatgaacctgacggaagtcgcgaacgtgctgtacacgtcgcagtcgggcgtgtcgaagcagatcaaggatctcgaggatgagctgggcgtcgacatcttcatccggcgcggcaagcggctgacggggctcacggagcccggcaaggccgtgcaccagctgatcgagcggatgctgctcgacgccgagaacctgcgccgcgtcgcgcgccagttcgccgaccaggacagcggccacctcgtcgtcgcgacgacgcacacgcaggcgcgctacgcgctgccgaaggtgatccgccagttcaccgacgtgttcccgaaggtgcatctcgcgctgcgccagggcagcccgcagcagatcgcgcagatgatcctgaacggcgaggccgatctcggcatctcgaccgaggcgctcgaccgctatccggacatcgtcacgttcccgtgctattcgtggcatcacacggtcgtcgtgccgaagggccatccgctcgtcggccgcgagaacctgacgctcgaggaaatcgccgagtacccgatcatcacgtacgaccaggatttcacgggccgctcgcatatcgaccaggcgttcacgcaggcgggcgccgtgcccgacgtcgtgctgaccgcaatcgacgcggacgtgatcaagacgtatgtcgagctcggaatggggatcggcgtggtcgcggcgatggcctacgatccgcagcgcgacacgggcctcgtcgcgctcgatacgcagcacctgttcgaggcgagtacgacgcgggtcgggctgcgcaagggagcgttcctgcgcgcgtatgcataccggctgatcgagatgttcgcgccgcacctgaacgaagcggaaatcgcggggatgttgcgcgaagccgtttga

SEQ ID NO: 75767 - protein, 303 aa, Burkholderia cepacia R18194
MRFVREAVRQNMNLTEVANVLYTSQSGVSKQIKDLEDELGVDIFIRRGKRLTGLTEPGKAVHQLIERMLLDAENLRRVARQFADQDSGHLVVATTHTQARYALPKVIRQFTDVFPKVHLALRQGSPQQIAQMILNGEADLGISTEALDRYPDIVTFPCYSWHHTVVVPKGHPLVGRENLTLEEIAEYPIITYDQDFTGRSHIDQAFTQAGAVPDVVLTAIDADVIKTYVELGMGIGVVAAMAYDPQRDTGLVALDTQHLFEASTTRVGLRKGAFLRAYAYRLIEMFAPHLNEAEIAGMLREAV

SEQ ID NO: 75768 - DNA, 942 bp, Burkholderia cepacia R1808
  CDS (1)..(942)
atgaacctgcaccaatttcgcttcgtgcgcgaggccgtccggcagaatttcaacctcaccgaggccgccaaggcgctctatacgtcgcagccgggggtgtcgaaggcgatcatcgagctggaggacgagctcggcgtcgagatcttcacccgccacggcaagcgggttcgctcgctcaccgagccgggcagaatcatactcgcgtcggtcgagcggatcctgcaggaagtcgagagcctcaaaagggtcggaaaggactacgccgcgcaggaccagggcaacctgaccatcgccgccacgcacacgcaggcgcgctattcgctgccggccgcaatcgccgaattcaagaagcgcttcccgaaggtgcatctgtcgatcctgcagggcagcccgacgcaggtcgccgagatggtcatccacgaccaggccgacctcgcgatcgcgaccgaggcgatctccgactacaaggagctcgtgtcgctgccgtgcttccagtggcatcacgcggccgtggtgccggccgaccatccgctgctcgagcgcaagccgatcacgctcgacgacctcgcgcagtatccgctgatcacctacgacgacgcgttcgccggccgcaagaagatcaaccatgcgttcgcgctgcgcgggctgtcgccggacatcgtgctcgaggcgatcgacgccgacgtcatcaagacctacgtcgagctcgggctgggcgtcgggatcatggccgacatcgcgttcaatccggagcgcgaccgcaacctgaggctgattccggtcggccatctgttcggcagcaacgtgacgcgcgtggcgctcaagcagggcgcgtacctgcgcagctatgtgtatacgctcgtcgagctgctgtcgccgacgctgaaccgcaagctgatcgagcaggcgctcaagggcgaagccgaatcgtacgagctttga

SEQ ID NO: 75769 - protein, 313 aa, Burkholderia cepacia R1808
MNLHQFRFVREAVRQNFNLTEAAKALYTSQPGVSKAIIELEDELGVEIFTRHGKRVRSLTEPGRIILASVERILQEVESLKRVGKDYAAQDQGNLTIAATHTQARYSLPAAIAEFKKRFPKVHLSILQGSPTQVAEMVIHDQADLAIATEAISDYKELVSLPCFQWHHAAVVPADHPLLERKPITLDDLAQYPLITYDDAFAGRKKINHAFALRGLSPDIVLEAIDADVIKTYVELGLGVGIMADIAFNPERDRNLRLIPVGHLFGSNVTRVALKQGAYLRSYVYTLVELLSPTLNRKLIEQALKGEAESYEL

SEQ ID NO: 75770 - DNA, 936 bp, Rubrivivax gelatinosus PM1
  CDS (1)..(936)
atgaacttccagcaactgcgctccgtccgcgaggcggtgcggctcggcttcaacctcaccgacgtggccgaggcgctgcacacgtcgcagccgggcgtgagccggcagatccgcgagctcgaagacgagctcggcgtcgacatcttcgtgcgcgccggcaagcggctgaccgggctcaccgcccccggcgaggcggtgctgccgatcgtggagcggctgctgcacgacgccgacaacctcaagcgcgccggcgccgactacgcccagcaggaccacggcccgctgtccatcgccgccacccactcgcaggcgcgctacgcgctgccgccagcggtgcgcgacttccgcggcagccatccgggcgtgcagttgcagctgcaccagggctcgccgaagcaggtggcgcagatgctgctcgacggcgaggccgacatcggcatcgcgaccgaggcgctggcgcagtaccccgacctcgtggcgctgccctgctaccgctggacgcacgcggtgctggtgccgcccgaccacccgctgctcgacggcggcgccctcacgctgaagcggctcgccgaatacccgctgatcacctacgacgccggctacaccggccgctcgcacatcgacgaggccttcgagcgcgagggcctcacgcccacgctggcgctgacggcgatggacgccgacgtgatcaagacctacgtggagttgggcctgggcgtcggcatcgtcgcctcgatcgcctacgacgacgagcgcgatcgccacctgcgcgcgctcgacgcgcgccacctgttcgccgtgaacatgacgcgcctggcgctcaagcgcggcagctacctgcgggcctatgtgtacgacttcatcgagagctttgcgccgtcgctgacgcgcaaggtggtgcagcgcgcgctcgacggcggcaaggtcgaactctga

SEQ ID NO: 75771 - protein, 311 aa, Rubrivivax gelatinosus PM1
MNFQQLRSVREAVRLGFNLTDVAEALHTSQPGVSRQIRELEDELGVDIFVRAGKRLTGLTAPGEAVLPIVERLLHDADNLKRAGADYAQQDHGPLSIAATHSQARYALPPAVRDFRGSHPGVQLQLHQGSPKQVAQMLLDGEADIGIATEALAQYPDLVALPCYRWTHAVLVPPDHPLLDGGALTLKRLAEYPLITYDAGYTGRSHIDEAFEREGLTPTLALTAMDADVIKTYVELGLGVGIVASIAYDDERDRHLRALDARHLFAVNMTRLALKRGSYLRAYVYDFIESFAPSLTRKVVQRALDGGKVEL

SEQ ID NO: 75772 - DNA, 954 bp, Rubrivivax gelatinosus PM1
  CDS (1)..(954)
atgaacctgcatcagtttcgtttcgtccaggaagccgtgcgccgcaatctcaacctgaccgagaccgcgaaggcccttcacacgtcccagcccggaatttccaaggccatcctcgagctcgagggcgagctcggcatcgacatcttcgcgcgccacggcaagcggctcaagcgcatcaccgagccaggccagcaggtgctcgcggccatcgagatcatcatgcgcgaggtcggcaacctcaagcgcatcggcgaggagtacagccagcaggatgccggcaccttgtcgatcgccaccacccacacccaggcacgctacgtgctgcctggcccggtggctgcgctgcgcaagcgccatcccaaggtggcaatcagcctgcaccagggcacacccgagcaggtggcgcagatgctgatcgacgagaccgcagaggtcgggctggcgaccgagtcgctgagcgatttcgagtccctggtcaccctgccctgctacgactggcagcacgtggtggtgctgccgctgaaccatccactcgcggcgcacgaacggctgaccctggagcaactggcccaggagccgctgatttcctaccacccgtccttcacgggccgcacccgcgtcgaccaggccttcgccacgcgcggactcaagccgaacgtcgtgctggaggcgatcgactccgacgtcatcaagacctacgtccggctcggcctgggtgtgggcatcgtggccgagatggcggtgcgcgacgatcccgcctgtgcaccgggcggcgatctcgtcacgcgtccagccggccagctgttcggcaacaacgtcgcccgactcgctttcaagcgcggagcctacctgcgcaacttcgtctacggttttgccgagctgctgtctgaccggctgacccgcgatctgatcacccgcgcgttgcagggcgacgccgaaagctacgaactgtga

SEQ ID NO: 75773 - protein, 317 aa, Rubrivivax gelatinosus PM1
MNLHQFRFVQEAVRRNLNLTETAKALHTSQPGISKAILELEGELGIDIFARHGKRLKRITEPGQQVLAAIEIIMREVGNLKRIGEEYSQQDAGTLSIATTHTQARYVLPGPVAALRKRHPKVAISLHQGTPEQVAQMLIDETAEVGLATESLSDFESLVTLPCYDWQHVVVLPLNHPLAAHERLTLEQLAQEPLISYHPSFTGRTRVDQAFATRGLKPNVVLEAIDSDVIKTYVRLGLGVGIVAEMAVRDDPACAPGGDLVTRPAGQLFGNNVARLAFKRGAYLRNFVYGFAELLSDRLTRDLITRALQGDAESYEL

SEQ ID NO: 75774 - DNA, 942 bp, Ralstonia metallidurans CH34
  CDS (1)..(942)
atgaaccttcatcaattccgctttgtgcgtgaggctgtccgtcagaatttcaacttgacggaggccgcaaaggcgctctatacgtcacaacccggcgtttccaaggcgattatcgaactggaagaggagctaggtgtcgatatcttcacacgacacggcaaacggattcgcagcctgaccgaaccggggcggcgcatcctgacctcggtagagaagatcctgcaggaagtggaaagtctgaagcgcgtgggcaaggactacgcggcacaggatcagggcaacttcaccatcgccaccacccatacccaggcccgttacgcgctgccgcgcgtgatcagcgagttcaccaagcgctacccgaaggtgcggctgtcgatccagcagggcaatccggcgcagatcgccgacatgatcttgcatgaccaggccgatctgggcatcgccaccgagggcatctcgggcgacaagagcctggtgtcgctgcccgggtaccagtggcagcatatggtgattacgccacctgaccatccgctgctggagaaaaagcacctgacgctggaagacctggccacctttccgctgatcacctatgacgtgaactttgctggccggcccaagatcgacaaggcattcgagttgcgccatctccagccggacatcgtgctggaggccatcgacgccgacgtcatcaagacgtacgtcgaggttggcctgggcgtcggcatcgtggccggccttgcctacgaccccgaacgtgaccgcaacctgcgcggcattccggccggccacctgtttggcaccaatgtcacccacctggccgtcaagcagggggcctatctacgcagcttcgtctatacattcatcgagttgttctcgccgaccctgaaccgcaagctggtggaacaggcgatgtcgggcgaccacgaagcctacgaactctga

SEQ ID NO: 75775 - protein, 313 aa, Ralstonia metallidurans CH34
MNLHQFRFVREAVRQNFNLTEAAKALYTSQPGVSKAIIELEEELGVDIFTRHGKRIRSLTEPGRRILTSVEKILQEVESLKRVGKDYAAQDQGNFTIATTHTQARYALPRVISEFTKRYPKVRLSIQQGNPAQIADMILHDQADLGIATEGISGDKSLVSLPGYQWQHMVITPPDHPLLEKKHLTLEDLATFPLITYDVNFAGRPKIDKAFELRHLQPDIVLEAIDADVIKTYVEVGLGVGIVAGLAYDPERDRNLRGIPAGHLFGTNVTHLAVKQGAYLRSFVYTFIELFSPTLNRKLVEQAMSGDHEAYEL

SEQ ID NO: 75776 - DNA, 942 bp, Burkholderia fungorum LB400
  CDS (1)..(942)
atgaacctgcatcaattccgcttcgtccgcgaggctgtgcggcagaatttcaacctgacggaagcggcgaaagccctgtttacaagccagccgggcgtttccaaggcgatcatcgagctggaggacgaactcggcgtggaaatcttcacacgacacggcaagcgggtgcgctcgctgaccgagccggggcgcatcattcttcaatcggttgagaagattctgcaggaagtcgagagcctcaaacgggtcggtaaagattacgcggcgcaggatcagggcaatctggtgatcgccgccacccacacccaggcgcgctactcgctgcccgctgcgatcgccgaattcaagaagcgctttcccaaggtccacctttcgattctgcaaggcagcccgactcaggtcgccgaaatggtgatccacgaccaggccgacctctgcatcgccaccgaggcgatcgccaactataaggaactggtgtcgctgccgtgcttccagtggcaccacgtggcggtcatgcaaccggatcatccattgctcgaccgcaaacttttgtcgctggatgatctgacccagtatccgctgatcacctacgacaacgcgttcgccggccgcaccaagatcaacgaggcgttccgcctgcgcggtctgcatccggacatcgtactggaggcgatcgacgccgacgtgatcaagacctacgtggaactgggtctgggcgtcggcatcatggcggatatcgcgttcaacgccgagcgcgaccgtcatctgcgcgccatgccggtcggccacctgttcggcagcaacgtgacgcgggtcgcgctgaaacagggcgcctatttgcgcagctatgtgtacacgctcgtcgaactgctgtcgccgagcatgaaccgcaagctgatcgagcaggcgctcaagggcgaacacgaaacctacgaactttga

SEQ ID NO: 75777 - protein, 313 aa, Burkholderia fungorum LB400
MNLHQFRFVREAVRQNFNLTEAAKALFTSQPGVSKAIIELEDELGVEIFTRHGKRVRSLTEPGRIILQSVEKILQEVESLKRVGKDYAAQDQGNLVIAATHTQARYSLPAAIAEFKKRFPKVHLSILQGSPTQVAEMVIHDQADLCIATEAIANYKELVSLPCFQWHHVAVMQPDHPLLDRKLLSLDDLTQYPLITYDNAFAGRTKINEAFRLRGLHPDIVLEAIDADVIKTYVELGLGVGIMADIAFNAERDRHLRAMPVGHLFGSNVTRVALKQGAYLRSYVYTLVELLSPSMNRKLIEQALKGEHETYEL

SEQ ID NO: 75778 - DNA, 927 bp, Burkholderia fungorum LB400
  CDS (1)..(927)
atgaatttccagcaattgcgcttcgtgcgcgaagccgtacgtcagaacatgaatctgaccgaggtggcgaacgtgctgtacacgtcgcaatcaggcgtgtccaaacagatcaaggatctggaggacgaactcggcgtcgatattttcatccggcgcggcaagcgtctgacgggcctcaccgagccgggcaaggcggtgcatcagttgatcgagcggatgctgctcgacgccgagaatctacgccgcgtcgcgcgccagtacgccgatcaggatagcgggcacctcgtcgtggccaccacgcacacgcaggcgcgctacgcgctgccaaaggtgatccgccagttcaccgaggtgttccccaaggtgcatctggcgctgcgccagggaagcccgcaacagatcgcgcagatgatcatcaacggcgaagcggacatcggcatctccaccgaagcgctcgaccgcttcccggatatcgtcacgttcccgtgctattcgtggcatcacgtggtggtcgtgccgaagggtcatccgctggtgggccggccgaatctgacgctcgacgagatcgccgaattcccgatcgtcacgtacgaccaggatttcacgggccgctcgcatatcgaccaggcgttcgcgaaagcgggcgcgttgcccgacgtcgtgctgaccgcgatcgacgccgacgtgatcaagacgtatgtcgaactgggcatgggtatcggcgtggttgcggcgatggcctacgaccccaagcgcgacacggaactggtcgcgctcgacacgcagcatctgttcgaagcgagcacgacgcgggtcggtttgcgcaagggcgcgttcctgcgtgcttacgcgtaccggctgatcgagatgttcgcgccgcagttgaacgaagcggatatcgccgcgcagttgcgcgaagcagtctga

SEQ ID NO: 75779 - protein, 308 aa, Burkholderia fungorum LB400
MNFQQLRFVREAVRQNMNLTEVANVLYTSQSGVSKQIKDLEDELGVDIFIRRGKRLTGLTEPGKAVHQLIERMLLDAENLRRVARQYADQDSGHLVVATTHTQARYALPKVIRQFTEVFPKVHLALRQGSPQQIAQMIINGEADIGISTEALDRFPDIVTFPCYSWHHVVVVPKGHPLVGRPNLTLDEIAEFPIVTYDQDFTGRSHIDQAFAKAGALPDVVLTAIDADVIKTYVELGMGIGVVAAMAYDPKRDTELVALDTQHLFEASTTRVGLRKGAFLRAYAYRLIEMFAPQLNEADIAAQLREAV

SEQ ID NO: 75780 - DNA, 975 bp, Microbulbifer degradans 2-40
  CDS (1)..(975)
atgaaactgcagcagttacgttacatttgggaagtcgctcatcacgagctaaacgtatcggctacggcacagagcttgtacacatcgcaacctggaattagtaagcagatccggttgctagaagatgagctaggtgtagaaattttttcgcgcagcggcaagcatttaacgcgcattactcctgccggggaggcaatacttcgtactgcgggcgagatactgcgtaaagtagagagcattaagcaggttgcgcaggaattcagcaacgagcgtaaaggcagcctatctattgctactacgcatacccaggcgcgctacgctttaccgcctgtaataggtaagtttattcaaaactaccctgatgtttcgctgcatatgaatcagggtacgccgatgcaaatttctgaaatggctgcagacggcaccgtagattttgctatcgccactgaggcaatggagctatttagcgatttaattatgttgccttgctacaagtggaaccgctgtattcttgttcctaaggggcacccactaacgcagttatcgatgcttagcttggaagatgtagctaaacacccgctggtaacctatgtatttgggttcaccggccgctcgcgcctagatgaagcatttttggagcatggtttagcgcctaaggtagtctttaccgcggcagatgccgatgtaattaaaacctatgtacgcttgggcttgggcataggtattgtggctaaaatggcctacaacgagcaggaagacagtgatttggtggcgctggatgctagtcacttgttccgtgctagcactaccaaaataggtttccgcaggggcacattcttacgcggctttatgtatgagtttatagaggcgtttgcgccgcaccttactaaagaggtggtaaacgaggcatttaaccgtcattccaagcttgaattggatgagctgttctctaatatcgaattgcctgaatattag

SEQ ID NO: 75781 - protein, 324 aa, Microbulbifer degradans 2-40
MKLQQLRYIWEVAHHELNVSATAQSLYTSQPGISKQIRLLEDELGVEIFSRSGKHLTRITPAGEAILRTAGEILRKVESIKQVAQEFSNERKGSLSIATTHTQARYALPPVIGKFIQNYPDVSLHMNQGTPMQISEMAADGTVDFAIATEAMELFSDLIMLPCYKWNRCILVPKGHPLTQLSMLSLEDVAKHPLVTYVFGFTGRSRLDEAFLEHGLAPKVVFTAADADVIKTYVRLGLGIGIVAKMAYNEQEDSDLVALDASHLFRASTTKIGFRRGTFLRGFMYEFIEAFAPHLTKEVVNEAFNRHSKLELDELFSNIELPEY

SEQ ID NO: 75782 - DNA, 948 bp, Ralstonia eutropha JMP134
  CDS (1)..(948)
atgaattttcagcaactccgatcgatccgcgaggcggtacgccgccagttcaacctgaccgaagtcgccaacgcgctgtacacctcgcagccgggcgtgtcgcgccagatccgcgaactcgaagaagaactcggcgtggagattttcgagcgctatggcaagcgcctgaccgggctgaccgagccgggccgcgagatcgtgcgcattgtcgagcgcctgctgctcgaggccgagaacctgcgccaggccggggacgaatttgcgggccgccataccggccgcctgacggtggccacgacgcacacgcaggcacgctatgcgttgccgaaggtggtgcagtcgttccgtcgcgagtatccgcacgtcacgctcgcgctgcaggaggcgtcgcccacgcacatcgtcgaactgctgctgacggggcaggccgacatcggcatcgcaaccgaggcgcttgccaccgaggccgggctgacctcgtttgacgcctacacatggcagcacgtgctggtggtctcgcccgatcatcccctgacgctcgtgccggagccgacgctggaagacctggccggtttcccgctgatcacgtatgacgccggcttcacgggccgccgcaagatcgacggcgccttcgccgaggccggcctgcagcccgaaatcgtgctgacggcgctggatgcggacgtcatcaagacctatgcggagctcgaactgggcgtgggcatcatcgcttcgatggcctacgacgagcgcaaggactcgggcctggtgcggatttcggccgaccatctgttcgattcgaacaccacaagcgtggcgctgcggcgcggcgcgtacctgcgcgactacgcccacgccttcatcaacatgttcgcgccgcacctgtcacgcgacacggtctccagcgcgctgggcgaaagcgacacgcggcaggccttggccgcgtga

SEQ ID NO: 75783 - protein, 315 aa, Ralstonia eutropha JMP134
MNFQQLRSIREAVRRQFNLTEVANALYTSQPGVSRQIRELEEELGVEIFERYGKRLTGLTEPGREIVRIVERLLLEAENLRQAGDEFAGRHTGRLTVATTHTQARYALPKVVQSFRREYPHVTLALQEASPTHIVELLLTGQADIGIATEALATEAGLTSFDAYTWQHVLVVSPDHPLTLVPEPTLEDLAGFPLITYDAGFTGRRKIDGAFAEAGLQPEIVLTALDADVIKTYAELELGVGIIASMAYDERKDSGLVRISADHLFDSNTTSVALRRGAYLRDYAHAFINMFAPHLSRDTVSSALGESDTRQALAA

SEQ ID NO: 75784 - DNA, 945 bp, Polaromonas sp. JS666
  CDS (1)..(945)
atgaaccttcaccaattccgattcgttcaagaggccatacggcgcaacctgaacctcaccgaaaccgctcgcgccctgcacacgtcgcagcccggggtgtccaaggccatcatcgaactcgaagaagaactcggggtggagatttttgcgcgccatggcaagcggctcaaacgcgtgaccgaacccggcgagcatgtgctcaaaagcatagaactcatcatgcgcgaggtgggtaacctgcggcgtatcggtgagcagttttcggcgcaggacagtggaacgctgtcgatcgccaccacgcacacccaggcccgctacgtgctgccgcaaccggtggcgaagctgcgcgaagctttccccaaggtcaacgtcagcctgcaccagggctcacccgaccaggtggcccgcatggtcatcgacgaggtcgccgaaatcggcatcgccaccgaatcactgacccagtacgaagaactggtgaccctgccttgctacgaatggcagcacatgctcgtgatgcctgtcgaccatccgctggccaaaaaggatgacatcacgctggaggatctggcgcaggaaccgctgatcacctaccacccatcctttaccgggcgcaccaaggttgaccacgcgtttgcggccaaacgcctgcaaccgcgcattgccctggaagccattgactctgatgtgatcaagacctatgtgcgcctggggctgggcgtggggattgtggccgagatggcactcatggatgacggcaccaacagcgacctcgtggccaagccggccggcatgttgtttggcatgaacgtggcccgcgtcgctttcaagcgcagcgcctacctgcgcaatttcgtttataaatttgccgagctgctcagcgacaagctggaccgcgcccttatcaccaaggccatggcaggccgcatcaacgactatgagatttga

SEQ ID NO: 75785 - protein, 314 aa, Polaromonas sp. JS666
MNLHQFRFVQEAIRRNLNLTETARALHTSQPGVSKAIIELEEELGVEIFARHGKRLKRVTEPGEHVLKSIELIMREVGNLRRIGEQFSAQDSGTLSIATTHTQARYVLPQPVAKLREAFPKVNVSLHQGSPDQVARMVIDEVAEIGIATESLTQYEELVTLPCYEWQHMLVMPVDHPLAKKDDITLEDLAQEPLITYHPSFTGRTKVDHAFAAKRLQPRIALEAIDSDVIKTYVRLGLGVGIVAEMALMDDGTNSDLVAKPAGMLFGMNVARVAFKRSAYLRNFVYKFAELLSDKLDRALITKAMAGRINDYEI

SEQ ID NO: 75786 - DNA, 972 bp, Thiocapsa roseopersicina
  CDS (1)..(972): transl_table=11
atggacgtacgccaattacgttcgctggtgaccctggtcgaggttcgcttcagcgtgagccgggccgccgagtgtctgcaccttgtccagtcggccgtgactcagcatctcaaacagctcgaggcggagctcggcacacgtctgttcgtgcgccacggcaaacgtctggtcgggttgaccgaggtgggagaacaggtcttgcgccacgcctgcgaggccttgcgccagaccgggaatatcgtcgcggtgggtcgcgagcacctggaggaagagcggcggcgtattcgcctgggcgccacccacacgcaggcccgctatgtcctgccgccagtcatccggcgttttgccgcggcctacccggcggtggagcttcagatccaccagggcacacccggccaactcgtcgacatggcgctgcgcgatctggtggatctggcgatctgcaccgaggcactcggtgacgagatcgccctgcaaacgattccctgctatcgctggaaccgttgtttgatcgcgccccggtcgcatgccgtgctcgacctgcagtcgatcacactggccgcgctctgtaccgtcccgatcatcacctacgtcttcggctttacggggcgcgggggcttcagcgatgtcttttcgcgagccggactgcatccgaatgtggtgctcagtgcagcggacaccgatgtcatcaagacctacgtgcgcgagggactcggcgtcggcatcatcgccgccttggcgtatcagccccgcgacgatgcggatctcgggatccgagaccttgccgatctttttccgtgggaggtgaccaagatcgcctacgctcggggtaagtatctgcgtcgcttccatgaacacttcatcgacattttcaaacgctgtaccggcgacatctcgggcgagcatgccgaggcaagcctccgggcgcagacgggaacgcgtgcgatgaaggatcgggtgattgcggactga

SEQ ID NO: 75787 - protein, 323 aa, Thiocapsa roseopersicina
MDVRQLRSLVTLVEVRFSVSRAAECLHLVQSAVTQHLKQLEAELGTRLFVRHGKRLVGLTEVGEQVLRHACEALRQTGNIVAVGREHLEEERRRIRLGATHTQARYVLPPVIRRFAAAYPAVELQIHQGTPGQLVDMALRDLVDLAICTEALGDEIALQTIPCYRWNRCLIAPRSHAVLDLQSITLAALCTVPIITYVFGFTGRGGFSDVFSRAGLHPNVVLSAADTDVIKTYVREGLGVGIIAALAYQPRDDADLGIRDLADLFPWEVTKIAYARGKYLRRFHEHFIDIFKRCTGDISGEHAEASLRAQTGTRAMKDRVIAD

SEQ ID NO: 75788 - DNA, 951 bp, Escherichia fergusonii
  CDS (1)..(951): transl_table=11
gtgaatttccagcaacttaaaattatccgtgaggcggccaggcgggattacaacctgaccgaggtcgccaatatgctttatacctctcagtccggcgtcagtcgccatatccgcgagctggaagaagaactggggatagagatttttatccgtcgcggcaagcgtctgcttggcatgacggagccgggcaaagccttgctgaccatcgcggagcggatcctcaacgaggccagcaatgtgcgtcgcctggcggatctctttaccaatgacgcctcgggcgtcctcactatcgccaccacccacacccaggcgcgttacagcctgccgccggtgattaaagccttccgtgaacttttccctgacgtccgtctggagcttatccagggcacaccgcaggaaattgacgtgctgttgcaaaacggtggggcagatatcggcattgccagtgaacgcctgagcaacgatccgctgctggtggctttcccgtggtttcgctggtaccacagtctgttacttcccgtcgaccatccgctgaatcaggttacgcccctgacgctggaagatatcgcgaaatggccactgattacctaccggcagggtattaccggacgctcgcgcattgatgaagcctttaaccgcaaaggcttaacgccggatgtggtgctgagtgcacaggactctgatgtaatcaaaacctacgtcgagttggggctgggcattggtctggtggcggaacagtccggtggtgaacgcgagacggagaacctggtacgactagatacgcgtcatctctttgatgccaataccgtatggctcggcctgaagcgtggacaactgcagcgcaactatgtgtggcgctttatcgaactctgcaacgccgggctgtccgtggatgagattaaacgtcaggtgatggagccagaagaagtggcgattgattatcagatttag

SEQ ID NO: 75789 - protein, 316 aa, Escherichia fergusonii
MNFQQLKIIREAARRDYNLTEVANMLYTSQSGVSRHIRELEEELGIEIFIRRGKRLLGMTEPGKALLTIAERILNEASNVRRLADLFTNDASGVLTIATTHTQARYSLPPVIKAFRELFPDVRLELIQGTPQEIDVLLQNGGADIGIASERLSNDPLLVAFPWFRWYHSLLLPVDHPLNQVTPLTLEDIAKWPLITYRQGITGRSRIDEAFNRKGLTPDVVLSAQDSDVIKTYVELGLGIGLVAEQSGGERETENLVRLDTRHLFDANTVWLGLKRGQLQRNYVWRFIELCNAGLSVDEIKRQVMEPEEVAIDYQI

SEQ ID NO: 75790 - DNA, 951 bp, Klebsiella aerogenes
  CDS (1)..(951): transl_table=11
gtgaacttccagcagctgaaaattatccgtgaggcggcccgtcaggattacaacctgacggaagtcgcgaatatgctctatacctcgcagtcaggcgtcagtcgccatatccgggaactggaagaggagctggggattgagatctttatccgccgcggcaaacgcctgttaggcatgaccgagccgggtaaagcgctgttatcgattgccgagcggatcctcaatgaagccagtaacgttcggcggctggcggatctcttcactaacgatgcgtcaggcgtcttaaccatcgccaccacccatactcaggcgcgctacagcctgccgccggtcattaaagctttccgcgagctgttctcagatgttcgcgtcgagctggtgcagggtaccccgcaggaaatcgaagcgctgctgcataacggtggagcggatatcggcatcgccagcgagcgcctgagcaacgatccgacgctggcggctttcccctggttccgctggcatcacagcctgctggtgccgaaggatcatcctttgacgcaggtttctcccctgacgctggaggcgatcgcccgctggccgttaatcacctaccgccaggggatcactggccgttcgcgcattgatgaggcgttcaaccgcaaggggttgatgccggatatcgtgctgagcgcgcaggattccgatgtgatcaagacctacgtggagctggggctgggcgtcgggctggtcgccgagcagtccggtgatgcccgggaagcggacacctttacgcgtcttgatacccgccatctgttcgatgccaataccgtgtggttgggactgaagcggggccagctgcagcggaattacgtttggcgctttatcgaattgtgcaatgccggactgtcgctggatgagattaagcgtcaggcgatggagccggaagaggtcgcaatcgactatcagatttaa

SEQ ID NO: 75791 - protein, 316 aa, Klebsiella aerogenes
MNFQQLKIIREAARQDYNLTEVANMLYTSQSGVSRHIRELEEELGIEIFIRRGKRLLGMTEPGKALLSIAERILNEASNVRRLADLFTNDASGVLTIATTHTQARYSLPPVIKAFRELFSDVRVELVQGTPQEIEALLHNGGADIGIASERLSNDPTLAAFPWFRWHHSLLVPKDHPLTQVSPLTLEAIARWPLITYRQGITGRSRIDEAFNRKGLMPDIVLSAQDSDVIKTYVELGLGVGLVAEQSGDAREADTFTRLDTRHLFDANTVWLGLKRGQLQRNYVWRFIELCNAGLSLDEIKRQAMEPEEVAIDYQI

SEQ ID NO: 75792 - DNA, 972 bp, Haemophilus influenzae
  CDS (1)..(972): transl_table=11
atgaaaatgcatcaattgcgttatatcgttgagattgtaaaccaaaatttgaatgtcacagaagctgcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggctcgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcacatacggcattagatacggatcttgtgctaattgatgcaagccatttgttccgcccgagtatgacgaatattgcatttaaacatagcacgttcttacgtaattatatgtacgatttcatggaatatttttcaccgcacttaactcgtagtgtcgtagaaaaagccgagcgtttgcgagataacaattcagtgaaaaaattatttgaaggcattgaattggaaacaaaataa

SEQ ID NO: 75793 - protein, 323 aa, Haemophilus influenzae
MKMHQLRYIVEIVNQNLNVTEAANALYTSQPGISKQVRLLEDELGLEIFERHGKHIKSITPAGKKIISIARELLVKAQGIRAVADEYTRPNHGVLRIATTNTQARYMLPSVIERFSKKYPDVSLHIHQGSPTQIHDALMSGEVDLAITTEAPYLFDDLVQIPCYWWNRAVIVSPEHPLAKVKELTIEELGKYPLVTYTFGFTGVSDLDYAFNSAGILPNIVFTATDADVIKTYVRLGLGVGIMASMAHTALDTDLVLIDASHLFRPSMTNIAFKHSTFLRNYMYDFMEYFSPHLTRSVVEKAERLRDNNSVKKLFEGIELETK

SEQ ID NO: 75794 - DNA, 1182 bp, Klebsiella aerogenes
  CDS (208)..(1182)
cgtctatacagtgttgatataaatgatatagtggttatagttaatgccttttttattattaaaacgtcttatacatcatcgctttcaggatgcattgcggcgccactatggccaactgccgggagcccagggccttcatcggcgacaagttgcctgaacgtaaagtgtattaagcggcttcattttacgcgcaaacggatatcagccatgaaactacaacagcttcgctacatcgttgaggtggttaaccataacctgaatgtttcatccaccgccgaagggctctatacctcccagccgggtatcagtaagcaggtccgcatgttggaggatgagctgggcattcagatctttgcccgcagcggtaaacacttaacccaggtgacgccggccgggcaggagatcatccgcatcgcccgcgaagtgctgtcgaaagtcgatgccatcaaatctgtcgccggagagcatacctggcctgacaaagggtctctttacgtcgccaccacccatacccaggcgcgctatgcgttaccgggagtgatcaaggggtttattgaacgctacccgcgggtgtcgctgcatatgcatcagggctcgccgactcagatcgcggaggctgtgtcgaaaggcaatgccgatttcgccatcgccaccgaggcgctgcatctgtatgacgatctggtgatgctgccatgctatcactggaaccggtcgattgtagtgacccccgagcatcctctggccaccaagggctcggtgtccatagaggaactggcccagtatccactggtaacctatacctttggttttaccggccgctccgaactggataccgcgtttaaccgtgcgggcctgacgccgcgcattgtttttaccgccaccgatgccgacgtcatcaaaacctatgttcgcctggggctgggggtaggggtaatcgccagcatggcggtggatccggtctctgacccggatctggtgaagctggatgcgaacggtattttcagccacagcaccactaagataggtttccgccgcagcaccttcttacgaagctacatgtatgattttattcaacgttttgctccccatttgaccagggacgtggtagataccgcggtggctttacgctcgaatgaagatattgaagcgatgttcaaagatataaaacttccggaaaaataa

SEQ ID NO: 75795 - protein, 324 aa, Klebsiella aerogenes
MKLQQLRYIVEVVNHNLNVSSTAEGLYTSQPGISKQVRMLEDELGIQIFARSGKHLTQVTPAGQEIIRIAREVLSKVDAIKSVAGEHTWPDKGSLYVATTHTQARYALPGVIKGFIERYPRVSLHMHQGSPTQIAEAVSKGNADFAIATEALHLYDDLVMLPCYHWNRSIVVTPEHPLATKGSVSIEELAQYPLVTYTFGFTGRSELDTAFNRAGLTPRIVFTATDADVIKTYVRLGLGVGVIASMAVDPVSDPDLVKLDANGIFSHSTTKIGFRRSTFLRSYMYDFIQRFAPHLTRDVVDTAVALRSNEDIEAMFKDIKLPEK

SEQ ID NO: 75796 - DNA, 975 bp, Salmonella typhimurium
  CDS (1)..(975)
atgaaattgcagcagcttcgttacattgttgaagtggttaatcataaccttaacgtctcctctaccgctgaggggttgtatacttcccagccggggatcagcaagcaggttcggatgctggaagatgagcttggcatccagattttcgcccgcagtggtaagcatctgactcaggtgacgcccgcaggtcaggagattattcgtattgcgcgtgaggtgctttccaaagtcgatgccattaagtcggtcgccggcgagcacacctggccggataaaggctcgctctatattgccactacccatactcaggcgcgttatgcattgccaggcgtgattaaaggcttcatcgagcgttacccgcgcgtttcgctgcatatgcaccaggggtcgccaacgcagattgcggaagcggtatcgaaagggaacgccgatttcgcgattgccacggaagcgctgcatttatatgacgatctggtgatgttgccatgctatcactggaaccgttcgatagtggtgacgccggatcatccattggcggcaacgtcttccgtaacgatcgaagcgctggcgcagtatccgctggtgacgtataccttcggctttaccgggcgttccgaactggataccgcttttaatcgcgcaggattaacgccgcggatcgtctttactgcaaccgatgcggatgtgattaaaacgtatgtcaggttgggactgggcgttggcgtcattgccagcatggcggtcgatccgcttgccgatcctgatttagtgcggattgacgcgcacgatatttttagccacagcaccacaaaaattggttttcgccgtagtacttttttacgcagctatatgtatgattttatccagcgttttgcgccacatctgacgcgtgatgtggtggatacggcggtggcgttgcgttctaatgaagaaattgaagcgatgtttcaggatataaagctgcctgaaaagtaa

SEQ ID NO: 75797 - protein, 324 aa, Salmonella typhimurium
MKLQQLRYIVEVVNHNLNVSSTAEGLYTSQPGISKQVRMLEDELGIQIFARSGKHLTQVTPAGQEIIRIAREVLSKVDAIKSVAGEHTWPDKGSLYIATTHTQARYALPGVIKGFIERYPRVSLHMHQGSPTQIAEAVSKGNADFAIATEALHLYDDLVMLPCYHWNRSIVVTPDHPLAATSSVTIEALAQYPLVTYTFGFTGRSELDTAFNRAGLTPRIVFTATDADVIKTYVRLGLGVGVIASMAVDPLADPDLVRIDAHDIFSHSTTKIGFRRSTFLRSYMYDFIQRFAPHLTRDVVDTAVALRSNEEIEAMFQDIKLPEK

SEQ ID NO: 75798 - DNA, 25 bp, Primer
atgaaattacaacaacttcgctata

SEQ ID NO: 75799 - DNA, 27 bp, Primer
ttatttttccggcagttttatatcttt

SEQ ID NO: 75800 - protein, 305 aa, consensus
  MISC_FEATURE (1)..(305): consensus for the disclosure of xaa see table XV
MXXXQXRXXXEXXXXXXNXXXXAXXLXTSQXGXSKXXXXLEXELGXXXFXRXGKXXXXXTXXGXXXXXXXXXXLXXXXXXXXXXXXXXXXXXGXLXXATTHTQARYXLPXXXXXFXXXXPXVXLXXXQGXPXXXXXXXXXGXXDXXIXTEXXXXXXXLXXXPXYXWXXXXXXXXXHPLXXXXXXXXXXXXXXXXXXXPXXTYXXXFXGXXXXXXAFXXXGXXXPXXXXXAXDXDVIKTYVXXGLGXGXXAXXAXXXXXXXXXDXXLXXXXXXXXFXXXXXXXXXXXXXXLRXXXXXFXXXXXPXL

SEQ ID NO: 75801 - protein, 58 aa, consensus
  MISC_FEATURE (1)..(58): consensus for the disclosure of xaa see table XV
XXXXXXXXXXXXQXXXXXXXXXXEXXXXXXXFXRXGXXXXXXXXXXGXXXXXXXXXXX

SEQ ID NO: 75802 - protein, 39 aa, consensus
  MISC_FEATURE (1)..(39): consensus for the disclosure of xaa see table XV
GXXXXXXXXXXAXXXLPXXXXXXXXXXXXXXXXXXXXXX

SEQ ID NO: 75803 - protein, 35 aa, consensus
  MISC_FEATURE (1)..(35): consensus for the disclosure of xaa see table XV
XXXXXXXXXXXXXXXXXXXXXXWXXXXXXXXXHXX

SEQ ID NO: 75804 - protein, 65 aa, consensus
  MISC_FEATURE (1)..(65): consensus for the disclosure of xaa see table XV
XXXXXXXXXXXXXYXXXXXXXXXXXXXFXXXXXXXXXXXXXAXXXDXXXXYXXXXXGXGXXXXXX

SEQ ID NO: 75805 - DNA, 1614 bp, Escherichia coli; identical to SEQ ID NO: 38469
  CDS (130)..(1503)

SEQ ID NO: 75806 - protein, 457 aa, Escherichia coli; identical to SEQ ID NO: 38470

SEQ ID NO: 75807 - DNA, 1221 bp, Thermococcus kodakaraensis; identical to SEQ ID NO: 38471
  CDS (1)..(1221)

SEQ ID NO: 75808 - protein, 406 aa, Thermococcus kodakaraensis; identical to SEQ ID NO: 38472

SEQ ID NO: 75809 - DNA, 1530 bp, Staphylococcus epidermidis RP62A; identical to SEQ ID NO: 38473
  CDS (1)..(1530)

SEQ ID NO: 75810 - protein, 509 aa, Staphylococcus epidermidis RP62A; identical to SEQ ID NO: 38474

SEQ ID NO: 75811 - DNA, 1452 bp, Homo sapiens; identical to SEQ ID NO: 38475
  CDS (1)..(1452)

SEQ ID NO: 75812 - protein, 483 aa, Homo sapiens; identical to SEQ ID NO: 38476

SEQ ID NO: 75813 - DNA, 1107 bp, Archaeoglobus fulgidus DSM 4304; identical to SEQ ID NO: 38477
  CDS (1)..(1107): transl_table=11

SEQ ID NO: 75814 - protein, 368 aa, Archaeoglobus fulgidus DSM 4304; identical to SEQ ID NO: 38478

SEQ ID NO: 75815 - DNA, 1131 bp, Thermoplasma volcanium GSS1; identical to SEQ ID NO: 38479
  CDS (1)..(1131): transl_table=11

SEQ ID NO: 75816 - protein, 376 aa, Thermoplasma volcanium GSS1; identical to SEQ ID NO: 38480

SEQ ID NO: 75817 - DNA, 1506 bp, Arabidopsis thaliana; identical to SEQ ID NO: 38481
  CDS (1)..(1506)

SEQ ID NO: 75818 - protein, 501 aa, Arabidopsis thaliana; identical to SEQ ID NO: 38482

SEQ ID NO: 75819 - DNA, 1833 bp, Arabidopsis thaliana; identical to SEQ ID NO: 38483
  CDS (1)..(1833)

SEQ ID NO: 75820 - protein, 610 aa, Arabidopsis thaliana; identical to SEQ ID NO: 38484

SEQ ID NO: 75821 - DNA, 1851 bp, Arabidopsis thaliana; identical to SEQ ID NO: 38485
  CDS (1)..(1851)

SEQ ID NO: 75822 - protein, 616 aa, Arabidopsis thaliana [sequence omitted]

SEQ ID NO: 75823 - DNA, 1497 bp, Arabidopsis thaliana; identical to SEQ ID NO: 38487
  CDS (1)..(1497)

SEQ ID NO: 75824 - protein, 498 aa, Arabidopsis thaliana; identical to SEQ ID NO: 38488

SEQ ID NO: 75825 - DNA, 2370 bp, Arabidopsis thaliana; identical to SEQ ID NO: 38489
  CDS (1)..(2370)

SEQ ID NO: 75826 - protein, 789 aa, Arabidopsis thaliana; identical to SEQ ID NO: 38490

SEQ ID NO: 75827 - DNA, 2142 bp, Arabidopsis thaliana; identical to SEQ ID NO: 38491
  CDS (1)..(2142)

SEQ ID NO: 75828 - protein, 713 aa, Arabidopsis thaliana; identical to SEQ ID NO: 38492

SEQ ID NO: 75829 - DNA, 1479 bp, Helicobacter pylori 26695; identical to SEQ ID NO: 38493
  CDS (1)..(1479): transl_table=11

SEQ ID NO: 75830 - protein, 492 aa, Helicobacter pylori 26695; identical to SEQ ID NO: 38494

SEQ ID NO: 75831 - DNA, 1950 bp, Treponema pallidum subsp. pallidum str. Nichols; identical to SEQ ID NO: 38495
  CDS (1)..(1950): transl_table=11

SEQ ID NO: 75832 - protein, 649 aa, Treponema pallidum subsp. pallidum str. Nichols; identical to SEQ ID NO: 38496

SEQ ID NO: 75833 - DNA, 1476 bp, Helicobacter pylori J99; identical to SEQ ID NO: 38497
  CDS (1)..(1476): transl_table=11

SEQ ID NO: 75834 - protein, 491 aa, Helicobacter pylori J99; identical to SEQ ID NO: 38498

SEQ ID NO: 75835 - DNA, 1833 bp, Pasteurella multocida subsp. multocida str. Pm70; identical to SEQ ID NO: 38499
  CDS (1)..(1833): transl_table=11

SEQ ID NO: 75836 - protein, 610 aa, Pasteurella multocida subsp. multocida str. Pm70; identical to SEQ ID NO: 38500

SEQ ID NO: 75837 - DNA, 1389 bp, Neisseria meningitidis MC58; identical to SEQ ID NO: 38501
  CDS (1)..(1389): transl_table=11

SEQ ID NO: 75838 - protein, 462 aa, Neisseria meningitidis MC58; identical to SEQ ID NO: 38502

SEQ ID NO: 75839 - DNA, 1278 bp, Methanothermobacter thermautotrophicus str. Delta H; identical to SEQ ID NO: 38503
  CDS (1)..(1278): transl_table=11

SEQ ID NO: 75840 - protein, 425 aa, Methanothermobacter thermautotrophicus str. Delta H; identical to SEQ ID NO: 38504

SEQ ID NO: 75841 - DNA, 1446 bp, Clostridium acetobutylicum ATCC 824; identical to SEQ ID NO: 38505
  CDS (1)..(1446): transl_table=11

SEQ ID NO: 75842 - protein, 481 aa, Clostridium acetobutylicum ATCC 824; identical to SEQ ID NO: 38506

SEQ ID NO: 75843 - DNA, 1167 bp, Thermoplasma acidophilum DSM 1728; identical to SEQ ID NO: 38507
  CDS (1)..(1167): transl_table=11

SEQ ID NO: 75844 - protein, 388 aa, Thermoplasma acidophilum DSM 1728; identical to SEQ ID NO: 38508

SEQ ID NO: 75845 - DNA, 1941 bp, Escherichia coli K12; identical to SEQ ID NO: 38509
  CDS (1)..(1941): transl_table=11

SEQ ID NO: 75846 - protein, 646 aa, Escherichia coli K12; identical to SEQ ID NO: 38510

SEQ ID NO: 75847 - DNA, 1554 bp, Caulobacter crescentus CB15; identical to SEQ ID NO: 38511
  CDS (1)..(1554): transl_table=11

SEQ ID NO: 75848 - protein, 517 aa, Caulobacter crescentus CB15; identical to SEQ ID NO: 38512

SEQ ID NO: 75849 - DNA, 1512 bp, Sinorhizobium meliloti 1021; identical to SEQ ID NO: 38513
  CDS (1)..(1512): transl_table=11

SEQ ID NO: 75850 - protein, 503 aa, Sinorhizobium meliloti 1021; identical to SEQ ID NO: 38514

SEQ ID NO: 75851 - DNA, 1479 bp, Synechocystis sp. PCC 6803; identical to SEQ ID NO: 38515
  CDS (1)..(1479): transl_table=11

SEQ ID NO: 75852 - protein, 492 aa, Synechocystis sp. PCC 6803; identical to SEQ ID NO: 38516

SEQ ID NO: 75853 - DNA, 1374 bp, Salmonella typhimurium LT2; identical to SEQ ID NO: 38517
  CDS (1)..(1374): transl_table=11

SEQ ID NO: 75854 - protein, 457 aa, Salmonella typhimurium LT2; identical to SEQ ID NO: 38518

SEQ ID NO: 75855 - DNA, 1890 bp, Salmonella typhimurium LT2; identical to SEQ ID NO: 38519
  CDS (1)..(1890): transl_table=11

SEQ ID NO: 75856 - protein, 629 aa, Salmonella typhimurium LT2; identical to SEQ ID NO: 38520

SEQ ID NO: 75857 - DNA, 1563 bp, Listeria monocytogenes EGD-e; identical to SEQ ID NO: 38521
  CDS (1)..(1563): transl_table=11

SEQ ID NO: 75858 - protein, 520 aa, Listeria monocytogenes EGD-e; identical to SEQ ID NO: 38522

SEQ ID NO: 75859 - DNA, 1542 bp, Nostoc sp. PCC 7120; identical to SEQ ID NO: 38523
  CDS (1)..(1542): transl_table=11

SEQ ID NO: 75860 - protein, 513 aa, Nostoc sp. PCC 7120; identical to SEQ ID NO: 38524

SEQ ID NO: 75861 - DNA, 1281 bp, Nostoc sp. PCC 7120; identical to SEQ ID NO: 38525
  CDS (1)..(1281): transl_table=11

SEQ ID NO: 75862 - protein, 426 aa, Nostoc sp. PCC 7120; identical to SEQ ID NO: 38526

SEQ ID NO: 75863 - DNA, 1200 bp, Caenorhabditis elegans; identical to SEQ ID NO: 38527
  CDS (1)..(1200)

SEQ ID NO: 75864 - protein, 399 aa, Caenorhabditis elegans; identical to SEQ ID NO: 38528

SEQ ID NO: 75865 - DNA, 1398 bp, Ralstonia solanacearum GMI1000; identical to SEQ ID NO: 38529
  CDS (1)..(1398): transl_table=11

SEQ ID NO: 75866 - protein, 465 aa, Ralstonia solanacearum GMI1000; identical to SEQ ID NO: 38530

SEQ ID NO: 75867 - DNA, 1509 bp, Agrobacterium tumefaciens str. C58; identical to SEQ ID NO: 38531
  CDS (1)..(1509): transl_table=11

SEQ ID NO: 75868 - protein, 502 aa, Agrobacterium tumefaciens str. C58; identical to SEQ ID NO: 38532

SEQ ID NO: 75869 - DNA, 1608 bp, Brucella melitensis 16M; identical to SEQ ID NO: 38533
  CDS (1)..(1608): transl_table=11

SEQ ID NO: 75870 - protein, 535 aa, Brucella melitensis 16M; identical to SEQ ID NO: 38534

SEQ ID NO: 75871 - DNA, 1437 bp, Clostridium perfringens str. 13; identical to SEQ ID NO: 38535
  CDS (1)..(1437): transl_table=11

SEQ ID NO: 75872 - protein, 478 aa, Clostridium perfringens str. 13; identical to SEQ ID NO: 38536

SEQ ID NO: 75873 - DNA, 1587 bp, Clostridium perfringens str. 13; identical to SEQ ID NO: 38537
  CDS (1)..(1587): transl_table=11

SEQ ID NO: 75874 - protein, 528 aa, Clostridium perfringens str. 13; identical to SEQ ID NO: 38538

SEQ ID NO: 75875 - DNA, 1989 bp, Schizosaccharomyces pombe; identical to SEQ ID NO: 38539
  CDS (1)..(1989)

SEQ ID NO: 75876 - protein, 662 aa, Schizosaccharomyces pombe; identical to SEQ ID NO: 38540

SEQ ID NO: 75877 - DNA, 1398 bp, Schizosaccharomyces pombe; identical to SEQ ID NO: 38541
  CDS (1)..(1398)

SEQ ID NO: 75878 - protein, 465 aa, Schizosaccharomyces pombe; identical to SEQ ID NO: 38542

SEQ ID NO: 75879 - DNA, 1362 bp, Schizosaccharomyces pombe; identical to SEQ ID NO: 38543
  CDS (1)..(1362)

SEQ ID NO: 75880 - protein, 453 aa, Schizosaccharomyces pombe; identical to SEQ ID NO: 38544

SEQ ID NO: 75881 - DNA, 1275 bp, Corynebacterium glutamicum ATCC 13032; identical to SEQ ID NO: 38545
  CDS (1)..(1275): transl_table=11

SEQ ID NO: 75882 - protein, 424 aa, Corynebacterium glutamicum ATCC 13032; identical to SEQ ID NO: 38546

SEQ ID NO: 75883 - DNA, 2199 bp, Corynebacterium glutamicum ATCC 13032; identical to SEQ ID NO: 38547
  CDS (1)..(2199): transl_table=11

SEQ ID NO: 75884 - protein, 732 aa, Corynebacterium glutamicum ATCC 13032; identical to SEQ ID NO: 38548

SEQ ID NO: 75885 - DNA, 1668 bp, Methanosarcina acetivorans C2A; identical to SEQ ID NO: 38549
  CDS (1)..(1668): transl_table=11

SEQ ID NO: 75886 - protein, 555 aa, Methanosarcina acetivorans C2A; identical to SEQ ID NO: 38550

SEQ ID NO: 75887 - DNA, 1764 bp, Methanosarcina mazei Go1; identical to SEQ ID NO: 38551
  CDS (1)..(1764): transl_table=11

SEQ ID NO: 75888 - protein, 587 aa, Methanosarcina mazei Go1; identical to SEQ ID NO: 38552

SEQ ID NO: 75889 - DNA, 1290 bp, Methanosarcina mazei Go1; identical to SEQ ID NO: 38553
  CDS (1)..(1290): transl_table=11

SEQ ID NO: 75890 - protein, 429 aa, Methanosarcina mazei Go1; identical to SEQ ID NO: 38554

SEQ ID NO: 75891 - DNA, 1293 bp, Xanthomonas campestris pv. campestris str. ATCC 33913; identical to SEQ ID NO: 38555
  CDS (1)..(1293): transl_table=11

SEQ ID NO: 75892 - protein, 430 aa, Xanthomonas campestris pv. campestris str. ATCC 33913; identical to SEQ ID NO: 38556

SEQ ID NO: 75893 - DNA, 1377 bp, Xanthomonas campestris pv. campestris str. ATCC 33913; identical to SEQ ID NO: 38557
  CDS (1)..(1377): transl_table=11

SEQ ID NO: 75894 - protein, 458 aa, Xanthomonas campestris pv. campestris str. ATCC 33913; identical to SEQ ID NO: 38558

SEQ ID NO: 75895 - DNA, 1293 bp, Xanthomonas axonopodis pv. citri str. 306; identical to SEQ ID NO: 38559
  CDS (1)..(1293): transl_table=11

SEQ ID NO: 75896 - protein, 430 aa, Xanthomonas axonopodis pv. citri str. 306; identical to SEQ ID NO: 38560

SEQ ID NO: 75897 - DNA, 1974 bp, Chlorobium tepidum TLS; identical to SEQ ID NO: 38561
  CDS (1)..(1974): transl_table=11

SEQ ID NO: 75898 - protein, 657 aa, Chlorobium tepidum TLS; identical to SEQ ID NO: 38562

SEQ ID NO: 75899 - DNA, 1245 bp, Chlorobium tepidum TLS; identical to SEQ ID NO: 38563
  CDS (1)..(1245): transl_table=11

SEQ ID NO: 75900 - protein, 414 aa, Chlorobium tepidum TLS; identical to SEQ ID NO: 38564

SEQ ID NO: 75901 - DNA, 1488 bp, Oceanobacillus iheyensis HTE831; identical to SEQ ID NO: 38565
  CDS (1)..(1488): transl_table=11

SEQ ID NO: 75902 - protein, 495 aa, Oceanobacillus iheyensis HTE831; identical to SEQ ID NO: 38566

SEQ ID NO: 75903 - DNA, 1566 bp, Leptospira interrogans serovar Lai str. 56601; identical to SEQ ID NO: 38567
  CDS (1)..(1566): transl_table=11

SEQ ID NO: 75904 - protein, 521 aa, Leptospira interrogans serovar Lai str. 56601; identical to SEQ ID NO: 38568

SEQ ID NO: 75905 - DNA, 1377 bp, Shewanella oneidensis MR-1; identical to SEQ ID NO: 38569
  CDS (1)..(1377): transl_table=11

SEQ ID NO: 75906 - protein, 458 aa, Shewanella oneidensis MR-1; identical to SEQ ID NO: 38570

SEQ ID NO: 75907 - DNA, 1302 bp, Shewanella oneidensis MR-1; identical to SEQ ID NO: 38571
  CDS (1)..(1302): transl_table=11

SEQ ID NO: 75908 - protein, 433 aa, Shewanella oneidensis MR-1; identical to SEQ ID NO: 38572

SEQ ID NO: 75909 - DNA, 1284 bp, Shewanella oneidensis MR-1; identical to SEQ ID NO: 38573
  CDS (1)..(1284): transl_table=11

SEQ ID NO: 75910 - protein, 427 aa, Shewanella oneidensis MR-1; identical to SEQ ID NO: 38574

SEQ ID NO: 75911 - DNA, 1230 bp, Shewanella oneidensis MR-1; identical to SEQ ID NO: 38575
  CDS (1)..(1230): transl_table=11

SEQ ID NO: 75912 - protein, 409 aa, Shewanella oneidensis MR-1; identical to SEQ ID NO: 38576

SEQ ID NO: 75913 - DNA, 1608 bp, Shewanella oneidensis MR-1; identical to SEQ ID NO: 38577
  CDS (1)..(1608): transl_table=11

SEQ ID NO: 75914 - protein, 535 aa, Shewanella oneidensis MR-1; identical to SEQ ID NO: 38578

SEQ ID NO: 75915 - DNA, 1872 bp, Shewanella oneidensis MR-1; identical to SEQ ID NO: 38579
  CDS (1)..(1872): transl_table=11

SEQ ID NO: 75916 - protein, 623 aa, Shewanella oneidensis MR-1; identical to SEQ ID NO: 38580

SEQ ID NO: 75917 - DNA, 1554 bp, Streptococcus mutans UA159; identical to SEQ ID NO: 38581
  CDS (1)..(1554): transl_table=11

SEQ ID NO: 75918 - protein, 517 aa, Streptococcus mutans UA159; identical to SEQ ID NO: 38582

SEQ ID NO: 75919 - DNA, 1446 bp, Clostridium tetani E88; identical to SEQ ID NO: 38583
  CDS (1)..(1446): transl_table=11

SEQ ID NO: 75920 - protein, 481 aa, Clostridium tetani E88; identical to SEQ ID NO: 38584

SEQ ID NO: 75921 - DNA, 1575 bp, Clostridium tetani E88; identical to SEQ ID NO: 38585
  CDS (1)..(1575): transl_table=11

SEQ ID NO: 75922 - protein, 524 aa, Clostridium tetani E88; identical to SEQ ID NO: 38586

SEQ ID NO: 75923 - DNA, 1113 bp, Clostridium tetani E88; identical to SEQ ID NO: 38587
  CDS (1)..(1113): transl_table=11

SEQ ID NO: 75924 - protein, 370 aa, Clostridium tetani E88; identical to SEQ ID NO: 38588

SEQ ID NO: 75925 - DNA, 1587 bp, Lactobacillus plantarum WCFS1; identical to SEQ ID NO: 38589
  CDS (1)..(1587): transl_table=11

SEQ ID NO: 75926 - protein, 528 aa, Lactobacillus plantarum WCFS1; identical to SEQ ID NO: 38590

SEQ ID NO: 75927 - DNA, 1380 bp, Vibrio parahaemolyticus RIMD 2210633; identical to SEQ ID NO: 38591
  CDS (1)..(1380): transl_table=11

SEQ ID NO: 75928 - protein, 459 aa, Vibrio parahaemolyticus RIMD 2210633; identical to SEQ ID NO: 38592

SEQ ID NO: 75929 - DNA, 1932 bp, Vibrio parahaemolyticus RIMD 2210633; identical to SEQ ID NO: 38593
  CDS (1)..(1932): transl_table=11

SEQ ID NO: 75930 - protein, 643 aa, Vibrio parahaemolyticus RIMD 2210633; identical to SEQ ID NO: 38594

SEQ ID NO: 75931 - DNA, 1125 bp, Bacteroides thetaiotaomicron VPI-5482; identical to SEQ ID NO: 38595
  CDS (1)..(1125): transl_table=11

SEQ ID NO: 75932 - protein, 374 aa, Bacteroides thetaiotaomicron VPI-5482; identical to SEQ ID NO: 38596

SEQ ID NO: 75933 - DNA, 1944 bp, Bacteroides thetaiotaomicron VPI-5482; identical to SEQ ID NO: 38597
  CDS (1)..(1944): transl_table=11

SEQ ID NO: 75934 - protein, 647 aa, Bacteroides thetaiotaomicron VPI-5482; identical to SEQ ID NO: 38598

SEQ ID NO: 75935 - DNA, 1611 bp, Enterococcus faecalis V583; identical to SEQ ID NO: 38599
  CDS (1)..(1611): transl_table=11

SEQ ID NO: 75936 - protein, 536 aa, Enterococcus faecalis V583; identical to SEQ ID NO: 38600

SEQ ID NO: 75937 - DNA, 1236 bp, Coxiella burnetii RSA 493; identical to SEQ ID NO: 38601
  CDS (1)..(1236): transl_table=11

SEQ ID NO: 75938 - protein, 411 aa, Coxiella burnetii RSA 493; identical to SEQ ID NO: 38602

SEQ ID NO: 75939 - DNA, 1545 bp, Bacillus cereus ATCC 14579; identical to SEQ ID NO: 38603
  CDS (1)..(1545): transl_table=11

SEQ ID NO: 75940 - protein, 514 aa, Bacillus cereus ATCC 14579; identical to SEQ ID NO: 38604

SEQ ID NO: 75941 - DNA, 1377 bp, Bacillus cereus ATCC 14579; identical to SEQ ID NO: 38605
  CDS (1)..(1377): transl_table=11

SEQ ID NO: 75942 - protein, 458 aa, Bacillus cereus ATCC 14579; identical to SEQ ID NO: 38606

SEQ ID NO: 75943 - DNA, 1446 bp, Bacillus cereus ATCC 14579; identical to SEQ ID NO: 38607
  CDS (1)..(1446): transl_table=11

SEQ ID NO: 75944 - protein, 481 aa, Bacillus cereus ATCC 14579; identical to SEQ ID NO: 38608

SEQ ID NO: 75945 - DNA, 1374 bp, Nitrosomonas europaea ATCC 19718; identical to SEQ ID NO: 38609
  CDS (1)..(1374): transl_table=11

SEQ ID NO: 75946 - protein, 457 aa, Nitrosomonas europaea ATCC 19718; identical to SEQ ID NO: 38610

SEQ ID NO: 75947 - DNA, 1860 bp, Arabidopsis thaliana; identical to SEQ ID NO: 38611
  CDS (1)..(1860)

SEQ ID NO: 75948 - protein, 619 aa, Arabidopsis thaliana; identical to SEQ ID NO: 38612

SEQ ID NO: 75949 - DNA, 1593 bp, Helicobacter hepaticus ATCC 51449; identical to SEQ ID NO: 38613
  CDS (1)..(1593): transl_table=11

SEQ ID NO: 75950 - protein, 530 aa, Helicobacter hepaticus ATCC 51449; identical to SEQ ID NO: 38614

SEQ ID NO: 75951 - DNA, 1359 bp, Rhodopirellula baltica SH 1; identical to SEQ ID NO: 38615
  CDS (1)..(1359): transl_table=11

SEQ ID NO: 75952 - protein, 452 aa, Rhodopirellula baltica SH 1; identical to SEQ ID NO: 38616

SEQ ID NO: 75953 - DNA, 2796 bp, Rhodopirellula baltica SH 1; identical to SEQ ID NO: 38617
  CDS (1)..(2796): transl_table=11

SEQ ID NO: 75954 - protein, 931 aa, Rhodopirellula baltica SH 1; identical to SEQ ID NO: 38618

SEQ ID NO: 75955 - DNA, 1752 bp, Wigglesworthia glossinidia endosymbiont of Glossina brevipalpis; identical to SEQ ID NO: 38619
  CDS (1)..(1752): transl_table=11

SEQ ID NO: 75956 - protein, 583 aa, Wigglesworthia glossinidia endosymbiont of Glossina brevipalpis; identical to SEQ ID NO: 38620

SEQ ID NO: 75957 - DNA, 1821 bp, Haemophilus ducreyi 35000HP; identical to SEQ ID NO: 38621
  CDS (1)..(1821): transl_table=11

SEQ ID NO: 75958 - protein, 606 aa, Haemophilus ducreyi 35000HP; identical to SEQ ID NO: 38622

SEQ ID NO: 75959 - DNA, 1812 bp, Prochlorococcus marinus subsp. marinus str. CCMP1375; identical to SEQ ID NO: 38623
  CDS (1)..(1812): transl_table=11

SEQ ID NO: 75960 - protein, 603 aa, Prochlorococcus marinus subsp. marinus str. CCMP1375; identical to SEQ ID NO: 38624

SEQ ID NO: 75961 - DNA, 1464 bp, Candidatus Blochmannia floridanus; identical to SEQ ID NO: 38625
  CDS (1)..(1464): transl_table=11

SEQ ID NO: 75962 - protein, 487 aa, Candidatus Blochmannia floridanus; identical to SEQ ID NO: 38626

SEQ ID NO: 75963 - DNA, 1725 bp, Bordetella pertussis Tohama I; identical to SEQ ID NO: 38627
  CDS (1)..(1725): transl_table=11

SEQ ID NO: 75964 - protein, 574 aa, Bordetella pertussis Tohama I; identical to SEQ ID NO: 38628

SEQ ID NO: 75965 - DNA, 1389 bp, Bordetella bronchiseptica RB50; identical to SEQ ID NO: 38629
  CDS (1)..(1389): transl_table=11

SEQ ID NO: 75966 - protein, 462 aa, Bordetella bronchiseptica RB50; identical to SEQ ID NO: 38630

SEQ ID NO: 75967 - DNA, 1779 bp, Prochlorococcus marinus subsp. pastoris str. CCMP1986; identical to SEQ ID NO: 38631
  CDS (1)..(1779): transl_table=11

SEQ ID NO: 75968 - protein, 592 aa, Prochlorococcus marinus subsp. pastoris str. CCMP1986; identical to SEQ ID NO: 38632

SEQ ID NO: 75969 - DNA, 1797 bp, Synechococcus sp. WH 8102; identical to SEQ ID NO: 38633
  CDS (1)..(1797): transl_table=11

SEQ ID NO: 75970 - protein, 598 aa, Synechococcus sp. WH 8102; identical to SEQ ID NO: 38634

SEQ ID NO: 75971 - DNA, 1419 bp, Chromobacterium violaceum ATCC 12472; identical to SEQ ID NO: 38635
  CDS (1)..(1419): transl_table=11

SEQ ID NO: 75972 - protein, 472 aa, Chromobacterium violaceum ATCC 12472; identical to SEQ ID NO: 38636

SEQ ID NO: 75973 - DNA, 1326 bp, Chromobacterium violaceum ATCC 12472; identical to SEQ ID NO: 38637
  CDS (1)..(1326): transl_table=11

SEQ ID NO: 75974 - protein, 441 aa, Chromobacterium violaceum ATCC 12472; identical to SEQ ID NO: 38638

SEQ ID NO: 75975 - DNA, 1263 bp, Chromobacterium violaceum ATCC 12472; identical to SEQ ID NO: 38639
  CDS (1)..(1263): transl_table=11

SEQ ID NO: 75976 - protein, 420 aa, Chromobacterium violaceum ATCC 12472; identical to SEQ ID NO: 38640

SEQ ID NO: 75977 - DNA, 1383 bp, Chromobacterium violaceum ATCC 12472; identical to SEQ ID NO: 38641
  CDS (1)..(1383): transl_table=11

SEQ ID NO: 75978 - protein, 460 aa, Chromobacterium violaceum ATCC 12472; identical to SEQ ID NO: 38642

SEQ ID NO: 75979 - DNA, 1320 bp, Chromobacterium violaceum ATCC 12472; identical to SEQ ID NO: 38643
  CDS (1)..(1320): transl_table=11

SEQ ID NO: 75980 - protein, 439 aa, Chromobacterium violaceum ATCC 12472; identical to SEQ ID NO: 38644

SEQ ID NO: 75981 - DNA, 1815 bp, Porphyromonas gingivalis W83; identical to SEQ ID NO: 38645
  CDS (1)..(1815): transl_table=11

SEQ ID NO: 75982 - protein, 604 aa, Porphyromonas gingivalis W83; identical to SEQ ID NO: 38646

SEQ ID NO: 75983 - DNA, 1284 bp, Porphyromonas gingivalis W83; identical to SEQ ID NO: 38647
  CDS (1)..(1284): transl_table=11

SEQ ID NO: 75984 - protein, 427 aa, Porphyromonas gingivalis W83; identical to SEQ ID NO: 38648

SEQ ID NO: 75985 - DNA, 1518 bp, Wolinella succinogenes DSM 1740; identical to SEQ ID NO: 38649
  CDS (1)..(1518): transl_table=11

SEQ ID NO: 75986 - protein, 505 aa, Wolinella succinogenes DSM 1740; identical to SEQ ID NO: 38650

SEQ ID NO: 75987 - DNA, 1215 bp, Oryza sativa (japonica cultivar-group); identical to SEQ ID NO: 38651
  CDS (1)..(1215)

SEQ ID NO: 75988 - protein, 404 aa, Oryza sativa (japonica cultivar-group); identical to SEQ ID NO: 38652

SEQ ID NO: 75989 - DNA, 2277 bp, Oryza sativa (japonica cultivar-group); identical to SEQ ID NO: 38653
  CDS (1)..(2277)

SEQ ID NO: 75990 - protein, 758 aa, Oryza sativa (japonica cultivar-group); identical to SEQ ID NO: 38654

SEQ ID NO: 75991 - DNA, 1485 bp, Oryza sativa (japonica cultivar-group); identical to SEQ ID NO: 38655
  CDS (1)..(1485)

SEQ ID NO: 75992 - protein, 494 aa, Oryza sativa (japonica cultivar-group); identical to SEQ ID NO: 38656

SEQ ID NO: 75993 - DNA, 2676 bp, Oryza sativa (japonica cultivar-group); identical to SEQ ID NO: 38657
  CDS (1)..(2676)

SEQ ID NO: 75994 - protein, 891 aa, Oryza sativa (japonica cultivar-group); identical to SEQ ID NO: 38658

SEQ ID NO: 75995 - DNA, 1155 bp, Gloeobacter violaceus PCC 7421; identical to SEQ ID NO: 38659
  CDS (1)..(1155): transl_table=11

SEQ ID NO: 75996 - protein, 384 aa, Gloeobacter violaceus PCC 7421; identical to SEQ ID NO: 38660

SEQ ID NO: 75997 - DNA, 1314 bp, Gloeobacter violaceus PCC 7421; identical to SEQ ID NO: 38661
  CDS (1)..(1314): transl_table=11

SEQ ID NO: 75998 - protein, 437 aa, Gloeobacter violaceus PCC 7421; identical to SEQ ID NO: 38662

SEQ ID NO: 75999 - DNA, 1305 bp, Photorhabdus luminescens subsp. laumondii TTO1; identical to SEQ ID NO: 38663
  CDS (1)..(1305): transl_table=11

SEQ ID NO: 76000 - protein, 434 aa, Photorhabdus luminescens subsp. laumondii TTO1; identical to SEQ ID NO: 38664

SEQ ID NO: 76001 - DNA, 1935 bp, Photorhabdus luminescens subsp. laumondii TTO1; identical to SEQ ID NO: 38665
  CDS (1)..(1935): transl_table=11

SEQ ID NO: 76002 - protein, 644 aa, Photorhabdus luminescens subsp. laumondii TTO1; identical to SEQ ID NO: 38666

SEQ ID NO: 76003 - DNA, 1380 bp, Vibrio vulnificus YJ016; identical to SEQ ID NO: 38667
  CDS (1)..(1380): transl_table=11

SEQ ID NO: 76004 - protein, 459 aa, Vibrio vulnificus YJ016; identical to SEQ ID NO: 38668

SEQ ID NO: 76005 - DNA, 1407 bp, Danio rerio; identical to SEQ ID NO: 38669
  CDS (1)..(1407)

SEQ ID NO: 76006 - protein, 468 aa, Danio rerio; identical to SEQ ID NO: 38670

SEQ ID NO: 76007 - DNA, 1425 bp, Rhodopseudomonas palustris CGA009; identical to SEQ ID NO: 38671
  CDS (1)..(1425): transl_table=11

SEQ ID NO: 76008 - protein, 474 aa, Rhodopseudomonas palustris CGA009; identical to SEQ ID NO: 38672

SEQ ID NO: 76009 - DNA, 2085 bp, Rhodopseudomonas palustris CGA009; identical to SEQ ID NO: 38673
  CDS (1)..(2085): transl_table=11

SEQ ID NO: 76010 - protein, 694 aa, Rhodopseudomonas palustris CGA009; identical to SEQ ID NO: 38674

SEQ ID NO: 76011 - DNA, 1659 bp, Onion yellows phytoplasma OY-M; identical to SEQ ID NO: 38675
  CDS (1)..(1659): transl_table=11

SEQ ID NO: 76012 - protein, 552 aa, Onion yellows phytoplasma OY-M; identical to SEQ ID NO: 38676

SEQ ID NO: 76013 - DNA, 1383 bp, Geobacter sulfurreducens PCA; identical to SEQ ID NO: 38677
  CDS (1)..(1383): transl_table=11

SEQ ID NO: 76014 - protein, 460 aa, Geobacter sulfurreducens PCA; identical to SEQ ID NO: 38678

SEQ ID NO: 76015 - DNA, 1353 bp, Geobacter sulfurreducens PCA; identical to SEQ ID NO: 38679
  CDS (1)..(1353): transl_table=11

SEQ ID NO: 76016 - protein, 450 aa, Geobacter sulfurreducens PCA; identical to SEQ ID NO: 38680

SEQ ID NO: 76017 - DNA, 1455 bp, Lactobacillus johnsonii NCC 533; identical to SEQ ID NO: 38681
  CDS (1)..(1455): transl_table=11

SEQ ID NO: 76018 - protein, 484 aa, Lactobacillus johnsonii NCC 533; identical to SEQ ID NO: 38682

SEQ ID NO: 76019 - DNA, 1227 bp, Wolbachia endosymbiont of Drosophila melanogaster; identical to SEQ ID NO: 38683
  CDS (1)..(1227): transl_table=11

SEQ ID NO: 76020 - protein, 408 aa, Wolbachia endosymbiont of Drosophila melanogaster; identical to SEQ ID NO: 38684

SEQ ID NO: 76021 - DNA, 1518 bp, Bdellovibrio bacteriovorus HD100; identical to SEQ ID NO: 38685
  CDS (1)..(1518): transl_table=11

SEQ ID NO: 76022 - protein, 505 aa, Bdellovibrio bacteriovorus HD100; identical to SEQ ID NO: 38686

SEQ ID NO: 76023 - DNA, 1518 bp, Bdellovibrio bacteriovorus HD100; identical to SEQ ID NO: 38687
  CDS (1)..(1518): transl_table=11

SEQ ID NO: 76024 - protein, 505 aa, Bdellovibrio bacteriovorus HD100; identical to SEQ ID NO: 38688

SEQ ID NO: 76025 - DNA, 1971 bp, Bdellovibrio bacteriovorus HD100; identical to SEQ ID NO: 38689
  CDS (1)..(1971): transl_table=11

SEQ ID NO: 76026 - protein, 656 aa, Bdellovibrio bacteriovorus HD100; identical to SEQ ID NO: 38690

SEQ ID NO: 76027 - DNA, 1650 bp, Bdellovibrio bacteriovorus HD100; identical to SEQ ID NO: 38691
  CDS (1)..(1650): transl_table=11

SEQ ID NO: 76028 - protein, 549 aa, Bdellovibrio bacteriovorus HD100; identical to SEQ ID NO: 38692

SEQ ID NO: 76029 - DNA, 1776 bp, Arabidopsis thaliana; identical to SEQ ID NO: 38693
  CDS (1)..(1776)

SEQ ID NO: 76030 - protein, 591 aa, Arabidopsis thaliana; identical to SEQ ID NO: 38694

SEQ ID NO: 76031 - DNA, 1446 bp, Bacillus cereus ATCC 10987; identical to SEQ ID NO: 38695
  CDS (1)..(1446): transl_table=11

SEQ ID NO: 76032 - protein, 481 aa, Bacillus cereus ATCC 10987; identical to SEQ ID NO: 38696

SEQ ID NO: 76033 - DNA, 2205 bp, Eremothecium gossypii; identical to SEQ ID NO: 38697
  CDS (1)..(2205)

SEQ ID NO: 76034 - protein, 734 aa, Eremothecium gossypii; identical to SEQ ID NO: 38698

SEQ ID NO: 76035 - DNA, 1197 bp, Eremothecium gossypii; identical to SEQ ID NO: 38699
  CDS (1)..(1197)

SEQ ID NO: 76036 - protein, 398 aa, Eremothecium gossypii; identical to SEQ ID NO: 38700

SEQ ID NO: 76037 - DNA, 1617 bp, Methanococcus maripaludis S2; identical to SEQ ID NO: 38701
  CDS (1)..(1617): transl_table=11

SEQ ID NO: 76038 - protein, 538 aa, Methanococcus maripaludis S2; identical to SEQ ID NO: 38702

SEQ ID NO: 76039 - DNA, 2100 bp, Xenopus tropicalis; identical to SEQ ID NO: 38703
  CDS (1)..(2100)

SEQ ID NO: 76040 - protein, 699 aa, Xenopus tropicalis; identical to SEQ ID NO: 38704

SEQ ID NO: 76041 - DNA, 1440 bp, Xenopus tropicalis; identical to SEQ ID NO: 38705
  CDS (1)..(1440)

SEQ ID NO: 76042 - protein, 479 aa, Xenopus tropicalis; identical to SEQ ID NO: 38706

SEQ ID NO: 76043 - DNA, 1809 bp, Anopheles gambiae str. PEST; identical to SEQ ID NO: 38707
  CDS (1)..(1809)

SEQ ID NO: 76044 - protein, 602 aa, Anopheles gambiae str. PEST; identical to SEQ ID NO: 38708

SEQ ID NO: 76045 - DNA, 1548 bp, Neurospora crassa; identical to SEQ ID NO: 38709
  CDS (1)..(1548)

SEQ ID NO: 76046 - protein, 515 aa, Neurospora crassa; identical to SEQ ID NO: 38710

SEQ ID NO: 76047 - DNA, 1203 bp, Neurospora crassa; identical to SEQ ID NO: 38711
  CDS (1)..(1203)

SEQ ID NO: 76048 - protein, 400 aa, Neurospora crassa; identical to SEQ ID NO: 38712

SEQ ID NO: 76049 - DNA, 1278 bp, Neurospora crassa; identical to SEQ ID NO: 38713
  CDS (1)..(1278)

SEQ ID NO: 76050 - protein, 425 aa, Neurospora crassa; identical to SEQ ID NO: 38714

SEQ ID NO: 76051 - DNA, 1278 bp, Magnaporthe grisea 70-15; identical to SEQ ID NO: 38715
  CDS (1)..(1278)

SEQ ID NO: 76052 - protein, 425 aa, Magnaporthe grisea 70-15; identical to SEQ ID NO: 38716

SEQ ID NO: 76053 - DNA, 2025 bp, Magnaporthe grisea 70-15; identical to SEQ ID NO: 38717
  CDS (1)..(2025)

SEQ ID NO: 76054 - protein, 674 aa, Magnaporthe grisea 70-15; identical to SEQ ID NO: 38718

SEQ ID NO: 76055 - DNA, 1746 bp, Gibberella zeae PH-1; identical to SEQ ID NO: 38719
  CDS (1)..(1746)

SEQ ID NO: 76056 - protein, 581 aa, Gibberella zeae PH-1; identical to SEQ ID NO: 38720

SEQ ID NO: 76057 - DNA, 1461 bp, Gibberella zeae PH-1; identical to SEQ ID NO: 38721
  CDS (1)..(1461)

SEQ ID NO: 76058 - protein, 486 aa, Gibberella zeae PH-1; identical to SEQ ID NO: 38722

SEQ ID NO: 76059 - DNA, 1206 bp, Gibberella zeae PH-1; identical to SEQ ID NO: 38723
  CDS (1)..(1206)

SEQ ID NO: 76060 - protein, 401 aa, Gibberella zeae PH-1; identical to SEQ ID NO: 38724

SEQ ID NO: 76061 - DNA, 1875 bp, Apis mellifera; identical to SEQ ID NO: 38725
  CDS (1)..(1875)

SEQ ID NO: 76062 - protein, 624 aa, Apis mellifera; identical to SEQ ID NO: 38726

SEQ ID NO: 76063 - DNA, 1656 bp, Ustilago maydis 521; identical to SEQ ID NO: 38727
  CDS (1)..(1656)

SEQ ID NO: 76064 - protein, 551 aa, Ustilago maydis 521; identical to SEQ ID NO: 38728

SEQ ID NO: 76065 - DNA, 1194 bp, Ustilago maydis 521; identical to SEQ ID NO: 38729
  CDS (1)..(1194)

SEQ ID NO: 76066 - protein, 397 aa, Ustilago maydis 521; identical to SEQ ID NO: 38730

SEQ ID NO: 76067 - DNA, 1266 bp, Aspergillus nidulans FGSC A4; identical to SEQ ID NO: 38731
  CDS (1)..(1266)

SEQ ID NO: 76068 - protein, 421 aa, Aspergillus nidulans FGSC A4; identical to SEQ ID NO: 38732

SEQ ID NO: 76069 - DNA, 1398 bp, Aspergillus nidulans FGSC A4; identical to SEQ ID NO: 38733
  CDS (1)..(1398)

SEQ ID NO: 76070 - protein, 465 aa, Aspergillus nidulans FGSC A4; identical to SEQ ID NO: 38734

SEQ ID NO: 76071 - DNA, 1497 bp, Aspergillus nidulans FGSC A4; identical to SEQ ID NO: 38735
  CDS (1)..(1497)

SEQ ID NO: 76072 - protein, 498 aa, Aspergillus nidulans FGSC A4; identical to SEQ ID NO: 38736

SEQ ID NO: 76073 - DNA, 1200 bp, Aspergillus nidulans FGSC A4; identical to SEQ ID NO: 38737
  CDS (1)..(1200)

SEQ ID NO: 76074 - protein, 399 aa, Aspergillus nidulans FGSC A4; identical to SEQ ID NO: 38738

SEQ ID NO: 76075 - DNA, 2178 bp, Candida glabrata CBS138; identical to SEQ ID NO: 38739
  CDS (1)..(2178)

SEQ ID NO: 76076 - protein, 725 aa, Candida glabrata CBS138; identical to SEQ ID NO: 38740

SEQ ID NO: 76077 - DNA, 1482 bp, Candida glabrata CBS138; identical to SEQ ID NO: 38741
  CDS (1)..(1482)

SEQ ID NO: 76078 - protein, 493 aa, Candida glabrata CBS138; identical to SEQ ID NO: 38742

SEQ ID NO: 76079 - DNA, 1635 bp, Candida glabrata CBS138; identical to SEQ ID NO: 38743
  CDS (1)..(1635)

SEQ ID NO: 76080 - protein, 544 aa, Candida glabrata CBS138; identical to SEQ ID NO: 38744

SEQ ID NO: 76081 - DNA, 1197 bp, Kluyveromyces lactis NRRL Y-1140; identical to SEQ ID NO: 38745
  CDS (1)..(1197)

SEQ ID NO: 76082 - protein, 398 aa, Kluyveromyces lactis NRRL Y-1140; identical to SEQ ID NO: 38746

SEQ ID NO: 76083 - DNA, 1464 bp, Kluyveromyces lactis NRRL Y-1140; identical to SEQ ID NO: 38747
  CDS (1)..(1464)

SEQ ID NO: 76084 - protein, 487 aa, Kluyveromyces lactis NRRL Y-1140; identical to SEQ ID NO: 38748

SEQ ID NO: 76085 - DNA, 2247 bp, Kluyveromyces lactis NRRL Y-1140; identical to SEQ ID NO: 38749
  CDS (1)..(2247)

SEQ ID NO: 76086 - protein, 748 aa, Kluyveromyces lactis NRRL Y-1140; identical to SEQ ID NO: 38750

SEQ ID NO: 76087 - DNA, 1665 bp, Kluyveromyces lactis NRRL Y-1140; identical to SEQ ID NO: 38751
  CDS (1)..(1665)

SEQ ID NO: 76088 - protein, 554 aa, Kluyveromyces lactis NRRL Y-1140; identical to SEQ ID NO: 38752

SEQ ID NO: 76089 - DNA, 1611 bp, Debaryomyces hansenii CBS767; identical to SEQ ID NO: 38753
  CDS (1)..(1611)

SEQ ID NO: 76090 - protein, 536 aa, Debaryomyces hansenii CBS767; identical to SEQ ID NO: 38754

SEQ ID NO: 76091 - DNA, 1917 bp, Oryza sativa (japonica cultivar-group); identical to SEQ ID NO: 38755
  CDS (1)..(1917)

SEQ ID NO: 76092 - protein, 638 aa, Oryza sativa (japonica cultivar-group); identical to SEQ ID NO: 38756

SEQ ID NO: 76093 - DNA, 1443 bp, Yarrowia lipolytica CLIB99; identical to SEQ ID NO: 38757
  CDS (1)..(1443)

SEQ ID NO: 76094 - protein, 480 aa, Yarrowia lipolytica CLIB99; identical to SEQ ID NO: 38758

SEQ ID NO: 76095 - DNA, 1188 bp, Yarrowia lipolytica CLIB99; identical to SEQ ID NO: 38759
  CDS (1)..(1188)

SEQ ID NO: 76096 - protein, 395 aa, Yarrowia lipolytica CLIB99; identical to SEQ ID NO: 38760

SEQ ID NO: 76097 - DNA, 1659 bp, Yarrowia lipolytica CLIB99; identical to SEQ ID NO: 38761
  CDS (1)..(1659)

SEQ ID NO: 76098 - protein, 552 aa, Yarrowia lipolytica CLIB99; identical to SEQ ID NO: 38762

SEQ ID NO: 76099 - DNA, 1194 bp, Yarrowia lipolytica CLIB99; identical to SEQ ID NO: 38763
  CDS (1)..(1194)

SEQ ID NO: 76100 - protein, 397 aa, Yarrowia lipolytica CLIB99; identical to SEQ ID NO: 38764

SEQ ID NO: 76101 - DNA, 2256 bp, Pan troglodytes; identical to SEQ ID NO: 38765
  CDS (1)..(2256)

SEQ ID NO: 76102 - protein, 751 aa, Pan troglodytes; identical to SEQ ID NO: 38766

SEQ ID NO: 76103 - DNA, 2127 bp, Oryza sativa (japonica cultivar-group); identical to SEQ ID NO: 38767
  CDS (1)..(2127)

SEQ ID NO: 76104 - protein, 708 aa, Oryza sativa (japonica cultivar-group); identical to SEQ ID NO: 38768

SEQ ID NO: 76105 - DNA, 2280 bp, Oryza sativa (japonica cultivar-group); identical to SEQ ID NO: 38769
  CDS (1)..(2280)

SEQ ID NO: 76106 - protein, 759 aa, Oryza sativa (japonica cultivar-group); identical to SEQ ID NO: 38770

SEQ ID NO: 76107 - DNA, 1554 bp, Thermus thermophilus HB27; identical to SEQ ID NO: 38771
  CDS (1)..(1554): transl_table=11

SEQ ID NO: 76108 - protein, 517 aa, Thermus thermophilus HB27; identical to SEQ ID NO: 38772

SEQ ID NO: 76109 - DNA, 1548 bp, Parachlamydia sp. UWE25; identical to SEQ ID NO: 38773
  CDS (1)..(1548): transl_table=11

SEQ ID NO: 76110 - protein, 515 aa, Parachlamydia sp. UWE25; identical to SEQ ID NO: 38774

SEQ ID NO: 76111 - DNA, 1734 bp, Desulfovibrio vulgaris subsp. vulgaris str. Hildenborough; identical to SEQ ID NO: 38775
  CDS (1)..(1734): transl_table=11

SEQ ID NO: 76112 - protein, 577 aa, Desulfovibrio vulgaris subsp. vulgaris str. Hildenborough; identical to SEQ ID NO: 38776

SEQ ID NO: 76113 - DNA, 1599 bp, Desulfovibrio vulgaris subsp. vulgaris str. Hildenborough; identical to SEQ ID NO: 38777
  CDS (1)..(1599): transl_table=11

SEQ ID NO: 76114 - protein, 532 aa, Desulfovibrio vulgaris subsp. vulgaris str. Hildenborough; identical to SEQ ID NO: 38778

SEQ ID NO: 76115 - DNA, 1404 bp, Bartonella quintana str. Toulouse; identical to SEQ ID NO: 38779
  CDS (1)..(1404): transl_table=11

SEQ ID NO: 76116 - protein, 467 aa, Bartonella quintana str. Toulouse; identical to SEQ ID NO: 38780

SEQ ID NO: 76117 - DNA, 1521 bp, Staphylococcus aureus subsp. aureus MRSA252; identical to SEQ ID NO: 38781
  CDS (1)..(1521): transl_table=11

SEQ ID NO: 76118 - protein, 506 aa, Staphylococcus aureus subsp. aureus MRSA252; identical to SEQ ID NO: 38782

SEQ ID NO: 76119 - DNA, 1152 bp, Acinetobacter sp. ADP1; identical to SEQ ID NO: 38783
  CDS (1)..(1152): transl_table=11

SEQ ID NO: 76120 - protein, 383 aa, Acinetobacter sp. ADP1; identical to SEQ ID NO: 38784

SEQ ID NO: 76121 - DNA, 1923 bp, Acinetobacter sp. ADP1; identical to SEQ ID NO: 38785
  CDS (1)..(1923): transl_table=11

SEQ ID NO: 76122 - protein, 640 aa, Acinetobacter sp. ADP1; identical to SEQ ID NO: 38786

SEQ ID NO: 76123 - DNA, 1914 bp, Erwinia carotovora subsp. atroseptica SCRI1043; identical to SEQ ID NO: 38787
  CDS (1)..(1914)

SEQ ID NO: 76124 - protein, 637 aa, Erwinia carotovora subsp. atroseptica SCRI1043; identical to SEQ ID NO: 38788

SEQ ID NO: 76125 - DNA, 1383 bp, Erwinia carotovora subsp. atroseptica SCRI1043; identical to SEQ ID NO: 38789
  CDS (1)..(1383)

SEQ ID NO: 76126 - protein, 460 aa, Erwinia carotovora subsp. atroseptica SCRI1043; identical to SEQ ID NO: 38790

SEQ ID NO: 76127 - DNA, 2001 bp, Mesoplasma florum L1; identical to SEQ ID NO: 38791
  CDS (1)..(2001): transl_table=4

SEQ ID NO: 76128 - protein, 666 aa, Mesoplasma florum L1; identical to SEQ ID NO: 38792

SEQ ID NO: 76129 - DNA, 1686 bp, Propionibacterium acnes KPA171202; identical to SEQ ID NO: 38793
  CDS (1)..(1686): transl_table=11

SEQ ID NO: 76130 - protein, 561 aa, Propionibacterium acnes KPA171202; identical to SEQ ID NO: 38794

SEQ ID NO: 76131 - DNA, 1476 bp, Leifsonia xyli subsp. xyli str. CTCB07; identical to SEQ ID NO: 38795
  CDS (1)..(1476): transl_table=11

SEQ ID NO: 76132 - protein, 491 aa, Leifsonia xyli subsp. xyli str. CTCB07; identical to SEQ ID NO: 38796

SEQ ID NO: 76133 - DNA, 1770 bp, Leifsonia xyli subsp. xyli str. CTCB07; identical to SEQ ID NO: 38797
  CDS (1)..(1770): transl_table=11

SEQ ID NO: 76134 - protein, 589 aa, Leifsonia xyli subsp. xyli str. CTCB07; identical to SEQ ID NO: 38798

SEQ ID NO: 76135 - DNA, 1275 bp, Desulfotalea psychrophila LSv54; identical to SEQ ID NO: 38799
  CDS (1)..(1275): transl_table=11

SEQ ID NO: 76136 - protein, 424 aa, Desulfotalea psychrophila LSv54; identical to SEQ ID NO: 38800

SEQ ID NO: 76137 - DNA, 1410 bp, Desulfotalea psychrophila LSv54; identical to SEQ ID NO: 38801
  CDS (1)..(1410): transl_table=11

SEQ ID NO: 76138 - protein, 469 aa, Desulfotalea psychrophila LSv54; identical to SEQ ID NO: 38802

SEQ ID NO: 76139 - DNA, 1383 bp, Yersinia pseudotuberculosis IP 32953; identical to SEQ ID NO: 38803
  CDS (1)..(1383): transl_table=11

SEQ ID NO: 76140 - protein, 460 aa, Yersinia pseudotuberculosis IP 32953; identical to SEQ ID NO: 38804

SEQ ID NO: 76141 - DNA, 1581 bp, Symbiobacterium thermophilum IAM 14863; identical to SEQ ID NO: 38805
  CDS (1)..(1581): transl_table=11

SEQ ID NO: 76142 - protein, 526 aa, Symbiobacterium thermophilum IAM 14863; identical to SEQ ID NO: 38806

SEQ ID NO: 76143 - DNA, 1587 bp, Bacillus cereus ZK; identical to SEQ ID NO: 38807
  CDS (1)..(1587): transl_table=11

SEQ ID NO: 76144 - protein, 528 aa, Bacillus cereus ZK; identical to SEQ ID NO: 38808

SEQ ID NO: 76145 - DNA, 1842 bp, Mannheimia succiniciproducens MBEL55E; identical to SEQ ID NO: 38809
  CDS (1)..(1842): transl_table=11

SEQ ID NO: 76146 - protein, 613 aa, Mannheimia succiniciproducens MBEL55E; identical to SEQ ID NO: 38810

SEQ ID NO: 76147 - DNA, 1254 bp, Mannheimia succiniciproducens MBEL55E; identical to SEQ ID NO: 38811
  CDS (1)..(1254): transl_table=11

SEQ ID NO: 76148 - protein, 417 aa, Mannheimia succiniciproducens MBEL55E; identical to SEQ ID NO: 38812

SEQ ID NO: 76149 - DNA, 1446 bp, Bacillus licheniformis ATCC 14580; identical to SEQ ID NO: 38813
  CDS (1)..(1446): transl_table=11

SEQ ID NO: 76150 - protein, 481 aa, Bacillus licheniformis ATCC 14580; identical to SEQ ID NO: 38814

SEQ ID NO: 76151 - DNA, 1911 bp, Bacteroides fragilis YCH46; identical to SEQ ID NO: 38815
  CDS (1)..(1911): transl_table=11

SEQ ID NO: 76152 - protein, 636 aa, Bacteroides fragilis YCH46; identical to SEQ ID NO: 38816

SEQ ID NO: 76153 - DNA, 1284 bp, Bacteroides fragilis YCH46; identical to SEQ ID NO: 38817
  CDS (1)..(1284): transl_table=11

SEQ ID NO: 76154 - protein, 427 aa, Bacteroides fragilis YCH46; identical to SEQ ID NO: 38818

SEQ ID NO: 76155 - DNA, 1362 bp, Methylococcus capsulatus str. Bath; identical to SEQ ID NO: 38819
  CDS (1)..(1362): transl_table=11

SEQ ID NO: 76156 - protein, 453 aa, Methylococcus capsulatus str. Bath; identical to SEQ ID NO: 38820

SEQ ID NO: 76157 - DNA, 1809 bp, Nocardia farcinica IFM 10152; identical to SEQ ID NO: 38821
  CDS (1)..(1809): transl_table=11

SEQ ID NO: 76158 - protein, 602 aa, Nocardia farcinica IFM 10152; identical to SEQ ID NO: 38822

SEQ ID NO: 76159 - DNA, 1770 bp, Legionella pneumophila str. Paris; identical to SEQ ID NO: 38823
  CDS (1)..(1770): transl_table=11

SEQ ID NO: 76160 - protein, 589 aa, Legionella pneumophila str. Paris; identical to SEQ ID NO: 38824

SEQ ID NO: 76161 - DNA, 1407 bp, Legionella pneumophila str. Lens; identical to SEQ ID NO: 38825
  CDS (1)..(1407): transl_table=11

SEQ ID NO: 76162 - protein, 468 aa, Legionella pneumophila str. Lens; identical to SEQ ID NO: 38826

SEQ ID NO: 76163 - DNA, 1368 bp, Photobacterium profundum SS9; identical to SEQ ID NO: 38827
  CDS (1)..(1368): transl_table=11

SEQ ID NO: 76164 - protein, 455 aa, Photobacterium profundum SS9; identical to SEQ ID NO: 38828

SEQ ID NO: 76165 - DNA, 1389 bp, Photobacterium profundum SS9; identical to SEQ ID NO: 38829
  CDS (1)..(1389): transl_table=11

SEQ ID NO: 76166 - protein, 462 aa, Photobacterium profundum SS9; identical to SEQ ID NO: 38830

SEQ ID NO: 76167 - DNA, 1872 bp, Photobacterium profundum SS9; identical to SEQ ID NO: 38831
  CDS (1)..(1872): transl_table=11

SEQ ID NO: 76168 - protein, 623 aa, Photobacterium profundum SS9; identical to SEQ ID NO: 38832

SEQ ID NO: 76169 - DNA, 1587 bp, Streptococcus thermophilus LMG 18311; identical to SEQ ID NO: 38833
  CDS (1)..(1587): transl_table=11

SEQ ID NO: 76170 - protein, 528 aa, Streptococcus thermophilus LMG 18311; identical to SEQ ID NO: 38834

SEQ ID NO: 76171 - DNA, 1554 bp, Thermus thermophilus HB8; identical to SEQ ID NO: 38835
  CDS (1)..(1554): transl_table=11

SEQ ID NO: 76172 - protein, 517 aa, Thermus thermophilus HB8; identical to SEQ ID NO: 38836

SEQ ID NO: 76173 - DNA, 1404 bp, Geobacillus kaustophilus HTA426; identical to SEQ ID NO: 38837
  CDS (1)..(1404): transl_table=11

SEQ ID NO: 76174 - protein, 467 aa, Geobacillus kaustophilus HTA426; identical to SEQ ID NO: 38838

SEQ ID NO: 76175 - DNA, 1425 bp, Idiomarina loihiensis L2TR; identical to SEQ ID NO: 38839
  CDS (1)..(1425): transl_table=11

SEQ ID NO: 76176 - protein, 474 aa, Idiomarina loihiensis L2TR; identical to SEQ ID NO: 38840

SEQ ID NO: 76177 - DNA, 1251 bp, Idiomarina loihiensis L2TR; identical to SEQ ID NO: 38841
  CDS (1)..(1251): transl_table=11

SEQ ID NO: 76178 - protein, 416 aa, Idiomarina loihiensis L2TR; identical to SEQ ID NO: 38842

SEQ ID NO: 76179 - DNA, 1785 bp, Idiomarina loihiensis L2TR; identical to SEQ ID NO: 38843
  CDS (1)..(1785): transl_table=11

SEQ ID NO: 76180 - protein, 594 aa, Idiomarina loihiensis L2TR; identical to SEQ ID NO: 38844

SEQ ID NO: 76181 - DNA, 1392 bp, Azoarcus sp. EbN1; identical to SEQ ID NO: 38845
  CDS (1)..(1392): transl_table=11

SEQ ID NO: 76182 - protein, 463 aa, Azoarcus sp. EbN1; identical to SEQ ID NO: 38846

SEQ ID NO: 76183 - DNA, 1527 bp, Azoarcus sp. EbN1; identical to SEQ ID NO: 38847
  CDS (1)..(1527): transl_table=11

SEQ ID NO: 76184 - protein, 508 aa, Azoarcus sp. EbN1; identical to SEQ ID NO: 38848

SEQ ID NO: 76185 - DNA, 1977 bp, Azoarcus sp. EbN1; identical to SEQ ID NO: 38849
  CDS (1)..(1977): transl_table=11

SEQ ID NO: 76186 - protein, 658 aa, Azoarcus sp. EbN1; identical to SEQ ID NO: 38850

SEQ ID NO: 76187 - DNA, 1479 bp, Zymomonas mobilis subsp. mobilis ZM4; identical to SEQ ID NO: 38851
  CDS (1)..(1479): transl_table=11

SEQ ID NO: 76188 - protein, 492 aa, Zymomonas mobilis subsp. mobilis ZM4; identical to SEQ ID NO: 38852

SEQ ID NO: 76189 - DNA, 1416 bp, Silicibacter pomeroyi DSS-3; identical to SEQ ID NO: 38853
  CDS (1)..(1416): transl_table=11

SEQ ID NO: 76190 - protein, 471 aa, Silicibacter pomeroyi DSS-3; identical to SEQ ID NO: 38854

SEQ ID NO: 76191 - DNA, 1326 bp, Francisella tularensis subsp. tularensis Schu 4; identical to SEQ ID NO: 38855
  CDS (1)..(1326): transl_table=11

SEQ ID NO: 76192 - protein, 441 aa, Francisella tularensis subsp. tularensis Schu 4; identical to SEQ ID NO: 38856

SEQ ID NO: 76193 - DNA, 1710 bp, Francisella tularensis subsp. tularensis Schu 4; identical to SEQ ID NO: 38857
  CDS (1)..(1710): transl_table=11

SEQ ID NO: 76194 - protein, 569 aa, Francisella tularensis subsp. tularensis Schu 4; identical to SEQ ID NO: 38858

SEQ ID NO: 76195 - DNA, 1614 bp, Bacillus clausii KSM-K16; identical to SEQ ID NO: 38859
  CDS (1)..(1614): transl_table=11

SEQ ID NO: 76196 - protein, 537 aa, Bacillus clausii KSM-K16; identical to SEQ ID NO: 38860

SEQ ID NO: 76197 - DNA, 1683 bp, Dehalococcoides ethenogenes 195; identical to SEQ ID NO: 38861
  CDS (1)..(1683): transl_table=11

SEQ ID NO: 76198 - protein, 560 aa, Dehalococcoides ethenogenes 195; identical to SEQ ID NO: 38862

SEQ ID NO: 76199 - DNA, 1362 bp, Rhodobacter sphaeroides 2.4.1; identical to SEQ ID NO: 38863
  CDS (1)..(1362)

SEQ ID NO: 76200 - protein, 453 aa, Rhodobacter sphaeroides 2.4.1; identical to SEQ ID NO: 38864

SEQ ID NO: 76201 - DNA, 1830 bp, Xylella fastidiosa Dixon; identical to SEQ ID NO: 38865
  CDS (1)..(1830)

SEQ ID NO: 76202 - protein, 609 aa, Xylella fastidiosa Dixon; identical to SEQ ID NO: 38866

SEQ ID NO: 76203 - DNA, 1656 bp, Magnetospirillum magnetotacticum MS-1; identical to SEQ ID NO: 38867
  CDS (1)..(1656)

SEQ ID NO: 76204 - protein, 551 aa, Magnetospirillum magnetotacticum MS-1; identical to SEQ ID NO: 38868

SEQ ID NO: 76205 - DNA, 1623 bp, Leuconostoc mesenteroides subsp. mesenteroides ATCC 8293; identical to SEQ ID NO: 38869
  CDS (1)..(1623)

SEQ ID NO: 76206 - protein, 540 aa, Leuconostoc mesenteroides subsp. mesenteroides ATCC 8293; identical to SEQ ID NO: 38870

SEQ ID NO: 76207 - DNA, 1260 bp, Azotobacter vinelandii; identical to SEQ ID NO: 38871
  CDS (1)..(1260)

SEQ ID NO: 76208 - protein, 419 aa, Azotobacter vinelandii; identical to SEQ ID NO: 38872

SEQ ID NO: 76209 - DNA, 1452 bp, Azotobacter vinelandii; identical to SEQ ID NO: 38873
  CDS (1)..(1452)

SEQ ID NO: 76210 - protein, 483 aa, Azotobacter vinelandii; identical to SEQ ID NO: 38874

SEQ ID NO: 76211 - DNA, 1677 bp, Azotobacter vinelandii; identical to SEQ ID NO: 38875
  CDS (1)..(1677)

SEQ ID NO: 76212 - protein, 558 aa, Azotobacter vinelandii; identical to SEQ ID NO: 38876

SEQ ID NO: 76213 - DNA, 1470 bp, Desulfitobacterium hafniense DCB-2; identical to SEQ ID NO: 38877
  CDS (1)..(1470)

SEQ ID NO: 76214 - protein, 489 aa, Desulfitobacterium hafniense DCB-2; identical to SEQ ID NO: 38878

SEQ ID NO: 76215 - DNA, 1530 bp, Nostoc punctiforme PCC 73102; identical to SEQ ID NO: 38879
  CDS (1)..(1530)

SEQ ID NO: 76216 - protein, 509 aa, Nostoc punctiforme PCC 73102; identical to SEQ ID NO: 38880

SEQ ID NO: 76217 - DNA, 1674 bp, Pseudomonas syringae pv. syringae B728a; identical to SEQ ID NO: 38881
  CDS (1)..(1674)

SEQ ID NO: 76218 - protein, 557 aa, Pseudomonas syringae pv. syringae B728a; identical to SEQ ID NO: 38882

SEQ ID NO: 76219 - DNA, 1860 bp, Actinobacillus pleuropneumoniae serovar 1 str. 4074; identical to SEQ ID NO: 38883
  CDS (1)..(1860)

SEQ ID NO: 76220 - protein, 619 aa, Actinobacillus pleuropneumoniae serovar 1 str. 4074; identical to SEQ ID NO: 38884

SEQ ID NO: 76221 - DNA, 1671 bp, Pseudomonas aeruginosa UCBPP-PA14; identical to SEQ ID NO: 38885
  CDS (1)..(1671)

SEQ ID NO: 76222 - protein, 556 aa, Pseudomonas aeruginosa UCBPP-PA14; identical to SEQ ID NO: 38886

SEQ ID NO: 76223 - DNA, 1377 bp, Pseudomonas aeruginosa UCBPP-PA14; identical to SEQ ID NO: 38887
  CDS (1)..(1377)

SEQ ID NO: 76224 - protein, 458 aa, Pseudomonas aeruginosa UCBPP-PA14; identical to SEQ ID NO: 38888

SEQ ID NO: 76225 - DNA, 1587 bp, Fusobacterium nucleatum subsp. vincentii ATCC 49256; identical to SEQ ID NO: 38889
  CDS (1)..(1587): transl_table=11

SEQ ID NO: 76226 - protein, 528 aa, Fusobacterium nucleatum subsp. vincentii ATCC 49256; identical to SEQ ID NO: 38890

SEQ ID NO: 76227 - DNA, 1704 bp, Psychrobacter sp. 273-4; identical to SEQ ID NO: 38891
  CDS (1)..(1704)

SEQ ID NO: 76228 - protein, 567 aa, Psychrobacter sp. 273-4; identical to SEQ ID NO: 38892

SEQ ID NO: 76229 - DNA, 1569 bp, Methanococcoides burtonii DSM 6242; identical to SEQ ID NO: 38893
  CDS (1)..(1569)

SEQ ID NO: 76230 - protein, 522 aa, Methanococcoides burtonii DSM 6242; identical to SEQ ID NO: 38894

SEQ ID NO: 76231 - DNA, 1821 bp, Dechloromonas aromatica RCB; identical to SEQ ID NO: 38895
  CDS (1)..(1821)

SEQ ID NO: 76232 - protein, 606 aa, Dechloromonas aromatica RCB; identical to SEQ ID NO: 38896

SEQ ID NO: 76233 - DNA, 1524 bp, Dechloromonas aromatica RCB; identical to SEQ ID NO: 38897
  CDS (1)..(1524)

SEQ ID NO: 76234 - protein, 507 aa, Dechloromonas aromatica RCB; identical to SEQ ID NO: 38898

SEQ ID NO: 76235 - DNA, 1401 bp, Dechloromonas aromatica RCB; identical to SEQ ID NO: 38899
  CDS (1)..(1401)

SEQ ID NO: 76236 - protein, 466 aa, Dechloromonas aromatica RCB; identical to SEQ ID NO: 38900

SEQ ID NO: 76237 - DNA, 1233 bp, Rickettsia rickettsii; identical to SEQ ID NO: 38901
  CDS (1)..(1233)

SEQ ID NO: 76238 - protein, 410 aa, Rickettsia rickettsii; identical to SEQ ID NO: 38902

SEQ ID NO: 76239 - DNA, 1842 bp, Haemophilus influenzae R2846; identical to SEQ ID NO: 38903
  CDS (1)..(1842)

SEQ ID NO: 76240 - protein, 613 aa, Haemophilus influenzae R2846; identical to SEQ ID NO: 38904

SEQ ID NO: 76241 - DNA, 1842 bp, Haemophilus influenzae R2866; identical to SEQ ID NO: 38905
  CDS (1)..(1842)

SEQ ID NO: 76242 - protein, 613 aa, Haemophilus influenzae R2866; identical to SEQ ID NO: 38906

SEQ ID NO: 76243 - DNA, 1248 bp, Haemophilus influenzae R2866; identical to SEQ ID NO: 38907
  CDS (1)..(1248)

SEQ ID NO: 76244 - protein, 415 aa, Haemophilus influenzae R2866; identical to SEQ ID NO: 38908

SEQ ID NO: 76245 - DNA, 1281 bp, Anabaena variabilis ATCC 29413; identical to SEQ ID NO: 38909
  CDS (1)..(1281)

SEQ ID NO: 76246 - protein, 426 aa, Anabaena variabilis ATCC 29413; identical to SEQ ID NO: 38910

SEQ ID NO: 76247 - DNA, 1542 bp, Anabaena variabilis ATCC 29413; identical to SEQ ID NO: 38911
  CDS (1)..(1542)

SEQ ID NO: 76248 - protein, 513 aa, Anabaena variabilis ATCC 29413; identical to SEQ ID NO: 38912

SEQ ID NO: 76249 - DNA, 1425 bp, Ralstonia eutropha JMP134; identical to SEQ ID NO: 38913
  CDS (1)..(1425)

SEQ ID NO: 76250 - protein, 474 aa, Ralstonia eutropha JMP134; identical to SEQ ID NO: 38914

SEQ ID NO: 76251 - DNA, 1521 bp, Ralstonia eutropha JMP134; identical to SEQ ID NO: 38915
  CDS (1)..(1521)

SEQ ID NO: 76252 - protein, 506 aa, Ralstonia eutropha JMP134; identical to SEQ ID NO: 38916

SEQ ID NO: 76253 - DNA, 1356 bp, Methylobacillus flagellatus KT; identical to SEQ ID NO: 38917
  CDS (1)..(1356)

SEQ ID NO: 76254 - protein, 451 aa, Methylobacillus flagellatus KT; identical to SEQ ID NO: 38918

SEQ ID NO: 76255 - DNA, 1383 bp, Methylobacillus flagellatus KT; identical to SEQ ID NO: 38919
  CDS (1)..(1383)

SEQ ID NO: 76256 - protein, 460 aa, Methylobacillus flagellatus KT; identical to SEQ ID NO: 38920

SEQ ID NO: 76257 - DNA, 1548 bp, Methylobacillus flagellatus KT; identical to SEQ ID NO: 38921
  CDS (1)..(1548)

SEQ ID NO: 76258 - protein, 515 aa, Methylobacillus flagellatus KT; identical to SEQ ID NO: 38922

SEQ ID NO: 76259 - DNA, 1443 bp, Crocosphaera watsonii WH 8501; identical to SEQ ID NO: 38923
  CDS (1)..(1443)

SEQ ID NO: 76260 - protein, 480 aa, Crocosphaera watsonii WH 8501; identical to SEQ ID NO: 38924

SEQ ID NO: 76261 - DNA, 1233 bp, Exiguobacterium sp. 255-15; identical to SEQ ID NO: 38925
  CDS (1)..(1233)

SEQ ID NO: 76262 - protein, 410 aa, Exiguobacterium sp. 255-15; identical to SEQ ID NO: 38926

SEQ ID NO: 76263 - DNA, 1536 bp, Exiguobacterium sp. 255-15; identical to SEQ ID NO: 38927
  CDS (1)..(1536)

SEQ ID NO: 76264 - protein, 511 aa, Exiguobacterium sp. 255-15; identical to SEQ ID NO: 38928

SEQ ID NO: 76265 - DNA, 1446 bp, Exiguobacterium sp. 255-15; identical to SEQ ID NO: 38929
  CDS (1)..(1446)

SEQ ID NO: 76266 - protein, 481 aa, Exiguobacterium sp. 255-15; identical to SEQ ID NO: 38930

SEQ ID NO: 76267 - DNA, 1398 bp, Burkholderia cepacia R1808; identical to SEQ ID NO: 38931
  CDS (1)..(1398)

SEQ ID NO: 76268 - protein, 465 aa, Burkholderia cepacia R1808; identical to SEQ ID NO: 38932

SEQ ID NO: 76269 - DNA, 1413 bp, Listeria monocytogenes str. 1/2a F6854; identical to SEQ ID NO: 38933
  CDS (1)..(1413): transl_table=11

SEQ ID NO: 76270 - protein, 470 aa, Listeria monocytogenes str. 1/2a F6854; identical to SEQ ID NO: 38934

SEQ ID NO: 76271 - DNA, 1467 bp, Rubrivivax gelatinosus PM1; identical to SEQ ID NO: 38935
  CDS (1)..(1467)

SEQ ID NO: 76272 - protein, 488 aa, Rubrivivax gelatinosus PM1; identical to SEQ ID NO: 38936

SEQ ID NO: 76273 - DNA, 1422 bp, Rubrivivax gelatinosus PM1; identical to SEQ ID NO: 38937
  CDS (1)..(1422)

SEQ ID NO: 76274 - protein, 473 aa, Rubrivivax gelatinosus PM1; identical to SEQ ID NO: 38938

SEQ ID NO: 76275 - DNA, 1182 bp, Rhodospirillum rubrum; identical to SEQ ID NO: 38939
  CDS (1)..(1182)

SEQ ID NO: 76276 - protein, 393 aa, Rhodospirillum rubrum; identical to SEQ ID NO: 38940

SEQ ID NO: 76277 - DNA, 2034 bp, Rhodospirillum rubrum; identical to SEQ ID NO: 38941
  CDS (1)..(2034)

SEQ ID NO: 76278 - protein, 677 aa, Rhodospirillum rubrum; identical to SEQ ID NO: 38942

SEQ ID NO: 76279 - DNA, 1905 bp, Ralstonia metallidurans CH34; identical to SEQ ID NO: 38943
  CDS (1)..(1905)

SEQ ID NO: 76280 - protein, 634 aa, Ralstonia metallidurans CH34; identical to SEQ ID NO: 38944

SEQ ID NO: 76281 - DNA, 1476 bp, Burkholderia fungorum LB400; identical to SEQ ID NO: 38945
  CDS (1)..(1476)

SEQ ID NO: 76282 - protein, 491 aa, Burkholderia fungorum LB400; identical to SEQ ID NO: 38946

SEQ ID NO: 76283 - DNA, 1512 bp, Thermobifida fusca; identical to SEQ ID NO: 38947
  CDS (1)..(1512)

SEQ ID NO: 76284 - protein, 503 aa, Thermobifida fusca; identical to SEQ ID NO: 38948

SEQ ID NO: 76285 - DNA, 1713 bp, Thermobifida fusca; identical to SEQ ID NO: 38949
  CDS (1)..(1713)

SEQ ID NO: 76286 - protein, 570 aa, Thermobifida fusca; identical to SEQ ID NO: 38950

SEQ ID NO: 76287 - DNA, 1740 bp, Methanosarcina barkeri str. fusaro; identical to SEQ ID NO: 38951
  CDS (1)..(1740)

SEQ ID NO: 76288 - protein, 579 aa, Methanosarcina barkeri str. fusaro; identical to SEQ ID NO: 38952

SEQ ID NO: 76289 - DNA, 1359 bp, Geobacter metallireducens GS-15; identical to SEQ ID NO: 38953
  CDS (1)..(1359)

SEQ ID NO: 76290 - protein, 452 aa, Geobacter metallireducens GS-15; identical to SEQ ID NO: 38954

SEQ ID NO: 76291 - DNA, 1395 bp, Novosphingobium aromaticivorans DSM 12444; identical to SEQ ID NO: 38955
  CDS (1)..(1395)

SEQ ID NO: 76292 - protein, 464 aa, Novosphingobium aromaticivorans DSM 12444; identical to SEQ ID NO: 38956

SEQ ID NO: 76293 - DNA, 1497 bp, Novosphingobium aromaticivorans DSM 12444; identical to SEQ ID NO: 38957
  CDS (1)..(1497)

SEQ ID NO: 76294 - protein, 498 aa, Novosphingobium aromaticivorans DSM 12444; identical to SEQ ID NO: 38958

SEQ ID NO: 76295 - DNA, 1260 bp, Cytophaga hutchinsonii; identical to SEQ ID NO: 38959
  CDS (1)..(1260)

SEQ ID NO: 76296 - protein, 419 aa, Cytophaga hutchinsonii; identical to SEQ ID NO: 38960

SEQ ID NO: 76297 - DNA, 1743 bp, Cytophaga hutchinsonii; identical to SEQ ID NO: 38961
  CDS (1)..(1743)

SEQ ID NO: 76298 - protein, 580 aa, Cytophaga hutchinsonii; identical to SEQ ID NO: 38962

SEQ ID NO: 76299 - DNA, 1395 bp, Microbulbifer degradans 2-40; identical to SEQ ID NO: 38963
  CDS (1)..(1395)

SEQ ID NO: 76300 - protein, 464 aa, Microbulbifer degradans 2-40; identical to SEQ ID NO: 38964

SEQ ID NO: 76301 - DNA, 1179 bp, Microbulbifer degradans 2-40; identical to SEQ ID NO: 38965
  CDS (1)..(1179)

SEQ ID NO: 76302 - protein, 392 aa, Microbulbifer degradans 2-40; identical to SEQ ID NO: 38966

SEQ ID NO: 76303 - DNA, 1788 bp, Microbulbifer degradans 2-40; identical to SEQ ID NO: 38967
  CDS (1)..(1788)

SEQ ID NO: 76304 - protein, 595 aa, Microbulbifer degradans 2-40; identical to SEQ ID NO: 38968

SEQ ID NO: 76305 - DNA, 1311 bp, Microbulbifer degradans 2-40; identical to SEQ ID NO: 38969
  CDS (1)..(1311)

SEQ ID NO: 76306 - protein, 436 aa, Microbulbifer degradans 2-40; identical to SEQ ID NO: 38970

SEQ ID NO: 76307 - DNA, 1197 bp, Microbulbifer degradans 2-40; identical to SEQ ID NO: 38971
  CDS (1)..(1197)

SEQ ID NO: 76308 - protein, 398 aa, Microbulbifer degradans 2-40; identical to SEQ ID NO: 38972

SEQ ID NO: 76309 - DNA, 1566 bp, Oenococcus oeni PSU-1; identical to SEQ ID NO: 38973
  CDS (1)..(1566)

SEQ ID NO: 76310 - protein, 521 aa, Oenococcus oeni PSU-1; identical to SEQ ID NO: 38974

SEQ ID NO: 76311 - DNA, 1626 bp, Haemophilus influenzae 86-028NP; identical to SEQ ID NO: 38975
  CDS (1)..(1626)

SEQ ID NO: 76312 - protein, 541 aa, Haemophilus influenzae 86-028NP; identical to SEQ ID NO: 38976

SEQ ID NO: 76313 - DNA, 1581 bp, Pediococcus pentosaceus ATCC 25745; identical to SEQ ID NO: 38977
  CDS (1)..(1581)

SEQ ID NO: 76314 - protein, 526 aa, Pediococcus pentosaceus ATCC 25745; identical to SEQ ID NO: 38978

SEQ ID NO: 76315 - DNA, 1362 bp, Pediococcus pentosaceus ATCC 25745; identical to SEQ ID NO: 38979
  CDS (1)..(1362)

SEQ ID NO: 76316 - protein, 453 aa, Pediococcus pentosaceus ATCC 25745; identical to SEQ ID NO: 38980

SEQ ID NO: 76317 - DNA, 1365 bp, Trichodesmium erythraeum IMS101; identical to SEQ ID NO: 38981
  CDS (1)..(1365)

SEQ ID NO: 76318 - protein, 454 aa, Trichodesmium erythraeum IMS101; identical to SEQ ID NO: 38982

SEQ ID NO: 76319 - DNA, 1488 bp, Trichodesmium erythraeum IMS101; identical to SEQ ID NO: 38983
  CDS (1)..(1488)

SEQ ID NO: 76320 - protein, 495 aa, Trichodesmium erythraeum IMS101; identical to SEQ ID NO: 38984

SEQ ID NO: 76321 - DNA, 1602 bp, Thiobacillus denitrificans ATCC 25259; identical to SEQ ID NO: 38985
  CDS (1)..(1602)

SEQ ID NO: 76322 - protein, 533 aa, Thiobacillus denitrificans ATCC 25259; identical to SEQ ID NO: 38986

SEQ ID NO: 76323 - DNA, 1434 bp, Thiobacillus denitrificans ATCC 25259; identical to SEQ ID NO: 38987
  CDS (1)..(1434)

SEQ ID NO: 76324 - protein, 477 aa, Thiobacillus denitrificans ATCC 25259; identical to SEQ ID NO: 38988

SEQ ID NO: 76325 - DNA, 1383 bp, Thiobacillus denitrificans ATCC 25259; identical to SEQ ID NO: 38989
  CDS (1)..(1383)

SEQ ID NO: 76326 - protein, 460 aa, Thiobacillus denitrificans ATCC 25259; identical to SEQ ID NO: 38990

SEQ ID NO: 76327 - DNA, 1338 bp, Silicibacter sp. TM1040; identical to SEQ ID NO: 38991
  CDS (1)..(1338)

SEQ ID NO: 76328 - protein, 445 aa, Silicibacter sp. TM1040; identical to SEQ ID NO: 38992

SEQ ID NO: 76329 - DNA, 1587 bp, Desulfovibrio desulfuricans G20; identical to SEQ ID NO: 38993
  CDS (1)..(1587)

SEQ ID NO: 76330 - protein, 528 aa, Desulfovibrio desulfuricans G20; identical to SEQ ID NO: 38994

SEQ ID NO: 76331 - DNA, 1659 bp, Chloroflexus aurantiacus; identical to SEQ ID NO: 38995
  CDS (1)..(1659)

SEQ ID NO: 76332 - protein, 552 aa, Chloroflexus aurantiacus; identical to SEQ ID NO: 38996

SEQ ID NO: 76333 - DNA, 1407 bp, Polaromonas sp. JS666; identical to SEQ ID NO: 38997
  CDS (1)..(1407)

SEQ ID NO: 76334 - protein, 468 aa, Polaromonas sp. JS666; identical to SEQ ID NO: 38998

SEQ ID NO: 76335 - DNA, 1269 bp, Polaromonas sp. JS666; identical to SEQ ID NO: 38999
  CDS (1)..(1269)

SEQ ID NO: 76336 - protein, 422 aa, Polaromonas sp. JS666; identical to SEQ ID NO: 39000

SEQ ID NO: 76337 - DNA, 1533 bp, Thermus thermophilus; identical to SEQ ID NO: 39001
  CDS (1)..(1533): transl_table=11

SEQ ID NO: 76338 - protein, 510 aa, Thermus thermophilus; identical to SEQ ID NO: 39002

SEQ ID NO: 76339 - DNA, 1407 bp, Brachydanio rerio; identical to SEQ ID NO: 39003
  CDS (1)..(1407)

SEQ ID NO: 76340 - protein, 468 aa, Brachydanio rerio; identical to SEQ ID NO: 39004

SEQ ID NO: 76341 - DNA, 2199 bp, Corynebacterium glutamicum; identical to SEQ ID NO: 39005
  CDS (1)..(2199): transl_table=11

SEQ ID NO: 76342 - protein, 732 aa, Corynebacterium glutamicum; identical to SEQ ID NO: 39006

SEQ ID NO: 76343 - DNA, 1908 bp, uncultured marine proteobacterium ANT8C10; identical to SEQ ID NO: 39007
  CDS (1)..(1908): transl_table=11

SEQ ID NO: 76344 - protein, 635 aa, uncultured marine proteobacterium ANT8C10; identical to SEQ ID NO: 39008

SEQ ID NO: 76345 - DNA, 1974 bp, Yersinia enterocolitica; identical to SEQ ID NO: 39009
  CDS (1)..(1974): transl_table=11

SEQ ID NO: 76346 - protein, 657 aa, Yersinia enterocolitica; identical to SEQ ID NO: 39010

SEQ ID NO: 76347 - DNA, 2247 bp, Arabidopsis thaliana; identical to SEQ ID NO: 39011
  CDS (1)..(2247)

SEQ ID NO: 76348 - protein, 748 aa, Arabidopsis thaliana; identical to SEQ ID NO: 39012

SEQ ID NO: 76349 - DNA, 1239 bp, Arabidopsis thaliana; identical to SEQ ID NO: 39013
  CDS (1)..(1239)

SEQ ID NO: 76350 - protein, 412 aa, Arabidopsis thaliana; identical to SEQ ID NO: 39014

SEQ ID NO: 76351 - DNA, 1860 bp, Arabidopsis thaliana; identical to SEQ ID NO: 39015
  CDS (1)..(1860)

SEQ ID NO: 76352 - protein, 619 aa, Arabidopsis thaliana; identical to SEQ ID NO: 39016

SEQ ID NO: 76353 - DNA, 1569 bp, Streptococcus sobrinus; identical to SEQ ID NO: 39017
  CDS (1)..(1569): transl_table=11

SEQ ID NO: 76354 - protein, 522 aa, Streptococcus sobrinus; identical to SEQ ID NO: 39018

SEQ ID NO: 76355 - DNA, 1464 bp, Synechococcus sp; identical to SEQ ID NO: 39019
  CDS (1)..(1464): transl_table=11

SEQ ID NO: 76356 - protein, 487 aa, Synechococcus sp; identical to SEQ ID NO: 39020

SEQ ID NO: 76357 - DNA, 1869 bp, Pisum sativum; identical to SEQ ID NO: 39021
  CDS (1)..(1869)

SEQ ID NO: 76358 - protein, 622 aa, Pisum sativum; identical to SEQ ID NO: 39022

SEQ ID NO: 76359 - DNA, 1494 bp, Lactobacillus reuteri; identical to SEQ ID NO: 39023
  CDS (1)..(1494): transl_table=11

SEQ ID NO: 76360 - protein, 497 aa, Lactobacillus reuteri; identical to SEQ ID NO: 39024

SEQ ID NO: 76361 - DNA, 1641 bp, Saccharomyces cerevisiae; identical to SEQ ID NO: 39025
  CDS (1)..(1641)

SEQ ID NO: 76362 - protein, 546 aa, Saccharomyces cerevisiae; identical to SEQ ID NO: 39026

SEQ ID NO: 76363 - DNA, 1440 bp, Bacillus subtilis; identical to SEQ ID NO: 39027
  CDS (1)..(1440): transl_table=11

SEQ ID NO: 76364 - protein, 479 aa, Bacillus subtilis; identical to SEQ ID NO: 39028

SEQ ID NO: 76365 - DNA, 1446 bp, Xenopus laevis; identical to SEQ ID NO: 39029
  CDS (1)..(1446)

SEQ ID NO: 76366 - protein, 481 aa, Xenopus laevis; identical to SEQ ID NO: 39030

SEQ ID NO: 76367 - DNA, 2336 bp, Klebsiella pneumoniae; identical to SEQ ID NO: 39031
  CDS (266)..(2197)

SEQ ID NO: 76368 - protein, 643 aa, Klebsiella pneumoniae; identical to SEQ ID NO: 39032

SEQ ID NO: 76369 - DNA, 2259 bp, Saccharomyces cerevisiae; identical to SEQ ID NO: 39033
  CDS (1)..(2259)

SEQ ID NO: 76370 - protein, 752 aa, Saccharomyces cerevisiae; identical to SEQ ID NO: 39034

SEQ ID NO: 76371 - DNA, 1575 bp, Streptococcus pneumoniae; identical to SEQ ID NO: 39035
  CDS (1)..(1575): transl_table=11

SEQ ID NO: 76372 - protein, 524 aa, Streptococcus pneumoniae; identical to SEQ ID NO: 39036

SEQ ID NO: 76373 - DNA, 1104 bp, Methanococcus jannaschii; identical to SEQ ID NO: 39037
  CDS (1)..(1104): transl_table=11

SEQ ID NO: 76374 - protein, 367 aa, Methanococcus jannaschii; identical to SEQ ID NO: 39038

SEQ ID NO: 76375 - DNA, 1239 bp, Arabidopsis thaliana; identical to SEQ ID NO: 39039
  CDS (1)..(1239)

SEQ ID NO: 76376 - protein, 412 aa, Arabidopsis thaliana; identical to SEQ ID NO: 39040

SEQ ID NO: 76377 - DNA, 1242 bp, Nicotiana tabacum; identical to SEQ ID NO: 39041
  CDS (1)..(1242)

SEQ ID NO: 76378 - protein, 413 aa, Nicotiana tabacum; identical to SEQ ID NO: 39042

SEQ ID NO: 76379 - DNA, 1185 bp, Schizosaccharomyces pombe; identical to SEQ ID NO: 39043
  CDS (1)..(1185)

SEQ ID NO: 76380 - protein, 394 aa, Schizosaccharomyces pombe; identical to SEQ ID NO: 39044

SEQ ID NO: 76381 - DNA, 1242 bp, Nicotiana tabacum; identical to SEQ ID NO: 39045
  CDS (1)..(1242)

SEQ ID NO: 76382 - protein, 413 aa, Nicotiana tabacum; identical to SEQ ID NO: 39046

SEQ ID NO: 76383 - DNA, 1242 bp, Nicotiana tabacum; identical to SEQ ID NO: 39047
  CDS (1)..(1242)

SEQ ID NO: 76384 - protein, 413 aa, Nicotiana tabacum; identical to SEQ ID NO: 39048

SEQ ID NO: 76385 - DNA, 1632 bp, Xylella fastidiosa; identical to SEQ ID NO: 39049
  CDS (1)..(1632): transl_table=11

SEQ ID NO: 76386 - protein, 543 aa, Xylella fastidiosa; identical to SEQ ID NO: 39050

SEQ ID NO: 76387 - DNA, 1365 bp, Escherichia coli; identical to SEQ ID NO: 39051
  CDS (1)..(1365): transl_table=11

SEQ ID NO: 76388 - protein, 454 aa, Escherichia coli; identical to SEQ ID NO: 39052

SEQ ID NO: 76389 - DNA, 2285 bp, Drosophila melanogaster; identical to SEQ ID NO: 39053
  CDS (152)..(2137)

SEQ ID NO: 76390 - protein, 661 aa, Drosophila melanogaster; identical to SEQ ID NO: 39054

SEQ ID NO: 76391 - DNA, 25 bp, Primer
atgaccgctttttctaccctgaatg

SEQ ID NO: 76392 - DNA, 24 bp, Primer
ttattttaataaccgcacccggca

SEQ ID NO: 76393 - protein, 414 aa, consensus; identical to SEQ ID NO: 39057
  MISC_FEATURE (1)..(414): consensus for the disclosure of xaa see table XV

SEQ ID NO: 76394 - protein, 94 aa, consensus; identical to SEQ ID NO: 39058
  MISC_FEATURE (1)..(94): consensus for the disclosure of xaa see table XV

SEQ ID NO: 76395 - protein, 116 aa, consensus; identical to SEQ ID NO: 39059
  MISC_FEATURE (1)..(116): consensus for the disclosure of xaa see table XV

SEQ ID NO: 76396 - protein, 99 aa, consensus; identical to SEQ ID NO: 39060
  MISC_FEATURE (1)..(99): consensus for the disclosure of xaa see table XV

SEQ ID NO: 76397 - DNA, 747 bp, Escherichia coli; identical to SEQ ID NO: 40395
  CDS (1)..(747)

SEQ ID NO: 76398 - protein, 248 aa, Escherichia coli; identical to SEQ ID NO: 40396

SEQ ID NO: 76399 - DNA, 783 bp, Escherichia coli; identical to SEQ ID NO: 40397
  CDS (1)..(783)

SEQ ID NO: 76400 - protein, 260 aa, Escherichia coli; identical to SEQ ID NO: 40398

SEQ ID NO: 76401 - DNA, 783 bp, Streptococcus thermophilus bacteriophage 7201; identical to SEQ ID NO: 40399
  CDS (1)..(783): transl_table=11

SEQ ID NO: 76402 - protein, 260 aa, Streptococcus thermophilus bacteriophage 7201; identical to SEQ ID NO: 40400

SEQ ID NO: 76403 - DNA, 786 bp, Plasmid R100; identical to SEQ ID NO: 40401
  CDS (1)..(786): transl_table=11

SEQ ID NO: 76404 - protein, 261 aa, Plasmid R100; identical to SEQ ID NO: 40402

SEQ ID NO: 76405 - DNA, 774 bp, Staphylococcus aureus prophage phiPV83; identical to SEQ ID NO: 40403
  CDS (1)..(774): transl_table=11

SEQ ID NO: 76406 - protein, 257 aa, Staphylococcus aureus prophage phiPV83; identical to SEQ ID NO: 40404

SEQ ID NO: 76407 - DNA, 780 bp, Staphylococcus aureus temperate phage phiSLT; identical to SEQ ID NO: 40405
  CDS (1)..(780): transl_table=11

SEQ ID NO: 76408 - protein, 259 aa, Staphylococcus aureus temperate phage phiSLT; identical to SEQ ID NO: 40406

SEQ ID NO: 76409 - DNA, 885 bp, Bacteriophage bIL309; identical to SEQ ID NO: 40407
  CDS (1)..(885): transl_table=11

SEQ ID NO: 76410 - protein, 294 aa, Bacteriophage bIL309; identical to SEQ ID NO: 40408

SEQ ID NO: 76411 - DNA, 804 bp, Bacillus halodurans C-125; identical to SEQ ID NO: 40409
  CDS (1)..(804): transl_table=11

SEQ ID NO: 76412 - protein, 267 aa, Bacillus halodurans C-125; identical to SEQ ID NO: 40410

SEQ ID NO: 76413 - DNA, 747 bp, Escherichia coli O157:H7; identical to SEQ ID NO: 40411
  CDS (1)..(747): transl_table=11

SEQ ID NO: 76414 - protein, 248 aa, Escherichia coli O157:H7; identical to SEQ ID NO: 40412

SEQ ID NO: 76415 - DNA, 1386 bp, Mycoplasma pulmonis UAB CTIP; identical to SEQ ID NO: 40413
  CDS (1)..(1386): transl_table=4

SEQ ID NO: 76416 - protein, 461 aa, Mycoplasma pulmonis UAB CTIP; identical to SEQ ID NO: 40414

SEQ ID NO: 76417 - DNA, 849 bp, Clostridium acetobutylicum ATCC 824; identical to SEQ ID NO: 40415
  CDS (1)..(849): transl_table=11

SEQ ID NO: 76418 - protein, 282 aa, Clostridium acetobutylicum ATCC 824; identical to SEQ ID NO: 40416

SEQ ID NO: 76419 - DNA, 990 bp, Clostridium acetobutylicum ATCC 824; identical to SEQ ID NO: 40417
  CDS (1)..(990): transl_table=11

SEQ ID NO: 76420 - protein, 329 aa, Clostridium acetobutylicum ATCC 824; identical to SEQ ID NO: 40418

SEQ ID NO: 76421 - DNA, 738 bp, Sinorhizobium meliloti 1021; identical to SEQ ID NO: 40419
  CDS (1)..(738): transl_table=11

SEQ ID NO: 76422 - protein, 245 aa, Sinorhizobium meliloti 1021; identical to SEQ ID NO: 40420

SEQ ID NO: 76423 - DNA, 747 bp, Salmonella enterica subsp. enterica serovar Typhi str. CT18; identical to SEQ ID NO: 40421
  CDS (1)..(747): transl_table=11

SEQ ID NO: 76424 - protein, 248 aa, Salmonella enterica subsp. enterica serovar Typhi str. CT18; identical to SEQ ID NO: 40422

SEQ ID NO: 76425 - DNA, 750 bp, Salmonella typhimurium LT2; identical to SEQ ID NO: 40423
  CDS (1)..(750): transl_table=11

SEQ ID NO: 76426 - protein, 249 aa, Salmonella typhimurium LT2; identical to SEQ ID NO: 40424

SEQ ID NO: 76427 - DNA, 738 bp, Salmonella typhimurium LT2; identical to SEQ ID NO: 40425
  CDS (1)..(738): transl_table=11

SEQ ID NO: 76428 - protein, 245 aa, Salmonella typhimurium LT2; identical to SEQ ID NO: 40426

SEQ ID NO: 76429 - DNA, 864 bp, Listeria innocua Clip11262; identical to SEQ ID NO: 40427
  CDS (1)..(864): transl_table=11

SEQ ID NO: 76430 - protein, 287 aa, Listeria innocua Clip11262; identical to SEQ ID NO: 40428

SEQ ID NO: 76431 - DNA, 780 bp, Bacteriophage phi ETA; identical to SEQ ID NO: 40429
  CDS (1)..(780): transl_table=11

SEQ ID NO: 76432 - protein, 259 aa, Bacteriophage phi ETA; identical to SEQ ID NO: 40430

SEQ ID NO: 76433 - DNA, 759 bp, Bacteriophage P27; identical to SEQ ID NO: 40431
  CDS (1)..(759): transl_table=11

SEQ ID NO: 76434 - protein, 252 aa, Bacteriophage P27; identical to SEQ ID NO: 40432

SEQ ID NO: 76435 - DNA, 996 bp, Clostridium perfringens str. 13; identical to SEQ ID NO: 40433
  CDS (1)..(996): transl_table=11

SEQ ID NO: 76436 - protein, 331 aa, Clostridium perfringens str. 13; identical to SEQ ID NO: 40434

SEQ ID NO: 76437 - DNA, 735 bp, uncultured bacterium; identical to SEQ ID NO: 40435
  CDS (1)..(735): transl_table=11

SEQ ID NO: 76438 - protein, 244 aa, uncultured bacterium; identical to SEQ ID NO: 40436

SEQ ID NO: 76439 - DNA, 774 bp, Methanosarcina acetivorans C2A; identical to SEQ ID NO: 40437
  CDS (1)..(774): transl_table=11

SEQ ID NO: 76440 - protein, 257 aa, Methanosarcina acetivorans C2A; identical to SEQ ID NO: 40438

SEQ ID NO: 76441 - DNA, 984 bp, Thermoanaerobacter tengcongensis MB4; identical to SEQ ID NO: 40439
  CDS (1)..(984): transl_table=11

SEQ ID NO: 76442 - protein, 327 aa, Thermoanaerobacter tengcongensis MB4; identical to SEQ ID NO: 40440

SEQ ID NO: 76443 - DNA, 588 bp, Methanosarcina mazei Go1; identical to SEQ ID NO: 40441
  CDS (1)..(588): transl_table=11

SEQ ID NO: 76444 - protein, 195 aa, Methanosarcina mazei Go1; identical to SEQ ID NO: 40442

SEQ ID NO: 76445 - DNA, 798 bp, Methanosarcina mazei Go1; identical to SEQ ID NO: 40443
  CDS (1)..(798): transl_table=11

SEQ ID NO: 76446 - protein, 265 aa, Methanosarcina mazei Go1; identical to SEQ ID NO: 40444

SEQ ID NO: 76447 - DNA, 831 bp, Bacillus anthracis str. A2012; identical to SEQ ID NO: 40445
  CDS (1)..(831): transl_table=11

SEQ ID NO: 76448 - protein, 276 aa, Bacillus anthracis str. A2012; identical to SEQ ID NO: 40446

SEQ ID NO: 76449 - DNA, 894 bp, Rhizobium etli; identical to SEQ ID NO: 40447
  CDS (1)..(894): transl_table=11

SEQ ID NO: 76450 - protein, 297 aa, Rhizobium etli; identical to SEQ ID NO: 40448

SEQ ID NO: 76451 - DNA, 1362 bp, Streptococcus agalactiae 2603V/R; identical to SEQ ID NO: 40449
  CDS (1)..(1362): transl_table=11

SEQ ID NO: 76452 - protein, 453 aa, Streptococcus agalactiae 2603V/R; identical to SEQ ID NO: 40450

SEQ ID NO: 76453 - DNA, 891 bp, Bacteriophage r1t; identical to SEQ ID NO: 40451
  CDS (1)..(891): transl_table=11

SEQ ID NO: 76454 - protein, 296 aa, Bacteriophage r1t; identical to SEQ ID NO: 40452

SEQ ID NO: 76455 - DNA, 879 bp, Shigella flexneri 2a str. 301; identical to SEQ ID NO: 40453
  CDS (1)..(879): transl_table=11

SEQ ID NO: 76456 - protein, 292 aa, Shigella flexneri 2a str. 301; identical to SEQ ID NO: 40454

SEQ ID NO: 76457 - DNA, 705 bp, Pseudomonas putida KT2440; identical to SEQ ID NO: 40455
  CDS (1)..(705): transl_table=11

SEQ ID NO: 76458 - protein, 234 aa, Pseudomonas putida KT2440; identical to SEQ ID NO: 40456

SEQ ID NO: 76459 - DNA, 786 bp, Pseudomonas resinovorans; identical to SEQ ID NO: 40457
  CDS (1)..(786): transl_table=11

SEQ ID NO: 76460 - protein, 261 aa, Pseudomonas resinovorans; identical to SEQ ID NO: 40458

SEQ ID NO: 76461 - DNA, 990 bp, Clostridium tetani E88; identical to SEQ ID NO: 40459
  CDS (1)..(990): transl_table=11

SEQ ID NO: 76462 - protein, 329 aa, Clostridium tetani E88; identical to SEQ ID NO: 40460

SEQ ID NO: 76463 - DNA, 843 bp, Enterococcus faecalis V583; identical to SEQ ID NO: 40461
  CDS (1)..(843): transl_table=11

SEQ ID NO: 76464 - protein, 280 aa, Enterococcus faecalis V583; identical to SEQ ID NO: 40462

SEQ ID NO: 76465 - DNA, 852 bp, Enterococcus faecalis V583; identical to SEQ ID NO: 40463
  CDS (1)..(852): transl_table=11

SEQ ID NO: 76466 - protein, 283 aa, Enterococcus faecalis V583; identical to SEQ ID NO: 40464

SEQ ID NO: 76467 - DNA, 885 bp, Lactococcus phage P335; identical to SEQ ID NO: 40465
  CDS (1)..(885): transl_table=11

SEQ ID NO: 76468 - protein, 294 aa, Lactococcus phage P335; identical to SEQ ID NO: 40466

SEQ ID NO: 76469 - DNA, 804 bp, Bacillus anthracis str. Ames; identical to SEQ ID NO: 40467
  CDS (1)..(804): transl_table=11

SEQ ID NO: 76470 - protein, 267 aa, Bacillus anthracis str. Ames; identical to SEQ ID NO: 40468

SEQ ID NO: 76471 - DNA, 849 bp, Pseudomonas sp. ADP; identical to SEQ ID NO: 40469
  CDS (1)..(849): transl_table=11

SEQ ID NO: 76472 - protein, 282 aa, Pseudomonas sp. ADP; identical to SEQ ID NO: 40470

SEQ ID NO: 76473 - DNA, 771 bp, Streptococcus mitis phage SM1; identical to SEQ ID NO: 40471
  CDS (1)..(771): transl_table=11

SEQ ID NO: 76474 - protein, 256 aa, Streptococcus mitis phage SM1; identical to SEQ ID NO: 40472

SEQ ID NO: 76475 - DNA, 798 bp, Burkholderia cepacia phage Bcep22; identical to SEQ ID NO: 40473
  CDS (1)..(798): transl_table=11

SEQ ID NO: 76476 - protein, 265 aa, Burkholderia cepacia phage Bcep22; identical to SEQ ID NO: 40474

SEQ ID NO: 76477 - DNA, 813 bp, Bacteriophage EJ-1; identical to SEQ ID NO: 40475
  CDS (1)..(813): transl_table=11

SEQ ID NO: 76478 - protein, 270 aa, Bacteriophage EJ-1; identical to SEQ ID NO: 40476

SEQ ID NO: 76479 - DNA, 1524 bp, Onion yellows phytoplasma OY-M; identical to SEQ ID NO: 40477
  CDS (1)..(1524): transl_table=11

SEQ ID NO: 76480 - protein, 507 aa, Onion yellows phytoplasma OY-M; identical to SEQ ID NO: 40478

SEQ ID NO: 76481 - DNA, 780 bp, Bacteriophage 77; identical to SEQ ID NO: 40479
  CDS (1)..(780): transl_table=11

SEQ ID NO: 76482 - protein, 259 aa, Bacteriophage 77; identical to SEQ ID NO: 40480

SEQ ID NO: 76483 - DNA, 756 bp, Symbiobacterium thermophilum IAM 14863; identical to SEQ ID NO: 40481
  CDS (1)..(756): transl_table=11

SEQ ID NO: 76484 - protein, 251 aa, Symbiobacterium thermophilum IAM 14863; identical to SEQ ID NO: 40482

SEQ ID NO: 76485 - DNA, 774 bp, Symbiobacterium thermophilum IAM 14863; identical to SEQ ID NO: 40483
  CDS (1)..(774): transl_table=11

SEQ ID NO: 76486 - protein, 257 aa, Symbiobacterium thermophilum IAM 14863; identical to SEQ ID NO: 40484

SEQ ID NO: 76487 - DNA, 783 bp, Symbiobacterium thermophilum IAM 14863; identical to SEQ ID NO: 40485
  CDS (1)..(783): transl_table=11

SEQ ID NO: 76488 - protein, 260 aa, Symbiobacterium thermophilum IAM 14863; identical to SEQ ID NO: 40486

SEQ ID NO: 76489 - DNA, 774 bp, Symbiobacterium thermophilum IAM 14863; identical to SEQ ID NO: 40487
  CDS (1)..(774): transl_table=11

SEQ ID NO: 76490 - protein, 257 aa, Symbiobacterium thermophilum IAM 14863; identical to SEQ ID NO: 40488

SEQ ID NO: 76491 - DNA, 831 bp, Bacillus cereus ZK; identical to SEQ ID NO: 40489
  CDS (1)..(831): transl_table=11

SEQ ID NO: 76492 - protein, 276 aa, Bacillus cereus ZK; identical to SEQ ID NO: 40490

SEQ ID NO: 76493 - DNA, 753 bp, Geobacillus kaustophilus HTA426; identical to SEQ ID NO: 40491
  CDS (1)..(753): transl_table=11

SEQ ID NO: 76494 - protein, 250 aa, Geobacillus kaustophilus HTA426; identical to SEQ ID NO: 40492

SEQ ID NO: 76495 - DNA, 798 bp, Azoarcus sp. EbN1; identical to SEQ ID NO: 40493
  CDS (1)..(798): transl_table=11

SEQ ID NO: 76496 - protein, 265 aa, Azoarcus sp. EbN1; identical to SEQ ID NO: 40494

SEQ ID NO: 76497 - DNA, 780 bp, Azoarcus sp. EbN1; identical to SEQ ID NO: 40495
  CDS (1)..(780): transl_table=11

SEQ ID NO: 76498 - protein, 259 aa, Azoarcus sp. EbN1; identical to SEQ ID NO: 40496

SEQ ID NO: 76499 - DNA, 690 bp, Chloroflexus aurantiacus; identical to SEQ ID NO: 40497
  CDS (1)..(690)

SEQ ID NO: 76500 - protein, 229 aa, Chloroflexus aurantiacus; identical to SEQ ID NO: 40498

SEQ ID NO: 76501 - DNA, 780 bp, Azotobacter vinelandii; identical to SEQ ID NO: 40499
  CDS (1)..(780)

SEQ ID NO: 76502 - protein, 259 aa, Azotobacter vinelandii; identical to SEQ ID NO: 40500

SEQ ID NO: 76503 - DNA, 654 bp, Desulfitobacterium hafniense DCB-2; identical to SEQ ID NO: 40501
  CDS (1)..(654)

SEQ ID NO: 76504 - protein, 217 aa, Desulfitobacterium hafniense DCB-2; identical to SEQ ID NO: 40502

SEQ ID NO: 76505 - DNA, 600 bp, Bifidobacterium longum DJO10A; identical to SEQ ID NO: 40503
  CDS (1)..(600)

SEQ ID NO: 76506 - protein, 199 aa, Bifidobacterium longum DJO10A; identical to SEQ ID NO: 40504

SEQ ID NO: 76507 - DNA, 774 bp, Desulfovibrio desulfuricans G20; identical to SEQ ID NO: 40505
  CDS (1)..(774)

SEQ ID NO: 76508 - protein, 257 aa, Desulfovibrio desulfuricans G20; identical to SEQ ID NO: 40506

SEQ ID NO: 76509 - DNA, 675 bp, Burkholderia cepacia R1808; identical to SEQ ID NO: 40507
  CDS (1)..(675)

SEQ ID NO: 76510 - protein, 224 aa, Burkholderia cepacia R1808; identical to SEQ ID NO: 40508

SEQ ID NO: 76511 - DNA, 699 bp, Burkholderia cepacia R1808; identical to SEQ ID NO: 40509
  CDS (1)..(699)

SEQ ID NO: 76512 - protein, 232 aa, Burkholderia cepacia R1808; identical to SEQ ID NO: 40510

SEQ ID NO: 76513 - DNA, 750 bp, Burkholderia cepacia R1808; identical to SEQ ID NO: 40511
  CDS (1)..(750)

SEQ ID NO: 76514 - protein, 249 aa, Burkholderia cepacia R1808; identical to SEQ ID NO: 40512

SEQ ID NO: 76515 - DNA, 810 bp, Bacillus cereus G9241; identical to SEQ ID NO: 40513
  CDS (1)..(810): transl_table=11

SEQ ID NO: 76516 - protein, 269 aa, Bacillus cereus G9241; identical to SEQ ID NO: 40514

SEQ ID NO: 76517 - DNA, 834 bp, Rubrivivax gelatinosus PM1; identical to SEQ ID NO: 40515
  CDS (1)..(834)

SEQ ID NO: 76518 - protein, 277 aa, Rubrivivax gelatinosus PM1; identical to SEQ ID NO: 40516

SEQ ID NO: 76519 - DNA, 819 bp, Burkholderia fungorum LB400; identical to SEQ ID NO: 40517
  CDS (1)..(819)

SEQ ID NO: 76520 - protein, 272 aa, Burkholderia fungorum LB400; identical to SEQ ID NO: 40518

SEQ ID NO: 76521 - DNA, 744 bp, Enterococcus faecium; identical to SEQ ID NO: 40519
  CDS (1)..(744)

SEQ ID NO: 76522 - protein, 247 aa, Enterococcus faecium; identical to SEQ ID NO: 40520

SEQ ID NO: 76523 - DNA, 720 bp, Magnetococcus sp. MC-1; identical to SEQ ID NO: 40521
  CDS (1)..(720)

SEQ ID NO: 76524 - protein, 239 aa, Magnetococcus sp. MC-1; identical to SEQ ID NO: 40522

SEQ ID NO: 76525 - DNA, 795 bp, Geobacter metallireducens GS-15; identical to SEQ ID NO: 40523
  CDS (1)..(795)

SEQ ID NO: 76526 - protein, 264 aa, Geobacter metallireducens GS-15; identical to SEQ ID NO: 40524

SEQ ID NO: 76527 - DNA, 759 bp, Clostridium thermocellum ATCC 27405; identical to SEQ ID NO: 40525
  CDS (1)..(759)

SEQ ID NO: 76528 - protein, 252 aa, Clostridium thermocellum ATCC 27405; identical to SEQ ID NO: 40526

SEQ ID NO: 76529 - DNA, 837 bp, Clostridium thermocellum ATCC 27405; identical to SEQ ID NO: 40527
  CDS (1)..(837)

SEQ ID NO: 76530 - protein, 278 aa, Clostridium thermocellum ATCC 27405; identical to SEQ ID NO: 40528

SEQ ID NO: 76531 - DNA, 819 bp, Pediococcus pentosaceus ATCC 25745; identical to SEQ ID NO: 40529
  CDS (1)..(819)

SEQ ID NO: 76532 - protein, 272 aa, Pediococcus pentosaceus ATCC 25745; identical to SEQ ID NO: 40530

SEQ ID NO: 76533 - DNA, 813 bp, Moorella thermoacetica ATCC 39073; identical to SEQ ID NO: 40531
  CDS (1)..(813)

SEQ ID NO: 76534 - protein, 270 aa, Moorella thermoacetica ATCC 39073; identical to SEQ ID NO: 40532

SEQ ID NO: 76535 - DNA, 759 bp, Moorella thermoacetica ATCC 39073; identical to SEQ ID NO: 40533
  CDS (1)..(759)

SEQ ID NO: 76536 - protein, 252 aa, Moorella thermoacetica ATCC 39073; identical to SEQ ID NO: 40534

SEQ ID NO: 76537 - DNA, 726 bp, Rubrobacter xylanophilus DSM 9941; identical to SEQ ID NO: 40535
  CDS (1)..(726)

SEQ ID NO: 76538 - protein, 241 aa, Rubrobacter xylanophilus DSM 9941; identical to SEQ ID NO: 40536

SEQ ID NO: 76539 - DNA, 828 bp, Polaromonas sp. JS666; identical to SEQ ID NO: 40537
  CDS (1)..(828)

SEQ ID NO: 76540 - protein, 275 aa, Polaromonas sp. JS666; identical to SEQ ID NO: 40538

SEQ ID NO: 76541 - DNA, 951 bp, Pseudomonas alcaligenes; identical to SEQ ID NO: 40539
  CDS (1)..(951): transl_table=11

SEQ ID NO: 76542 - protein, 316 aa, Pseudomonas alcaligenes; identical to SEQ ID NO: 40540

SEQ ID NO: 76543 - DNA, 660 bp, Pseudomonas alcaligenes; identical to SEQ ID NO: 40541
  CDS (1)..(660): transl_table=11

SEQ ID NO: 76544 - protein, 219 aa, Pseudomonas alcaligenes; identical to SEQ ID NO: 40542

SEQ ID NO: 76545 - DNA, 780 bp, Azoarcus sp; identical to SEQ ID NO: 40543
  CDS (1)..(780): transl_table=11

SEQ ID NO: 76546 - protein, 259 aa, Azoarcus sp; identical to SEQ ID NO: 40544

SEQ ID NO: 76547 - DNA, 768 bp, Azoarcus sp; identical to SEQ ID NO: 40545
  CDS (1)..(768): transl_table=11

SEQ ID NO: 76548 - protein, 255 aa, Azoarcus sp; identical to SEQ ID NO: 40546

SEQ ID NO: 76549 - DNA, 750 bp, Burkholderia multivorans; identical to SEQ ID NO: 40547
  CDS (1)..(750): transl_table=11

SEQ ID NO: 76550 - protein, 249 aa, Burkholderia multivorans; identical to SEQ ID NO: 40548

SEQ ID NO: 76551 - DNA, 702 bp, Rhizobium sp; identical to SEQ ID NO: 40549
  CDS (1)..(702): transl_table=11

SEQ ID NO: 76552 - protein, 233 aa, Rhizobium sp; identical to SEQ ID NO: 40550

SEQ ID NO: 76553 - DNA, 741 bp, Enterococcus faecium; identical to SEQ ID NO: 40551
  CDS (1)..(741): transl_table=11

SEQ ID NO: 76554 - protein, 246 aa, Enterococcus faecium; identical to SEQ ID NO: 40552

SEQ ID NO: 76555 - DNA, 660 bp, Aeromonas hydrophila; identical to SEQ ID NO: 40553
  CDS (1)..(660): transl_table=11

SEQ ID NO: 76556 - protein, 219 aa, Aeromonas hydrophila; identical to SEQ ID NO: 40554

SEQ ID NO: 76557 - DNA, 792 bp, Pseudomonas stutzeri; identical to SEQ ID NO: 40555
  CDS (1)..(792): transl_table=11

SEQ ID NO: 76558 - protein, 263 aa, Pseudomonas stutzeri; identical to SEQ ID NO: 40556

SEQ ID NO: 76559 - DNA, 744 bp, Pseudomonas aeruginosa; identical to SEQ ID NO: 40557
  CDS (1)..(744): transl_table=11

SEQ ID NO: 76560 - protein, 247 aa, Pseudomonas aeruginosa; identical to SEQ ID NO: 40558

SEQ ID NO: 76561 - DNA, 780 bp, Rhizobium sp; identical to SEQ ID NO: 40559
  CDS (1)..(780): transl_table=11

SEQ ID NO: 76562 - protein, 259 aa, Rhizobium sp; identical to SEQ ID NO: 40560

SEQ ID NO: 76563 - DNA, 780 bp, Salmonella enterica subsp; identical to SEQ ID NO: 40561
  CDS (1)..(780): transl_table=11

SEQ ID NO: 76564 - protein, 259 aa, Salmonella enterica subsp; identical to SEQ ID NO: 40562

SEQ ID NO: 76565 - DNA, 804 bp, Lactococcus delbrueckii bacteriophage LL; identical to SEQ ID NO: 40563
  CDS (1)..(804): transl_table=11

SEQ ID NO: 76566 - protein, 267 aa, Lactococcus delbrueckii bacteriophage LL; identical to SEQ ID NO: 40564

SEQ ID NO: 76567 - DNA, 876 bp, Lactococcus lactis; identical to SEQ ID NO: 40565
  CDS (1)..(876): transl_table=11

SEQ ID NO: 76568 - protein, 291 aa, Lactococcus lactis; identical to SEQ ID NO: 40566

SEQ ID NO: 76569 - DNA, 843 bp, Pseudomonas sp; identical to SEQ ID NO: 40567
  CDS (1)..(843): transl_table=11

SEQ ID NO: 76570 - protein, 280 aa, Pseudomonas sp; identical to SEQ ID NO: 40568

SEQ ID NO: 76571 - DNA, 1368 bp, Lactococcus lactis; identical to SEQ ID NO: 40569
  CDS (1)..(1368): transl_table=11

SEQ ID NO: 76572 - protein, 455 aa, Lactococcus lactis; identical to SEQ ID NO: 40570

SEQ ID NO: 76573 - DNA, 1545 bp, Pseudomonas aeruginosa; identical to SEQ ID NO: 40571
  CDS (1)..(1545): transl_table=11

SEQ ID NO: 76574 - protein, 514 aa, Pseudomonas aeruginosa; identical to SEQ ID NO: 40572

SEQ ID NO: 76575 - DNA, 741 bp, Buchnera aphidicola; identical to SEQ ID NO: 40573
  CDS (1)..(741): transl_table=11

SEQ ID NO: 76576 - protein, 246 aa, Buchnera aphidicola; identical to SEQ ID NO: 40574

SEQ ID NO: 76577 - DNA, 741 bp, Escherichia coli; identical to SEQ ID NO: 40575
  CDS (1)..(738): transl_table=11

SEQ ID NO: 76578 - protein, 245 aa, Escherichia coli; identical to SEQ ID NO: 40576

SEQ ID NO: 76579 - DNA, 22 bp, Primer
atgaaaaatattgcgacaggcg

SEQ ID NO: 76580 - DNA, 23 bp, Primer
ttacttcgcaattcctggctgga

SEQ ID NO: 76581 - protein, 156 aa, consensus; identical to SEQ ID NO: 40579
  MISC_FEATURE (1)..(156): consensus for the disclosure of xaa see table XV

SEQ ID NO: 76582 - protein, 14 aa, consensus
  MISC_FEATURE (1)..(14): consensus for the disclosure of xaa see table XV
GXXGXGKXXXXXXX

SEQ ID NO: 76583 - protein, 73 aa, consensus; identical to SEQ ID NO: 40581
  MISC_FEATURE (1)..(73): consensus for the disclosure of xaa see table XV

SEQ ID NO: 76584 - DNA, 522 bp, Escherichia coli
  CDS (1)..(522)
atggctattattctcggcattgatccgggttcgcgcgtgaccggctacggcgtcatccgccaggtaggtaggcaactgtcctacctgggtagcggatgcatacgcaccaaagtggatgatttaccgtctcgtctgaaactcatctatgcgggcgtgacggaaatcatcacccagttccagcccgattatttcgccattgaacaagtctttatggcaaagaacgctgactcagccctgaaactgggccaggcgcgcggcgtggcgattgtggcggcggtgaatcaggagttgccagtatttgaatacgcggcacgtcaggtaaagcaaacggtggtaggtattggtagtgccgaaaaaagccaggtgcagcatatggtccgcaccttgctgaaactgcccgctaatccacaggcggatgccgccgatgcgctggcgattgccatcacccactgccacgttagtcagaatgcgatgcagatgagcgaatcgcggctgaacctggcgagagggcgactgcgttaa

SEQ ID NO: 76585 - protein, 173 aa, Escherichia coli
MAIILGIDPGSRVTGYGVIRQVGRQLSYLGSGCIRTKVDDLPSRLKLIYAGVTEIITQFQPDYFAIEQVFMAKNADSALKLGQARGVAIVAAVNQELPVFEYAARQVKQTVVGIGSAEKSQVQHMVRTLLKLPANPQADAADALAIAITHCHVSQNAMQMSESRLNLARGRLR

SEQ ID NO: 76586 - DNA, 507 bp, Gluconobacter oxydans 621H
  CDS (1)..(507)
atgatccgcctgatgggcattgaccccggcctgcgtttcatgggctggggcatcatcgacgtggacggcaatcatctcaagcatgtggcttcgggtgtgatcgggaccgatgggtccgaatccgtgccgctgcgtctgtgtgaacttcacggcgcactcaagaagctgatccgcgaatatgcgccggccgaggcggctgttgaggagacttatgtcaaccgcaacggctcctcgacgctcaagctcggctatgcgcgtggggtggctctgctgacgcccgcctatgaagggctgccggttgcggaatacggggcgatgacggtcaagaaatccgtggtcgggaccggatcggcgagcaaggaacaggtgacgatgatggtgaagcggcttctgccgggggcggagatccgcaaggctgacgcctccgatgcgctggcggttgcgatctgtcatgcccatcatcgtgcaagtgcggcccatgtcgtggccggaaagcgcatggcatga

SEQ ID NO: 76587 - protein, 168 aa, Gluconobacter oxydans 621H
MIRLMGIDPGLRFMGWGIIDVDGNHLKHVASGVIGTDGSESVPLRLCELHGALKKLIREYAPAEAAVEETYVNRNGSSTLKLGYARGVALLTPAYEGLPVAEYGAMTVKKSVVGTGSASKEQVTMMVKRLLPGAEIRKADASDALAVAICHAHHRASAAHVVAGKRMA

SEQ ID NO: 76588 - DNA, 489 bp, Wolbachia endosymbiont strain TRS of Brugia malayi
  CDS (1)..(489)
atgacaagaataataggtctcgatccgggaatgagtaaaaccgggtgggctattattgatatggatgaaagaagcaatatcgaatttctaggcagtggcactatatcaactggtaataagctcggtatgggtgaacgcttgcatgtaatttttgaacaattaaagaaggtaatttctctgtattctccaagtgaagctgcaatagaaaaaatttttgttaataagaatccaaaatcttcactaactttaggatatgcgagagggattgtaattttagtattagaaataacagagttaactatgaatgaatatgatacaaattatgtaaaaaaaagcatcaccggaaatggccatgctgataaggatcaggttatattcatggtgaaacagataattaaaaatttaaatataaaatgccaccatgctgctgatgctctcgctgtagcgatttgccacgtttatacaaaaagttcttattttgtgaggtag

SEQ ID NO: 76589 - protein, 162 aa, Wolbachia endosymbiont strain TRS of Brugia malayi
MTRIIGLDPGMSKTGWAIIDMDERSNIEFLGSGTISTGNKLGMGERLHVIFEQLKKVISLYSPSEAAIEKIFVNKNPKSSLTLGYARGIVILVLEITELTMNEYDTNYVKKSITGNGHADKDQVIFMVKQIIKNLNIKCHHAADALAVAICHVYTKSSYFVR

SEQ ID NO: 76590 - DNA, 525 bp, Xanthomonas oryzae pv. oryzae KACC10331
  CDS (1)..(525)
atgacccgcatcctgggcatcgatcccggctcgcagcgcaccggcatcggcatcatcgatatcgacgagggcggtcgcagccggcatgtgcaccacgcgccgttgatactgctgggcgagggcgacttctcccagcggctcaagcgcctgttgcacgggctgggcgagttgatcgaaacctaccggccggatgaggtggcgatcgagaaggtgttcatgggcaagagtgccgcttccgcgctcaagcttggccaggcgcgcggcgcggcaatctgcgcggtggtcatgcgcgacctgccggtgcacgagtacgccgccaccgaggtcaagctggcgctggtcggcaaaggcggcgcggacaagctgcaggtgcagcacatggtcggcatcatgctcaacttgaaaggcaagctgcagcccgacgccgccgacgcactggcggtcgccatcactcacgcccacgtgcgcgcgactgcgcaatgcttgggcgtcaatacccaacaggcctggagccgcaagaaatga

SEQ ID NO: 76591 - protein, 174 aa, Xanthomonas oryzae pv. oryzae KACC10331
MTRILGIDPGSQRTGIGIIDIDEGGRSRHVHHAPLILLGEGDFSQRLKRLLHGLGELIETYRPDEVAIEKVFMGKSAASALKLGQARGAAICAVVMRDLPVHEYAATEVKLALVGKGGADKLQVQHMVGIMLNLKGKLQPDAADALAVAITHAHVRATAQCLGVNTQQAWSRKK

SEQ ID NO: 76592 - DNA, 543 bp, Neisseria meningitidis Z2491
  CDS (1)..(543): transl_table=11
gtgaatatgtcggcaaccgtccgtatcttaggcatcgacccgggcagccgcgtaacgggtttcggtgtcatcgatgtcagggggcgcgatcatttttacgtcgcctccggttgcatcaaaacgcctgccgatgcgcctctggcagacaggattgccgtgattgtgcggcatatcggcgaagtcgttactgtttacaagcctcaacaggcggcagtggaacaggtgttcgtcaacgtcaaccctgcatcgacgctgatgctcggtcaggctaggggcgcggcattggcggcattggtcagccataagctgcccgtttcggaatacacggccttgcaggtcaaacaggcggtagtcggcaagggtaaggcggcaaaagaacaggtgcagcatatggtggtgcagatgttgggactttcgggaacgccccagccggatgccgccgacggtttggcggtggcgctgacccacgccttacgtaaccacgggcttgccgccaaactcaatccttcggggatgcaggtcaagcgcggcaggtttcaatag

SEQ ID NO: 76593 - protein, 180 aa, Neisseria meningitidis Z2491
MNMSATVRILGIDPGSRVTGFGVIDVRGRDHFYVASGCIKTPADAPLADRIAVIVRHIGEVVTVYKPQQAAVEQVFVNVNPASTLMLGQARGAALAALVSHKLPVSEYTALQVKQAVVGKGKAAKEQVQHMVVQMLGLSGTPQPDAADGLAVALTHALRNHGLAAKLNPSGMQVKRGRFQ

SEQ ID NO: 76594 - DNA, 531 bp, Leptospira interrogans serovar Lai str. 56601
  CDS (1)..(531): transl_table=11
ttggatactattttcatgcgttcgagtagtagttctttgagaattataggaatcgaccctggttcacatagagctggttatgcggttttagaaaaaaacgcttctaaaatcaaaattttaaattatggaaccgtagaagttccttctggaactcctagccctgataatcttttgatgctgcgaaagggacttagggaaattctagaagaatttaatccctccattgcttccgtggaagaaatgttttttgccaaaaataaaaaaacggcttctcgtgtgtttgaatctagaggtgttcttttagttactttagcagaaatgaatattcgaattttagaacctactgtttctcagatcaaaaaaggaaccactggaagcggaactgcggataaaaaacaaattcatcaggctttaaaacttcttttaaacgtagaattgttaaaaggacacgacgattcttgggacgcaattgctgcggcttacgttgggctttcaatgagttctagccctttgttatctaaacttcgatag

SEQ ID NO: 76595 - protein, 176 aa, Leptospira interrogans serovar Lai str. 56601
MDTIFMRSSSSSLRIIGIDPGSHRAGYAVLEKNASKIKILNYGTVEVPSGTPSPDNLLMLRKGLREILEEFNPSIASVEEMFFAKNKKTASRVFESRGVLLVTLAEMNIRILEPTVSQIKKGTTGSGTADKKQIHQALKLLLNVELLKGHDDSWDAIAAAYVGLSMSSSPLLSKLR

SEQ ID NO: 76596 - DNA, 693 bp, Corynebacterium efficiens YS-314
  CDS (1)..(693): transl_table=11
atgggcggaacaggtgcacagatgaatcatgagggtctacgggtgatgggcattgaccccggcctgacccgctgtggcctgtccgtcgtgcaggcgggacgcggacgtacggtctacccggtgtccgtcggcgtggtccggaccccctcggatgccgaactcgcggaccggctgctgcgactcagccaggctgtgggggaatggatggatgattacaccccggatgtgatcgccattgaacgtgtcttcgagcgcggtaatgtctccaccgtcatgaacaccgcccatgccgtgggcgtgctcatcctcgctgcggccgaacggggactgccggtccacatgtacacccccagtgaggtcaagaaggccatctccggcaacggtcgggcggacaagaaacagatgaccgtcatgatcacccgcatcctgggcctcgcggaggctccgaaacccgccgacgccgccgacgccctggcactggcggtgtgccactgctggcgcgcaccactgctcatgcgcaccaggatgaccgccgttgatctggaacaccggcgccgccagtaccagggcaaactggggaaggcgaagtcgaccctgaatgccaggaacaacgcccaggtgaccggggatgcacaggtccgcgcaggacaccccagccagttcgaacggcccgaccgtgccgatccccggtga

SEQ ID NO: 76597 - protein, 230 aa, Corynebacterium efficiens YS-314
MGGTGAQMNHEGLRVMGIDPGLTRCGLSVVQAGRGRTVYPVSVGVVRTPSDAELADRLLRLSQAVGEWMDDYTPDVIAIERVFERGNVSTVMNTAHAVGVLILAAAERGLPVHMYTPSEVKKAISGNGRADKKQMTVMITRILGLAEAPKPADAADALALAVCHCWRAPLLMRTRMTAVDLEHRRRQYQGKLGKAKSTLNARNNAQVTGDAQVRAGHPSQFERPDRADPR

SEQ ID NO: 76598 - DNA, 552 bp, Tropheryma whipplei str. Twist
  CDS (1)..(552): transl_table=11
atgcgaataatggctgttgatcctggcttgaccaattgtggagtggccgttgtaaatgcgaccgggcctctttctcttgagctcttggcggtaaaagtttttcataccgatagatctttgtcatttgaaaatcgtattggaaagattggtgatagtcttctatcaatgctcgaggagttttccccggatttatttgcgcttgaaaaggtgttcgcgcagcataatttgagtacagtgagtggcgttgcgggtgttataggcgtggcgagttatctatgttacaaacatggtacccatattgcgtttcacacaccgagcgaaataaaggcctctatttgtgggtatggaaacgcaaagaaggatcaaattcgtagcatggtaaatagggtttttttatcccaagatattccactcaggcatgatgcgtcagatgctttggcccttgctgtatgttgcgccaggcgatatgcactgcacaatgagcattttaccgaggcgaggctgcgatggctatcagcactcggggccagttcgacagagcggggtcggtaa

SEQ ID NO: 76599 - protein, 183 aa, Tropheryma whipplei str. Twist
MRIMAVDPGLTNCGVAVVNATGPLSLELLAVKVFHTDRSLSFENRIGKIGDSLLSMLEEFSPDLFALEKVFAQHNLSTVSGVAGVIGVASYLCYKHGTHIAFHTPSEIKASICGYGNAKKDQIRSMVNRVFLSQDIPLRHDASDALALAVCCARRYALHNEHFTEARLRWLSALGASSTERGR

SEQ ID NO: 76600 - DNA, 510 bp, Bacteroides thetaiotaomicron VPI-5482
  CDS (1)..(510): transl_table=11
atgggatatggagtcttgcgcgtgaaagggactaagcctgagatgatcgcgatgggaattatcgatttacgtaaatttgccaatcattatctgaagctgcggcatattcacgaacgggtattaagtatcatcgaaagctatctgcctgacgaactggctatcgaagctccttttttcggcaagaacgtacagtccatgttgaagttgggacgtgctcagggagtggcgatggcagtggcattgagccgtgatattccgatcacagaatatgctcctttgaagatcaagatggctataaccggaaacggacaggcatcaaaggaacaagtagcggatatgctgcagcgtatgctgcattttcccaaagaagagatgcctacctttatggatgcgacggacggtttggcggcagcctattgtcattttctgcaaatgggacgtccggcaatggaaaaaggatatagcagttggaaagattttattgcgaaaaatcccgataaagtaaaataa

SEQ ID NO: 76601 - protein, 169 aa, Bacteroides thetaiotaomicron VPI-5482
MGYGVLRVKGTKPEMIAMGIIDLRKFANHYLKLRHIHERVLSIIESYLPDELAIEAPFFGKNVQSMLKLGRAQGVAMAVALSRDIPITEYAPLKIKMAITGNGQASKEQVADMLQRMLHFPKEEMPTFMDATDGLAAAYCHFLQMGRPAMEKGYSSWKDFIAKNPDKVK

SEQ ID NO: 76602 - DNA, 492 bp, Corynebacterium diphtheriae NCTC 13129
  CDS (1)..(492): transl_table=11
atgggaatcgaccccggtctgacgcgctgtggattatcggtggttcaggctggaaaaggtcgaagcgttatacccgtagccgtcggggtggtgcgtacgccgcctcatgctgagttgtcacaacgattgttagaattgagtgaagcggtaaatagctggatcgacgagtatcaacctgatgtcgttgccatcgagagaatttttgagcgcggaaatgtgtccacggtgatgaataccgcccacggagtaggagtgcttgttcttgcagcagcgcaacgcggcctaccagtgcatatgtacacacctagcgaggtgaaaaaggcaatttcgggtaatggtcgagccgacaaaaaacagatgacggccatgattacaagaattcttgggttggtggaagcgcccaaaccggctgatgcggccgatgctcttgctctagcggtatgccattgttggcgagctccaatgctagcgatacataactcccagagatag

SEQ ID NO: 76603 - protein, 163 aa, Corynebacterium diphtheriae NCTC 13129
MGIDPGLTRCGLSVVQAGKGRSVIPVAVGVVRTPPHAELSQRLLELSEAVNSWIDEYQPDVVAIERIFERGNVSTVMNTAHGVGVLVLAAAQRGLPVHMYTPSEVKKAISGNGRADKKQMTAMITRILGLVEAPKPADAADALALAVCHCWRAPMLAIHNSQR

SEQ ID NO: 76604 - DNA, 525 bp, Rhodopseudomonas palustris CGA009
  CDS (1)..(525): transl_table=11
atgaccgcagtctcgattcgtcgcccgatccgcatcctcggcatcgaccccggccttcgccgcaccggctggggggtggtcgacagcgatggcaatcggctggtctatgtcgcgtgcggctcggtcgagccgcgggatacgctgccgctggccgagcggctgctggcgattcatgatgggctggcgaaggtgctggccgcccacgcgccggctgaggccgcggtcgagcagaccttcgtcaacaaggacggcgccgcgacgctgaagctcggccaggcgcgcggtgtggcgatgctggtgccggcgatgcatggcctgctggtcgccgaatacgcgcccaatctcgtgaagaagacagtggtcggcgccggccatgccgacaagacccagatccagatgatgctgaagatcctgctgcccaaagccgatccgaaaaccgccgacgccgccgacgccctcgccatcgccatcacccacgcccaccaccgcggcgccgcgcagcggctgaaggcggtgggggcatga

SEQ ID NO: 76605 - protein, 174 aa, Rhodopseudomonas palustris CGA009
MTAVSIRRPIRILGIDPGLRRTGWGVVDSDGNRLVYVACGSVEPRDTLPLAERLLAIHDGLAKVLAAHAPAEAAVEQTFVNKDGAATLKLGQARGVAMLVPAMHGLLVAEYAPNLVKKTVVGAGHADKTQIQMMLKILLPKADPKTADAADALAIAITHAHHRGAAQRLKAVGA

SEQ ID NO: 76606 - DNA, 567 bp, Mycobacterium avium subsp. paratuberculosis str. k10
  CDS (1)..(567): transl_table=11
atgcgggtgatgggcgtcgaccccggcctgacccggtgcgggctgtcggtggtggaaagcgggcgcggtcgcaccgtcgtcgcgctggacgtcgacgtggtgcgcaccccgtcggacgcgccgctggccgagcggctgctgagcatcagcgacgcggtcgagcattggctggccacccatcagccggacgtggtggccatcgagcgggtgttctcccagctgaatgtgacgaccgtgatgggcaccgcccaggccggcggcgtagtggcgctggcggcggccaaacgcggcatcggcgtgcacttccacacccccagcgaggtcaaggccgcggtgaccggcaacggcgccgccaacaaggcccaagtcaccgcgatggtcaccagaatccttgcgctgcaagccaaaccgacacccgccgacgccgccgacgcgctggcgctggccatctgccactgctggcgggcgccgatgatcgcccggatggcgcgggccgaggcgctggcggcccagcagcggcagaaatacaaggacaaggtggacgcgacgctgagggccgcgcgatga

SEQ ID NO: 76607 - protein, 188 aa, Mycobacterium avium subsp. paratuberculosis str. k10
MRVMGVDPGLTRCGLSVVESGRGRTVVALDVDVVRTPSDAPLAERLLSISDAVEHWLATHQPDVVAIERVFSQLNVTTVMGTAQAGGVVALAAAKRGIGVHFHTPSEVKAAVTGNGAANKAQVTAMVTRILALQAKPTPADAADALALAICHCWRAPMIARMARAEALAAQQRQKYKDKVDATLRAAR

SEQ ID NO: 76608 - DNA, 489 bp, Wolbachia endosymbiont of Drosophila melanogaster
  CDS (1)..(489): transl_table=11
gtggttaaaataataggtctagatccaggaataagcaagactgggtgggccattatcagcctgaacgaaaaaaataatattgaatttttgggcggcggtaccatatcaactgatggtaaattgggtacaggtgaacgcctacatataatttttgaacaattaaagaaagtaatttccctatactctccgaatgaagctgcggtggagaaaatttttgttaataaaaatcctaaatcttcactaactttaggatatgcaagaggggttgtaattttagcgttaaaaataacaaagctaactatgaatgaatatgatgcaaactatgtaaaaaaaagcattaccggaaatggccatgctgataaggatcagattatatttatggtgaagcaaatagttaaaaatttgagtataaaatgccaccatgttgctgacgctcttgctgtagcaatttgtcatgcttatacgaaaggttcttgttttgttgagtaa

SEQ ID NO: 76609 - protein, 162 aa, Wolbachia endosymbiont of Drosophila melanogaster
MVKIIGLDPGISKTGWAIISLNEKNNIEFLGGGTISTDGKLGTGERLHIIFEQLKKVISLYSPNEAAVEKIFVNKNPKSSLTLGYARGVVILALKITKLTMNEYDANYVKKSITGNGHADKDQIIFMVKQIVKNLSIKCHHVADALAVAICHAYTKGSCFVE

SEQ ID NO: 76610 - DNA, 507 bp, Bdellovibrio bacteriovorus HD100
  CDS (1)..(507): transl_table=11
ttgtctttggttattcttggggtcgatcccggttcccgcattacaggtttcggtgttgttcgcgtggcgaacggaaagattgagcacatcaatcacggcgtcatcgtcatggacggtgacgacgctttcccgcgccggatgaccgaactgggctctgcgttccgagaagtcatggaaaaatacaaacccgaacaggtcgtcatcgaaaaaatctttctgggtaaaaatgccgacagtgccttcaagctagggcatgcccgcggtgtgatcatgtacgaagctggcctgggcggcgctgaagttcaggaatacgccacccggtccgtcaaaaaaggtgtcaccggcaacggtggtgcctccaaagaggacgtgcaggccattttgaaagtcatgctgagcttaaaaaccatcagccgcatcgatgcctcggacgccctggccatggcttgttaccatgcctttgaaatgaaaaagaaagccctaatgcaaagagcggtgagtttatga

SEQ ID NO: 76611 - protein, 168 aa, Bdellovibrio bacteriovorus HD100
MSLVILGVDPGSRITGFGVVRVANGKIEHINHGVIVMDGDDAFPRRMTELGSAFREVMEKYKPEQVVIEKIFLGKNADSAFKLGHARGVIMYEAGLGGAEVQEYATRSVKKGVTGNGGASKEDVQAILKVMLSLKTISRIDASDALAMACYHAFEMKKKALMQRAVSL

SEQ ID NO: 76612 - DNA, 537 bp, Treponema denticola ATCC 35405
  CDS (1)..(537): transl_table=11
atgggtattttaaaagcagcttcaagcaaaaaaaatctccgcccctgtgttatagggattgatccgggtttggcaaatacgggatatggaattataagtttttcaaataaccgctttgagtgtatagaatacggctcaataagtaccgagcctcatttactccaaggggaaaggcttttaaaaattttcgataaggtttcggaacttattgaaaaatacaggcctaaggaggccggaatagaaaccttatattttgcaaaaaatgcgacgagtgcaatgtccgtttcggaagcccgcggcgtggttcttttggctctggctcaagggggggtaagggtaggagagtatgctcccaattccattaaaaaagctgtaacgggtattgctcaagctgaaaaaaggcaggtacaggaagccgtaaaattgattttaggtttaaaggaaattcctaggcctgaccatgcggccgatgccttggctgctgccattacaaaaataaatttaggagatgtaggggaggtacgggcttatgtttaa

SEQ ID NO: 76613 - protein, 178 aa, Treponema denticola ATCC 35405
MGILKAASSKKNLRPCVIGIDPGLANTGYGIISFSNNRFECIEYGSISTEPHLLQGERLLKIFDKVSELIEKYRPKEAGIETLYFAKNATSAMSVSEARGVVLLALAQGGVRVGEYAPNSIKKAVTGIAQAEKRQVQEAVKLILGLKEIPRPDHAADALAAAITKINLGDVGEVRAYV

SEQ ID NO: 76614 - DNA, 573 bp, Leptospira interrogans serovar Copenhageni str. Fiocruz L1-130
  CDS (1)..(573): transl_table=11
ttgttacgcactttcggatctttacaaaaatggtcgttgattttggatactattttcatgcgttcgagtagtagttctttgagaattataggaatcgaccctggttcacatagagctggttatgcggttttagaaaaaaacgcttctaaaatcaaaattttaaattatggaaccgtagaagttccttctggaactcctagccctgataatcttttgatgctgcgaaagggacttagggaaattctagaagaatttaatccctccattgcttccgtggaagaaatgttttttgccaaaaataaaaaaacggcttctcgtgtgtttgaatctagaggtgttcttttagttactttagcagaactgaatattcgaattttagaacctactgtttctcagatcaaaaaaggaaccactggaagcggaactgcggataaaaaacaaattcgtcatgctttaaaacttcttttaaacgtagaattgttaaaaggacacgacgattcttgggacgcaattgctgcggcttacgttgggctttcaatgagttctagccctttgttatctaaacttcgatag

SEQ ID NO: 76615 - protein, 190 aa, Leptospira interrogans serovar Copenhageni str. Fiocruz L1-130
MLRTFGSLQKWSLILDTIFMRSSSSSLRIIGIDPGSHRAGYAVLEKNASKIKILNYGTVEVPSGTPSPDNLLMLRKGLREILEEFNPSIASVEEMFFAKNKKTASRVFESRGVLLVTLAELNIRILEPTVSQIKKGTTGSGTADKKQIRHALKLLLNVELLKGHDDSWDAIAAAYVGLSMSSSPLLSKLR

SEQ ID NO: 76616 - DNA, 501 bp, Thermus thermophilus HB27
  CDS (1)..(501): transl_table=11
gtggtcgtggccggcatagaccccgggatcacccacctgggcctcggggtggtggcggtggaggggaagggggccctcaaggcccgcctcctccacggggaggtggtgaagacctcgccgcaggagcccgcaaaggagagggtggggcggatccacgcccgggtcctggaggtcctccaccgcttccggcccgaggcggtggcggtggaggagcagttcttctaccgccaaaacgagctcgcctacaaggtgggctgggccctgggggccgtcctcgtggcggcctttgaagcgggggtgcccgtctacgcctacggccccatgcaggtgaagcaggccctggcggggcacggccacgccgccaaggaggaggtggccctcatggtccggggcatcctgggcctgaaggaggccccgaggccaagccacctggcagacgccttggccatcgccctgacccacgccttctacgcccgcatgggcacggcgaagcccctttag

SEQ ID NO: 76617 - protein, 166 aa, Thermus thermophilus HB27
MVVAGIDPGITHLGLGVVAVEGKGALKARLLHGEVVKTSPQEPAKERVGRIHARVLEVLHRFRPEAVAVEEQFFYRQNELAYKVGWALGAVLVAAFEAGVPVYAYGPMQVKQALAGHGHAAKEEVALMVRGILGLKEAPRPSHLADALAIALTHAFYARMGTAKPL

SEQ ID NO: 76618 - DNA, 507 bp, Parachlamydia sp. UWE25
  CDS (1)..(507): transl_table=11
atgagcaatcaagttattattttaggattagaccctgggacaaaaataactggttttggagtcattcgcattgaaggccatcagtatgttcctgtcgattacggttgtattcgccctccttctcattataaattgtctgagcgttatttagtcatatgtcaaggagttgaacagttaatcgatcaacatcagcctcatgctgtcgttgtggaaacacaatacgtttctaaaaatgttcaaagtgctatgaaattgggaatggcaagaggtgttatcatgattgctgctaaaaaaagaggaattcctatttatgaatatgctccctcaaaagctaaattagctgttgttgggacaggaagagcaagcaaatatcaagttcaaggcatggttcagaggttacttaatctatcaattcctccaacgccagaagatgctgcagatgctttggcattagctatttgccatgcacaaatgcccattttaaaacaaagtcaatatgaaacttga

SEQ ID NO: 76619 - protein, 168 aa, Parachlamydia sp. UWE25
MSNQVIILGLDPGTKITGFGVIRIEGHQYVPVDYGCIRPPSHYKLSERYLVICQGVEQLIDQHQPHAVVVETQYVSKNVQSAMKLGMARGVIMIAAKKRGIPIYEYAPSKAKLAVVGTGRASKYQVQGMVQRLLNLSIPPTPEDAADALALAICHAQMPILKQSQYET

SEQ ID NO: 76620 - DNA, 501 bp, Desulfovibrio vulgaris subsp. vulgaris str. Hildenborough
  CDS (1)..(501): transl_table=11
atggcggcttccgtcacggtcataggcatagaccccggttcgcagtgtacgggttggggcatcgtgcgcgaggcttcgggcgtgctcacgctcgtcgattgcggggccattcgccccaaaggcggcgatttcgctgcgcgcctcggtgacctctaccgtcagcttgccgatgtcgtccgcgcccatacccccgacgaggcggcggtcgaagacgtccatgcggcgcagaacgtggctacggccctcaagctggggcaggcgcgcggggtcgtcgtggctgcgtgtgccgcgcacggtgtgccggtcatcgactacaggccgtcggtcatcaagaaggcactggtcggtacgggcagggcagagaaggaacaggtgggctacatggtcgggcaggtgcttggcgtgcgacccgactggaaactcgacaccggtgatgcccttgccgcagccatctgccatctgaaccagcggcgcctgacgcgtctggcggggttagcctga

SEQ ID NO: 76621 - protein, 166 aa, Desulfovibrio vulgaris subsp. vulgaris str. Hildenborough
MAASVTVIGIDPGSQCTGWGIVREASGVLTLVDCGAIRPKGGDFAARLGDLYRQLADVVRAHTPDEAAVEDVHAAQNVATALKLGQARGVVVAACAAHGVPVIDYRPSVIKKALVGTGRAEKEQVGYMVGQVLGVRPDWKLDTGDALAAAICHLNQRRLTRLAGLA

SEQ ID NO: 76622 - DNA, 510 bp, Bartonella quintana str. Toulouse
  CDS (1)..(510): transl_table=11
atggcagagacgattcgtattataggcattgatcccggattgcggcgaacaggatggggcgttatcgatttctctggcaatcgtcttcaattcgttgcagcaggcacgctttcttctgatgcacgctgtgaccttgcttccaggctatgccagctttacaaagggctttcagatattttgcatcaatttatgccccatgaagctgccgtagaacatgtgtttgttaataaggatgctacagcgactttaaaacttggtcaagcgcgggccattgctctccttgctccggcgcaagcaaatcttcctgtttttgagtatgctccgaacaaagtaaaaaaatcggttattggggttggtcatggcgctaaggaacaaattcacatgatggtaaaagttcttctcccacgtgctgaatttgacagcagtgatgctgctgatgcgcttgctcttgctctttgccatagtacccaccgcaccagcgcttctcattatgcaaggattaccgcatga

SEQ ID NO: 76623 - protein, 169 aa, Bartonella quintana str. Toulouse
MAETIRIIGIDPGLRRTGWGVIDFSGNRLQFVAAGTLSSDARCDLASRLCQLYKGLSDILHQFMPHEAAVEHVFVNKDATATLKLGQARAIALLAPAQANLPVFEYAPNKVKKSVIGVGHGAKEQIHMMVKVLLPRAEFDSSDAADALALALCHSTHRTSASHYARITA

SEQ ID NO: 76624 - DNA, 510 bp, Bartonella henselae str. Houston-1
  CDS (1)..(510): transl_table=11
atggcagagacgattcgtattataggcattgatccaggattacggcgaacaggatggggggttatcgatttctctggcaatcgtcttcaatttgttgcagcgggtacgcttacttctgatgcacgttgtgatcttgcttctaggctctgccagctttacaaagggcttacagatattttgcatcagtttatgcctcaggaagccgccgtagaacatgtgttcgtcaacaaggatgctacggcaactttaaaacttggtcaagcacgggccattgcacttcttgctccagcgcaggcaaatttgcctgtttttgaatatgctccaaacaaagtgaaaaaatcagttattggagttggtcatggcgataaggaacaaattcacatgatggtgaaagttcttcttccacgtgctgaatttgatagcagtgatgccgctgatgcacttgcacttgctctttgtcacagtactcaccgtatcggcgcttcttatcatgcaaggattatggcatga

SEQ ID NO: 76625 - protein, 169 aa, Bartonella henselae str. Houston-1
MAETIRIIGIDPGLRRTGWGVIDFSGNRLQFVAAGTLTSDARCDLASRLCQLYKGLTDILHQFMPQEAAVEHVFVNKDATATLKLGQARAIALLAPAQANLPVFEYAPNKVKKSVIGVGHGDKEQIHMMVKVLLPRAEFDSSDAADALALALCHSTHRIGASYHARIMA

SEQ ID NO: 76626 - DNA, 576 bp, Acinetobacter sp. ADP1
  CDS (1)..(576): transl_table=11
atgggcaatattttatttttaaagtcttttatgccattaattattggaattgatccaggttcacgtttaacaggttatggaatcattgaaaaaaatggtaatgagctgcgttttatcgatgcaggcacaattcgtactgaaagtcaggacatgccagaacgattaaaacgaatttttgctggtgtggaacgaattgttaaatttcatggcccaacacaagccgcggtggaacaagtctttatggcacaaaaccccgactctgcacttaagctaggccaagccagaggtgctgcaattgcagctttggtcaatctggatctggaagtagccgaatatacagcaagacaaattaaacaatcggttgtgggttatggtgcagccgacaaagaacaggtgcagatgatggtaatgcgtatattaaatttaacgattaaaccacaatccgatgccgcagatgcacttgcagccgccatttgtcatgcacacgcttctggcagtatgagtaaaatggctgttttaaatgctttaggtggtatggcacgtggacgaagccgatccagtacccgtcgtcgctaa

SEQ ID NO: 76627 - protein, 191 aa, Acinetobacter sp. ADP1
MGNILFLKSFMPLIIGIDPGSRLTGYGIIEKNGNELRFIDAGTIRTESQDMPERLKRIFAGVERIVKFHGPTQAAVEQVFMAQNPDSALKLGQARGAAIAALVNLDLEVAEYTARQIKQSVVGYGAADKEQVQMMVMRILNLTIKPQSDAADALAAAICHAHASGSMSKMAVLNALGGMARGRSRSSTRRR

SEQ ID NO: 76628 - DNA, 513 bp, Erwinia carotovora subsp. atroseptica SCRI1043
  CDS (1)..(513)
atgacaatcatagtaggcatcgaccccggttcgcgcgtgacgggttatggcattatccgccagcaggggcggcatctgacgtatctcggcagcggttgtattcgcaccgtggtagatgatatgcccactcggcttaagctgatttacgctggcgtcagtgaaattattacgcaatttcagccagactgtatggcgatcgaacaggtcttcatggcgaaaaacccggattcagccttgaagctggggcaggcgcgcggtgtggccatcgtcgcgggtgtgaatcaggatctgcccgtgtttgagtatgcagcgcgtttggtcaagaaaacggtggtaggtacgggcgcagcagataaaaagcaggtacagcatatggttcgctcattgctgaaactgtcggccagtccgcaggcggatgctgccgatgcgttggcgattgcgattactcactgccactttaaccagagtctgctgcgtaccgcagcagtgaaagtaaacccgctggcaggatga

SEQ ID NO: 76629 - protein, 170 aa, Erwinia carotovora subsp. atroseptica SCRI1043
MTIIVGIDPGSRVTGYGIIRQQGRHLTYLGSGCIRTVVDDMPTRLKLIYAGVSEIITQFQPDCMAIEQVFMAKNPDSALKLGQARGVAIVAGVNQDLPVFEYAARLVKKTVVGTGAADKKQVQHMVRSLLKLSASPQADAADALAIAITHCHFNQSLLRTAAVKVNPLAG

SEQ ID NO: 76630 - DNA, 591 bp, Propionibacterium acnes KPA171202
  CDS (1)..(591): transl_table=11
gtgagcattccaaagtcgacccccgaccggcgtgttacaagggtcatgggggtcgaccctggtttaacccggtgcggggttggcgtcgttgaaggtgggttaggatcctccctgaagctcattgccgtgggcgtcattcgtactcctgccgacctcgatcatgcacaccgactactgcgcatccacgacgggctggaggagtggcgtgaccacacccgccccgatgccattgccgtcgagaaagtgtttgcccagcacaaccgcaatacggtagctggtaccgctcaggcagccggaatcgcgatgatgattgccgcccggcatggtcttccagttgctcttcacactccaagtgaggttaaagcggcaatctcgggttcaggacgagccgacaaagcccaggtgggtttcatggtggcacgggtgttgcggctctcggctcctcccaagcctgctgatgctgccgacgctgtcgccttggcgatctgccacctgtggcgtggcggggcggctcgtcgcattgaagctgctgtggctacgcaacgacgcggtcggcgtgtgccccgttcttggaaggacctagcccggtga

SEQ ID NO: 76631 - protein, 196 aa, Propionibacterium acnes KPA171202
MSIPKSTPDRRVTRVMGVDPGLTRCGVGVVEGGLGSSLKLIAVGVIRTPADLDHAHRLLRIHDGLEEWRDHTRPDAIAVEKVFAQHNRNTVAGTAQAAGIAMMIAARHGLPVALHTPSEVKAAISGSGRADKAQVGFMVARVLRLSAPPKPADAADAVALAICHLWRGGAARRIEAAVATQRRGRRVPRSWKDLAR

SEQ ID NO: 76632 - DNA, 627 bp, Leifsonia xyli subsp. xyli str. CTCB07
  CDS (1)..(627): transl_table=11
atgacgatccgggtgctcggcatcgaccccggtctcacccggtgcggtgtcggggtggtggatgtgcgtcgcgaccgccgcgcgaccctggtcgaggtgacggtcatccggaccccggcggagatgcccctcgaacagcggctgctcgccgtcggcgacgggatcgccgccctcctggacaggtacagcccggcggcggtcgccatcgagcgcgtcttcgcgcagcacaacctgcggacggtgataggtgtggcgcaggtgagcggcgtcgcgctgcacacggccgcgcagcgcggcctgcccgtcgccttgcacacgccgagcgaggtcaaggcagcgatcacgggctacggctcggcggacaagaagcaggtgcaggcgatggtcgcccgcgttctcgggctccccgaggcccccaagccggcggatgccgccgacgcgctcgccatcgcgatctgccatgcgtggcggggtgggctggccgctttgtccacgtccggagcggtgggagcggccggccccgcagccgtgcccggagcggcgctcacgcccgcccaggccgcgtggcgcgccgcggagcgctccaccgcccggacgtcgtccgctccccgtaggctggccaggtga

SEQ ID NO: 76633 - protein, 208 aa, Leifsonia xyli subsp. xyli str. CTCB07
MTIRVLGIDPGLTRCGVGVVDVRRDRRATLVEVTVIRTPAEMPLEQRLLAVGDGIAALLDRYSPAAVAIERVFAQHNLRTVIGVAQVSGVALHTAAQRGLPVALHTPSEVKAAITGYGSADKKQVQAMVARVLGLPEAPKPADAADALAIAICHAWRGGLAALSTSGAVGAAGPAAVPGAALTPAQAAWRAAERSTARTSSAPRRLAR

SEQ ID NO: 76634 - DNA, 501 bp, Symbiobacterium thermophilum IAM 14863
  CDS (1)..(501): transl_table=11
ttgcggattctcggcatcgaccccggcacggcaaggatgggctacggcatcgtggaggacgcgggcgcagggcgggagcgggcggtggagtacggctgcctggagaccccgcccgacatgcggccggagctcaggctgcaggcgctctaccgcggcctcgccgacctcatggcccggcaccggcccgacgccctggcggtggaggagctcttcttcgggcggaacgtgaccacggccatccacgtgggccaggcgcggggcgtggtgctgctggccgcggcggacagcggcgtgccggtccgggagttcacgccgatgcaggtgaagatggccgtcaccggctacggccgcgccaacaaggcgcaggtgcagcgcatggtccaggccctgctggggctgccggagatcccgaagccggacgacgcggccgacgccctggccgtcgccctggcgggcctgcacagcgagcggctcaccgcccggttgggaggtctgtcgtag

SEQ ID NO: 76635 - protein, 166 aa, Symbiobacterium thermophilum IAM 14863
MRILGIDPGTARMGYGIVEDAGAGRERAVEYGCLETPPDMRPELRLQALYRGLADLMARHRPDALAVEELFFGRNVTTAIHVGQARGVVLLAAADSGVPVREFTPMQVKMAVTGYGRANKAQVQRMVQALLGLPEIPKPDDAADALAVALAGLHSERLTARLGGLS

SEQ ID NO: 76636 - DNA, 600 bp, Mannheimia succiniciproducens MBEL55E
  CDS (1)..(600): transl_table=11
gtgttcgccctctttatttggagttttatggcgatcattttaggcattgaccccggctctcgggtaaccggctatggcattatccggcaaacggggcgaacgctggaatatttaggcagcggcgcaatacgtacgcaggttgaggatttacctacccggcttaagcgcatttatgcgggagtgacggaaattattactcaattccgtccggatatgtttgccattgaagaggtttttttagcgaagaatccgaactccgcactaaaactggggcaggcaagaggtaccgctattgttgctgcggtaaatcagaatttgccggtttttgaatatgccgcgcgcttggtcaagcaaaccgtaacgggcagcggttcggcggataaagttcaggtgcaggatatggttacccgtattttgcgtttatcggacaaaccgcaggcggatgcggcggatgcgctggcaattgccattactcatgcccatacgattcagcattctttgcaggtggctacgagtgccaagtcaacggaaaatcatgaaaaaacgaccgcacttttaagaacccggtacagcagagggcgttttcggttaaaaatttaa

SEQ ID NO: 76637 - protein, 199 aa, Mannheimia succiniciproducens MBEL55E
MFALFIWSFMAIILGIDPGSRVTGYGIIRQTGRTLEYLGSGAIRTQVEDLPTRLKRIYAGVTEIITQFRPDMFAIEEVFLAKNPNSALKLGQARGTAIVAAVNQNLPVFEYAARLVKQTVTGSGSADKVQVQDMVTRILRLSDKPQADAADALAIAITHAHTIQHSLQVATSAKSTENHEKTTALLRTRYSRGRFRLKI

SEQ ID NO: 76638 - DNA, 525 bp, Legionella pneumophila subsp. pneumophila str. Philadelphia 1
  CDS (1)..(525): transl_table=11
atgacgattatattagggatagatccaggctcacgggttacaggatatggattgattaaagaatctgaccgtaaaattgcgtacatcgatagcggctgtattcgcacatcaaacgatacggaattaagtcataaattattgcaaatatatgatggaatatgtgagctaatggatcactattccccaactgaggttgctattgagcagatatttatgcataacaatcctaattcagctttgaaattaggacatgcgcggggggttgccatggtagcagcagcctcacatcgtgcgaaaatctttgagtattcagcaagagaaataaagcaaagtgtagttggttatggggccgctgaaaaagatcaagtgagtcatatggttgtagagcttcttcagctcaatcgagctcctcaaaaagacgctgccgatgctttggcaatagcaatatgtcatagccatatgagaaatggtttgtcaaaattaatcggttcaagaggaacgaaacgcaggaggatgagactatga

SEQ ID NO: 76639 - protein, 174 aa, Legionella pneumophila subsp. pneumophila str. Philadelphia 1
MTIILGIDPGSRVTGYGLIKESDRKIAYIDSGCIRTSNDTELSHKLLQIYDGICELMDHYSPTEVAIEQIFMHNNPNSALKLGHARGVAMVAAASHRAKIFEYSAREIKQSVVGYGAAEKDQVSHMVVELLQLNRAPQKDAADALAIAICHSHMRNGLSKLIGSRGTKRRRMRL

SEQ ID NO: 76640 - DNA, 510 bp, Bacteroides fragilis YCH46
  CDS (1)..(510): transl_table=11
atgggatacggagtgctccgtgtttgcgggacaagacccgagatgatcgctatggggatcatcgatttgcggaagttcggcaatcattacctcaaacttcgtcatatccacgaacgggtgcttagtattatcgaaagttacttgcccgatgaactggcaattgaagctccttttttcgggaaaaacgtgcagtcgatgctgaagctcggacgtgctcagggagtagcgatggcggctgcgttgagccgtgatattcctattactgaatatgccccgctgaaaataaagatggccatcaccggcaacgggcaggcctctaaagaacaagtggcggatatgttgcaacgcatgctgcattttgccaaagaggatatgcctgtttttatggatgctaccgacggattggcagctgcttattgtcatttcctgcagatggggcgtccggtaatggagaaagggtatagcggttggaaagattttatagccaaaaatcccgaaagagtaaagtag

SEQ ID NO: 76641 - protein, 169 aa, Bacteroides fragilis YCH46
MGYGVLRVCGTRPEMIAMGIIDLRKFGNHYLKLRHIHERVLSIIESYLPDELAIEAPFFGKNVQSMLKLGRAQGVAMAAALSRDIPITEYAPLKIKMAITGNGQASKEQVADMLQRMLHFAKEDMPVFMDATDGLAAAYCHFLQMGRPVMEKGYSGWKDFIAKNPERVK

SEQ ID NO: 76642 - DNA, 543 bp, Burkholderia mallei ATCC 23344
  CDS (1)..(543): transl_table=11
atgcgaatcctcggcatcgaccccggcttgcgcgtcacgggcttcggcgtgatcgacgtcagcggccaccagctcgcgtacgtcgcgagcggcgtgatcaagacgcccaccgccgatctgcccacgcggctcggcacgatctacgacggcgtctcgacgctgatccgcgagcatacgcccgatcaggcggcgatcgagaaagtgttcgtcaacgtcaatccgcaatcgacgctgctcctcggccaagcgcgcggcgccgcgatctgcgggctcgtatcgggcggcctgcccgtcgccgagtacacggcgctgcagctcaagcaggcggtggtcggctacggccgcgcgacgaaagagcagatgcaggagatggtcgcccggctgctgagcctgtccgggcggcccggcaccgacgcggccgacgcgctcggcatggcgatctgccacgcgcacggcggcaacacgctgaacacgctcggcggcatcgcgcccgcgctcgcgaaaaaggggctgcgcgtgcggcgcgggcggctcgtcgggtaa

SEQ ID NO: 76643 - protein, 180 aa, Burkholderia mallei ATCC 23344
MRILGIDPGLRVTGFGVIDVSGHQLAYVASGVIKTPTADLPTRLGTIYDGVSTLIREHTPDQAAIEKVFVNVNPQSTLLLGQARGAAICGLVSGGLPVAEYTALQLKQAVVGYGRATKEQMQEMVARLLSLSGRPGTDAADALGMAICHAHGGNTLNTLGGIAPALAKKGLRVRRGRLVG

SEQ ID NO: 76644 - DNA, 498 bp, Methylococcus capsulatus str. Bath
  CDS (1)..(498): transl_table=11
atgacccgcgttctcggcatcgaccccggatcccgggtgacgggttacggcatcctggactggacgggcaaaccggtgttggtggcagcgggctgtatccgtaccgagacggacgattttcccgagcgcttgcgccggatcttcgaggggatcagccggatcgtggaggagtttcggccggaggaaatggcggtggagcaggtgttcatgcacaagaacgcggattcggcgctcaagctgggccaggcgcggggagccgcgatctgcgccggcgtggcgcacggtttgccggtgcacgagtatgcagcgcgccaggtgaagctcgctctggtcggcaagggcagtgccgacaaagcccaagtgcagcacatggtctgcttcctgctgggtcaggctggtcccttggcactggacgccagtgatgcgctgggggtggcattctgccatctgcaccatcgccagaccctgagccgcatgagccggatggttcggcgatga

SEQ ID NO: 76645 - protein, 165 aa, Methylococcus capsulatus str. Bath
MTRVLGIDPGSRVTGYGILDWTGKPVLVAAGCIRTETDDFPERLRRIFEGISRIVEEFRPEEMAVEQVFMHKNADSALKLGQARGAAICAGVAHGLPVHEYAARQVKLALVGKGSADKAQVQHMVCFLLGQAGPLALDASDALGVAFCHLHHRQTLSRMSRMVRR

SEQ ID NO: 76646 - DNA, 570 bp, Nocardia farcinica IFM 10152
  CDS (1)..(570): transl_table=11
gtgcgggtgatgggcgtcgaccccgggctcaccaggtgcggactcagcatggtcgagggcgggcacgggcgcaccgtcaccgcactggacgtcgacgtggtgcgcaccccggcggacatggacctggcgcatcggctgatgctggtcgccgacgccgccgagtactggatggacacccaccgcccgggcgcggtcgccatcgagcgcgtcttcgcccagcacaacgtccgcacggcgatgggcaccgcgcaggcgggcggggtgatcgcgctggccgcggcccgtcgcgacatcccggtggtgttccacacccccagcgaggtcaaggccgccgtcaccggcaacggcaacgcggacaaggcgcaggtgaccgcgatggtcacccgcatcctcgggttgcagaccgcgccgaaacccgccgacgcggcggatgcgctggccctggcgatctgtcattgttggcgggcgccgctgctggccaggatggccgcggccgaggccaaggcggccgaggccaagcggcgctacaccgaacgactggccgaacaacggaaggcggtgcgcgggtga

SEQ ID NO: 76647 - protein, 189 aa, Nocardia farcinica IFM 10152
MRVMGVDPGLTRCGLSMVEGGHGRTVTALDVDVVRTPADMDLAHRLMLVADAAEYWMDTHRPGAVAIERVFAQHNVRTAMGTAQAGGVIALAAARRDIPVVFHTPSEVKAAVTGNGNADKAQVTAMVTRILGLQTAPKPADAADALALAICHCWRAPLLARMAAAEAKAAEAKRRYTERLAEQRKAVRG

SEQ ID NO: 76648 - DNA, 522 bp, Photobacterium profundum SS9
  CDS (1)..(522): transl_table=11
atgacgattatcttaggtatagacccaggttctagaattactggttatggggttattcgtcaggttggtcgaaaccttgaataccttggtagtggctgtattagaacgtctgctgaagatattcctggtcgattaaagcaaatctatgcgggtgtttctgaagtgatcactcaattccaacctgatacgtttgcgattgaagaagtcttcatggggaagaatgccagttctgcgttaaaactggggcaagcacgaggcagtgcgattgtcgcagcggttaatgctgacttaccagtaagtgaatatgctgctcgtctaataaagcaggcagtggtaggtacgggtgccgcagataaagcccaagttcaacacatggtgtgttcggtgcttaaattgcccggtaaaccacaagcggatgctgccgatgcattagccgttgccatttgtcatgctcatacacataaaacattaattgctatgtctggtaaagcaagtagtgcccgtcgtggccgttatcgttaa

SEQ ID NO: 76649 - protein, 173 aa, Photobacterium profundum SS9
MTIILGIDPGSRITGYGVIRQVGRNLEYLGSGCIRTSAEDIPGRLKQIYAGVSEVITQFQPDTFAIEEVFMGKNASSALKLGQARGSAIVAAVNADLPVSEYAARLIKQAVVGTGAADKAQVQHMVCSVLKLPGKPQADAADALAVAICHAHTHKTLIAMSGKASSARRGRYR

SEQ ID NO: 76650 - DNA, 498 bp, Anaplasma marginale str. St. Maries
  CDS (1)..(498): transl_table=11
gtgatgatcattggtatagatcctgggcttgagtttactggctggggggtggtttctagtacaaattcccaatccgtgtgccttctagatagtggagtaatttccactaggggtattagtagagagagtgaaaagctatataaaatctacgtatcgcttctttcagttctgagtttatataaaatagacgaggcgtcgatcgagaaggtatttataaactcaaaccctagatcgtcaatgtcattatgctacgctagagccgcgtcgacaatttccgttatgtctagagggattgatatatatgaatattcctctactgccataaaaaaatgtataactggaaatggcatggccccaaaggagcaagtttcgtttatggtaaggagttcacttgggataaagcaagatgttgaaatcaataaccactcatcagatgcaatagccgccgctttatgccacgtatataatactagaaatagaaattttgctttaaaatag

SEQ ID NO: 76651 - protein, 165 aa, Anaplasma marginale str. St. Maries
MMIIGIDPGLEFTGWGVVSSTNSQSVCLLDSGVISTRGISRESEKLYKIYVSLLSVLSLYKIDEASIEKVFINSNPRSSMSLCYARAASTISVMSRGIDIYEYSSTAIKKCITGNGMAPKEQVSFMVRSSLGIKQDVEINNHSSDAIAAALCHVYNTRNRNFALK

SEQ ID NO: 76652 - DNA, 537 bp, Idiomarina loihiensis L2TR
  CDS (1)..(537): transl_table=11
gtggcgattattctgggtatcgacccgggttcgagactgaccggctacggcgttatagagcagcgagggcggcaactgaattaccttggtagtggttgtatcaaggttattggtaccactaaagagcctttaaccctggcggaaaagctgcgtcgcattcatgacagcgtcagtgaactcattactcagtttaagccgaacgaattcgcaatagagcaagtgttcatggcaaagaacccggattctgccttaaagcttgggcaggcgcgtggggcggctattgtggctgctgcttgtgcagagcttccggtagcggaatattcagcccgacaaatcaaacagtctgtagtgggtaatggtggtgcagaaaagtctcaggttcagcatatggttatggccttactgaatctgcagcgttgccctcaggaagatgccgcagatgcacttgccgttgccttatgtcatgctcacagttcacaaaacctgattaaaatggcaggcgccgcgcgtaaaactgtgcgagggcgtttgcgttaa

SEQ ID NO: 76653 - protein, 178 aa, Idiomarina loihiensis L2TR
MAIILGIDPGSRLTGYGVIEQRGRQLNYLGSGCIKVIGTTKEPLTLAEKLRRIHDSVSELITQFKPNEFAIEQVFMAKNPDSALKLGQARGAAIVAAACAELPVAEYSARQIKQSVVGNGGAEKSQVQHMVMALLNLQRCPQEDAADALAVALCHAHSSQNLIKMAGAARKTVRGRLR

SEQ ID NO: 76654 - DNA, 612 bp, Azoarcus sp. EbN1
  CDS (1)..(612): transl_table=11
gtgccagtgcctcgattccaccgccggtcctcgacgccccgtagaatgcgcggcatgaaaagcgcttccacggtcgttgccacccgcattctcggactcgatccggggctgcgcatcaccggcttcggcgtcatcgacaaactcggcaaccagctgcgctacgtcgcgagcggctgcatccgcacgcgcgacggcgaactgcccggacggctgaagacgctgctcgacggcgtgcgcgaagtcgtcgcggcctacacgcccgaccaggtcgcggtcgagaaagtgttcgtcaacgtcaatccgcaatcgacgctgctgctcggccaggcgcgcggcgcggtgatctgcggcgccgtgtcgtgcgacctgccggtgcatgaatacaccgcactgcaggtcaagcaggcggtcgtcggctacggcaaagcggccaaggagcaggtccagcacatggtgcagcggctgctcgcgctcgatggctgcccgagcccggacgccgccgacgcactcgcatgcgcgatctgccacgcgcacggcggccagggcacggcgggcgcattcgccgggcggcgccgcgccgggcgcatcctcgtcgcgccggaccccggctga

SEQ ID NO: 76655 - protein, 203 aa, Azoarcus sp. EbN1
MPVPRFHRRSSTPRRMRGMKSASTVVATRILGLDPGLRITGFGVIDKLGNQLRYVASGCIRTRDGELPGRLKTLLDGVREVVAAYTPDQVAVEKVFVNVNPQSTLLLGQARGAVICGAVSCDLPVHEYTALQVKQAVVGYGKAAKEQVQHMVQRLLALDGCPSPDAADALACAICHAHGGQGTAGAFAGRRRAGRILVAPDPG

SEQ ID NO: 76656 - DNA, 504 bp, Zymomonas mobilis subsp. mobilis ZM4
  CDS (1)..(504): transl_table=11
atgatttttctgggacttgaccccggtttgggaacaaccggctggggagcgattacagttgagggtaatcgtcttagtcatattgccaatggacaaatccgcaccgatccttccatggctttggcacggcggctagcgttattgcatgatgccttagccgccgtcattgccagccaccagccggaaatggcggcggttgaagaggttttgggcaatagcaatgcgcaatcaaccctgaaattggggcaggcgcgcggtattgccctgtttagccttgcagaagctgggctatccgtcggggaatatcacccgaatgtggttaaaaaggccgttgttggcaccggaagcgctgacaagaaacaggtgcaagcaatggtgtcccgtttgttacccggagtgaagttagcgggccctgatgcggcagatgccttggcggtggctattacgcatgcccatcatcatgcctctgcccgtggttatgcccgtcgcgtaagggcttcataa

SEQ ID NO: 76657 - protein, 167 aa, Zymomonas mobilis subsp. mobilis ZM4
MIFLGLDPGLGTTGWGAITVEGNRLSHIANGQIRTDPSMALARRLALLHDALAAVIASHQPEMAAVEEVLGNSNAQSTLKLGQARGIALFSLAEAGLSVGEYHPNVVKKAVVGTGSADKKQVQAMVSRLLPGVKLAGPDAADALAVAITHAHHHASARGYARRVRAS

SEQ ID NO: 76658 - DNA, 498 bp, Silicibacter pomeroyi DSS-3
  CDS (1)..(498): transl_table=11
atgcgcattctaggcatcgatcccgggctgagaacgctcggctggggcgtcatcgaacagcgcggcagccggctgtcgcatgtggccaatgggctgtgtcattccgacggcgacgacctgggcgagcggctgttgtcgctgcacaatcagatcgtcgaggtgatcgaagaataccggcccgatcaggccgcgatcgagcagacctttgtcaacaaggacggggcgggcacgctgaaactgggccaggcgcgcggcgtggcgctgctgacgctggcgcaggccgggctgccggtgggcgaatacgcccccaaccgggtcaagaagacggttgtgggcgtgggccatgccgaaaaggaacaggtcatccacatggtcaagctgcaattgccaggctgtctgcccaagggggcggatgcggccgacgcgctggccatcgccatctgccacgcctattacggaagcgcgcaggcgctgagccagagggaggtgcgggcatga

SEQ ID NO: 76659 - protein, 165 aa, Silicibacter pomeroyi DSS-3
MRILGIDPGLRTLGWGVIEQRGSRLSHVANGLCHSDGDDLGERLLSLHNQIVEVIEEYRPDQAAIEQTFVNKDGAGTLKLGQARGVALLTLAQAGLPVGEYAPNRVKKTVVGVGHAEKEQVIHMVKLQLPGCLPKGADAADALAIAICHAYYGSAQALSQREVRA

SEQ ID NO: 76660 - DNA, 537 bp, Francisella tularensis subsp. tularensis Schu 4
  CDS (1)..(537): transl_table=11
atggttataacaaagtattatatggttattttaggaatagatccaggctcaaggataacaggttttggggttataaaagtccaagataataaaatctattatgttgcaagtggctgtattcggataacagaaataactactccaaaaagactcaaacaaattgctgatggtataacacagattataaatatatacgcaccaactgaagctgcgattgaacaaatatttatgtttcagaaccctatgggagctattaagttaggacaagctagaggtgtagcaatgtgtacactagctattaataacctagaagttagcgaatattcagcaaaacaaattaaacaagctgtagtaggtactggaggagctgctaaatctcaggtccagcacatggttcagtctttgttaggtttgagcaaaaagcctccagaggatgctgcggatgctttagcaatagcaatatgccactaccatagtagcaaatcattggcaaaaatctctggagcaagtcgagtttcacaaaaaagaattaaatga

SEQ ID NO: 76661 - protein, 178 aa, Francisella tularensis subsp. tularensis Schu 4
MVITKYYMVILGIDPGSRITGFGVIKVQDNKIYYVASGCIRITEITTPKRLKQIADGITQIINIYAPTEAAIEQIFMFQNPMGAIKLGQARGVAMCTLAINNLEVSEYSAKQIKQAVVGTGGAAKSQVQHMVQSLLGLSKKPPEDAADALAIAICHYHSSKSLAKISGASRVSQKRIK

SEQ ID NO: 76662 - DNA, 486 bp, Synechococcus elongatus PCC 6301
  CDS (1)..(486): transl_table=11
gtgggtcagcgcattcttgggctcgatccggggttggcgatcgtggggttcggagcgctgctctgccctgactcacgccaaggcagtctggaactactggacttcggcgtcatttcaacgccggctggcgcagagattggcgatcgcctcgaaacgatctatcaggatctgcatcagctcattgatctggtgcagccggatgcagtcgccgtcgaaaagctgttcttctaccgcatgggcaacacgatcgcggttgcacaagcccgaggagtgctgatgttggttttacggcagcgccgcttgccttactgtgagttcacgccagcccaggtcaaacaagcccttacgggttatggtaatgcccccaagttagccgtccaacaagcggttcaacgggaattacagctagacgcaattccgcgtcctgatgacgcggccgatgccgtggcgctcgccttgaccgcttggtttcagcaactggcctag

SEQ ID NO: 76663 - protein, 161 aa, Synechococcus elongatus PCC 6301
MGQRILGLDPGLAIVGFGALLCPDSRQGSLELLDFGVISTPAGAEIGDRLETIYQDLHQLIDLVQPDAVAVEKLFFYRMGNTIAVAQARGVLMLVLRQRRLPYCEFTPAQVKQALTGYGNAPKLAVQQAVQRELQLDAIPRPDDAADAVALALTAWFQQLA

SEQ ID NO: 76664 - DNA, 483 bp, Campylobacter jejuni RM1221
  CDS (1)..(483): transl_table=11
atgaatttgaaaattttaggtatagatccaggttcaagaaattgcggttatgctatcatagaagccaacaaaggaaaaaacattctcatagaagcaggacttataaagataaagccaagtaccttacagtatcaaatcacagagctttgtgagggtttggacttgatttttaaaaatcattcttttgatgaggtggctatagaagatatcttttttgcttacaatccaaaaaccgttttaaaactcgcacaatttcgcggagccctatctttaaaaattcttcaaattcatggagattttgcagaatacactcccttacaagtaaaaaaagccgttacaggaaaagccaaagcaactaaagaacaagttgcttttatggtaaaaaggcttttaggacttagtaaagatatcaagcctttagacatcacagatgctatcgcagtggctttaactcatgcggcaaatttaagagttagggtgtga

SEQ ID NO: 76665 - protein, 160 aa, Campylobacter jejuni RM1221
MNLKILGIDPGSRNCGYAIIEANKGKNILIEAGLIKIKPSTLQYQITELCEGLDLIFKNHSFDEVAIEDIFFAYNPKTVLKLAQFRGALSLKILQIHGDFAEYTPLQVKKAVTGKAKATKEQVAFMVKRLLGLSKDIKPLDITDAIAVALTHAANLRVRV

SEQ ID NO: 76666 - DNA, 483 bp, Ehrlichia ruminantium str. Welgevonden
  CDS (1)..(483): transl_table=11
atgaacataataggtattgatccaagcttaaattccacaggatgggccatactgtctgtacatgataacaactataatgaaattcgtttggttgataacggttctatattaacaagcaacaagaaaaccattggtgaaaggctaaacaaaatatacagtgaattattgaacatacttaactcttacaaagtagatactgcatctatggaagaaatctttataaataaaaatccaaaatcttcaacattgctatgctatgccagaggtgtactactactaactttaaatgttgcttgtataccattatttgaatactcagcaaatcgtgtaaagaaatctattacaggaaatggacatgccaaaaaggaacaagtatgctttatgatcgaaaatatattaaatattaaatgccatggtacctatgatatatctgatgctatagcagtagctatatgtcacatctattccataaaagcattttga

SEQ ID NO: 76667 - protein, 160 aa, Ehrlichia ruminantium str. Welgevonden
MNIIGIDPSLNSTGWAILSVHDNNYNEIRLVDNGSILTSNKKTIGERLNKIYSELLNILNSYKVDTASMEEIFINKNPKSSTLLCYARGVLLLTLNVACIPLFEYSANRVKKSITGNGHAKKEQVCFMIENILNIKCHGTYDISDAIAVAICHIYSIKAF

SEQ ID NO: 76668 - DNA, 498 bp, Dehalococcoides ethenogenes 195
  CDS (1)..(498): transl_table=11
atgagaatattgggaatagaccccggcacaatggtagtgggatacggcgttattgaagccgcagatgatgagctgtcactgataggtttttccagccttaccccccctgccagcgcacccataccccagcgtctggcttacatatataaaggactggtagaagtgattgagctataccagccggacgaagtagcggtggaaagcccgtttgcagataaaaatatcaagagcgccctggccattggcaaagctcaggccgtagccctgcttgcggctgccaaccacagcctgtcagttaccgaatacagccccgcttgcataaaaagccgggtaagcggctcaggcactgcctccaaagaacagatacaggaaatggtgcgcctgctgttaaatctggctgaaataccccagcccaatgacgccgctgatgccctggcagtagctatctgccaccacagccacagggcttttgcaaatataacatcacagggagactga

SEQ ID NO: 76669 - protein, 165 aa, Dehalococcoides ethenogenes 195
MRILGIDPGTMVVGYGVIEAADDELSLIGFSSLTPPASAPIPQRLAYIYKGLVEVIELYQPDEVAVESPFADKNIKSALAIGKAQAVALLAAANHSLSVTEYSPACIKSRVSGSGTASKEQIQEMVRLLLNLAEIPQPNDAADALAVAICHHSHRAFANITSQGD

SEQ ID NO: 76670 - DNA, 507 bp, Rhodobacter sphaeroides 2.4.1
  CDS (1)..(507)
atgagggttctgggcatcgaccccggtctgcggaacatgggatggggggtgatcgacgtgtcgggcacgcgtctggctcatgtcgcaaacggaatctgccactccgattcgggcgatctggcgcatcggcttctgtcgctgcacggccagctgaccgatgtgctggcgcgctttcagcccgacacggcggccgtcgagcatacgttcgtcaacaaggacggtgtggcgacgctgaaactcgggcaagcgcgggggatcgcgctcctcgttccggcgcaggcggggctggcggtcggcgaatatgccccgaacgcggtgaagaagaccgtggtcggcgtgggccatgccgccaaggagcagatccagcacatggtgcggctgcatctgccgggcgttcaccttgcaggtcccgacgcggccgacgcgctcgcggtcgcgatctgccatgcgcaccatgtgcagtcctccggccggctcgaggccgcactggcgagggccgcgcgatga

SEQ ID NO: 76671 - protein, 168 aa, Rhodobacter sphaeroides 2.4.1
MRVLGIDPGLRNMGWGVIDVSGTRLAHVANGICHSDSGDLAHRLLSLHGQLTDVLARFQPDTAAVEHTFVNKDGVATLKLGQARGIALLVPAQAGLAVGEYAPNAVKKTVVGVGHAAKEQIQHMVRLHLPGVHLAGPDAADALAVAICHAHHVQSSGRLEAALARAAR

SEQ ID NO: 76672 - DNA, 501 bp, Magnetospirillum magnetotacticum MS-1
  CDS (1)..(501)
atgagaatcctggggctcgatccagggctgcgcaataccggctggggcatcatcgatgcggtcgataaccgtctgcgccatgtggccgacggggtgatccgtcccgatgcctccgccgccttgtccgagcgcctggtccagctccatgacgccatcatggccgtcatcgccgaatatggacccgacgaggcggcggtcgaggagaccttcgtcaatatgaaccccgccagcacgctgaaattgggtcaggcccgcggcgtggtgatgctggttcccgccaaggccgggctgccggtgggcgaatacgccgccaccttggtcaagcaatcggtggtggggacgggccgtgccgccaaggaacaggtgggcatgatggtcaagaccctgctgcccggctgcctggctgccacgcccgatgccgccgatgccctggccgtggccatctgtcacgcccatcaccgcggcacgcaacagcgtctggcaagggcggtggcgcgatga

SEQ ID NO: 76673 - protein, 166 aa, Magnetospirillum magnetotacticum MS-1
MRILGLDPGLRNTGWGIIDAVDNRLRHVADGVIRPDASAALSERLVQLHDAIMAVIAEYGPDEAAVEETFVNMNPASTLKLGQARGVVMLVPAKAGLPVGEYAATLVKQSVVGTGRAAKEQVGMMVKTLLPGCLAATPDAADALAVAICHAHHRGTQQRLARAVAR

SEQ ID NO: 76674 - DNA, 492 bp, Nostoc punctiforme PCC 73102
  CDS (1)..(492)
atggaaaaacgaattttaggattagatccaggactggcaactttagggtttggggtaattacctgcacacaaattgccaacaaggtgccagaaactacagtcaatatgctggatttcggggtaattaaaacgtcagcagatgtagaaatgggactgaggctatgtacgttgtttgatgatttacacactgtgatggaggaatttcaaccagatttagttgcgatcgagaaactattcttctatcggatgtcaagtacaattttggttgcacaggcgcggggtgtattaattttggtgttgggccagcgtcgtcttccttatgtagagtttactccggctcaaattaaacaagctttaacgggatatggcaatgcagataagttagatgtgcaagaggcggtagcacgggagttagatttagatgaaattcccaagccagatgatgctgctgatgctttggcagtggctttaacggcttcttatcagctgtaa

SEQ ID NO: 76675 - protein, 163 aa, Nostoc punctiforme PCC 73102
MEKRILGLDPGLATLGFGVITCTQIANKVPETTVNMLDFGVIKTSADVEMGLRLCTLFDDLHTVMEEFQPDLVAIEKLFFYRMSSTILVAQARGVLILVLGQRRLPYVEFTPAQIKQALTGYGNADKLDVQEAVARELDLDEIPKPDDAADALAVALTASYQL

SEQ ID NO: 76676 - DNA, 570 bp, Haemophilus somnus 129PT
  CDS (1)..(570)
atgtctattattttaggaatagatccgggatctcgagtaaccggatatggtgttgttcgtcaagttgggcataagctagaatatttgggaagtggtgttattcgtacctcaatagatgatttaccaactagattaaaacgaatttatgccggaataacagaaattattacgcaattcaatcccaatgaatttgccattgaacaggtttttatggcgaaaaatcctgattcagctctaaaattggggcaagcaagaggaactgcgatagttgccgcagtcaatcaaaatttacccgtatttgaatattcacctagaacgattaaacaaacggtcgttggaacaggtgcggctgaaaaatcacaagtacaggaaatggtggttcggttattacaactttccgataaaccgcaggttgatgcagcagatgcgttggcaattgccattacccatgcaaattctattcataactcattacagattgctaattctattgcaataaaaacaccggataaaataaccgcacttttacgcacgaaatatcgtaggggaaggttgaggttgaaaggctag

SEQ ID NO: 76677 - protein, 189 aa, Haemophilus somnus 129PT
MSIILGIDPGSRVTGYGVVRQVGHKLEYLGSGVIRTSIDDLPTRLKRIYAGITEIITQFNPNEFAIEQVFMAKNPDSALKLGQARGTAIVAAVNQNLPVFEYSPRTIKQTVVGTGAAEKSQVQEMVVRLLQLSDKPQVDAADALAIAITHANSIHNSLQIANSIAIKTPDKITALLRTKYRRGRLRLKG

SEQ ID NO: 76678 - DNA, 501 bp, Desulfovibrio desulfuricans G20
  CDS (1)..(501)
atgactacgcagggtataacggtgctgggcatagacccggggtcgagaacaacgggctggggtatcgtgcgcgaggtttccggcgtgctgacgctggtggattgcggtgcggtgcgcccccggggcgatgaattttctgacagactcggcgctatttatcacgggctgcatgaggtgattgcccggcatatgccggacgaagcatcggttgaaaatgtctttaccgccaaaaatgccgcttctgctcttaaactgggacaggcgcggggtgcggcagtggctgcctgcgctgcacatcacctgcctgtagcaagctatgctcccacagaaataaaaaaaacaattgtgggagtgggccgtgccgaaaaagagcaggtcagctttatggtggcccgcctgctgggcgtgaaaggcgactggggtccggatacgggcgacgcgctggccgcggccatctgtcatctgaatatgcgcagattgcgcaggctggccgcggggtaa

SEQ ID NO: 76679 - protein, 166 aa, Desulfovibrio desulfuricans G20
MTTQGITVLGIDPGSRTTGWGIVREVSGVLTLVDCGAVRPRGDEFSDRLGAIYHGLHEVIARHMPDEASVENVFTAKNAASALKLGQARGAAVAACAAHHLPVASYAPTEIKKTIVGVGRAEKEQVSFMVARLLGVKGDWGPDTGDALAAAICHLNMRRLRRLAAG

SEQ ID NO: 76680 - DNA, 579 bp, Actinobacillus pleuropneumoniae serovar 1 str. 4074
  CDS (1)..(579)
atgccgattattttaggaattgaccccggttcacgggttaccggttatggcgtaattcgccaaaccggacgccatttagaatatttaggaagcggtgctattcgcacttccgtcgatgatttaccgactcgcttaaaacgcatttatgcgggcgtaaccgaaatcatcactcaattccaccccgatatgtttgcaattgaacaggtgtttatggcgaaaaacgccgattccgccttaaaactcgggcaagctcgcggtacggcgattgtcgcggcggtaaatcacgacttaccggtgtttgaatatgccgcccgtttagtgaaacaaaccgtcaccggtatcggctcggcggataaaatccaagtgcaggatatggtcactcgaatgcttcaactttcttccaaaccgcaagccgatgccgccgatgcgcttgcgattgcgattacgcacgctcactcgatccaacattccttaatcgttgcgaagcagagcgaccaaaaagtcggtagcgacaaagaacaaatcctcgctttgatgaaaactcgttacagtcggggacgattccgtttaaaagggtaa

SEQ ID NO: 76681 - protein, 192 aa, Actinobacillus pleuropneumoniae serovar 1 str. 4074
MPIILGIDPGSRVTGYGVIRQTGRHLEYLGSGAIRTSVDDLPTRLKRIYAGVTEIITQFHPDMFAIEQVFMAKNADSALKLGQARGTAIVAAVNHDLPVFEYAARLVKQTVTGIGSADKIQVQDMVTRMLQLSSKPQADAADALAIAITHAHSIQHSLIVAKQSDQKVGSDKEQILALMKTRYSRGRFRLKG

SEQ ID NO: 76682 - DNA, 573 bp, Fusobacterium nucleatum subsp. vincentii ATCC 49256
  CDS (1)..(573): transl_table=11
atgcgcgttatagggatagatccaggtacagcaatagttggatatggaattatagattatgataaaaataaatattcaatagttgactatggtgttgtactcacttcaaaagatttaagcacagaagaaagattagagattgtatatagtgaaatagataaaattttaaagaaatataaacctgaatttatggcaatagaagatttattttattttaaaaataataagactgtaatttctgttgcacaagcaagaggtgttattttattggcaggtaaacaaaataatattgctatgtcaagttatactccacttcaagttaaaattggaattacaggttatggtaaagcagaaaaaaaacaggtacaacaaatggtacaaaaatttctaggactttctgagatacctaaacctgatgatgcagcagatgctttggccatttgtattactcatataaattcattgggttctaaattaagttttggaggtacaaatagcttgaagaaaatagtcattccatctgatgcaaataaaatatctcttgaagaatataagaatttattaaagaaataa

SEQ ID NO: 76683 - protein, 190 aa, Fusobacterium nucleatum subsp. vincentii ATCC 49256
MRVIGIDPGTAIVGYGIIDYDKNKYSIVDYGVVLTSKDLSTEERLEIVYSEIDKILKKYKPEFMAIEDLFYFKNNKTVISVAQARGVILLAGKQNNIAMSSYTPLQVKIGITGYGKAEKKQVQQMVQKFLGLSEIPKPDDAADALAICITHINSLGSKLSFGGTNSLKKIVIPSDANKISLEEYKNLLKK

SEQ ID NO: 76684 - DNA, 585 bp, Psychrobacter sp. 273-4
  CDS (1)..(585)
atggcaattattattgggattgatccaggttcacgcatgaccggctatggaatccttcaacaaacgggtgataagctcacctatattgattcaggtactattcgtaccgataccaaagagatgcctgaacgcctaaaacgtatttttaatggcttgacgcgtattactcagcatcatctaaaatatgcagatgagcctatttatacggcaattgaacaagtatttatggcagaaaaccctgattcagcgcttaagctggggcaagcacgtggtgcagccattgcagcgatggtagcactggatttggaagtctcagaatatactgctcgccaaataaaacaagccgtttgcggctatggcgcagcagcaaaagagcaagtacaagacatggtgtgccgcatactgactttggactttgtaccacaacaagatgcggcagacggtcttgcctgcgccatctgtcatgcgcactcaagccattcgatgaacaaacttatattaaacagtgccatgcgcgggcgcggtgcgtctaagaaaaaaggtcgctggcgtttaactgaagaagacttaggaaatttgcgttaa

SEQ ID NO: 76685 - protein, 194 aa, Psychrobacter sp. 273-4
MAIIIGIDPGSRMTGYGILQQTGDKLTYIDSGTIRTDTKEMPERLKRIFNGLTRITQHHLKYADEPIYTAIEQVFMAENPDSALKLGQARGAAIAAMVALDLEVSEYTARQIKQAVCGYGAAAKEQVQDMVCRILTLDFVPQQDAADGLACAICHAHSSHSMNKLILNSAMRGRGASKKKGRWRLTEEDLGNLR

SEQ ID NO: 76686 - DNA, 492 bp, Anabaena variabilis ATCC 29413
  CDS (1)..(492)
atggaaaagcgaattttaggattagacccaggactggcaattttaggatttggggcaattacttgtacaccaggcttaacccaactacaaagtacaaaagtcaatatcttggactttggagtcatcaaaacctcagcagatatcgagattgggcaacgcttgtgtaccttgttcgatgatttgcacacagtgattgataatttacaacctgatgtagtcgcaattgaaaaactgttcttctatcgtatgtcaagtacaattgttgtggcacaagctagaggtgtagtaatgttagccttagcacagcaccatttgccttatgtcgaatttacaccagcacaggttaagctagctttaacgggatatggcaacgctgataaatctgaagtgcaagaggcggtagcacgagagttagatttagccgaaattcctcagcctgatgatgctgctgatgctttggctgtagctttgacagcttggtatcaaatgtga

SEQ ID NO: 76687 - protein, 163 aa, Anabaena variabilis ATCC 29413
MEKRILGLDPGLAILGFGAITCTPGLTQLQSTKVNILDFGVIKTSADIEIGQRLCTLFDDLHTVIDNLQPDVVAIEKLFFYRMSSTIVVAQARGVVMLALAQHHLPYVEFTPAQVKLALTGYGNADKSEVQEAVARELDLAEIPQPDDAADALAVALTAWYQM

SEQ ID NO: 76688 - DNA, 546 bp, Ralstonia eutropha JMP134
  CDS (1)..(546)
atgcgtattctcggcatcgaccccggcctccgcaccaccggcttcggcgtcctggaaaagcacggcaacaagctttcctacatcgcctcgggcaccatcaaaagcaatggtgaaaccgacctgcccgcgcgcctgaagacactgttcgatggcatcagcgaggtagcccgcacgtacacaccggattgcgcagcgattgaaaaggtcttcgtcaacgtcaacccgcagtccacgctgctactaggtcaagcacgcggcgcggcaatctgcggcctggtcggccaaggcctgccggtgttcgaatacaccgccctgcaactgaaggtagccgtagtcggctatggccgcgccaacaaggaacaagtgcaggaaatggtcatgcgtctgctaagcctgccgggacggcccagcactgacgccgccgatgcattgggcgtcgcgatctgccacgccaatggcggcgacacgctcggcacgctgtcgggcctcgcccctgaactggtccgcaagggcatgcgcgtccgccgagggcgcctgatcggctga

SEQ ID NO: 76689 - protein, 181 aa, Ralstonia eutropha JMP134
MRILGIDPGLRTTGFGVLEKHGNKLSYIASGTIKSNGETDLPARLKTLFDGISEVARTYTPDCAAIEKVFVNVNPQSTLLLGQARGAAICGLVGQGLPVFEYTALQLKVAVVGYGRANKEQVQEMVMRLLSLPGRPSTDAADALGVAICHANGGDTLGTLSGLAPELVRKGMRVRRGRLIG

SEQ ID NO: 76690 - DNA, 543 bp, Methylobacillus flagellatus KT
  CDS (1)..(543)
atgacattccgcattctcggtatcgaccccggcctgcgcttgacaggcttcggtgtcattgagaaaaccggcgagaagcttgcctatgtggccagcggcaccatcaagaccacaaccggcaaaggcagcgaaatcgaagatttgcctacccgcctcaagatcatcctggatagcctggcggaagtgattgataactaccagccacaacaggcggcgatcgagaaggtatttgtcaacgtcaatccccagtctaccttgttgctgggtcaggcgcgtggtgcagccatcagcgccctggtattgcaaggcttgccgattgccgaatataccgcgctgcaggtcaagcagtcggtcgttggtcatggtcatgcggcgaaggaccaagtgcaggagatggtaaagcgtctgctgaacctgcctggcctgcctcggccggactcggcagatgcgctggcttgcgcgatttgccatgcacatggcgggcaaggcttgggtaaattggcaacggcaggattcagggtgaaaggtggcaggctgatatga

SEQ ID NO: 76691 - protein, 180 aa, Methylobacillus flagellatus KT
MTFRILGIDPGLRLTGFGVIEKTGEKLAYVASGTIKTTTGKGSEIEDLPTRLKIILDSLAEVIDNYQPQQAAIEKVFVNVNPQSTLLLGQARGAAISALVLQGLPIAEYTALQVKQSVVGHGHAAKDQVQEMVKRLLNLPGLPRPDSADALACAICHAHGGQGLGKLATAGFRVKGGRLI

SEQ ID NO: 76692 - DNA, 489 bp, Crocosphaera watsonii WH 8501
  CDS (1)..(489)
atgtctcagcaaaattggttaggaattgatccaggactcgcaatagttggctgggcaatgttacaagaaaatgagcaagaacttcctctgattattgattatggaaccattgaaaccaataaacagttatctacttcccaaagactggtagaaatagaaacagatttaagtgaattattgagagaatttaagccccaaggtattgccatagaaatgcccttttttaaccgtacaattaaagcagcaggaggagttatgcaagctttaggagtaattaatttagtttgttatcgagattcaaaaattgaagcaatttttctccatcaagccagttggaaatgtcatttaggggacggaaaagctaacaaaaaagaagttgcagaaatggtcgcaactttgtttgatttagagacattaccaatagatgatagtgtagatgcgatcgccattgcctacgcaggattatgtggtttgagaaacaatatctaa

SEQ ID NO: 76693 - protein, 162 aa, Crocosphaera watsonii WH 8501
MSQQNWLGIDPGLAIVGWAMLQENEQELPLIIDYGTIETNKQLSTSQRLVEIETDLSELLREFKPQGIAIEMPFFNRTIKAAGGVMQALGVINLVCYRDSKIEAIFLHQASWKCHLGDGKANKKEVAEMVATLFDLETLPIDDSVDAIAIAYAGLCGLRNNI

SEQ ID NO: 76694 - DNA, 540 bp, Rubrobacter xylanophilus DSM 9941
  CDS (1)..(540)
atgctcggctcccaaacaaagcaggtcatcctcgggatagaccccggcaccgccaccatgggctggggggtggtgcggcaggaggggagccggctgcgctacgtgcagcacggggcgatcaccaccccctccgggtgggggatgccgcgccggctcgaccgcctcttcgccggtgtgaccgagctgatccgggggtataggccctcggcggtggcggtggaggagctcttcttcaacaccaacgtcaccaccgccatcaccgtcggccaggcacgcggggtcgcgctgctcgccgcctaccgggccggggtggaggtcttcgagtacaccccgttgcaggtcaagcaggccatcacctcctacggccgggcggacaagcggcaggtgcaggagatggtgcgcgcgctgctgggcctgcggtccatcccccggccggatgatgccgccgacgggctcgccatcgccatctgccacgccttctcccaccggatgtcggcggcgacgggggtgggtaaaccgcgggccatgcaggataattga

SEQ ID NO: 76695 - protein, 179 aa, Rubrobacter xylanophilus DSM 9941
MLGSQTKQVILGIDPGTATMGWGVVRQEGSRLRYVQHGAITTPSGWGMPRRLDRLFAGVTELIRGYRPSAVAVEELFFNTNVTTAITVGQARGVALLAAYRAGVEVFEYTPLQVKQAITSYGRADKRQVQEMVRALLGLRSIPRPDDAADGLAIAICHAFSHRMSAATGVGKPRAMQDN

SEQ ID NO: 76696 - DNA, 516 bp, Mesorhizobium sp. BNC1
  CDS (1)..(516)
atgacaggtacgattcgcatcattggcatcgatccggggctccggcgcaccggttgggccgtcatcgaaacggtcggcaattcgctccgcttcatcggtgcgggtacggtgcgctcaaacgataaggcggatctcgcctcccgcctctgccagcttcatgacgggctggccgaaattcttcaccttcacatgccgcaggaagcggcggtcgaagctacattcgtcaacaaggacgccgtggcgacgctcaagctcggccaggcgcgcggcatcgccatgctcgtgccggcgcgcgcggggctgcgcgttgcagaatatgcgcccaacgcagtgaaaaaggcggtgatcggcgtcggccatggcgagaagcggcagatccacatgatggtgaaggtgctcatgcccaaggctctcttcgatggcgacgatgcggcagatgccatcgcggtcgcgatctgccatgcgcatcaccggcagtcgcccgcttggcgacttgctctggaggctcagccatga

SEQ ID NO: 76697 - protein, 171 aa, Mesorhizobium sp. BNC1
MTGTIRIIGIDPGLRRTGWAVIETVGNSLRFIGAGTVRSNDKADLASRLCQLHDGLAEILHLHMPQEAAVEATFVNKDAVATLKLGQARGIAMLVPARAGLRVAEYAPNAVKKAVIGVGHGEKRQIHMMVKVLMPKALFDGDDAADAIAVAICHAHHRQSPAWRLALEAQP

SEQ ID NO: 76698 - DNA, 540 bp, Dechloromonas aromatica RCB
  CDS (1)..(540)
atgagcatcacgaccccccgtatccttggcatcgaccccggcctgcgggtgaccggctttggtgtcatcgaactgcacggcaagcaactggtgtacgtcgccagtggctgcatcaagtcgaacgacaaggagtcgctgccggagcggatcaagacccttttcgccggcatcagcgaagtcatcgcgacctatcagccgaatcaggcggcagtggaaaaggtcttcgtcaacgtcaatccgcaatcgaccttgttgctcggtcaggcgcgtggcgcggcaatcagcgcgctggttcatgccgatttgccggtcgccgaatacacggcgctgcaaaccaagcaggccgtggtcggccatggcaaggcggccaaggatcaggtgcaggccatggtcgtccggctgttgaacctgcccggcgcgccaactgccgacgcggccgatgccctcgcttgcgccattgcccatgcccatggcggccaaggtttgggcgccatggcgacggccggctatcgcattcgcggcgggcgactgataggatga

SEQ ID NO: 76699 - protein, 179 aa, Dechloromonas aromatica RCB
MSITTPRILGIDPGLRVTGFGVIELHGKQLVYVASGCIKSNDKESLPERIKTLFAGISEVIATYQPNQAAVEKVFVNVNPQSTLLLGQARGAAISALVHADLPVAEYTALQTKQAVVGHGKAAKDQVQAMVVRLLNLPGAPTADAADALACAIAHAHGGQGLGAMATAGYRIRGGRLIG

SEQ ID NO: 76700 - DNA, 471 bp, Ehrlichia canis str. Jake
  CDS (1)..(471)
atgaatgtaataggtctagatcctggtttgaaccatacaggctggggcatattatctattgaaaaagatataaagttaataggcaatggtgttatcaaaacaaacaataaagaaacccctggtcaaaggttaaataaaatacataaagaacttataaatatacttaactcatatcaaataaacagtgcatctatggaagaagtatttataaataagaaccctaggtcttcaatatcattatgttatgcaaggggtgttttgttattgactttaaatgctatgaatatacaagtttttgaatattcatcaaattatgtaaagaaatctattacaggaaatggacatgcaaagaaagaacaagttcattttatggtagagaaaattttaaatgttgagtttaaaggtacttatgatatatctgatgcaatagccgttgcactttgtcatgcttactcaaagaataatttttga

SEQ ID NO: 76701 - protein, 156 aa, Ehrlichia canis str. Jake
MNVIGLDPGLNHTGWGILSIEKDIKLIGNGVIKTNNKETPGQRLNKIHKELINILNSYQINSASMEEVFINKNPRSSISLCYARGVLLLTLNAMNIQVFEYSSNYVKKSITGNGHAKKEQVHFMVEKILNVEFKGTYDISDAIAVALCHAYSKNNF

SEQ ID NO: 76702 - DNA, 543 bp, Burkholderia cepacia R18194
  CDS (1)..(543)
atgcgaattctcggcatcgaccccggcctgcgcgtcaccggcttcggcatcatcgacgtcagcggccaccggctcgcgtatgttgcgagcggcgtgatccgcacgccgaccgccgacctggccacccggctcggtacgatcttccagggcgtctcgaccatcgtgcgcgagcacgcccccgaccagtccgcgatcgaaaaggtgttcgtcaacgtgaacccgcagtcgacgctgctgctcggccaggcgcgcggcgccgcgatctgcggcctcgtcgcgggcggcctgcccgttgccgaatacacggcgctgcagctcaagcaggcggtggtcggctacggccgcgcgaccaagacgcagatgcaggaaatggtcacgcgcctgctcaatctctccggacaaccgggctccgacgcggccgatgcactcggcatggcgatctgccacgcgcacggcggcaacacgctcagcacgctcggcggcctcgcgccggcgctcgcgaagaaagggctgcgcgtgcggcgcgggcggctggtcggctga

SEQ ID NO: 76703 - protein, 180 aa, Burkholderia cepacia R18194
MRILGIDPGLRVTGFGIIDVSGHRLAYVASGVIRTPTADLATRLGTIFQGVSTIVREHAPDQSAIEKVFVNVNPQSTLLLGQARGAAICGLVAGGLPVAEYTALQLKQAVVGYGRATKTQMQEMVTRLLNLSGQPGSDAADALGMAICHAHGGNTLSTLGGLAPALAKKGLRVRRGRLVG

SEQ ID NO: 76704 - DNA, 555 bp, Rubrivivax gelatinosus PM1
  CDS (1)..(555)
atggcgacacggatcctcggcatcgatccagggctgcgcaccaccggattcggcgtggtcgagtgcgaggggtcgcggctgcactacatcgccagcggcacggtgcgcaccgacgcgctgccgaacggcgacctgccagggcggctgaagatcatcttcgagggtgtgcgcgaggtcgcggcgcgctaccagccggactgcgccgcggtcgagatcgtgttcgtcaacgtcaatccgcaatcgacgctgttgctcggtcaggcccggggcgcggcactggcggcgctggtgtcgggcgatctggccgtggccgagtacaccgcgttgcagatgaagaaggcgatcgtcggccacggccacgcccgcaaggagcaggtgcaggccatggtggcgcggctgctgtcgctgcccggtgagccgagccgggacgcagccgatgcgctcggcctcgcggtctgccatgcgcacgcgggcgcgtcgcaggcggcgatcgccgccgtcagcccgctggcgcggcgcgcccatgcgcaataccgcaagggccgcagctattga

SEQ ID NO: 76705 - protein, 184 aa, Rubrivivax gelatinosus PM1
MATRILGIDPGLRTTGFGVVECEGSRLHYIASGTVRTDALPNGDLPGRLKIIFEGVREVAARYQPDCAAVEIVFVNVNPQSTLLLGQARGAALAALVSGDLAVAEYTALQMKKAIVGHGHARKEQVQAMVARLLSLPGEPSRDAADALGLAVCHAHAGASQAAIAAVSPLARRAHAQYRKGRSY

SEQ ID NO: 76706 - DNA, 528 bp, Pseudomonas fluorescens PfO-1
  CDS (1)..(528)
atgactttaattcttggtatcgaccccggttcgcgcattaccggttacggcattgttcgcgataccggacgcggcggttgcatctacgtcgcctcgggttgtatccgcactggtgccggcgagctgcatgagcggttgcagattgtctaccgcggcgtgcgggaaatcatccagacctacggcccggtcaccatgggcatcgaaaaggtgttcatggcgaaaaacgctgattcggcgctcaagctcgggcaggcccgtggggccgctatcgttgccggcgccgaagaaagcctggagatcgccgagtacacggccactcaggtcaagcaggctgtggtgggaaccggtgctgccaataaagagcaggtgcagatgatggtcatgcacatgctcaagctgaccagcaaaccgcaaatcgacgcatcggatgccctggcgattgccatttgtcacgcccacacccgctccagtctgttgccgcatggcttgggaactgcacgcagtcgtggcgggcgtctgcgtctctga

SEQ ID NO: 76707 - protein, 175 aa, Pseudomonas fluorescens PfO-1
MTLILGIDPGSRITGYGIVRDTGRGGCIYVASGCIRTGAGELHERLQIVYRGVREIIQTYGPVTMGIEKVFMAKNADSALKLGQARGAAIVAGAEESLEIAEYTATQVKQAVVGTGAANKEQVQMMVMHMLKLTSKPQIDASDALAIAICHAHTRSSLLPHGLGTARSRGGRLRL

SEQ ID NO: 76708 - DNA, 510 bp, Rhodospirillum rubrum
  CDS (1)..(510)
atgagactcctggggctggatcccggtctgcggattaccggctggggggtgatcgaggtgacgggcaaccgcatcggccatgtggccgatggggtggtgcggtccgacgatcgcctgtccctggccgcccggctggcccagctccatggcgggatcgtcgccgtgctcaaagcctatgagccggtggaggccgccgtcgaggaaaccttcgtcaaccgcaatccggcctcgaccctcaagcttggtcaggcgcgcggcgcggtgatgctggcgccggccctggccggcctcgtcgtggccgaataccagccaagtgtcgtcaagaaggcggtggtcggtaccggcggagcggccaaggatcaggtggggatgatgatccgcaccctgttgcccggcgccaccttggaaaccgctgatgccgccgatgccttggccatcgccatctgtcatgcccattaccgggcgggggcgctgtccctggccctggcccgcgccggaggggggcgatga

SEQ ID NO: 76709 - protein, 169 aa, Rhodospirillum rubrum
MRLLGLDPGLRITGWGVIEVTGNRIGHVADGVVRSDDRLSLAARLAQLHGGIVAVLKAYEPVEAAVEETFVNRNPASTLKLGQARGAVMLAPALAGLVVAEYQPSVVKKAVVGTGGAAKDQVGMMIRTLLPGATLETADAADALAIAICHAHYRAGALSLALARAGGGR

SEQ ID NO: 76710 - DNA, 543 bp, Burkholderia fungorum LB400
  CDS (1)..(543)
atgagaattctcggcatcgaccccggcctgcgcgtgaccggcttcggcgtgatcgaccaaagcggccacacgctcagctatgtcgcgagcggcgtcatcaaaaccgccgacgccgatctgccctcgcgtctgggcaccatcttcgaaggcatctccacactgatccgccagcattcgccggatcagtcggcgatcgaaaaagtgttcgtcaacgtcaaccctcagtccaccttgctgctcggtcaggcacgcggcgcggccatctgcggactggtcgcgggcggcgtgccggtcgccgaatacaccgccctccaattgaagcaggccgtggtgggttacggccgcgccaccaaggagcagatgcagcagatggtcgtgcgcctgctcaatctctccggcgtacccggcaccgacgccgccgacgcgcttggcatggcgatctgccacgcgcacggcggcacgacgctgagcacgttgggcggcatcgcaccctcgctggcaaagaaaggtttgcgcgtgagacgcggacgcctggtcggatag

SEQ ID NO: 76711 - protein, 180 aa, Burkholderia fungorum LB400
MRILGIDPGLRVTGFGVIDQSGHTLSYVASGVIKTADADLPSRLGTIFEGISTLIRQHSPDQSAIEKVFVNVNPQSTLLLGQARGAAICGLVAGGVPVAEYTALQLKQAVVGYGRATKEQMQQMVVRLLNLSGVPGTDAADALGMAICHAHGGTTLSTLGGIAPSLAKKGLRVRRGRLVG

SEQ ID NO: 76712 - DNA, 543 bp, Magnetococcus sp. MC-1
  CDS (1)..(543)
atgagctccgcaagccccatccgtgtcattggtattgacccaggcagtaatgtcaccggatggggcgtcattgatggcttaggccagcgtcagcaggtggtggagtatggcaccatccgccttgatggcaaggagcccttacccatgcgcctgcatcaaatccacgcccagttggtcagccttatccagcgcctgcaaccccatgaaatggcggtggaggaggtgttcgtttcgcaaaacgtacagagcgcgctcaagcttggccatgcgcggggggccgccattgtggccggtgcgcagatgggtctgcccattgcggagtataccgccatgcaggtcaaaaaagcggtggtgggttatggccgggccgagaaaaaccagatgcaggagatgatgcgcatgctgcttaatctggataaaaagccggcgcaggatgccgccgatggtcttgccattgccatgtgccaccttaaccaacggcaatggcatcagcagacgctgccagcggcgatccttggtctacagcggggggggcgtgcatga

SEQ ID NO: 76713 - protein, 180 aa, Magnetococcus sp. MC-1
MSSASPIRVIGIDPGSNVTGWGVIDGLGQRQQVVEYGTIRLDGKEPLPMRLHQIHAQLVSLIQRLQPHEMAVEEVFVSQNVQSALKLGHARGAAIVAGAQMGLPIAEYTAMQVKKAVVGYGRAEKNQMQEMMRMLLNLDKKPAQDAADGLAIAMCHLNQRQWHQQTLPAAILGLQRGGRA

SEQ ID NO: 76714 - DNA, 549 bp, Thermobifida fusca
  CDS (1)..(549)
atgcgcgtactgggaatcgatccggggctgacccgctgcggcataggcgtggtcgacggggctgtcggcgcccccctcaccatggtcgctgcgggggcagttcgcactctggccgacgaggaactccctgcccgcctcctggggatcgaaaaagggatcgagcagtggctcgatgactaccagcccgacgccgtggccgtggaacgggtcttcgcccagcacaacgtccgcacggtcatgggaaccgcccaggccagcgcaatcgccgtggtctgcgccgcccgccggggcctgcctgtctccctgcacacccccagcgaggtcaaagccgccatcaccggcagcggacgcgcagacaaagcccaggtcggcaccatggtggcgcgtatcctgcggctcgacagcccgccccggcccgccgacgccgcggacgcggtggccctggccatctgctacctgtggcgcggcagtgcccaggagcggattgcacgcgcccgccagaagttcgcccgcaccatcgagctcgcccggcaacggcacggactgtga

SEQ ID NO: 76715 - protein, 182 aa, Thermobifida fusca
MRVLGIDPGLTRCGIGVVDGAVGAPLTMVAAGAVRTLADEELPARLLGIEKGIEQWLDDYQPDAVAVERVFAQHNVRTVMGTAQASAIAVVCAARRGLPVSLHTPSEVKAAITGSGRADKAQVGTMVARILRLDSPPRPADAADAVALAICYLWRGSAQERIARARQKFARTIELARQRHGL

SEQ ID NO: 76716 - DNA, 495 bp, Geobacter metallireducens GS-15
  CDS (1)..(495)
atgagagttctcggcattgaccccgggtcgcgcatcaccggctacggcatcatagaaaaggtcggcaaccgcctcgtccatgtggacaacggcgccatccataccgataaccacaaggagttcgcgctccgcctccacaggatattcgaaggactctgcgaggttatcgcagaataccgtcccgacgccatggccgtggagcaggtgttcctcgcccacaacgcccagagcgccctgaagctggggcaggcccggggggccgccatcgtggccggggtgaacgcggggctcccggtcagcgagtacacggccatgcaggtcaaacaggcggttgtcggctacggccatgcccgcaaggagcaggtgcagcagatggtcaagtccctccttaaccttcctgagatcgcccaggccgacgcctccgacgcattggccgtggcggtctgtcacgccaattcggccggcatgaaaaacatcctccggagcatcagatga

SEQ ID NO: 76717 - protein, 164 aa, Geobacter metallireducens GS-15
MRVLGIDPGSRITGYGIIEKVGNRLVHVDNGAIHTDNHKEFALRLHRIFEGLCEVIAEYRPDAMAVEQVFLAHNAQSALKLGQARGAAIVAGVNAGLPVSEYTAMQVKQAVVGYGHARKEQVQQMVKSLLNLPEIAQADASDALAVAVCHANSAGMKNILRSIR

SEQ ID NO: 76718 - DNA, 477 bp, Novosphingobium aromaticivorans DSM 12444
  CDS (1)..(477)
atgatcatcctcggcatcgaccccggcctcaccgtcaccggctggggcgtcgtcgccaagtcgggcagccggttgagccacgtggccaacggccagatccgcactgacaacaaggccacgatggccgagcgcctcgtcgaactcgattccgcgctcgccgccgtgatcgacatctacaagcccgataccggcgcggtcgaagaggtcttcgtcaacgtcaatccgcagtccacgctgaagctggggcaggcacgcggcgtggcgatggtcgccgtggcgcgctccggcattccggtggcggaatatccgaccaaggtcatcaagaaggcgctggtcgggacgggcggcgccgaaaagcagcagatccagcacatgctcaagatcctgctccccggcgttcaactggcgggcgaggatgcctccgacgcattggccgtggcgattacccacgccaacatgctgggcagccatcgatag

SEQ ID NO: 76719 - protein, 158 aa, Novosphingobium aromaticivorans DSM 12444
MIILGIDPGLTVTGWGVVAKSGSRLSHVANGQIRTDNKATMAERLVELDSALAAVIDIYKPDTGAVEEVFVNVNPQSTLKLGQARGVAMVAVARSGIPVAEYPTKVIKKALVGTGGAEKQQIQHMLKILLPGVQLAGEDASDALAVAITHANMLGSHR

SEQ ID NO: 76720 - DNA, 603 bp, Cytophaga hutchinsonii
  CDS (1)..(603)
atggtcaacaaaaattctcccaaaacaattgatcggatcattctcggtgtagaccccggaacgaatgtgatgggttatggacttattgctattaaaggaactcaattgacattgattcaatttggtgttattcatttgagcaaatacacggaccatgcaataaagttaagtaaaatctttgagaggataagccttctgatcgaagagtatcatcccgatgaaatggccattgaagctcctttcttcggctcaaatgtgcaatccatgttaaagcttgggcgtgcacagggtgtagcaattgccgcagctatttcaaagcaggttcctatttttgaatatgcaccaaaaaaaataaaacaatcggtaaccggcagcggaaatgcttcaaaagagcaggtagcagccatgctttctaaaattttattttttcaggagatccctaaattgcttgatgcaacggatgccctcggcgttgccgtatgccattacttccaaaagggtgatgttaaaaaaagtaaaggcggatggaataatttcattaaagagaatcccgacaaagtaaaaactgtacctgccaaaataagtaaaaaaaaaactgactaa

SEQ ID NO: 76721 - protein, 200 aa, Cytophaga hutchinsonii
MVNKNSPKTIDRIILGVDPGTNVMGYGLIAIKGTQLTLIQFGVIHLSKYTDHAIKLSKIFERISLLIEEYHPDEMAIEAPFFGSNVQSMLKLGRAQGVAIAAAISKQVPIFEYAPKKIKQSVTGSGNASKEQVAAMLSKILFFQEIPKLLDATDALGVAVCHYFQKGDVKKSKGGWNNFIKENPDKVKTVPAKISKKKTD

SEQ ID NO: 76722 - DNA, 489 bp, Clostridium thermocellum ATCC 27405
  CDS (1)..(489)
atgattataatgggaattgaccccggatttgcaattgccgggtatggtatagtaaaatatgaaggaaacaagtttacttccgtagattatggcgcaattaccactgaaagctcaatggagcttccaaaaaggcttttggttttatacaacggtttgaaggaaattattgagaagtacagacctgaggcaatagctgtagaagagctttttttcaataaaaatataaaaacggctcttgccgtggggcatggaagaggtgttgcggttttggcggccgctcaatcgggaattgatgtttttgaatacactcccattcaggtaaaacagtcaatagtgggatacggaagggcggaaaaaacacaggtacagcagatggtaaaagcaatacttaatcttccggctatccctaagccggatgatgtggcggacgcactggctgtggcggtatgtcatgcccattcctataaaatgataagctatggactgtga

SEQ ID NO: 76723 - protein, 162 aa, Clostridium thermocellum ATCC 27405
MIIMGIDPGFAIAGYGIVKYEGNKFTSVDYGAITTESSMELPKRLLVLYNGLKEIIEKYRPEAIAVEELFFNKNIKTALAVGHGRGVAVLAAAQSGIDVFEYTPIQVKQSIVGYGRAEKTQVQQMVKAILNLPAIPKPDDVADALAVAVCHAHSYKMISYGL

SEQ ID NO: 76724 - DNA, 522 bp, Microbulbifer degradans 2-40
  CDS (1)..(522)
atggcgatagtgctaggcgttgacccaggctcattgaaaacgggctttgggttagtaaatcacgtatctgggcggtgtgaatatatcgctagtggtgtgatccgtatgaaatctagcgatgagctccctgagcgcctaaaaacgatatttgaatcgctagtagaaatcattgaatgctatcagccatctgaatttgcgatagagaaagtatttatggcaaaaagtgcgggctcagcactcaagctggggcaagcgcgcggtgcagcgatagttgctgccgtaactaacggtttgcctgtgggggaatacgaagcgcgaaaggtcaagcaatcggttgttgggtcgggagcggcggataaatcgcaggttcagcatatggtacgcacacttttacatcttactgctaccccacaagaggacgccgcggacgcattggcgattgcattgtgccatatcaatactcaagcaagcctaattagattggcgggttcgcgtcagtttaggcgtggccgtttggtttaa

SEQ ID NO: 76725 - protein, 173 aa, Microbulbifer degradans 2-40
MAIVLGVDPGSLKTGFGLVNHVSGRCEYIASGVIRMKSSDELPERLKTIFESLVEIIECYQPSEFAIEKVFMAKSAGSALKLGQARGAAIVAAVTNGLPVGEYEARKVKQSVVGSGAADKSQVQHMVRTLLHLTATPQEDAADALAIALCHINTQASLIRLAGSRQFRRGRLV

SEQ ID NO: 76726 - DNA, 492 bp, Trichodesmium erythraeum IMS101
  CDS (1)..(492)
atggaaaaattaattctcggattagatccaggtttagcggtactaggatttggattaattaagtgtatttataattcaaaaacagaaaaaatagattctacttctctggttgattttggggtaattaaaactacaaaaaaacaagaaatggggcaacgtctcgtcacaatatatgaagatttacatactatcctaaataactttaaaccagacttggcagctacagaaaagttattcttttatcgtatgggtaatacaattttagttgcccaagctagaggaattttaatattggcattagcacaaaatgaaattccattaattgagtttacacccgcacaaattaagcaagcagtaacaggttatggcaatgcagataaatatgatgtgcaacaagcagtagcaagggaattaaatttggaggaaattcctaaaccagatgatgctgctgatgctttagcagttgctctaacagcaagttggttaaattaa

SEQ ID NO: 76727 - protein, 163 aa, Trichodesmium erythraeum IMS101
MEKLILGLDPGLAVLGFGLIKCIYNSKTEKIDSTSLVDFGVIKTTKKQEMGQRLVTIYEDLHTILNNFKPDLAATEKLFFYRMGNTILVAQARGILILALAQNEIPLIEFTPAQIKQAVTGYGNADKYDVQQAVARELNLEEIPKPDDAADALAVALTASWLN

SEQ ID NO: 76728 - DNA, 504 bp, Moorella thermoacetica ATCC 39073
  CDS (1)..(504)
atgctgatcctgggaatagacccggggacggcgattgtcggttacggcctggtggaggcccgggctggacaaacccgcgccctggtatacgattgtatccggacaccggcgggggaggatccctgccggcggctggcaaccatttacgccggcataagggagctaatcgagcgcttgcagccagaaaccatggccgtggaagaactcttctttaacaaaaacagcaagacagccctagccgttggccaggccaggggcgtgatccttctggccgcggcccataccggtctgccggtggccgagtatacccccctggaggtcaagcaggcagtggccggtttcggccgggcgcccaaggaacaggtccagcgtatggtccaggctttgctgggcctggaagaaaaaccccggccagatgatgtggccgatgccctggcggtagccgtatgtcatgccagcttcgcgccctggcggcaaagggaaaaggaggtggctggccgttga

SEQ ID NO: 76729 - protein, 167 aa, Moorella thermoacetica ATCC 39073
MLILGIDPGTAIVGYGLVEARAGQTRALVYDCIRTPAGEDPCRRLATIYAGIRELIERLQPETMAVEELFFNKNSKTALAVGQARGVILLAAAHTGLPVAEYTPLEVKQAVAGFGRAPKEQVQRMVQALLGLEEKPRPDDVADALAVAVCHASFAPWRQREKEVAGR

SEQ ID NO: 76730 - DNA, 516 bp, Thiobacillus denitrificans ATCC 25259
  CDS (1)..(516)
ttgcgcatcctcggcatcgatcccggcctcaggctcaccggcttcggcctgatcgagcagaccgggcagaagctcgcctacgtcgcgagcggcgtggtcaagagcggcgagggcagcctgccggcgcgcctgggcatactattcggcgggatcaacgaggtcatcgcgacctatcggcccgacacctgcgccgtcgagatcgttttcgtcaacgtcaacccgcaatcgacgctgctgctcgggcaggcccgcggcgccgcgatctgcgcggcggtctcgaacgacctcacggtcgccgaatacacggcgctgcagatcaagcaggccgtcgtcggccacggcaaggcggcgaagacgcaggtccaagaaatggtcaagcggctgctcgccctgccgatcgcgccgacggccgacgccgccgacgcgctggcctgcgcgatcacccatgcccacggcagccgcctcggcgcgcagtcgaccgcgggctatcgtctcaagggcgggcggctggtctga

SEQ ID NO: 76731 - protein, 171 aa, Thiobacillus denitrificans ATCC 25259
MRILGIDPGLRLTGFGLIEQTGQKLAYVASGVVKSGEGSLPARLGILFGGINEVIATYRPDTCAVEIVFVNVNPQSTLLLGQARGAAICAAVSNDLTVAEYTALQIKQAVVGHGKAAKTQVQEMVKRLLALPIAPTADAADALACAITHAHGSRLGAQSTAGYRLKGGRLV

SEQ ID NO: 76732 - DNA, 474 bp, Rickettsia akari str. Hartford
  CDS (1)..(474)
atgatagtacttgggattgatccagcacttgggagtcttggatgggcagtagttgcaaggcagttgacaaaactgaaatatttagctagcggtattattaaaacaaatagtaaagatgaaattcataatagacttgcctgtattaacagtacattagaaaaagtaatattagaatatcaaccaaatatggcagcgattgaagaaacatttgttaatactaatagcgtgacttcgttaaagctcggctatgctagaggtgcgataatgtcgctgtgcggtaggtataatttggacattcgggaatttaaaccaaatacggtcaaaaaaaccgtgaccggttatgggcatgcagagaaagatcaaattttgcatatgataaagcttttgctgcccggcacttccttaattactaattccgatgaagctgatgctatagcaatcgcttatacttgtcatgttatgagagttaaatga

SEQ ID NO: 76733 - protein, 157 aa, Rickettsia akari str. Hartford
MIVLGIDPALGSLGWAVVARQLTKLKYLASGIIKTNSKDEIHNRLACINSTLEKVILEYQPNMAAIEETFVNTNSVTSLKLGYARGAIMSLCGRYNLDIREFKPNTVKKTVTGYGHAEKDQILHMIKLLLPGTSLITNSDEADAIAIAYTCHVMRVK

SEQ ID NO: 76734 - DNA, 525 bp, Azotobacter vinelandii
  CDS (1)..(525)
atgacgctcatcctgggtatcgatcccggctcgcggatcaccggcttcggtgtggtacgcgacggcgggcgtggctgcgaatacatcgcttccggttgcatccgtaccggcagtggttccctgcccgagcgcctgcaggcggtgtatcgtggcgtgaccgaaatcatccgcagccacggtccggtgaccatgggcatcgagcaggtattcatggcgcgcaatgccgattccgccctgaagctcggccaggcgcgcggcgcggcgatcgtcgcggcggcggaggcggggctggagatcgccgagtacaccgccacccaggtcaagcaggccatcgtcggcagcggcggggcggacaagcgacaagtacagatgatggtgatgcacttgctccggctggtgcagaagccgcagatcgacgcttccgatgccctggctatcgccttgtgtcacgctcaccaccggcagagcctgattccccacggcctggatggcgccaggcggcggggcgggcgtttgcgtttgtga

SEQ ID NO: 76735 - protein, 174 aa, Azotobacter vinelandii
MTLILGIDPGSRITGFGVVRDGGRGCEYIASGCIRTGSGSLPERLQAVYRGVTEIIRSHGPVTMGIEQVFMARNADSALKLGQARGAAIVAAAEAGLEIAEYTATQVKQAIVGSGGADKRQVQMMVMHLLRLVQKPQIDASDALAIALCHAHHRQSLIPHGLDGARRRGGRLRL

SEQ ID NO: 76736 - DNA, 495 bp, Chloroflexus aurantiacus
  CDS (1)..(495)
atgcgtgcgcttggtatcgaccccggtacggctacgatgggctggggcatcgttgagttcaacaatggtcatttgcgcctgatcgatgttggtgccttgacgacgcctgccggtatgccccaccctgaacggctcttgcagctctacaatggcctccgtgcgattattgagcgcttgcgcccggatactgctgcggtcgaggagctgtttttcgggaagaatgtcaataccgcactgacggttggtcaggcgcgcggggtggccttactggcgctcgcgcaggccggtattcctgttcacgagtataagccgctggcggtgaagcaggcagtggcaggctacggtggcgccgataagcggcagatgcaggagatggtgcgcctgacgctcggtctggccacgataccccgccccgatgacgctgccgatgcgctggcgattgcgatctgccacgcctatactgccccaactctccagcgctttgggttgtcgtga

SEQ ID NO: 76737 - protein, 164 aa, Chloroflexus aurantiacus
MRALGIDPGTATMGWGIVEFNNGHLRLIDVGALTTPAGMPHPERLLQLYNGLRAIIERLRPDTAAVEELFFGKNVNTALTVGQARGVALLALAQAGIPVHEYKPLAVKQAVAGYGGADKRQMQEMVRLTLGLATIPRPDDAADALAIAICHAYTAPTLQRFGLS

SEQ ID NO: 76738 - DNA, 522 bp, Polaromonas sp. JS666
  CDS (1)..(522)
ttgcagatcgccggattcggcgtggtcgaagtcgacggcccccacttgcactatgtggccagcggcaccatcaagaccacgcacatggtgcgcggcgacctgccggcccggctgaaggtgctgtttgacggggtacgggaagtggtgcagcgctaccagcccgacatggcctcggtggagatcgtctttaccaacgtcaacccacaggccacgctgctgctggggcaggcgcgcggtgcctgcatcacggccctggtctccagcgatctcaccgtggccgaatacacggccctgcaaatgaagaaggcggtggccggctatggcaaggccggcaaggccgaggtccagcagatggtgatgcggctgctgaaattgccggccctgcccggcaaggacgccgccgatgccctgggcctggccatcacccatgcccatgccgggcgttcaacggccatcctggcggccgccacggcgttgaagcccaacgccagcgcttcttacaaggcgggtcggcactattga

SEQ ID NO: 76739 - protein, 173 aa, Polaromonas sp. JS666
MQIAGFGVVEVDGPHLHYVASGTIKTTHMVRGDLPARLKVLFDGVREVVQRYQPDMASVEIVFTNVNPQATLLLGQARGACITALVSSDLTVAEYTALQMKKAVAGYGKAGKAEVQQMVMRLLKLPALPGKDAADALGLAITHAHAGRSTAILAAATALKPNASASYKAGRHY

SEQ ID NO: 76740 - DNA, 486 bp, Campylobacter lari RM2100
  CDS (1)..(486): transl_table=11
gtgaaaagtttgaaagttttagggatagatcctggttctaggtattgtggatacgctattgtagaaaagattaataataaaaatcaactcatagaagcagggctaatcaaaatcaaacccaatgatttgcaatatcaaatcacagaattatgtgaaggacttgatctaatctttaaaaatcatcaatttgatgaggtagctatagaagatatattttttgcttataatccaaaaacggttttaaaactagcacaatttagaggagcgctaagtcttaaaattttacaaatgcatggagaatttgcagaatacacgcctttgcaagttaaaaaaaccgtaacaggtaaagcaaaagctacaaaagagcaagttgcgtttatggtaaaaagattacttggaatttcaaaagatatcaagccacttgatattactgatgctattgcggtggctttgacgcattcagcaaatttgagagtgaaaaagtga

SEQ ID NO: 76741 - protein, 161 aa, Campylobacter lari RM2100
MKSLKVLGIDPGSRYCGYAIVEKINNKNQLIEAGLIKIKPNDLQYQITELCEGLDLIFKNHQFDEVAIEDIFFAYNPKTVLKLAQFRGALSLKILQMHGEFAEYTPLQVKKTVTGKAKATKEQVAFMVKRLLGISKDIKPLDITDAIAVALTHSANLRVKK

SEQ ID NO: 76742 - DNA, 513 bp, Agrobacterium tumefaciens
  CDS (1)..(513): transl_table=11
atgcaaaagacgattcgaatcatcggcatcgacccaggactgcggcgcaccggttggggcgtcatcgacaccctcggcaacagcctgcggtttgtcgcctccggcacggtgacgtcggatggcgatatggacctcgcctcccggctctgccagctgcatgacgggctggcggaaatcgtgcacagccatcagcccgatgaagcagccgtggagcagaccttcgtgaacaaggatgctgtcgccacgctgaaactcggccaggcacgcggcatcgccatgctggttccggcgcgggcgggattgccggtctttgaatatgcaccaaatgcggtcaaaaaggccgtcatcggcgtcgggcacggcgaaaagcagcagattcacatgatgctgaaaatcctgatgccgaaggccgaattcaagggtaacgatgcggcggacgcgctcgccatcgccatctgccacgcccataatcgcggcggtgacaggatgcggcggctcctggcggccggttaa

SEQ ID NO: 76743 - protein, 170 aa, Agrobacterium tumefaciens
MQKTIRIIGIDPGLRRTGWGVIDTLGNSLRFVASGTVTSDGDMDLASRLCQLHDGLAEIVHSHQPDEAAVEQTFVNKDAVATLKLGQARGIAMLVPARAGLPVFEYAPNAVKKAVIGVGHGEKQQIHMMLKILMPKAEFKGNDAADALAIAICHAHNRGGDRMRRLLAAG

SEQ ID NO: 76744 - DNA, 585 bp, Bifidobacterium longum
  CDS (1)..(585): transl_table=11
gtgattatccttggcgtcgaccccgggctcacacgttgcggggtcggcgtgatcgaagccggcgagcaccgccggctttcgtttattcacgtggacgtggtgcggtcctcaccggatatcacccaggatctgcgtctactggccatctacaacggcctgtccgagaaaatggaccgattcgcgccggacgcggtatctatcgagcgtgtgttcgcccaatccaaccgcaacaccgtactcggtaccgcacaggccgccggcctcgccatgctcgccgccgcgcaacgcaatattcccgtggcgttgcatacgcctaccgaagccaagctggctatcaccggtaacgggcaggcgcagaagattcaggtggagcgtatggtgacacgtattttgaacctcaccaaaatgccgactcccgccgatgccgccgatgccttggctttggccatttgccatgcgctgcgcccggcaggcgcattgcagggcggcgaacgcgaacaacatctgaccgccgcgcaacgccagtgggctgaggccgcacagaactccacgcgccgccgcatcaaccacgaccgaggcatgtag

SEQ ID NO: 76745 - protein, 194 aa, Bifidobacterium longum
MIILGVDPGLTRCGVGVIEAGEHRRLSFIHVDVVRSSPDITQDLRLLAIYNGLSEKMDRFAPDAVSIERVFAQSNRNTVLGTAQAAGLAMLAAAQRNIPVALHTPTEAKLAITGNGQAQKIQVERMVTRILNLTKMPTPADAADALALAICHALRPAGALQGGEREQHLTAAQRQWAEAAQNSTRRRINHDRGM

SEQ ID NO: 76746 - DNA, 549 bp, Bordetella bronchiseptica
  CDS (1)..(549): transl_table=11
atgcgcgtactcggcatcgaccccggcctgcgccgcaccggctttggcgtcatcgatgccgagggcatgcgcctgcgctacgtcgccagcgggaccatcgtggtcccgccggcgctggcgctgcccgaacgcctgaaggtcatcctcgacaacctgcgcgaagtcgcgcgcgagacccggcccgacgtcgccgcgctggaaatcgtctttctcaacaccaacccggcctccacgctgctgctgggacaggcgcgcggcgcggccctgtgcgcgctggccgacagcgcgctggacgtgcacgagtacaccgcgctgcagatcaagaaagccgtcgtgggcaccggccgcgcggccaaggagcaggtgcagatgatggtgcagcgcctgctgtcgctggacggcacgcccgcgcccgattcggccgacgcgctggcctgcgccatttgccatgcccacgtcggcccgctgcacgacaagctggaccgcctgggcacggccgcgcaactgggcagccgcccgcgcctgcgcaacggccgcctggtcggctga

SEQ ID NO: 76747 - protein, 182 aa, Bordetella bronchiseptica
MRVLGIDPGLRRTGFGVIDAEGMRLRYVASGTIVVPPALALPERLKVILDNLREVARETRPDVAALEIVFLNTNPASTLLLGQARGAALCALADSALDVHEYTALQIKKAVVGTGRAAKEQVQMMVQRLLSLDGTPAPDSADALACAICHAHVGPLHDKLDRLGTAAQLGSRPRLRNGRLVG

SEQ ID NO: 76748 - DNA, 549 bp, Bordetella parapertussis
  CDS (1)..(549): transl_table=11
atgcgcgtactcggcatcgaccccggcctgcgccgtaccggctttggcgtcatcgatgccgagggcatgcgcctgcgctacgtcgccagcgggaccatcgtggtcccgccggcgctgtcgctgcccgaacgcctgaaggtcatcctcgacaacctgcgcgaagtcgcgcgcgagacccggcccgacgtcgccgcgctggaaatcgtctttctcaacaccaacccggcctccacgctgctgctgggacaggcgcgcggcgcggccctgtgcgcgctggccgacagcgcgctggacgtgcacgagtacaccgcgctgcagatcaagaaagccgtcgtgggcaccggccgcgcggccaaggagcaggtgcagatgatggtgcagcgcctgctgtcgctggacggcacgcccgcgcccgactcggccgacgcgctggcctgcgccatttgccatgcccacgtcggcccgctgcacgacaggctggaccgcctgggcacggccgcgcaactgggcagccgcccgcgcctgcgcaacggccgcctggtcggctga

SEQ ID NO: 76749 - protein, 182 aa, Bordetella parapertussis
MRVLGIDPGLRRTGFGVIDAEGMRLRYVASGTIVVPPALSLPERLKVILDNLREVARETRPDVAALEIVFLNTNPASTLLLGQARGAALCALADSALDVHEYTALQIKKAVVGTGRAAKEQVQMMVQRLLSLDGTPAPDSADALACAICHAHVGPLHDRLDRLGTAAQLGSRPRLRNGRLVG

SEQ ID NO: 76750 - DNA, 549 bp, Bordetella pertussis
  CDS (1)..(549): transl_table=11
atgcgcgtactcggcatcgaccccggcctgcgccgcaccggctttggcgtcatcgatgccgagggcatgcgcctgcgctacgtcgccagcgggaccatcgtggtcccgccggcgctggcgctgcccgaacgcctgaaggtcatcctcgacaacctgcgcgaagtcgcgcgcgagacccggcccgacgtcgccgcgctggaaatcgtctttctcaacaccaacccggcctccacgctgctgctgggacaggcgcgcggcgcggccctgtgcgcgctggccgacagcgcgctggacgtgcacgagtacaccgcgctgcagatcaagaaagccgtcatgggcaccggccgcgcggccaaggagcaggtgcagatgatggtgcagcgcctgctgtcgctggacggcacgcccgcgcccgattcggccgacgcgctggcctgcgccatttgccatgcccacgtcggcccgctgcacgacaagctggaccgcctgggcacggccgcgcaactgggcagccgcccgcgcctgcgcaacggccgcctggtcggctga

SEQ ID NO: 76751 - protein, 182 aa, Bordetella pertussis
MRVLGIDPGLRRTGFGVIDAEGMRLRYVASGTIVVPPALALPERLKVILDNLREVARETRPDVAALEIVFLNTNPASTLLLGQARGAALCALADSALDVHEYTALQIKKAVMGTGRAAKEQVQMMVQRLLSLDGTPAPDSADALACAICHAHVGPLHDKLDRLGTAAQLGSRPRLRNGRLVG

SEQ ID NO: 76752 - DNA, 528 bp, Bradyrhizobium japonicum
  CDS (1)..(528)
atgactgcgctcccgattcgtggccccgttcgcatcatcggcatcgaccctggcctgcgccgtaccggctggggcgtgatcgaggctgagggcaaccgcctgatctatgtcgcctgcggttcggtggaaccgccggacgacctgccgctgtccagccgcctgctcgcgatccacgaagggctcgcctctgtcctgtccgatcacaagccgatggaagccgccgtcgagcagacttttgtgaacaaggacggcgttgcgacgctgaagctcggccaggcccggggcgtcgccatgctggcgcccgcaatgttcggcatcagcgtcgccgaatatgcgccgaaccaggtgaagaagactgtggtcggcgccggccatgccgacaagcaacagatcgcgatgatgctgaagatattgctgccgaaggccgaaccgccgtcagccgacgctgccgacgcgctcgccatcgccatcacccacgcccatcaccgccagagcacggcgctcaggctgaaggtggtgggagtttaa

SEQ ID NO: 76753 - protein, 175 aa, Bradyrhizobium japonicum
MTALPIRGPVRIIGIDPGLRRTGWGVIEAEGNRLIYVACGSVEPPDDLPLSSRLLAIHEGLASVLSDHKPMEAAVEQTFVNKDGVATLKLGQARGVAMLAPAMFGISVAEYAPNQVKKTVVGAGHADKQQIAMMLKILLPKAEPPSADAADALAIAITHAHHRQSTALRLKVVGV

SEQ ID NO: 76754 - DNA, 522 bp, Brucella suis
  CDS (1)..(522)
atgaaagaaacgattcgcattattggcatcgatccgggcctgctccgaaccggctggggcatcgtcgaatcgcttggcaattcgctgcatttcatcggctcggggaccgtgacctcgaatgccgagatggatctggcatcgcgcctgtgccagttgcatgaagggctttcaaaagtcctgcatgaattcatgccgcatgaagcggcggtcgagcatactttcgtcaacaaggacgcgactgcaacactcaaactggggcaggcgcgcggcattgcgctgctggcgccggcgcaggccggattgccggttgccgaatatgcgcccaatgccgtcaagaaggcggtgatcggcgttggccatggcgaaaagcagcagatccacatgatggtgaaggtgctgatgccgcgcgcttccttcgatacgagcgatgccgccgatgcgctggccatcgccatatgtcatgcgcatcaccggcagagcatcgtgagtgcccgccggatgcaggcattgttagcggggtaa

SEQ ID NO: 76755 - protein, 173 aa, Brucella suis
MKETIRIIGIDPGLLRTGWGIVESLGNSLHFIGSGTVTSNAEMDLASRLCQLHEGLSKVLHEFMPHEAAVEHTFVNKDATATLKLGQARGIALLAPAQAGLPVAEYAPNAVKKAVIGVGHGEKQQIHMMVKVLMPRASFDTSDAADALAIAICHAHHRQSIVSARRMQALLAG

SEQ ID NO: 76756 - DNA, 483 bp, Campylobacter jejuni
  CDS (1)..(483): transl_table=11
atgaatttgaaaattttaggtatagatccaggttcgagaaattgtggttatgctatcatagaagctgacaaaggaaaaaacattctcatagaagcaggacttataaagataaagccaagtaccttacagtatcaaatcacagagctttgcgagggtttggacttgatttttaaaaatcattcttttgatgaggtagctatagaagatatcttttttgcttacaatccaaaaaccgttttaaaactcgcacaatttcgcggagccctatctttaaaaattcttcaaattcatggagattttgcagaatacactcccttacaagtaaaaaaagccgttacaggaaaagccaaagcaactaaagaacaagttgcttttatggtaaaaaggcttttaggacttagtaaagatatcaagcctttggatatcacagatgctatcgcagtggctttaacccatgcagcaaatttaagagttagggtgtga

SEQ ID NO: 76757 - protein, 160 aa, Campylobacter jejuni
MNLKILGIDPGSRNCGYAIIEADKGKNILIEAGLIKIKPSTLQYQITELCEGLDLIFKNHSFDEVAIEDIFFAYNPKTVLKLAQFRGALSLKILQIHGDFAEYTPLQVKKAVTGKAKATKEQVAFMVKRLLGLSKDIKPLDITDAIAVALTHAANLRVRV

SEQ ID NO: 76758 - DNA, 510 bp, Caulobacter crescentus
  CDS (1)..(510): transl_table=11
atgatgaacgcgaatcgccttccgacccggatcctcggccttgatcccggcctgcgccgcaccggctggggcgtgctcgccgtcgagggctcgcgcatgacccacatcgcgcatggcgtgatcacgcctgacgagaaggccgagttcgccgatcggctactgcacctgttcgaaggcatcacggcggtgatcgagcagcatcgccccgacgaggcggcggtcgaggaggtgttcctgaacaccaacgcccagtcgaccctgaagctgggccacgcccgcgccgccgccttgatcgccccggcccgcgcaggcttgctcgtggccgagtattccacgcgcctggtcaagaaggcggtggtcgggaccggcgcggccgacaaggctcagatcggtttcatgatcgcgcggctgttgccgaccgcgggcaagaccacggccgattgcgccgatgcgctcgccgtcgccatcacccacgccaacctgcgtgtcgccaatcggagggtcgcatga

SEQ ID NO: 76759 - protein, 169 aa, Caulobacter crescentus
MMNANRLPTRILGLDPGLRRTGWGVLAVEGSRMTHIAHGVITPDEKAEFADRLLHLFEGITAVIEQHRPDEAAVEEVFLNTNAQSTLKLGHARAAALIAPARAGLLVAEYSTRLVKKAVVGTGAADKAQIGFMIARLLPTAGKTTADCADALAVAITHANLRVANRRVA

SEQ ID NO: 76760 - DNA, 507 bp, Chlamydophila caviae
  CDS (1)..(507): transl_table=11
atgacgcaattgattatggggattgatcctgggacactagtttctggatacgctattatccatattgaacagcgttataagatacgagctcatagctatggggctatccgtttatcttcaaaagattcattaacacagcgttataaacagctttttcaaacattgtctggggtattggatgatattactcctgatgctgtggttcttgaaacgcaatatgtgcataagaaccctcaaagtactataaaattaggcatggcgcggggagtgctcatacttgctgctgctttacgagacattcctgtttttgaatatgctccaaacgtagctaagagagctgttgtcggtaaaggaaatgccagtaaacagcaggtgcaacttatggttagcaagattttaaatattcctgatgtcttaaattccaattgtgaagatattgcagatgcatttgcattagcaatatgccatgcacatacttctgcttatacttgtttaggagttcgataa

SEQ ID NO: 76761 - protein, 168 aa, Chlamydophila caviae
MTQLIMGIDPGTLVSGYAIIHIEQRYKIRAHSYGAIRLSSKDSLTQRYKQLFQTLSGVLDDITPDAVVLETQYVHKNPQSTIKLGMARGVLILAAALRDIPVFEYAPNVAKRAVVGKGNASKQQVQLMVSKILNIPDVLNSNCEDIADAFALAICHAHTSAYTCLGVR

SEQ ID NO: 76762 - DNA, 513 bp, Chlamydia muridarum
  CDS (1)..(513): transl_table=11
atggcggatttgattatggggatagatccgggaactttggtttgtggatatgcattcattcgagtagaaaatcgatatcagatccagccgcatagttttggaaaaatcaaactatctcagaaacaggcgttgtctcatagatatagacagctgtttacagaaatttccacaatccttcaacgagaagctcctaaagccgttgttttagagactcagtacgttcataaaaatcctcagagtacaattaaactagggatggcaaggggagtattattattagcagcctctttacaagatatctctgtgtttgagtatgcgcctaacacagctaagaaagctgctgtaggtaaaggtaatgcttctaagcagcaggtacagcttatggtaagtaagctactgaatattcaggatctgctagcggatgataatgaggatattgcggatgcttttgctttagccatgtgtcatgcacatttagcgccttatcaggatctaaaaaaaagtcttttgtaa

SEQ ID NO: 76763 - protein, 170 aa, Chlamydia muridarum
MADLIMGIDPGTLVCGYAFIRVENRYQIQPHSFGKIKLSQKQALSHRYRQLFTEISTILQREAPKAVVLETQYVHKNPQSTIKLGMARGVLLLAASLQDISVFEYAPNTAKKAAVGKGNASKQQVQLMVSKLLNIQDLLADDNEDIADAFALAMCHAHLAPYQDLKKSLL

SEQ ID NO: 76764 - DNA, 507 bp, Chlamydia pneumoniae
  CDS (1)..(507): transl_table=11
gtgtcagaactgattataggtgtggatccaggaacgatagtcgcaggatatgccatcattgcagtggaacagcgctatcaattacgtccttatagttatggtgccattcgtttatcttccgacatgccactgcctatgcgctataagactttgtttgagcaactctcaggagtattagatgatacgcaacctaatgctatggtcctagaaacgcaatttgtaaataagaatcctcaaagtactatgaaattagctatggcacgaggaatcgttttattggctgcagctcagcgtgatatcctcatttttgaatatgccccaaatgttgctaagaaagcagtagtcggtaagggtcatgcaagtaaaagacaggtccaggtgatggtaagcaagattctaaatgttcccgaagttttgcacccttcgaatgaagatattgctgatgcctttgcacttgctatatgtcatactcatgtagcgcgtagccctctttgtggagtgagataa

SEQ ID NO: 76765 - protein, 168 aa, Chlamydia pneumoniae
MSELIIGVDPGTIVAGYAIIAVEQRYQLRPYSYGAIRLSSDMPLPMRYKTLFEQLSGVLDDTQPNAMVLETQFVNKNPQSTMKLAMARGIVLLAAAQRDILIFEYAPNVAKKAVVGKGHASKRQVQVMVSKILNVPEVLHPSNEDIADAFALAICHTHVARSPLCGVR

SEQ ID NO: 76766 - DNA, 561 bp, Chlorobium tepidum
  CDS (1)..(561): transl_table=11
atgattgtactgggcatcgatccgggcagccgcaaaaccggctatggcgtcatcgccgaaacggcggcgggctatcgcgtgcttggatgcggccttgttcgccctcgcgcagcggatacgctgcatgagcggatcagccagctctgcgcgggcctcgacgaggtgatcgagcagctgaagcccgaggcggtggcgcttgagacggccttcgtggggcgcaatgtcagaagcgcgctgattctcggccaggtcaggggggcggtgcttgccacggtgatgaggcatagcttgccggtgcgtgaatacgcgccgcgcgaaatcaagctctcggttaccggcaccggttcggcgtgcaaggagcaggtggcggcaatgctgtcgcggatgctcgagcttggcggtgagctgaagcctctcgatgttaccgatgcgcttggcatcgcctactgcgatctcgctcggggtgcatcttcgctcggcggccagttgcgcaagaacggaaaagggcggagcaagggatgggcggcgttcgtaaacgagcatcccgagctgatggcctga

SEQ ID NO: 76767 - protein, 186 aa, Chlorobium tepidum
MIVLGIDPGSRKTGYGVIAETAAGYRVLGCGLVRPRAADTLHERISQLCAGLDEVIEQLKPEAVALETAFVGRNVRSALILGQVRGAVLATVMRHSLPVREYAPREIKLSVTGTGSACKEQVAAMLSRMLELGGELKPLDVTDALGIAYCDLARGASSLGGQLRKNGKGRSKGWAAFVNEHPELMA

SEQ ID NO: 76768 - DNA, 513 bp, Chlamydia trachomatis
  CDS (1)..(513): transl_table=11
atggctgatttgatcatggggatagatccaggaacgttagtttgtggatacgcgttgattaaggtagaaaatcgatatcacattcacccacatagttttggaaaggttaagctctctcagaagttagctttggctcatcgttataaacagttgtttacagagatttccacaattcttcaacaagagtctcctaaagctgttgttttagagacgcagtacgtccataaaaatccccaaagtaccattaagctgggaatggctagaggtgttttattattagcggcatctttacaggatgtccctgtatttgaatacgctcccaatacggctaaaaaagctgctgtgggtaaaggcaatgcttctaagaagcaggtacagttaatggtgagcaaattattgcgtgttccagatcttttagcagaagataatgaggatatagcggatgcctttgctttagccatgtgccacgcacatctcgctccttatcaggatttaaagaagactcttgtataa

SEQ ID NO: 76769 - protein, 170 aa, Chlamydia trachomatis
MADLIMGIDPGTLVCGYALIKVENRYHIHPHSFGKVKLSQKLALAHRYKQLFTEISTILQQESPKAVVLETQYVHKNPQSTIKLGMARGVLLLAASLQDVPVFEYAPNTAKKAAVGKGNASKKQVQLMVSKLLRVPDLLAEDNEDIADAFALAMCHAHLAPYQDLKKTLV

SEQ ID NO: 76770 - DNA, 531 bp, Chromobacterium violaceum
  CDS (1)..(531): transl_table=11
atgagccggcgcatcttaggcatcgatcccggcagcctgatcaccggcttcggcgtcatcgacgtggtgggcaaccagcgccattacgtcgcttccggcgcgatccgcaccaagagcggatcgccgctggccgagcgggtcaaggtgctggtggacggcatccatcaggtgatagacacctatcggcccaccgaggcggcgctggaacgggtgttcgtcaacgtcaatccggcggccacgctgatgctgggacaggcgcgcggcgcctgcatgaccgcgctggtgctgaaggatttgccggtggccgaatacacggcgctgcaggtcaagcaatccgtggtcggtcagggcaaggcgccgaaggagcaggtgcagtacatggtggtgcgcatgctgaacctgtccggcacgccgcaggccgacgccgccgacgcgctggcggtggcgctgacccatgcgaatcatagcggcggggccatcggcaagctggcgctgcggggcctgaaggtgcggggcggccgcttggtgtag

SEQ ID NO: 76771 - protein, 176 aa, Chromobacterium violaceum
MSRRILGIDPGSLITGFGVIDVVGNQRHYVASGAIRTKSGSPLAERVKVLVDGIHQVIDTYRPTEAALERVFVNVNPAATLMLGQARGACMTALVLKDLPVAEYTALQVKQSVVGQGKAPKEQVQYMVVRMLNLSGTPQADAADALAVALTHANHSGGAIGKLALRGLKVRGGRLV

SEQ ID NO: 76772 - DNA, 672 bp, Corynebacterium efficiens
  CDS (1)..(672)
atgaatcatgagggtctacgggtgatgggcattgaccccggcctgacccgctgtggcctgtccgtcgtgcaggcgggacgcggacgtacggtctacccggtgtccgtcggcgtggtccggaccccctcggatgccgaactcgcggaccggctgctgcgactcagccaggctgtgggggaatggatggatgattacaccccggatgtgatcgccattgaacgtgtcttcgagcgcggtaatgtctccaccgtcatgaacaccgcccatgccgtgggcgtgctcatcctcgctgcggccgaacggggactgccggtccacatgtacacccccagtgaggtcaagaaggccatctccggcaacggtcgggcggacaagaaacagatgaccgtcatgatcacccgcatcctgggcctcgcggaggctccgaaacccgccgacgccgccgacgccctggcactggcggtgtgccactgctggcgcgcaccactgctcatgcgcaccaggatgaccgccgttgatctggaacaccggcgccgccagtaccagggcaaactggggaaggcgaagtcgaccctgaatgccaggaacaacgcccaggtgaccggggatgcacaggtccgcgcaggacaccccagccagttcgaacggcccgaccgtgccgatccccggtga

SEQ ID NO: 76773 - protein, 223 aa, Corynebacterium efficiens
MNHEGLRVMGIDPGLTRCGLSVVQAGRGRTVYPVSVGVVRTPSDAELADRLLRLSQAVGEWMDDYTPDVIAIERVFERGNVSTVMNTAHAVGVLILAAAERGLPVHMYTPSEVKKAISGNGRADKKQMTVMITRILGLAEAPKPADAADALALAVCHCWRAPLLMRTRMTAVDLEHRRRQYQGKLGKAKSTLNARNNAQVTGDAQVRAGHPSQFERPDRADPR

SEQ ID NO: 76774 - DNA, 666 bp, Corynebacterium glutamicum
  CDS (1)..(666): transl_table=11
atgaaccacgaagggcttcgggtaatgggcattgacccaggtcttacccgttgtggcttatctgtggttcaagcaggtcgtggtcgtaccgtgtatccagtgtcggtgggcgtggtgcgcaccccaccagatgcggagttggcggagcggttgcttcggctcagcaaagcagtgggtgagtggatggatgagtacaccccagatgtcattgctattgagcgtgtctttgagcgcggaaatgtttccaccgtgatgaacactgcgcatgcggtgggtgtgttgatcttggctgctgctgaacgcggattgccagttcacatgtacacccccagtgaggtgaaaaaggctatctccggtaatggtcgcgctgataagaaacagatgacggtcatgatcactcgaattctgggccttggtgagccacccaaacctgctgacgccgctgatgctttatcgttggcggtgtgtcactgctggcgggcgccaatgcttatgcgggcgcaatcgcagtactccgagcaagagttggaaaagcgacggcgtgtgcagcaaggaaaattgggtaaagcgaaatcaacttacaatgcggaacaagctcaatcccatgcatccgatcctgctaaagcggctcatcccagtcagtttcaacgaactgacaccaattag

SEQ ID NO: 76775 - protein, 221 aa, Corynebacterium glutamicum
MNHEGLRVMGIDPGLTRCGLSVVQAGRGRTVYPVSVGVVRTPPDAELAERLLRLSKAVGEWMDEYTPDVIAIERVFERGNVSTVMNTAHAVGVLILAAAERGLPVHMYTPSEVKKAISGNGRADKKQMTVMITRILGLGEPPKPADAADALSLAVCHCWRAPMLMRAQSQYSEQELEKRRRVQQGKLGKAKSTYNAEQAQSHASDPAKAAHPSQFQRTDTN

SEQ ID NO: 76776 - DNA, 519 bp, Coxiella burnetii
  CDS (1)..(519): transl_table=11
atggacaacccaagacgaatcatcatcggcattgacccggggtcgcggataaccggctacggtatcatctggtcacaaggctcaaagcaaggctgcattgcctttggtcagatcaaaaccgacaatgattctttgaatttccgcctccatcaaatcgaacgagaattacgcgacctcatcctaattcaccgtccccacgaagccgctatcgaacaagtgttcacctttcacaatcaccaatctgctttaaaactcggacaagcacgcggcgctgccctcgtcgcaacagcggcttgcgctttgtccgtcgccgaatacagcgctcgccaaattaaacaagcggtcgtcggttacggcgccgctaccaaagcccaagttcaacacatggtccacttactgttacaattagaaaaagcaccaccggcagacgccgcggacgccttagcgattgcgttatgtcatgcaaccagtagtcgcctgtccgaaaaattaatgcaagccaaaggaacactaacatga

SEQ ID NO: 76777 - protein, 172 aa, Coxiella burnetii
MDNPRRIIIGIDPGSRITGYGIIWSQGSKQGCIAFGQIKTDNDSLNFRLHQIERELRDLILIHRPHEAAIEQVFTFHNHQSALKLGQARGAALVATAACALSVAEYSARQIKQAVVGYGAATKAQVQHMVHLLLQLEKAPPADAADALAIALCHATSSRLSEKLMQAKGTLT

SEQ ID NO: 76778 - DNA, 540 bp, Deinococcus radiodurans
  CDS (1)..(540): transl_table=11
atgagggttctggggattgaccccggtctggcgaacctgggcctgggactggtcgaaggggatgtccggcgggccaagcacctgtaccacgtctgcctgaccaccgaaagcgcgtggctgatgccccggcggctgcaatacctgcacgaggaactgacccggctgctcaccgagtaccggcccgacgcggtggcgatcgaggaccagattctgcgccgacaggctgacgtggcgttcaaagtggggcaggcgttcggggtggtgcagctcgcctgtgcgcaggccggggtgccgattcacgcctacggccccatgcaggtcaagaagtcgctggtgggcacgggccgcgccgacaaggagcaggtcatctacatggtcaaggcgagcctgggtattcgcgagctgttcaacaaccacgccgccgacgcgctggctctggcgctgacccacctcgcgcacgcgcccatgcaggagcgcagcgagcggctggcggcggcgggcagggctgcgcgcacaggagacgccccgctgcggcgctga

SEQ ID NO: 76779 - protein, 179 aa, Deinococcus radiodurans
MRVLGIDPGLANLGLGLVEGDVRRAKHLYHVCLTTESAWLMPRRLQYLHEELTRLLTEYRPDAVAIEDQILRRQADVAFKVGQAFGVVQLACAQAGVPIHAYGPMQVKKSLVGTGRADKEQVIYMVKASLGIRELFNNHAADALALALTHLAHAPMQERSERLAAAGRAARTGDAPLRR

SEQ ID NO: 76780 - DNA, 573 bp, Fusobacterium nucleatum
  CDS (1)..(573): transl_table=11
atgcgtgttataggaattgacccaggtacagcaatagttggatatggaattatagattatgataaaaataaatattcaatagttgactatggagttgtactcacttcaaaagatttgagtacagaagaaagattagagattgtatatgatgaaatagataaaattttaaagaaatataaacctgaatttatggcaatagaagatttattttattttaaaaataataagactgtaatctctgttgctcaagcaagaggtgttattttacttgcaggaaaacaaaataatattgctatgacaagttatactccacttcaagttaaaattggaattacaggttatggtaaagctgaaaaaaagcaaatacaacagatggtgcaaaaatttttaggactttctgaaatccctaagcctgatgatgcagctgatgctttggctatttgtattacccatataaattcattgggttctaaattaagttttggaagaacaaataatttaaataaaatagtagttccatctggtacaaataagatatctcttgaagaatacaaaaatttattaaagaaataa

SEQ ID NO: 76781 - protein, 190 aa, Fusobacterium nucleatum
MRVIGIDPGTAIVGYGIIDYDKNKYSIVDYGVVLTSKDLSTEERLEIVYDEIDKILKKYKPEFMAIEDLFYFKNNKTVISVAQARGVILLAGKQNNIAMTSYTPLQVKIGITGYGKAEKKQIQQMVQKFLGLSEIPKPDDAADALAICITHINSLGSKLSFGRTNNLNKIVVPSGTNKISLEEYKNLLKK

SEQ ID NO: 76782 - DNA, 522 bp, Gloeobacter violaceus
  CDS (1)..(522)
atgtgcggcatgcggattctcggtctcgatccgggcgtggcgatcctcggttacggagtgctcgacttttttgacagcgctccgccggtagtgtgcgactacggcattgtgcagacctcggcaaaaaccgccttcgaagcaagacttgcggccatctacgaggacattaatagtttattttccgcccacaagcccgacttggttgctatcgaaaaactcttcttctacaagatgggcaacacgatctcggtggcccaggcgcggggagtggtgctcctgtgcgctgcccagcacggggtgccctatgtcgaattcagtccgccccaggtcaaactcgccctcaccggcgacggccgcgccgacaagcgcgccatccaggaggccgtgcagcgcgagttggggttgattaccatgcccaaacccgacgacgccgccgatgccctggccatcgccctgaccggctggttccaccacctgccccccgccgcccgcgaagccgttcccgcctacagcgtcggttga

SEQ ID NO: 76783 - protein, 173 aa, Gloeobacter violaceus
MCGMRILGLDPGVAILGYGVLDFFDSAPPVVCDYGIVQTSAKTAFEARLAAIYEDINSLFSAHKPDLVAIEKLFFYKMGNTISVAQARGVVLLCAAQHGVPYVEFSPPQVKLALTGDGRADKRAIQEAVQRELGLITMPKPDDAADALAIALTGWFHHLPPAAREAVPAYSVG

SEQ ID NO: 76784 - DNA, 573 bp, Haemophilus influenzae
  CDS (1)..(573): transl_table=11
atgagcattattttaggtattgacccaggctctcgcgtaactggttacggtgtgattcgtcaaacaggaaaacatttagaatatctcggtagtggcgcaattcgtactcaagttgaagatttacccacccgtttgaaacgcatttatgctggagtaactgaaatcatcacgcaatttcaacctaatatgtttgcgattgagcaagtgtttatggcgaagaatgcggattcagcattgaaacttgggcaggctcgcggcacggcgattgttgcagcggtaaataatgatttacctgtttttgaatatgccgcacgtttagtaaaacaaacagtggtgggcattggttccgctgataaagtgcaagtgcaagaaatggtgactcgtattttgaagttgtcagataaacctcaagccgatgcagcggatgcgttggctattgcgattacacacgcgcattctattcaacattctttacatattgccaattctgtgaaaatgacagaaacgcaagaaaaaatgaccgcacttttaaagaccagatatagccgaggacgctttagattaaaaatttaa

SEQ ID NO: 76785 - protein, 190 aa, Haemophilus influenzae
MSIILGIDPGSRVTGYGVIRQTGKHLEYLGSGAIRTQVEDLPTRLKRIYAGVTEIITQFQPNMFAIEQVFMAKNADSALKLGQARGTAIVAAVNNDLPVFEYAARLVKQTVVGIGSADKVQVQEMVTRILKLSDKPQADAADALAIAITHAHSIQHSLHIANSVKMTETQEKMTALLKTRYSRGRFRLKI

SEQ ID NO: 76786 - DNA, 558 bp, Helicobacter hepaticus
  CDS (1)..(558): transl_table=11
ttgcatatcttaggtatagaccccggaagtagaaattgcggttatgcaattatcaattatgcacctcacgttaattcacttaaactcattgaagcaggtattattaaaatcaaagagcgtgatttacaaacccaaattatggaatttgtagaaggcattgatttggtaattaaaaatattcatattgatgaggtggctattgaagatatattttttgcttacaaccctcaaagtgtcatcaaacttgctcaatttcgtggggcattgagcttaaaaattctccaagagattggaaatttttctgaatacacacccttacaggtcaaaaaagcaatcacaggaaatggtaaggcagacaaaacccaagttgcatttatggtaaagcgcattttagggcttaagggtgaaataaaacctcttgatattacagatgctattgccattgccattacacattctcaacgtatcaaaacaaacgatgttcattctacacctaatcttcaacgtgcaatgcctttaaaatctctttctgcaaacccttctaaaggctgtatatga

SEQ ID NO: 76787 - protein, 185 aa, Helicobacter hepaticus
MHILGIDPGSRNCGYAIINYAPHVNSLKLIEAGIIKIKERDLQTQIMEFVEGIDLVIKNIHIDEVAIEDIFFAYNPQSVIKLAQFRGALSLKILQEIGNFSEYTPLQVKKAITGNGKADKTQVAFMVKRILGLKGEIKPLDITDAIAIAITHSQRIKTNDVHSTPNLQRAMPLKSLSANPSKGCI

SEQ ID NO: 76788 - DNA, 474 bp, Helicobacter pylori
  CDS (1)..(474): transl_table=11
atgcgtattttaggaatagatccgggcagtaggaaatgcgggtatgctatcatttctcacgcttctaacaagctttctttaatcacggccgggttcattaatatcaccacgacacgcttgcaagaacagattttagatttgatagaagccttagattgcttattggatcgttacgaagtcaatgaagtggcgattgaagatattttctttgggtataacccaaaaagcgtgatcaagctcgcgcaattcaggggagcgttgtccttaaagattttagaaaggattggtaattttagcgaatacacgcccttacaagtcaaaaaagccctgaccggtaacgggaaagccgctaaagaacaagtagcttttatggtcaagcgcttgcttaacatcacaagcgaaatcaagcctttggatattagcgatgcgatagccgttgctatcacgcatgcgcaacgcttaaagctccattaa

SEQ ID NO: 76789 - protein, 157 aa, Helicobacter pylori
MRILGIDPGSRKCGYAIISHASNKLSLITAGFINITTTRLQEQILDLIEALDCLLDRYEVNEVAIEDIFFGYNPKSVIKLAQFRGALSLKILERIGNFSEYTPLQVKKALTGNGKAAKEQVAFMVKRLLNITSEIKPLDISDAIAVAITHAQRLKLH

SEQ ID NO: 76790 - DNA, 567 bp, Mycobacterium bovis
  CDS (1)..(567): transl_table=11
gtgcgggtgatgggtgtcgatcccgggttgacccgatgcgggctgtcgcttatcgagagtgggcgtggtcggcagctcaccgcgctggatgtcgacgtggtgcgcacaccgtcggatgcggccttggcgcagcgcctgttggccatcagcgatgccgtcgagcactggctggacacccatcatccggaggtggtggctatcgaacgggtgttctctcagctcaacgtgaccacggtgatgggcaccgcgcaggccggcggcgtgatcgccctggcggcggccaaacgtggtgtcgacgtgcatttccatacccccagcgaggtcaaggcggcggtcactggcaacggttccgcagacaaggctcaggtcaccgcgatggtcaccaaaatccttgcgctgcaagctaaaccgacaccggccgacgcggccgacgctttggcgctggcgatctgtcactgttggcgggcgccgacgatcgcccggatggctgaggccacgtcgagggcggaagcacgagcagcgcagcagcgtcatgcgtacctagccaagctgaaggccgcccgatga

SEQ ID NO: 76791 - protein, 188 aa, Mycobacterium bovis
MRVMGVDPGLTRCGLSLIESGRGRQLTALDVDVVRTPSDAALAQRLLAISDAVEHWLDTHHPEVVAIERVFSQLNVTTVMGTAQAGGVIALAAAKRGVDVHFHTPSEVKAAVTGNGSADKAQVTAMVTKILALQAKPTPADAADALALAICHCWRAPTIARMAEATSRAEARAAQQRHAYLAKLKAAR

SEQ ID NO: 76792 - DNA, 567 bp, Mycobacterium leprae
  CDS (1)..(567): transl_table=11
atgcgcgtgatgggcgtcgatcccgggttgacgcggtgcgggttgtctgtcgtcgaaaatgggcgcggtagccaagttgttgcgttggatgtcgatgtggtgcgcacaccatcggacgcaccggtatccaagcgcttgctggctgtcagcgatgtcgtcgaacactggctggacgcccatcatccggatgttatggccatcgaacgggttttttctcagcagaatgtgtcgacggtgatgggtacggcacaagccggcggtgtgatcgcgttggccgcggcgagacgcggtatcgacgtacatttccataccccaagtgaggttaaggccgcagttaccggcaatggtgccgccaacaaagcgcaagttaccgcgatggtgaccagaatccttgcactgcaagctaaaccgacaccggccgatgcggccgacgcgttggccctggcgatctgccactgctggagagcaccaatgatcgcgcggatggcagaagccgaagcgctgggcgcgcggcaccgtcaggcctatcgggccaaggtagctggcgaggttaaggccacccggtga

SEQ ID NO: 76793 - protein, 188 aa, Mycobacterium leprae
MRVMGVDPGLTRCGLSVVENGRGSQVVALDVDVVRTPSDAPVSKRLLAVSDVVEHWLDAHHPDVMAIERVFSQQNVSTVMGTAQAGGVIALAAARRGIDVHFHTPSEVKAAVTGNGAANKAQVTAMVTRILALQAKPTPADAADALALAICHCWRAPMIARMAEAEALGARHRQAYRAKVAGEVKATR

SEQ ID NO: 76794 - DNA, 546 bp, Nitrosomonas europaea
  CDS (1)..(546): transl_table=11
ttgacctcgttggtatatgccgctaaaggtattcgcatactgggaatcgatcctggtttgcgtataacgggttttggcattgttgagaaaatcgggaatcggctggtttatattggcagcggctgtgtagtgactggagaatccggtttgccggatcgtttgaagaccattctcgatggattgaatgaaatcattctgcagcataaaccggagcaggttgcggtagaacaggttttcgtcaatatcaatcccaaatcaaccctgttgcttggccaggcacgcggtgctgcgatcagtgcagcggttcttcatgaactttccgtgtatgaatatactgccttgcaagtcaaacaggctgtggtggggaatggtcatgcccgtaaagaacaggtgcaggaaatggtgatgcggttgctggggctgggagaacgaccgcgaccggatgcagccgatgcactggcatgtgccatttgtcatgctcacggcggaaccggcctgttgaccctgagtgcccgcaatcgctctaaacggagcaagcggctgtga

SEQ ID NO: 76795 - protein, 181 aa, Nitrosomonas europaea
MTSLVYAAKGIRILGIDPGLRITGFGIVEKIGNRLVYIGSGCVVTGESGLPDRLKTILDGLNEIILQHKPEQVAVEQVFVNINPKSTLLLGQARGAAISAAVLHELSVYEYTALQVKQAVVGNGHARKEQVQEMVMRLLGLGERPRPDAADALACAICHAHGGTGLLTLSARNRSKRSKRL

SEQ ID NO: 76796 - DNA, 573 bp, Pasteurella multocida
  CDS (1)..(573): transl_table=11
atggcaattattttaggcatcgatcctggctctcgcgtaactggctatggcgttatacgtcaagcgggtaggcatttagaatatttaggtagtggcgtgatccggacgtctgttacagatttaccaactcgtttgaaacggatctacatgggggtaaatgaaattattttgcaatatcaaccggatatgtttgctattgaagaagtgtttttagccaaaaatgccaattcagctttaaaacttgggcaagcaagaggtgccgcgattgttgccgcagttaatcatgatttacccgttttcgaatatgcggcgcgcttagtcaaacaaacggtagtagggattggttctgcagataaaattcaagtacaagatatggtaacacggattttaactttatctgaaaaaccacaagccgatgcggcggatgcgttagcgatagcgattacgcatgcccattctcttcaacacgctttccatgttacaaatagtgcacaagcgacagaaaaaccagaaaaaacgaccgcactgcttaaagcgcgatacagtcgaggacgctttcgtttaaaaatttaa

SEQ ID NO: 76797 - protein, 190 aa, Pasteurella multocida
MAIILGIDPGSRVTGYGVIRQAGRHLEYLGSGVIRTSVTDLPTRLKRIYMGVNEIILQYQPDMFAIEEVFLAKNANSALKLGQARGAAIVAAVNHDLPVFEYAARLVKQTVVGIGSADKIQVQDMVTRILTLSEKPQADAADALAIAITHAHSLQHAFHVTNSAQATEKPEKTTALLKARYSRGRFRLKI

SEQ ID NO: 76798 - DNA, 522 bp, Photorhabdus luminescens
  CDS (1)..(522): transl_table=11
atggcgattatcttaggtatcgacccgggttcccgcgtcactggctatggtgtgatccgtcagcaggggcgtcatttgagctaccttggcagtggttgtatccgaacaaaagttgatgatctgcctaaccggttacagcggatttatgcgggtatccttgaaattattacgcaatttcaaccagatgcttttgctatcgagcaagtctttatggcaaaaaacgccgattcagcgctgaaattagggcaagcacggggagtggctattcttgccgctgttaatcaatctataccggtttttgaatatgctgcgcggcaggtgaaacaaacggttgttggaaccggggcggctgaaaaaagtcaggttcagcacatggtgcgttctgtgctgaaattgtctgctaacccgcaatccgatgcggcagatgcattggcgattgcgataacccattgtcactttaatcagaatcttttgcgggttggtgatcccagattaattttggcacgtggacgtttaagataa

SEQ ID NO: 76799 - protein, 173 aa, Photorhabdus luminescens
MAIILGIDPGSRVTGYGVIRQQGRHLSYLGSGCIRTKVDDLPNRLQRIYAGILEIITQFQPDAFAIEQVFMAKNADSALKLGQARGVAILAAVNQSIPVFEYAARQVKQTVVGTGAAEKSQVQHMVRSVLKLSANPQSDAADALAIAITHCHFNQNLLRVGDPRLILARGRLR

SEQ ID NO: 76800 - DNA, 570 bp, Porphyromonas gingivalis
  CDS (1)..(570): transl_table=11
atgagtccgaaggaacgcattatcatgggagtagaccccggcacaatactgatgggctacgggatgcttcacgtcgtggggaatactccccgactcatggctatgggggtaatacgtctggagaaattcgacaatcactatatccgtctgaaacgcatattcgacaggattacaggtctgatcgatgaattcctaccggatgaaatggctatcgaagcacctttctttgggaagaatgtacagagtatgctcaagttagggcgggctcagggtgtcgctatggcagcggctttggctcgcgacattcctattacggaatatgctccgatgcgcatcaagcaagcgattacaggtaatggcaatgcgagcaaagagcaggtagccggcatgctccaacgctatttacgaatacctgacgaacagatgttacctgaaatggatgccacggacggactggcggctgccgtctgccacttctttcagacgtcgggacctatggctcgttcgggcggatcggcagtcaagaattggaaagacttcgtcaaccggaatccggataaggtacgctga

SEQ ID NO: 76801 - protein, 189 aa, Porphyromonas gingivalis
MSPKERIIMGVDPGTILMGYGMLHVVGNTPRLMAMGVIRLEKFDNHYIRLKRIFDRITGLIDEFLPDEMAIEAPFFGKNVQSMLKLGRAQGVAMAAALARDIPITEYAPMRIKQAITGNGNASKEQVAGMLQRYLRIPDEQMLPEMDATDGLAAAVCHFFQTSGPMARSGGSAVKNWKDFVNRNPDKVR

SEQ ID NO: 76802 - DNA, 468 bp, Prochlorococcus marinus
  CDS (1)..(468): transl_table=11
ttggtaattcttggcattgatcctggcctagcaagagttgggtatggcctgatagaagtaaataatcaacgccaagtaaaaatgcttgattgtggaatcataaaaacaaataaaaatcaatatgaaggagaaagaatggttgaaatagcaaaagatctccgagttttaatccgtaaatggaaaccaggtcttgctgctgtagaaaaatttttcttttacaaatcaagtactaccattagtgttgtgcaagctagaggagtgctaataatgacgcttgctcgcttcaaagtacctattgttgagtttccaccaatgcaaataaagttagccgtagcaggttcaggtcatgcaaaaaaagacgaggtacttgaagctgtaatgagagaattacgactcaaagttcctcctcgtccagacgatgcagcagatgcactggcaatagcacttacaggattatttcaacaatag

SEQ ID NO: 76803 - protein, 155 aa, Prochlorococcus marinus
MVILGIDPGLARVGYGLIEVNNQRQVKMLDCGIIKTNKNQYEGERMVEIAKDLRVLIRKWKPGLAAVEKFFFYKSSTTISVVQARGVLIMTLARFKVPIVEFPPMQIKLAVAGSGHAKKDEVLEAVMRELRLKVPPRPDDAADALAIALTGLFQQ

SEQ ID NO: 76804 - DNA, 465 bp, Prochlorococcus marinus
  CDS (1)..(465): transl_table=11
ttgcgcatccttggcatcgaccctggcattgccagggtgggctacggggtcatcgacaccagcaacggacaacagcagatgctcgattgcggcatcatccgcaccaatcccggcattgacgatggtgaacggatggtggaaatcgccagcgatctacgccagctcatccgtcgttggaagccccaactggccgctgtggagaaattcttcttctaccgctccagcacgacaatcagcgtggtccaggcacgtggagtcatcatcatgaccctggcacgctttcgagtgccagtgatggaattcccaccgatgcagatcaagcttgctctggcgggctcaggccatgctgaaaaagatgaagtgctcgatgcggtgatgcgcgaattgaatcttgatcagccgccccgacccgatgatgccgccgacgccctggccatagcactcacgggttggttccagcgctaa

SEQ ID NO: 76805 - protein, 154 aa, Prochlorococcus marinus
MRILGIDPGIARVGYGVIDTSNGQQQMLDCGIIRTNPGIDDGERMVEIASDLRQLIRRWKPQLAAVEKFFFYRSSTTISVVQARGVIIMTLARFRVPVMEFPPMQIKLALAGSGHAEKDEVLDAVMRELNLDQPPRPDDAADALAIALTGWFQR

SEQ ID NO: 76806 - DNA, 525 bp, Pseudomonas aeruginosa
  CDS (1)..(525): transl_table=11
atgactttgattctagggattgacccgggctcgcgcatcaccggcttcggcgtggtgcgggaaacggcgcgcggttgcgaatacgtggcgtccggatgtatacggaccggtaatggccccttgcacgagcgtctacacgtggtgtttcgcagcgtccgcgaggtgatccgcacccatggcccgacggccctgagcatcgagcaggtgttcatggcgcgcaacgccgattcggccctgaagctggggcaggcgcggggggcggccatcgtcgcggcaatggaggaggggttgagcgtggcggagtacaccgcctcgcaggtcaagcaggcagtcgtggggaccggcggtgcagacaagcagcaggtgcagatgatggtcatgcatctgttgaagctgacccagaaaccgcagatagatgcttccgacgccctggccatcgccctgtgtcatgcccatacccaacagagtctggtcccccatggcctggtgggcgcacgccgacgtggcgggcgcctgcgtctttga

SEQ ID NO: 76807 - protein, 174 aa, Pseudomonas aeruginosa
MTLILGIDPGSRITGFGVVRETARGCEYVASGCIRTGNGPLHERLHVVFRSVREVIRTHGPTALSIEQVFMARNADSALKLGQARGAAIVAAMEEGLSVAEYTASQVKQAVVGTGGADKQQVQMMVMHLLKLTQKPQIDASDALAIALCHAHTQQSLVPHGLVGARRRGGRLRL

SEQ ID NO: 76808 - DNA, 510 bp, Rhizobium loti
  CDS (1)..(510)
atgggggacgcgattcgcatcatcggcatcgatccggggctcaggcgcaccggctggggcatcgtcgagagcctcggcaattccttgcgcttcgtcgcgtccggcaccgtgcgctccgaggacaaggcggcgctggcgacgcggctctgccaattgcatgacgggctcgccgaagtcctgcatgcagcaatgccgcatgaggcggccgtcgaacagactttcgtcaacaaggatgccgtggcaacattgaagctcggccaggcgcgcggcatcgccatgctggtgccggcgcgtgccggccttgtcgtcgccgaatatgcacccaatgcggtgaagaaggcggtcatcggcgtcggccatggcgacaagaagcagatccacatgatggtgaaggtgctgctgccgaaagcgaccttcgacaccgaacacgccgccgacgcgctggctatcgcgatttgccacgcgcatcaccgccagagcgctgcctaccggatggcgcttgccggataa

SEQ ID NO: 76809 - protein, 169 aa, Rhizobium loti
MGDAIRIIGIDPGLRRTGWGIVESLGNSLRFVASGTVRSEDKAALATRLCQLHDGLAEVLHAAMPHEAAVEQTFVNKDAVATLKLGQARGIAMLVPARAGLVVAEYAPNAVKKAVIGVGHGDKKQIHMMVKVLLPKATFDTEHAADALAIAICHAHHRQSAAYRMALAG

SEQ ID NO: 76810 - DNA, 513 bp, Rhizobium meliloti
  CDS (1)..(513): transl_table=11
atgcagaatacgattcgcatcatcggcatcgatccgggcttgaggcgcaccggctggggggtcatcgaaacgctcggcaattcgctgcgtttcgtcgcttccggcaccgtcacttccgatggcgagttggatcttgcctcccgcctctgccagttgcatgacgggcttgccgaggtggtgcacggctaccagccgcacgaggccgctgtcgaacagaccttcgtcaacaaagatgcgaccgccacgctgaagctcggccaggcgcgcggcatcgccatgctggtgccggcccgggcgggcttgagggtcgcggaatatgcgccgaacgccgtcaagaaagccgtgatcggcgtcggccacggcgaaaagcagcagatacatatgatgttgaaagtcctgatgcccaaggccgagttcaaaggcaacgatgccgccgacgcgctcgccatcgccatctgccacgcccataacaggcaggcagtcacgagccgccttgcggcgcttgcggggtag

SEQ ID NO: 76811 - protein, 170 aa, Rhizobium meliloti
MQNTIRIIGIDPGLRRTGWGVIETLGNSLRFVASGTVTSDGELDLASRLCQLHDGLAEVVHGYQPHEAAVEQTFVNKDATATLKLGQARGIAMLVPARAGLRVAEYAPNAVKKAVIGVGHGEKQQIHMMLKVLMPKAEFKGNDAADALAIAICHAHNRQAVTSRLAALAG

SEQ ID NO: 76812 - DNA, 537 bp, Rhodopirellula baltica
  CDS (1)..(537): transl_table=11
ttgggaacgcaagtcgtaacggctcgtcctggatcggcttcctgcattttaggaatcgacccggggctcaacaccactggttatgcggtgatctcgcgagagggaccgcgtttgtgtctgcgtgaagcgggtgtgattaaatcacgtcgttccgacacgcttcccgaacgtctgcgtgaaatccatgttgggttgtcagaggttttcgcggtgcatgccgtggacctgatggcgttggagcaattgttttcgcattacgatcggcctcgcacggcgatcctgatggggcacgctcgtggcgtgatttgtttggctgccgcttcggctggtgttcccgtcgagcattacgagccaactcgcgtcaaaaaggtgatgaccggaaacggtcgtgcgccgaaaagtcagattcagttggcggtgaagatgcaattgaatctgcagtcggttcccgaacccgccgacgtcgccgacgcgatggcaatttctttgtgcgggcactacctggccaacaacccgatcgaccaagcgttggcgtga

SEQ ID NO: 76813 - protein, 178 aa, Rhodopirellula baltica
MGTQVVTARPGSASCILGIDPGLNTTGYAVISREGPRLCLREAGVIKSRRSDTLPERLREIHVGLSEVFAVHAVDLMALEQLFSHYDRPRTAILMGHARGVICLAAASAGVPVEHYEPTRVKKVMTGNGRAPKSQIQLAVKMQLNLQSVPEPADVADAMAISLCGHYLANNPIDQALA

SEQ ID NO: 76814 - DNA, 474 bp, Rickettsia conorii
  CDS (1)..(474): transl_table=11
atgataatacttgggattgatccggcacttgggagtcttggatgggcagtagtggcaaaggagaccgcacagttgaaatatttagctagtggtattattagaacaaatagtaaggatgcaattcatcatagacttgcttttattaatagtacattagaaaaagtaatattagaatatcaaccaaatatggtagcgattgaagaaacatttgttaatactaatagcgtgacttctttaaagcttggatatgctagaggggcgataatgtcgctgatcggtagatataatttggacatgcgagagtttaagccaaatacggtaaaaaaaaccgtaacaggatatgggcatgcagaaaaagaccaaatgttgcatatgataaagcttttgctgtctggcactgccttaattaccaattctgatgaagctgacgccgtagcgattgcctatacctgcttagttacaaaaaattattaa

SEQ ID NO: 76815 - protein, 157 aa, Rickettsia conorii
MIILGIDPALGSLGWAVVAKETAQLKYLASGIIRTNSKDAIHHRLAFINSTLEKVILEYQPNMVAIEETFVNTNSVTSLKLGYARGAIMSLIGRYNLDMREFKPNTVKKTVTGYGHAEKDQMLHMIKLLLSGTALITNSDEADAVAIAYTCLVTKNY

SEQ ID NO: 76816 - DNA, 474 bp, Rickettsia prowazekii
  CDS (1)..(474)
atgatagtacttggaattgatccggcacttggaaagcttgggtgggcggtagtagctaaagaatctacaaaattgcactatttagctagtggtactattaaaacacatagtaaagatgaaatacataatagacttgcttttatcaatagcatattagaaaaagtaatattggaatatcaaccaaatattgcagcaatagaagaaacatttgttaatactaacaacgttacatcgttaaagctcggctatgctagaggagctataatgtcgctaatcggtaggtataatttggatatgcaggaatttaaaccaaatacggtaaaaaaaactgtaactggctatggtcatgcaggaaaagagcaaattttgtatatgatcaaacatttaatatccggtactgacttaattactaattctgatgaagctgatgctgtagcacttgcatatacatgtttagttgccaaaaaatattaa

SEQ ID NO: 76817 - protein, 157 aa, Rickettsia prowazekii
MIVLGIDPALGKLGWAVVAKESTKLHYLASGTIKTHSKDEIHNRLAFINSILEKVILEYQPNIAAIEETFVNTNNVTSLKLGYARGAIMSLIGRYNLDMQEFKPNTVKKTVTGYGHAGKEQILYMIKHLISGTDLITNSDEADAVALAYTCLVAKKY

SEQ ID NO: 76818 - DNA, 522 bp, Shewanella oneidensis
  CDS (1)..(522): transl_table=11
atggcaattattttaggtgttgacccgggatcgcggatcacaggttacggcgttatccaatgccaagggcggcagcaactttatttaggtagcggctgcattcgtacctcgggtgatgatttgccgttaaaattaaagcaaatctttgatggtataagtgaaattattcgccaatatcaacccgatgagtttgccattgagcgggtgtttttggctaaaaatgccgactcagccttgaaattgggtcaagcccgtggcgcagccattgtcgctgcaacagtggcaaacttacctgtcgcagaatacagcgccacccagataaaaagtgctgtagtcgggactgggcgtgctaaaaaagagcaagtacaacacatgatccagcaattgctaaagctcccagccgcaccacaggcagacgccgcggatgcgcttggcgttgcagtatgtcattatcacaccaatcaaagtttggttgccttaagcggccgagcgacaacaagaacatatggacggtacagatga

SEQ ID NO: 76819 - protein, 173 aa, Shewanella oneidensis
MAIILGVDPGSRITGYGVIQCQGRQQLYLGSGCIRTSGDDLPLKLKQIFDGISEIIRQYQPDEFAIERVFLAKNADSALKLGQARGAAIVAATVANLPVAEYSATQIKSAVVGTGRAKKEQVQHMIQQLLKLPAAPQADAADALGVAVCHYHTNQSLVALSGRATTRTYGRYR

SEQ ID NO: 76820 - DNA, 522 bp, Shigella flexneri
  CDS (1)..(522)
atggctattattctcggcattgacccgggttcgcgcgtgaccggctacggcgtcatccgccaggtaggtaggcaactgtcctacctgggtagcggatgcatacgcaccaaagtggatgatttaccgtctcgtctgaagctcatctatgcgggcgtgacggaaatcatcacccagttccagcctgattatttcgccattgaacaagtctttatggcgaagaacgctgactcagccctgaaactgggccaggcgcgcggcgtggcgattgttgcggcggtgaatcaggaattgccggtatttgaatacgcggcacgtcaggtaaagcaaacggtggtaggtatgggtagtgccgaaaaaagccaggtgcagcatatggtccgcaccttgctgaaactgcccgctaatccacaggcggatgccgccgatgcgctggcgattgccatcacccactgccacgttagtcagaatgcgatgcagatgagcgaatcgcggctgaacctgacgagagggcgactgcgttaa

SEQ ID NO: 76821 - protein, 173 aa, Shigella flexneri
MAIILGIDPGSRVTGYGVIRQVGRQLSYLGSGCIRTKVDDLPSRLKLIYAGVTEIITQFQPDYFAIEQVFMAKNADSALKLGQARGVAIVAAVNQELPVFEYAARQVKQTVVGMGSAEKSQVQHMVRTLLKLPANPQADAADALAIAITHCHVSQNAMQMSESRLNLTRGRLR

SEQ ID NO: 76822 - DNA, 531 bp, Streptomyces avermitilis
  CDS (1)..(531): transl_table=11
gtgcgggtactgggcgttgaccccgggttgacccggtgcggtgtcggcgtggtcgaaggagtcgccggccggcccctgaccatgcgcggtgtcggcgtcgtacggaccccggcggacgccgagttgggcctgcggctcgtggccatcgagcagggcatcgagcagtggctcgacgagtaccggcccgaatgcgtcgccgtggagcgggtgttcagccagcacaacgtgcgtacggtgatgggcacggcccaggccagcgcggtcgccatgctctgcgcggcccgccgcggcatccccgtcgccctgcacacccccagcgaggtcaaggccgccgtcaccggcagcggacgcgccgacaaggcccaggtcggcgcgatggtgacccgcctgctgcggctcgacgcgccgcccaagcccgccgacgccgccgacgccctcgcgctcgccatctgccacatctggcgagcccccgcccagaacagacttcagcaggccgtcgccctgcacgcatcgaaagggcgtaccgcatga

SEQ ID NO: 76823 - protein, 176 aa, Streptomyces avermitilis
MRVLGVDPGLTRCGVGVVEGVAGRPLTMRGVGVVRTPADAELGLRLVAIEQGIEQWLDEYRPECVAVERVFSQHNVRTVMGTAQASAVAMLCAARRGIPVALHTPSEVKAAVTGSGRADKAQVGAMVTRLLRLDAPPKPADAADALALAICHIWRAPAQNRLQQAVALHASKGRTA

SEQ ID NO: 76824 - DNA, 567 bp, Streptomyces coelicolor
  CDS (1)..(567): transl_table=11
gtgcgcgtactgggggtggacccgggactgacccgtcgcgggatcggcgtcgtggagggcgtcgcgggccggccgctcaccatgatcggcgtcggcgtcgtccgcacgcccgcggacgccgacctcggccaccgcctcgtcgccgtcgagcagggcatcgagcagtggctcgacgaacaccggccggagttcgtcgccgtcgagcgcgtcttcagccagcacaacgtccgcacggtcatgggcaccgcccaggccagcgccgtggcgatcctgtgcgcgtcccgccgcggcatccccgtcgccctgcacaccccgagcgaggtgaaggccgccgtcaccggcagcggccgcgcagacaaggcccaggtcggcgccatggtcacccgcctgctccggctcgccgccccgcccaagcccgccgacgccgcggacgccctcgccctcgccatctgccacatctggcgcgcccccgcgcagaatcgcctccagcaggccgtggccctgcacaccgcacagggcccgcgccgcccccacaagctccacccgtcgaaaggccgccccgcatga

SEQ ID NO: 76825 - protein, 188 aa, Streptomyces coelicolor
MRVLGVDPGLTRRGIGVVEGVAGRPLTMIGVGVVRTPADADLGHRLVAVEQGIEQWLDEHRPEFVAVERVFSQHNVRTVMGTAQASAVAILCASRRGIPVALHTPSEVKAAVTGSGRADKAQVGAMVTRLLRLAAPPKPADAADALALAICHIWRAPAQNRLQQAVALHTAQGPRRPHKLHPSKGRPA

SEQ ID NO: 76826 - DNA, 480 bp, Synechococcus elongatus
  CDS (1)..(480)
atgcgcattctcggcctcgaccctggcctagcgacccttggctatgggtgtattgaggtgtacagggacacctgccaagtgcgggattttggtgtgattaccacctctgccgacctgcctacgggcgatcgcctccaaagtctctataacgatctgcacacgctaattcccatcctccagccggatttggtggctttggagcggctctttttctacagaatgagccataccattggggttgcccaagcacggggtgtgattcttttagtcctgagccaacggcactgtcccctgctggaactgacccccccccaggtgaagcaggccctcaccggctatggcaatgccaccaaaatagaggtgcagcgggcggtgcaacgggaactccatctctgcaccctgccccagcccgatgatgccgctgatgccctagcgatcgccctcacggccagtcgtcactgcggccacatcaacggttga

SEQ ID NO: 76827 - protein, 159 aa, Synechococcus elongatus
MRILGLDPGLATLGYGCIEVYRDTCQVRDFGVITTSADLPTGDRLQSLYNDLHTLIPILQPDLVALERLFFYRMSHTIGVAQARGVILLVLSQRHCPLLELTPPQVKQALTGYGNATKIEVQRAVQRELHLCTLPQPDDAADALAIALTASRHCGHING

SEQ ID NO: 76828 - DNA, 465 bp, Synechococcus sp
  CDS (1)..(465): transl_table=11
atgcggatcctcgggatcgatccgggccttgctcgggtgggctacggggtgattgacaccagcggcgggcatcagcgcatgctggattgtggaatcatccgcaccgaccccggccgcagcgacggtgaacgcatggtggagattgccagcgacctgcggcaactgatccgtgcctggcgaccggagctcgcggccgtggagaaattcttcttctaccgctccagtaacaccatcaacgtggtgcaggccaggggggtggtgatgatgaccttggcccgattcaaggtgccggtggtggagttcccaccgatgcagatcaagctggcgctggccggtttcggccatgccgaaaaagatgaagtgctagaggcggtgatgcgagagcttgatctgaccgaaccgccgcggccggatgatgctgccgatgccctggcggtggcccttacgggctggtttcagcgatga

SEQ ID NO: 76829 - protein, 154 aa, Synechococcus sp
MRILGIDPGLARVGYGVIDTSGGHQRMLDCGIIRTDPGRSDGERMVEIASDLRQLIRAWRPELAAVEKFFFYRSSNTINVVQARGVVMMTLARFKVPVVEFPPMQIKLALAGFGHAEKDEVLEAVMRELDLTEPPRPDDAADALAVALTGWFQR

SEQ ID NO: 76830 - DNA, 504 bp, Synechocystis sp
  CDS (1)..(504)
atggatcaaactgaagcggcccaacgctggttgggcattgaccccggtttagccattattggttgggctattctcgacggtcagccggatctatcggctcacttggtggactatggcattatcgaaacatctaaaaatctcagcaccccagaaagattggtggaaattgagcaggatatccacgtcctactagaagaattttccccccaggcgatcgccatggaaatgcctttttttagtcggcaaatcaaagcggccggaggcgtaatgcaggccttgggggtgataaacctcgttatttaccgggaaaagagcattcagcccgtctttttgcaccaatccagttggaaatgccatctgggcaacggtaaagccaataaagccgaggtggccgccatggtgcagaatttttttggtctagaagacctacccatcgacgatagtgtagatgccattgccattgccctggctggtctgaacggagtccgcaacgacattggttaa

SEQ ID NO: 76831 - protein, 167 aa, Synechocystis sp
MDQTEAAQRWLGIDPGLAIIGWAILDGQPDLSAHLVDYGIIETSKNLSTPERLVEIEQDIHVLLEEFSPQAIAMEMPFFSRQIKAAGGVMQALGVINLVIYREKSIQPVFLHQSSWKCHLGNGKANKAEVAAMVQNFFGLEDLPIDDSVDAIAIALAGLNGVRNDIG

SEQ ID NO: 76832 - DNA, 507 bp, Thermotoga maritima
  CDS (1)..(507): transl_table=11
ttgggttccttgaggatccttggggtagatcccggctacggaattgtaggaataggcatcattgaagtatctggaaacagaatctctcacgttttccacggaacgatagagactcccaaaaatcttccagcggaaaagaggttgaagcgaatctacgaggagtttttgaaagttcttgaacgtttctctccagacgaatgcgccatggaaaagctgttctttgtgaaaaacgttaccacggccataggtgtgggggaggcacgtggtgtgctttttctcgctctcgcggaaaaaaacatacctgtctttgaatacgcgccgaacgaagtgaaggtttcgctgtcggggtatggaagggcaagcaagaaacagattcaggagaacgtaaagcgttttctgaacctttcggagattcccagacccgacgatgcagcggatgcactcgccatcgcctggtgtcacgcccttcagagcagagcaaggagggtaacacatgaaaaagattga

SEQ ID NO: 76833 - protein, 168 aa, Thermotoga maritima
MGSLRILGVDPGYGIVGIGIIEVSGNRISHVFHGTIETPKNLPAEKRLKRIYEEFLKVLERFSPDECAMEKLFFVKNVTTAIGVGEARGVLFLALAEKNIPVFEYAPNEVKVSLSGYGRASKKQIQENVKRFLNLSEIPRPDDAADALAIAWCHALQSRARRVTHEKD

SEQ ID NO: 76834 - DNA, 498 bp, Thermoanaerobacter tengcongensis
  CDS (1)..(498): transl_table=11
atgagggtattgggaatagatccgggaattgccacattgggatatggagtcgttgagtacaagaacaacaaattttctcccatagtttatggagccatcactacagatgcgggagttgacaaggcgtttcgtctttacaccctatataagggacttgaagatattataaagctttatcgtccagagattgtagcgattgaagagcttttctataataaaaattctaagacggtaattacaattggagaagttagagggatttcaatactggctgctgtaaattctggggtaaaagtgtatgagtatacccccctacaggtgaaacaggcagtagttgggtatgggagagcggaaaaacagcaggttcagcagatggtaaaggtgcttttaaatcttgatgagataccaaagccagatgatgtggctgatgcgctggccgttgccatttgccactgccacagcaataatatgttggaaagactggggtatgggcgatga

SEQ ID NO: 76835 - protein, 165 aa, Thermoanaerobacter tengcongensis
MRVLGIDPGIATLGYGVVEYKNNKFSPIVYGAITTDAGVDKAFRLYTLYKGLEDIIKLYRPEIVAIEELFYNKNSKTVITIGEVRGISILAAVNSGVKVYEYTPLQVKQAVVGYGRAEKQQVQQMVKVLLNLDEIPKPDDVADALAVAICHCHSNNMLERLGYGR

SEQ ID NO: 76836 - DNA, 591 bp, Treponema pallidum
  CDS (1)..(591): transl_table=11
gtgcacgcacagaacgtagatattgcgccgggcagtacctcgaccgtttccatcatagtgggtattgacccaggacttgaatctaccggatacggcgttatagaagcagggggaggcagtctgcgctgtcttacctacggggtgattgttacccaaagcaatcagccatctgctgcacgactcagacacatcttcgataccctgcaacaggtaatctcaatatatcaacctcagtattgcgcagtggagacaatctatttcgcaaagaatgtaaccagtgcgttgtgtgttgcgcaagcgcgtggggttgtattacttgctatggcacaacagcacatttcagtagctgaatacgcaccgaatgcgattaaaaaagcaataactggtattgcccaagcagaaaaaagacaggtacagcatttggtaaaaattttactcaatcttaaggatatacctcatcctgatcacgctgctgatgccctagcggttgctgttacccatgtacactgttgtatgtcttcaaactatgcggtaggttcaacgcgctctaggggagcgtacgttacgctgtacaaaaaaggtaagagatga

SEQ ID NO: 76837 - protein, 196 aa, Treponema pallidum
MHAQNVDIAPGSTSTVSIIVGIDPGLESTGYGVIEAGGGSLRCLTYGVIVTQSNQPSAARLRHIFDTLQQVISIYQPQYCAVETIYFAKNVTSALCVAQARGVVLLAMAQQHISVAEYAPNAIKKAITGIAQAEKRQVQHLVKILLNLKDIPHPDHAADALAVAVTHVHCCMSSNYAVGSTRSRGAYVTLYKKGKR

SEQ ID NO: 76838 - DNA, 522 bp, Vibrio cholerae
  CDS (1)..(522): transl_table=11
atgtctgtcatcttagggattgatcctggatcgcgcgtgacggggtatggtgtgattcgtcaacaaggacgacaccttatctacctcggtagcggttgtatccgtacttccgatctcgagttaccgttacgcctgaaacaaatctatgcgggcgtgagtgaaatcatcacccaatttcagccggatgcctttgccattgagcaggtgtttatggcaaagaatgccgattcagcattaaaacttggtcaagcccgcggcagtgcgattgtggcggcggtgaacgcagaacttcctgtttatgaatatgctgccagactgattaaacaagcggtcgttggtacgggagcggctgataaaagccaagttcaacatatggtgcagcagatgctcaaactgcccggtaagccccaagccgatgcagcagatgctttaggtgttgctatttgtcatgctaataccaacaaaactctaattgcattggcagggcaggcaacgagtgcgcgtagaggtcgttatcgttaa

SEQ ID NO: 76839 - protein, 173 aa, Vibrio cholerae
MSVILGIDPGSRVTGYGVIRQQGRHLIYLGSGCIRTSDLELPLRLKQIYAGVSEIITQFQPDAFAIEQVFMAKNADSALKLGQARGSAIVAAVNAELPVYEYAARLIKQAVVGTGAADKSQVQHMVQQMLKLPGKPQADAADALGVAICHANTNKTLIALAGQATSARRGRYR

SEQ ID NO: 76840 - DNA, 522 bp, Vibrio vulnificus
  CDS (1)..(522): transl_table=11
atgtcgattattctaggaattgacccaggctctcgcgttactggctatggtgtgattcgccaaaatggccgacacctgcaatatcttggcagtggttgtattcgtacatcagaaaaagatttacctggtcgtttaaagcaaatttatgcgggtgtaacggagattattactcagtttcagccggatgcgtttgccatcgaacaggtcttcatggcgaaaaatgccgactcagcactcaaacttggccaagcgcgtggtgcggcaatcgtttctgccgtgaatcacgatttgccagtttacgaatacgccgctcgtttgattaagcaagccgtggtaggcacgggtggggctgataaagcacaggtgcaacacatggtgcaacatatgctcaagttacccgctaaaccccaggcggacgcggccgatgcgttaggtgttgccatttgtcacgccaataccaataaaaccctcattgccttagccgggcaggcgaccagtgctaaacgaggccgttatcgctaa

SEQ ID NO: 76841 - protein, 173 aa, Vibrio vulnificus
MSIILGIDPGSRVTGYGVIRQNGRHLQYLGSGCIRTSEKDLPGRLKQIYAGVTEIITQFQPDAFAIEQVFMAKNADSALKLGQARGAAIVSAVNHDLPVYEYAARLIKQAVVGTGGADKAQVQHMVQHMLKLPAKPQADAADALGVAICHANTNKTLIALAGQATSAKRGRYR

SEQ ID NO: 76842 - DNA, 486 bp, Wigglesworthia glossinidia brevipalpis
  CDS (1)..(486)
atgtcgattataattggaatagatccaggatcatatgttacaggatatggtataattaaaagtgaaaaaaatacattaaaacacataaaaagtggttcaatttttttaaaaaaacatgattttaaaaaaagattaaaaataatttatatttgtattaaaaatattattaataaatttaaacctaaatattttgttatagaacaaatttttttttctaaaaatccatcatcagtattaaaattgggacaagctagttgcgcagctactttagctgcaataaatttagacatattgatttttgaatatgcatctaaaaaaataaaaaaaattttagttggagatggaaaagctaaaaaattacaagtaaaaaataaagtatgtagtattttaaatttgtctaaatcaattggaattgacacatctgatgctttagcagtagcaataactcatcattatttaattaataataaagataaaattttttaa

SEQ ID NO: 76843 - protein, 161 aa, Wigglesworthia glossinidia brevipalpis
MSIIIGIDPGSYVTGYGIIKSEKNTLKHIKSGSIFLKKHDFKKRLKIIYICIKNIINKFKPKYFVIEQIFFSKNPSSVLKLGQASCAATLAAINLDILIFEYASKKIKKILVGDGKAKKLQVKNKVCSILNLSKSIGIDTSDALAVAITHHYLINNKDKIF

SEQ ID NO: 76844 - DNA, 489 bp, Wolinella succinogenes
  CDS (1)..(489): transl_table=11
gtgaatattttaggaatcgaccccggaagtcgaaattgcggttacgcgatcttgcaccatgatccaaaaaaaggaaatcgcctcgttgaggcgggactcatcaaaatcaaagagcgcactttgcaacaccagattttggaatttgtggagggaatcgacctcgtgctgaaaaatcattcgattgatgaagtcgccattgaagatattttttatgcttacaatccaaaaactgttatcaaactcgctcaatttcgtggcgctttgagtctcaaaattttgcaagatttggggaatttttatgaatacactcccttacaagtgaaaaaggctctcacaggtcatggcaaggccgacaagagccaagtcgctttcatggtgaagcgtcttttagggcttaagggagagatcaaacctttagatatcaccgatgccatcgccgtggccatcacgcactctcaacgaatcaaactaggaggaatccccacatga

SEQ ID NO: 76845 - protein, 162 aa, Wolinella succinogenes
MNILGIDPGSRNCGYAILHHDPKKGNRLVEAGLIKIKERTLQHQILEFVEGIDLVLKNHSIDEVAIEDIFYAYNPKTVIKLAQFRGALSLKILQDLGNFYEYTPLQVKKALTGHGKADKSQVAFMVKRLLGLKGEIKPLDITDAIAVAITHSQRIKLGGIPT

SEQ ID NO: 76846 - DNA, 525 bp, Xanthomonas axonopodis
  CDS (1)..(525): transl_table=11
atgacccgcatcctgggcatcgatccgggttcgcagcgcaccggcatcggcatcatcgacatcgacgagggcggtcgcagccggcatgtgcaccacgcgccgctgatgctgctgggcgagggggatttctcccagcggctcaagcgcctgctgcagggcttgggcgagttgatcgagatctatcggccggatgaagtcgcgatcgaaaaggtgttcatgggcaagagtgccgcttcggcgctcaagctcggccacgcgcgcggcgcggcgatctgcgcggtggtcatgcgcgatctgccggtgcacgagtacgcggccaaagaaatcaaactggcgctggtcggcaagggcggcgccgacaaggtgcaggtgcagcacatggtcggcatcatgctcaacttgaatggcaagctgcagcccgacgctgccgacgcattggcggtcgccatcactcacgcccacgtgcgcgccaccgcgcaacgcctgggcgtcaatacccaacaggcctggagccgcaagaaatga

SEQ ID NO: 76847 - protein, 174 aa, Xanthomonas axonopodis
MTRILGIDPGSQRTGIGIIDIDEGGRSRHVHHAPLMLLGEGDFSQRLKRLLQGLGELIEIYRPDEVAIEKVFMGKSAASALKLGHARGAAICAVVMRDLPVHEYAAKEIKLALVGKGGADKVQVQHMVGIMLNLNGKLQPDAADALAVAITHAHVRATAQRLGVNTQQAWSRKK

SEQ ID NO: 76848 - DNA, 525 bp, Xanthomonas campestris
  CDS (1)..(525): transl_table=11
atgacccgcatcctcggcatcgatcccggttcgcagcgcaccggcatcggcatcatcgacgtcgacgagagcggtcgcagccggcatgtgttccatgcgccgctggtgctgctgggcgagggcgacttcgcccagcgcctgaaacgcctgctgcacgggctgggtgagctgatcgagacctaccagccgcaggaagtggcgatcgagaaggtattcatgggcaagagtgccgattcggcgctcaagctcggccacgcgcgcggggcggcgatctgcgcggtggtgctgcgcgacctgccggtgcacgagtacgctgccaccgagatcaagctcgcgctggtcggcaagggcggcgcggacaaggtccaggtgcagcacatggtcgggatcatgctcaatctcaaaggcaagctgcaggccgacgccgccgacgcgctggcggtcgccatcactcacgcccacgtgcgcgccaccgcgcagcgcctgggcgtcaatacccaacaggcgtggagccggaaaagatga

SEQ ID NO: 76849 - protein, 174 aa, Xanthomonas campestris
MTRILGIDPGSQRTGIGIIDVDESGRSRHVFHAPLVLLGEGDFAQRLKRLLHGLGELIETYQPQEVAIEKVFMGKSADSALKLGHARGAAICAVVLRDLPVHEYAATEIKLALVGKGGADKVQVQHMVGIMLNLKGKLQADAADALAVAITHAHVRATAQRLGVNTQQAWSRKR

SEQ ID NO: 76850 - DNA, 522 bp, Xylella fastidiosa
  CDS (1)..(522)
atgacgcgtatcctcggtattgatcctggatcacagcgcactggagttggtgtcattgatgtcgatgagtatggatgtagccgccatgtctaccatgcaccattggtactactaggtcagagtagttttgcggggcggctgaagcagttgttgttgggtctgagcgcagtgattgaggagtacagcccaaaggaagtggccattgagaaggtgtttatgtctaagaatgctgactcagcacttaagcttggtcaggcgcgcggtgtggcaatcagtgcggtagtgctacgtgatttacctgtgcatgagtacgctgccaggcaaatcaaacttgctgtggttggtcgcggtggtgccgacaagcaacagatccagcatatggttggtgtcatgctgaatctgcaaggtaggttacagtctgatgcagcagatgcattggcggtcgctatcacgcatgctcatgtgagtgctactgcgcagcgcttaggtgtcagtacgaagcaggcgtggagccggaaatga

SEQ ID NO: 76851 - protein, 173 aa, Xylella fastidiosa
MTRILGIDPGSQRTGVGVIDVDEYGCSRHVYHAPLVLLGQSSFAGRLKQLLLGLSAVIEEYSPKEVAIEKVFMSKNADSALKLGQARGVAISAVVLRDLPVHEYAARQIKLAVVGRGGADKQQIQHMVGVMLNLQGRLQSDAADALAVAITHAHVSATAQRLGVSTKQAWSRK

SEQ ID NO: 76852 - DNA, 522 bp, Yersinia pestis
  CDS (1)..(522): transl_table=11
atggcgatcgtattaggtatcgaccccggttctcgtgttaccggctatggtgttatccgccagcaaggtcgtcaacttacgtatctgggcagtggctgtatccgcactgtggttgacgatatgcctactcgcttgaagttgatatacgcaggtgtgaccgaaatcattacgcagtttcagccagatttttttgctatcgaacaagtctttatggcaaaaaatccggactcggcattaaaactggggcaagcgcgtggcgcggccattgtggcggcagtaaacctcaatttacctgtctctgaatacgccgcacgtcaggtaaaacagacggttgtagggaccggcgcggcagaaaaaagccaggtccagcacatggtgcgctccctgcttaaattaccggcgaatccacaagcggatgcggcggatgcattagctatcgccattacacattgtcatctgagccaaaatacgttgcgtttgggtaatgaccaaatgacattatcacgtggccggatacgctga

SEQ ID NO: 76853 - protein, 173 aa, Yersinia pestis
MAIVLGIDPGSRVTGYGVIRQQGRQLTYLGSGCIRTVVDDMPTRLKLIYAGVTEIITQFQPDFFAIEQVFMAKNPDSALKLGQARGAAIVAAVNLNLPVSEYAARQVKQTVVGTGAAEKSQVQHMVRSLLKLPANPQADAADALAIAITHCHLSQNTLRLGNDQMTLSRGRIR

SEQ ID NO: 76854 - DNA, 25 bp, Primer
atggctattattctcggcattgatc

SEQ ID NO: 76855 - DNA, 21 bp, Primer
ttaacgcagtcgccctctcgc

SEQ ID NO: 76856 - protein, 167 aa, consensus
  MISC_FEATURE (1)..(167): consensus for the disclosure of xaa see table XV
GXDPGXXXXGXXXXXXXXXXXXXXXXXXXXXXXGXXXXXXXXXXXXXXXXXRLXXXXXXXXXXXXXXXXXXXXPXXXAXEXXFXXXXXXXXXXXXXXARGXXXXXXXXXXXXXXEXXXXXXKXXXXGXGXAXKXQXXXMVXXXLXXXXXXXXXXXDXXDALAXAXXH

SEQ ID NO: 76857 - protein, 16 aa, consensus
  MISC_FEATURE (1)..(16): consensus for the disclosure of xaa see table XV
XXGXDPXXXXXGXXXX

SEQ ID NO: 76858 - protein, 91 aa, consensus
  MISC_FEATURE (1)..(91): consensus for the disclosure of xaa see table XV
XXXXXXEXXXXXXXXXXXXXXXXXXXXXXXXXXXXXXXXXXXXXXXXXXXXXXGXXXXXKXXXXXXXXXXXXXXXXXXXXXXXXXDXXXXX

SEQ ID NO: 76859 - DNA, 591 bp, Escherichia coli K12; identical to SEQ ID NO: 30305
  CDS (1)..(591): transl_table=11

SEQ ID NO: 76860 - protein, 196 aa, Escherichia coli K12; identical to SEQ ID NO: 30306

SEQ ID NO: 76861 - DNA, 591 bp, Idiomarina loihiensis L2TR; identical to SEQ ID NO: 30307
  CDS (1)..(591)

SEQ ID NO: 76862 - protein, 196 aa, Idiomarina loihiensis L2TR; identical to SEQ ID NO: 30308

SEQ ID NO: 76863 - DNA, 639 bp, Silicibacter pomeroyi DSS-3; identical to SEQ ID NO: 30309
  CDS (1)..(639)

SEQ ID NO: 76864 - protein, 212 aa, Silicibacter pomeroyi DSS-3; identical to SEQ ID NO: 30310

SEQ ID NO: 76865 - DNA, 597 bp, Methanocaldococcus jannaschii DSM 2661; identical to SEQ ID NO: 30311
  CDS (1)..(597): transl_table=11

SEQ ID NO: 76866 - protein, 198 aa, Methanocaldococcus jannaschii DSM 2661; identical to SEQ ID NO: 30312

SEQ ID NO: 76867 - DNA, 855 bp, Halobacterium sp. NRC-1; identical to SEQ ID NO: 30313
  CDS (1)..(855): transl_table=11

SEQ ID NO: 76868 - protein, 284 aa, Halobacterium sp. NRC-1; identical to SEQ ID NO: 30314

SEQ ID NO: 76869 - DNA, 666 bp, Agrobacterium tumefaciens str. C58; identical to SEQ ID NO: 30315
  CDS (1)..(666): transl_table=11

SEQ ID NO: 76870 - protein, 221 aa, Agrobacterium tumefaciens str. C58; identical to SEQ ID NO: 30316

SEQ ID NO: 76871 - DNA, 594 bp, Sulfolobus tokodaii str. 7; identical to SEQ ID NO: 30317
  CDS (1)..(594): transl_table=11

SEQ ID NO: 76872 - protein, 197 aa, Sulfolobus tokodaii str. 7; identical to SEQ ID NO: 30318

SEQ ID NO: 76873 - DNA, 594 bp, Salmonella typhimurium LT2; identical to SEQ ID NO: 30319
  CDS (1)..(594): transl_table=11

SEQ ID NO: 76874 - protein, 197 aa, Salmonella typhimurium LT2; identical to SEQ ID NO: 30320

SEQ ID NO: 76875 - DNA, 735 bp, Brucella melitensis 16M; identical to SEQ ID NO: 30321
  CDS (1)..(735): transl_table=11

SEQ ID NO: 76876 - protein, 244 aa, Brucella melitensis 16M; identical to SEQ ID NO: 30322

SEQ ID NO: 76877 - DNA, 624 bp, Methanosarcina mazei Go1; identical to SEQ ID NO: 30323
  CDS (1)..(624): transl_table=11

SEQ ID NO: 76878 - protein, 207 aa, Methanosarcina mazei Go1; identical to SEQ ID NO: 30324

SEQ ID NO: 76879 - DNA, 1650 bp, Eremothecium gossypii; identical to SEQ ID NO: 30325
  CDS (1)..(1650)

SEQ ID NO: 76880 - protein, 549 aa, Eremothecium gossypii; identical to SEQ ID NO: 30326

SEQ ID NO: 76881 - DNA, 1662 bp, Neurospora crassa; identical to SEQ ID NO: 30327
  CDS (1)..(1662)

SEQ ID NO: 76882 - protein, 553 aa, Neurospora crassa; identical to SEQ ID NO: 30328

SEQ ID NO: 76883 - DNA, 1668 bp, Magnaporthe grisea 70-15; identical to SEQ ID NO: 30329
  CDS (1)..(1668)

SEQ ID NO: 76884 - protein, 555 aa, Magnaporthe grisea 70-15; identical to SEQ ID NO: 30330

SEQ ID NO: 76885 - DNA, 1650 bp, Gibberella zeae PH-1; identical to SEQ ID NO: 30331
  CDS (1)..(1650)

SEQ ID NO: 76886 - protein, 549 aa, Gibberella zeae PH-1; identical to SEQ ID NO: 30332

SEQ ID NO: 76887 - DNA, 1848 bp, Ustilago maydis 521; identical to SEQ ID NO: 30333
  CDS (1)..(1848)

SEQ ID NO: 76888 - protein, 615 aa, Ustilago maydis 521; identical to SEQ ID NO: 30334

SEQ ID NO: 76889 - DNA, 1662 bp, Aspergillus nidulans FGSC A4; identical to SEQ ID NO: 30335
  CDS (1)..(1662)

SEQ ID NO: 76890 - protein, 553 aa, Aspergillus nidulans FGSC A4; identical to SEQ ID NO: 30336

SEQ ID NO: 76891 - DNA, 1659 bp, Candida glabrata CBS138; identical to SEQ ID NO: 30337
  CDS (1)..(1659)

SEQ ID NO: 76892 - protein, 552 aa, Candida glabrata CBS138; identical to SEQ ID NO: 30338

SEQ ID NO: 76893 - DNA, 1659 bp, Kluyveromyces lactis NRRL Y-1140; identical to SEQ ID NO: 30339
  CDS (1)..(1659)

SEQ ID NO: 76894 - protein, 552 aa, Kluyveromyces lactis NRRL Y-1140; identical to SEQ ID NO: 30340

SEQ ID NO: 76895 - DNA, 1773 bp, Debaryomyces hansenii CBS767; identical to SEQ ID NO: 30341
  CDS (1)..(1773)

SEQ ID NO: 76896 - protein, 590 aa, Debaryomyces hansenii CBS767; identical to SEQ ID NO: 30342

SEQ ID NO: 76897 - DNA, 1662 bp, Yarrowia lipolytica CLIB99; identical to SEQ ID NO: 30343
  CDS (1)..(1662)

SEQ ID NO: 76898 - protein, 553 aa, Yarrowia lipolytica CLIB99; identical to SEQ ID NO: 30344

SEQ ID NO: 76899 - DNA, 627 bp, Listeria monocytogenes str. 4b F2365; identical to SEQ ID NO: 30345
  CDS (1)..(627): transl_table=11

SEQ ID NO: 76900 - protein, 208 aa, Listeria monocytogenes str. 4b F2365; identical to SEQ ID NO: 30346

SEQ ID NO: 76901 - DNA, 561 bp, Picrophilus torridus DSM 9790; identical to SEQ ID NO: 30347
  CDS (1)..(561): transl_table=11

SEQ ID NO: 76902 - protein, 186 aa, Picrophilus torridus DSM 9790; identical to SEQ ID NO: 30348

SEQ ID NO: 76903 - DNA, 630 bp, Bacillus thuringiensis serovar konkukian str. 97-27; identical to SEQ ID NO: 30349
  CDS (1)..(630): transl_table=11

SEQ ID NO: 76904 - protein, 209 aa, Bacillus thuringiensis serovar konkukian str. 97-27; identical to SEQ ID NO: 30350

SEQ ID NO: 76905 - DNA, 618 bp, Acinetobacter sp. ADP1; identical to SEQ ID NO: 30351
  CDS (1)..(618): transl_table=11

SEQ ID NO: 76906 - protein, 205 aa, Acinetobacter sp. ADP1; identical to SEQ ID NO: 30352

SEQ ID NO: 76907 - DNA, 591 bp, Erwinia carotovora subsp. atroseptica SCRI1043; identical to SEQ ID NO: 30353
  CDS (1)..(591)

SEQ ID NO: 76908 - protein, 196 aa, Erwinia carotovora subsp. atroseptica SCRI1043; identical to SEQ ID NO: 30354

SEQ ID NO: 76909 - DNA, 654 bp, Propionibacterium acnes KPA171202; identical to SEQ ID NO: 30355
  CDS (1)..(654): transl_table=11

SEQ ID NO: 76910 - protein, 217 aa, Propionibacterium acnes KPA171202; identical to SEQ ID NO: 30356

SEQ ID NO: 76911 - DNA, 630 bp, Leifsonia xyli subsp. xyli str. CTCB07; identical to SEQ ID NO: 30357
  CDS (1)..(630): transl_table=11

SEQ ID NO: 76912 - protein, 209 aa, Leifsonia xyli subsp. xyli str. CTCB07; identical to SEQ ID NO: 30358

SEQ ID NO: 76913 - DNA, 1593 bp, Desulfotalea psychrophila LSv54; identical to SEQ ID NO: 30359
  CDS (1)..(1593): transl_table=11

SEQ ID NO: 76914 - protein, 530 aa, Desulfotalea psychrophila LSv54; identical to SEQ ID NO: 30360

SEQ ID NO: 76915 - DNA, 639 bp, Symbiobacterium thermophilum IAM 14863; identical to SEQ ID NO: 30361
  CDS (1)..(639): transl_table=11

SEQ ID NO: 76916 - protein, 212 aa, Symbiobacterium thermophilum IAM 14863; identical to SEQ ID NO: 30362

SEQ ID NO: 76917 - DNA, 630 bp, Bacillus cereus ZK; identical to SEQ ID NO: 30363
  CDS (1)..(630): transl_table=11

SEQ ID NO: 76918 - protein, 209 aa, Bacillus cereus ZK; identical to SEQ ID NO: 30364

SEQ ID NO: 76919 - DNA, 585 bp, Mannheimia succiniciproducens MBEL55E; identical to SEQ ID NO: 30365
  CDS (1)..(585): transl_table=11

SEQ ID NO: 76920 - protein, 194 aa, Mannheimia succiniciproducens MBEL55E; identical to SEQ ID NO: 30366

SEQ ID NO: 76921 - DNA, 639 bp, Bacillus licheniformis DSM 13; identical to SEQ ID NO: 30367
  CDS (1)..(639): transl_table=11

SEQ ID NO: 76922 - protein, 212 aa, Bacillus licheniformis DSM 13; identical to SEQ ID NO: 30368

SEQ ID NO: 76923 - DNA, 600 bp, Legionella pneumophila subsp. pneumophila str. Philadelphia 1; identical to SEQ ID NO: 30369
  CDS (1)..(600): transl_table=11

SEQ ID NO: 76924 - protein, 199 aa, Legionella pneumophila subsp. pneumophila str. Philadelphia 1; identical to SEQ ID NO: 30370

SEQ ID NO: 76925 - DNA, 591 bp, Bacteroides fragilis YCH46; identical to SEQ ID NO: 30371
  CDS (1)..(591): transl_table=11

SEQ ID NO: 76926 - protein, 196 aa, Bacteroides fragilis YCH46; identical to SEQ ID NO: 30372

SEQ ID NO: 76927 - DNA, 642 bp, Burkholderia mallei ATCC 23344; identical to SEQ ID NO: 30373
  CDS (1)..(642): transl_table=11

SEQ ID NO: 76928 - protein, 213 aa, Burkholderia mallei ATCC 23344; identical to SEQ ID NO: 30374

SEQ ID NO: 76929 - DNA, 654 bp, Methylococcus capsulatus str. Bath; identical to SEQ ID NO: 30375
  CDS (1)..(654): transl_table=11

SEQ ID NO: 76930 - protein, 217 aa, Methylococcus capsulatus str. Bath; identical to SEQ ID NO: 30376

SEQ ID NO: 76931 - DNA, 636 bp, Nocardia farcinica IFM 10152; identical to SEQ ID NO: 30377
  CDS (1)..(636): transl_table=11

SEQ ID NO: 76932 - protein, 211 aa, Nocardia farcinica IFM 10152; identical to SEQ ID NO: 30378

SEQ ID NO: 76933 - DNA, 642 bp, Legionella pneumophila str. Lens; identical to SEQ ID NO: 30379
  CDS (1)..(642): transl_table=11

SEQ ID NO: 76934 - protein, 213 aa, Legionella pneumophila str. Lens; identical to SEQ ID NO: 30380

SEQ ID NO: 76935 - DNA, 618 bp, Leuconostoc mesenteroides subsp. mesenteroides ATCC 8293; identical to SEQ ID NO: 30381
  CDS (1)..(618)

SEQ ID NO: 76936 - protein, 205 aa, Leuconostoc mesenteroides subsp. mesenteroides ATCC 8293; identical to SEQ ID NO: 30382

SEQ ID NO: 76937 - DNA, 639 bp, Azotobacter vinelandii; identical to SEQ ID NO: 30383
  CDS (1)..(639)

SEQ ID NO: 76938 - protein, 212 aa, Azotobacter vinelandii; identical to SEQ ID NO: 30384

SEQ ID NO: 76939 - DNA, 636 bp, Desulfitobacterium hafniense DCB-2; identical to SEQ ID NO: 30385
  CDS (1)..(636)

SEQ ID NO: 76940 - protein, 211 aa, Desulfitobacterium hafniense DCB-2; identical to SEQ ID NO: 30386

SEQ ID NO: 76941 - DNA, 636 bp, Nostoc punctiforme PCC 73102; identical to SEQ ID NO: 30387
  CDS (1)..(636)

SEQ ID NO: 76942 - protein, 211 aa, Nostoc punctiforme PCC 73102; identical to SEQ ID NO: 30388

SEQ ID NO: 76943 - DNA, 639 bp, Pseudomonas syringae pv. syringae B728a; identical to SEQ ID NO: 30389
  CDS (1)..(639)

SEQ ID NO: 76944 - protein, 212 aa, Pseudomonas syringae pv. syringae B728a; identical to SEQ ID NO: 30390

SEQ ID NO: 76945 - DNA, 642 bp, Desulfovibrio desulfuricans G20; identical to SEQ ID NO: 30391
  CDS (1)..(642)

SEQ ID NO: 76946 - protein, 213 aa, Desulfovibrio desulfuricans G20; identical to SEQ ID NO: 30392

SEQ ID NO: 76947 - DNA, 591 bp, Actinobacillus pleuropneumoniae serovar 1 str. 4074; identical to SEQ ID NO: 30393
  CDS (1)..(591)

SEQ ID NO: 76948 - protein, 196 aa, Actinobacillus pleuropneumoniae serovar 1 str. 4074; identical to SEQ ID NO: 30394

SEQ ID NO: 76949 - DNA, 645 bp, Psychrobacter sp. 273-4; identical to SEQ ID NO: 30395
  CDS (1)..(645)

SEQ ID NO: 76950 - protein, 214 aa, Psychrobacter sp. 273-4; identical to SEQ ID NO: 30396

SEQ ID NO: 76951 - DNA, 609 bp, Methanococcoides burtonii DSM 6242; identical to SEQ ID NO: 30397
  CDS (1)..(609)

SEQ ID NO: 76952 - protein, 202 aa, Methanococcoides burtonii DSM 6242; identical to SEQ ID NO: 30398

SEQ ID NO: 76953 - DNA, 648 bp, Dechloromonas aromatica RCB; identical to SEQ ID NO: 30399
  CDS (1)..(648)

SEQ ID NO: 76954 - protein, 215 aa, Dechloromonas aromatica RCB; identical to SEQ ID NO: 30400

SEQ ID NO: 76955 - DNA, 636 bp, Anabaena variabilis ATCC 29413; identical to SEQ ID NO: 30401
  CDS (1)..(636)

SEQ ID NO: 76956 - protein, 211 aa, Anabaena variabilis ATCC 29413; identical to SEQ ID NO: 30402

SEQ ID NO: 76957 - DNA, 654 bp, Synechococcus elongatus PCC 7942; identical to SEQ ID NO: 30403
  CDS (1)..(654)

SEQ ID NO: 76958 - protein, 217 aa, Synechococcus elongatus PCC 7942; identical to SEQ ID NO: 30404

SEQ ID NO: 76959 - DNA, 615 bp, Methylobacillus flagellatus KT; identical to SEQ ID NO: 30405
  CDS (1)..(615)

SEQ ID NO: 76960 - protein, 204 aa, Methylobacillus flagellatus KT; identical to SEQ ID NO: 30406

SEQ ID NO: 76961 - DNA, 636 bp, Crocosphaera watsonii WH 8501; identical to SEQ ID NO: 30407
  CDS (1)..(636)

SEQ ID NO: 76962 - protein, 211 aa, Crocosphaera watsonii WH 8501; identical to SEQ ID NO: 30408

SEQ ID NO: 76963 - DNA, 588 bp, Exiguobacterium sp. 255-15; identical to SEQ ID NO: 30409
  CDS (1)..(588)

SEQ ID NO: 76964 - protein, 195 aa, Exiguobacterium sp. 255-15; identical to SEQ ID NO: 30410

SEQ ID NO: 76965 - DNA, 651 bp, Mesorhizobium sp. BNC1; identical to SEQ ID NO: 30411
  CDS (1)..(651)

SEQ ID NO: 76966 - protein, 216 aa, Mesorhizobium sp. BNC1; identical to SEQ ID NO: 30412

SEQ ID NO: 76967 - DNA, 618 bp, Rubrobacter xylanophilus DSM 9941; identical to SEQ ID NO: 30413
  CDS (1)..(618)

SEQ ID NO: 76968 - protein, 205 aa, Rubrobacter xylanophilus DSM 9941; identical to SEQ ID NO: 30414

SEQ ID NO: 76969 - DNA, 639 bp, Rhodobacter sphaeroides 2.4.1; identical to SEQ ID NO: 30415
  CDS (1)..(639)

SEQ ID NO: 76970 - protein, 212 aa, Rhodobacter sphaeroides 2.4.1; identical to SEQ ID NO: 30416

SEQ ID NO: 76971 - DNA, 651 bp, Magnetospirillum magnetotacticum MS-1; identical to SEQ ID NO: 30417
  CDS (1)..(651)

SEQ ID NO: 76972 - protein, 216 aa, Magnetospirillum magnetotacticum MS-1; identical to SEQ ID NO: 30418

SEQ ID NO: 76973 - DNA, 609 bp, Burkholderia cepacia R18194; identical to SEQ ID NO: 30419
  CDS (1)..(609)

SEQ ID NO: 76974 - protein, 202 aa, Burkholderia cepacia R18194; identical to SEQ ID NO: 30420

SEQ ID NO: 76975 - DNA, 609 bp, Burkholderia cepacia R1808; identical to SEQ ID NO: 30421
  CDS (1)..(609)

SEQ ID NO: 76976 - protein, 202 aa, Burkholderia cepacia R1808; identical to SEQ ID NO: 30422

SEQ ID NO: 76977 - DNA, 627 bp, Listeria monocytogenes str. 1/2a F6854; identical to SEQ ID NO: 30423
  CDS (1)..(627): transl_table=11

SEQ ID NO: 76978 - protein, 208 aa, Listeria monocytogenes str. 1/2a F6854; identical to SEQ ID NO: 30424

SEQ ID NO: 76979 - DNA, 630 bp, Bacillus cereus G9241; identical to SEQ ID NO: 30425
  CDS (1)..(630): transl_table=11

SEQ ID NO: 76980 - protein, 209 aa, Bacillus cereus G9241; identical to SEQ ID NO: 30426

SEQ ID NO: 76981 - DNA, 657 bp, Rubrivivax gelatinosus PM1; identical to SEQ ID NO: 30427
  CDS (1)..(657)

SEQ ID NO: 76982 - protein, 218 aa, Rubrivivax gelatinosus PM1; identical to SEQ ID NO: 30428

SEQ ID NO: 76983 - DNA, 726 bp, Rhodospirillum rubrum; identical to SEQ ID NO: 30429
  CDS (1)..(726)

SEQ ID NO: 76984 - protein, 241 aa, Rhodospirillum rubrum; identical to SEQ ID NO: 30430

SEQ ID NO: 76985 - DNA, 636 bp, Magnetococcus sp. MC-1; identical to SEQ ID NO: 30431
  CDS (1)..(636)

SEQ ID NO: 76986 - protein, 211 aa, Magnetococcus sp. MC-1; identical to SEQ ID NO: 30432

SEQ ID NO: 76987 - DNA, 639 bp, Magnetococcus sp. MC-1; identical to SEQ ID NO: 30433
  CDS (1)..(639)

SEQ ID NO: 76988 - protein, 212 aa, Magnetococcus sp. MC-1; identical to SEQ ID NO: 30434

SEQ ID NO: 76989 - DNA, 636 bp, Thermobifida fusca; identical to SEQ ID NO: 30435
  CDS (1)..(636)

SEQ ID NO: 76990 - protein, 211 aa, Thermobifida fusca; identical to SEQ ID NO: 30436

SEQ ID NO: 76991 - DNA, 609 bp, Methanosarcina barkeri str. fusaro; identical to SEQ ID NO: 30437
  CDS (1)..(609)

SEQ ID NO: 76992 - protein, 202 aa, Methanosarcina barkeri str. fusaro; identical to SEQ ID NO: 30438

SEQ ID NO: 76993 - DNA, 633 bp, Geobacter metallireducens GS-15; identical to SEQ ID NO: 30439
  CDS (1)..(633)

SEQ ID NO: 76994 - protein, 210 aa, Geobacter metallireducens GS-15; identical to SEQ ID NO: 30440

SEQ ID NO: 76995 - DNA, 630 bp, Novosphingobium aromaticivorans DSM 12444; identical to SEQ ID NO: 30441
  CDS (1)..(630)

SEQ ID NO: 76996 - protein, 209 aa, Novosphingobium aromaticivorans DSM 12444; identical to SEQ ID NO: 30442

SEQ ID NO: 76997 - DNA, 570 bp, Ferroplasma acidarmanus; identical to SEQ ID NO: 30443
  CDS (1)..(570)

SEQ ID NO: 76998 - protein, 189 aa, Ferroplasma acidarmanus; identical to SEQ ID NO: 30444

SEQ ID NO: 76999 - DNA, 582 bp, Cytophaga hutchinsonii; identical to SEQ ID NO: 30445
  CDS (1)..(582)

SEQ ID NO: 77000 - protein, 193 aa, Cytophaga hutchinsonii; identical to SEQ ID NO: 30446

SEQ ID NO: 77001 - DNA, 615 bp, Clostridium thermocellum ATCC 27405; identical to SEQ ID NO: 30447
  CDS (1)..(615)

SEQ ID NO: 77002 - protein, 204 aa, Clostridium thermocellum ATCC 27405; identical to SEQ ID NO: 30448

SEQ ID NO: 77003 - DNA, 678 bp, Microbulbifer degradans 2-40; identical to SEQ ID NO: 30449
  CDS (1)..(678)

SEQ ID NO: 77004 - protein, 225 aa, Microbulbifer degradans 2-40; identical to SEQ ID NO: 30450

SEQ ID NO: 77005 - DNA, 645 bp, Trichodesmium erythraeum IMS101; identical to SEQ ID NO: 30451
  CDS (1)..(645)

SEQ ID NO: 77006 - protein, 214 aa, Trichodesmium erythraeum IMS101; identical to SEQ ID NO: 30452

SEQ ID NO: 77007 - DNA, 633 bp, Moorella thermoacetica ATCC 39073; identical to SEQ ID NO: 30453
  CDS (1)..(633)

SEQ ID NO: 77008 - protein, 210 aa, Moorella thermoacetica ATCC 39073; identical to SEQ ID NO: 30454

SEQ ID NO: 77009 - DNA, 687 bp, Thiobacillus denitrificans ATCC 25259; identical to SEQ ID NO: 30455
  CDS (1)..(687)

SEQ ID NO: 77010 - protein, 228 aa, Thiobacillus denitrificans ATCC 25259; identical to SEQ ID NO: 30456

SEQ ID NO: 77011 - DNA, 639 bp, Silicibacter sp. TM1040; identical to SEQ ID NO: 30457
  CDS (1)..(639)

SEQ ID NO: 77012 - protein, 212 aa, Silicibacter sp. TM1040; identical to SEQ ID NO: 30458

SEQ ID NO: 77013 - DNA, 639 bp, Pseudomonas aeruginosa UCBPP-PA14; identical to SEQ ID NO: 30459
  CDS (1)..(639)

SEQ ID NO: 77014 - protein, 212 aa, Pseudomonas aeruginosa UCBPP-PA14; identical to SEQ ID NO: 30460

SEQ ID NO: 77015 - DNA, 654 bp, Ralstonia eutropha JMP134; identical to SEQ ID NO: 30461
  CDS (1)..(654)

SEQ ID NO: 77016 - protein, 217 aa, Ralstonia eutropha JMP134; identical to SEQ ID NO: 30462

SEQ ID NO: 77017 - DNA, 654 bp, Polaromonas sp. JS666; identical to SEQ ID NO: 30463
  CDS (1)..(654)

SEQ ID NO: 77018 - protein, 217 aa, Polaromonas sp. JS666; identical to SEQ ID NO: 30464

SEQ ID NO: 77019 - DNA, 699 bp, Haloarcula marismortui ATCC 43049; identical to SEQ ID NO: 30465
  CDS (1)..(699)

SEQ ID NO: 77020 - protein, 232 aa, Haloarcula marismortui ATCC 43049; identical to SEQ ID NO: 30466

SEQ ID NO: 77021 - DNA, 621 bp, uncultured archaeon GZfos18F2; identical to SEQ ID NO: 30467
  CDS (1)..(621)

SEQ ID NO: 77022 - protein, 206 aa, uncultured archaeon GZfos18F2; identical to SEQ ID NO: 30468

SEQ ID NO: 77023 - DNA, 693 bp, uncultured archaeon GZfos14B8; identical to SEQ ID NO: 30469
  CDS (1)..(693)

SEQ ID NO: 77024 - protein, 230 aa, uncultured archaeon GZfos14B8; identical to SEQ ID NO: 30470

SEQ ID NO: 77025 - DNA, 609 bp, uncultured bacterium 440; identical to SEQ ID NO: 30471
  CDS (1)..(609): transl_table=11

SEQ ID NO: 77026 - protein, 202 aa, uncultured bacterium 440; identical to SEQ ID NO: 30472

SEQ ID NO: 77027 - DNA, 612 bp, Rhizobium leguminosarum bv; identical to SEQ ID NO: 30473
  CDS (1)..(612): transl_table=11

SEQ ID NO: 77028 - protein, 203 aa, Rhizobium leguminosarum bv; identical to SEQ ID NO: 30474

SEQ ID NO: 77029 - DNA, 1779 bp, Arabidopsis thaliana; identical to SEQ ID NO: 30475
  CDS (1)..(1779)

SEQ ID NO: 77030 - protein, 592 aa, Arabidopsis thaliana; identical to SEQ ID NO: 30476

SEQ ID NO: 77031 - DNA, 615 bp, Pseudomonas aeruginosa; identical to SEQ ID NO: 30477
  CDS (1)..(615): transl_table=11

SEQ ID NO: 77032 - protein, 204 aa, Pseudomonas aeruginosa; identical to SEQ ID NO: 30478

SEQ ID NO: 77033 - DNA, 1884 bp, Candida albicans; identical to SEQ ID NO: 30479
  CDS (1)..(1884): transl_table=12

SEQ ID NO: 77034 - protein, 627 aa, Candida albicans; identical to SEQ ID NO: 30480

SEQ ID NO: 77035 - DNA, 606 bp, Campylobacter jejuni; identical to SEQ ID NO: 30481
  CDS (1)..(606): transl_table=11

SEQ ID NO: 77036 - protein, 201 aa, Campylobacter jejuni; identical to SEQ ID NO: 30482

SEQ ID NO: 77037 - DNA, 633 bp, Leptospira interrogans; identical to SEQ ID NO: 30483
  CDS (1)..(633): transl_table=11

SEQ ID NO: 77038 - protein, 210 aa, Leptospira interrogans; identical to SEQ ID NO: 30484

SEQ ID NO: 77039 - DNA, 651 bp, Prochlorococcus marinus; identical to SEQ ID NO: 30485
  CDS (1)..(651): transl_table=11

SEQ ID NO: 77040 - protein, 216 aa, Prochlorococcus marinus; identical to SEQ ID NO: 30486

SEQ ID NO: 77041 - DNA, 633 bp, Synechococcus sp; identical to SEQ ID NO: 30487
  CDS (1)..(633): transl_table=11

SEQ ID NO: 77042 - protein, 210 aa, Synechococcus sp; identical to SEQ ID NO: 30488

SEQ ID NO: 77043 - DNA, 588 bp, Campylobacter jejuni; identical to SEQ ID NO: 30489
  CDS (1)..(588): transl_table=11

SEQ ID NO: 77044 - protein, 195 aa, Campylobacter jejuni; identical to SEQ ID NO: 30490

SEQ ID NO: 77045 - DNA, 615 bp, Leptospira interrogans; identical to SEQ ID NO: 30491
  CDS (1)..(615): transl_table=11

SEQ ID NO: 77046 - protein, 204 aa, Leptospira interrogans; identical to SEQ ID NO: 30492

SEQ ID NO: 77047 - DNA, 609 bp, Pseudomonas aeruginosa; identical to SEQ ID NO: 30493
  CDS (1)..(609): transl_table=11

SEQ ID NO: 77048 - protein, 202 aa, Pseudomonas aeruginosa; identical to SEQ ID NO: 30494

SEQ ID NO: 77049 - DNA, 639 bp, Synechococcus sp; identical to SEQ ID NO: 30495
  CDS (1)..(639): transl_table=11

SEQ ID NO: 77050 - protein, 212 aa, Synechococcus sp; identical to SEQ ID NO: 30496

SEQ ID NO: 77051 - DNA, 621 bp, Vibrio vulnificus; identical to SEQ ID NO: 30497
  CDS (1)..(621): transl_table=11

SEQ ID NO: 77052 - protein, 206 aa, Vibrio vulnificus; identical to SEQ ID NO: 30498

SEQ ID NO: 77053 - DNA, 636 bp, Anabaena sp; identical to SEQ ID NO: 30499
  CDS (1)..(636): transl_table=11

SEQ ID NO: 77054 - protein, 211 aa, Anabaena sp; identical to SEQ ID NO: 30500

SEQ ID NO: 77055 - DNA, 624 bp, Aquifex aeolicus; identical to SEQ ID NO: 30501
  CDS (1)..(624): transl_table=11

SEQ ID NO: 77056 - protein, 207 aa, Aquifex aeolicus; identical to SEQ ID NO: 30502

SEQ ID NO: 77057 - DNA, 594 bp, Archaeoglobus fulgidus; identical to SEQ ID NO: 30503
  CDS (1)..(594): transl_table=11

SEQ ID NO: 77058 - protein, 197 aa, Archaeoglobus fulgidus; identical to SEQ ID NO: 30504

SEQ ID NO: 77059 - DNA, 579 bp, Azospirillum brasilense; identical to SEQ ID NO: 30505
  CDS (1)..(579): transl_table=11

SEQ ID NO: 77060 - protein, 192 aa, Azospirillum brasilense; identical to SEQ ID NO: 30506

SEQ ID NO: 77061 - DNA, 630 bp, Bacillus cereus; identical to SEQ ID NO: 30507
  CDS (1)..(630): transl_table=11

SEQ ID NO: 77062 - protein, 209 aa, Bacillus cereus; identical to SEQ ID NO: 30508

SEQ ID NO: 77063 - DNA, 630 bp, Bacillus cereus; identical to SEQ ID NO: 30509
  CDS (1)..(630): transl_table=11

SEQ ID NO: 77064 - protein, 209 aa, Bacillus cereus; identical to SEQ ID NO: 30510

SEQ ID NO: 77065 - DNA, 639 bp, Bacillus subtilis; identical to SEQ ID NO: 30511
  CDS (1)..(639): transl_table=11

SEQ ID NO: 77066 - protein, 212 aa, Bacillus subtilis; identical to SEQ ID NO: 30512

SEQ ID NO: 77067 - DNA, 591 bp, Bacteroides thetaiotaomicron; identical to SEQ ID NO: 30513
  CDS (1)..(591): transl_table=11

SEQ ID NO: 77068 - protein, 196 aa, Bacteroides thetaiotaomicron; identical to SEQ ID NO: 30514

SEQ ID NO: 77069 - DNA, 615 bp, Bdellovibrio bacteriovorus; identical to SEQ ID NO: 30515
  CDS (1)..(615): transl_table=11

SEQ ID NO: 77070 - protein, 204 aa, Bdellovibrio bacteriovorus; identical to SEQ ID NO: 30516

SEQ ID NO: 77071 - DNA, 648 bp, Bifidobacterium longum; identical to SEQ ID NO: 30517
  CDS (1)..(648): transl_table=11

SEQ ID NO: 77072 - protein, 215 aa, Bifidobacterium longum; identical to SEQ ID NO: 30518

SEQ ID NO: 77073 - DNA, 678 bp, Bordetella pertussis; identical to SEQ ID NO: 30519
  CDS (1)..(678): transl_table=11

SEQ ID NO: 77074 - protein, 225 aa, Bordetella pertussis; identical to SEQ ID NO: 30520

SEQ ID NO: 77075 - DNA, 651 bp, Bradyrhizobium japonicum; identical to SEQ ID NO: 30521
  CDS (1)..(651): transl_table=11

SEQ ID NO: 77076 - protein, 216 aa, Bradyrhizobium japonicum; identical to SEQ ID NO: 30522

SEQ ID NO: 77077 - DNA, 594 bp, Buchnera aphidicola; identical to SEQ ID NO: 30523
  CDS (1)..(594): transl_table=11

SEQ ID NO: 77078 - protein, 197 aa, Buchnera aphidicola; identical to SEQ ID NO: 30524

SEQ ID NO: 77079 - DNA, 591 bp, Buchnera aphidicola; identical to SEQ ID NO: 30525
  CDS (1)..(591): transl_table=11

SEQ ID NO: 77080 - protein, 196 aa, Buchnera aphidicola; identical to SEQ ID NO: 30526

SEQ ID NO: 77081 - DNA, 591 bp, Candidatus Blochmannia floridanus; identical to SEQ ID NO: 30527
  CDS (1)..(591): transl_table=11

SEQ ID NO: 77082 - protein, 196 aa, Candidatus Blochmannia floridanus; identical to SEQ ID NO: 30528

SEQ ID NO: 77083 - DNA, 642 bp, Caulobacter crescentus; identical to SEQ ID NO: 30529
  CDS (1)..(642): transl_table=11

SEQ ID NO: 77084 - protein, 213 aa, Caulobacter crescentus; identical to SEQ ID NO: 30530

SEQ ID NO: 77085 - DNA, 606 bp, Chlorobium tepidum; identical to SEQ ID NO: 30531
  CDS (1)..(606): transl_table=11

SEQ ID NO: 77086 - protein, 201 aa, Chlorobium tepidum; identical to SEQ ID NO: 30532

SEQ ID NO: 77087 - DNA, 639 bp, Chromobacterium violaceum; identical to SEQ ID NO: 30533
  CDS (1)..(639): transl_table=11

SEQ ID NO: 77088 - protein, 212 aa, Chromobacterium violaceum; identical to SEQ ID NO: 30534

SEQ ID NO: 77089 - DNA, 612 bp, Clostridium acetobutylicum; identical to SEQ ID NO: 30535
  CDS (1)..(612): transl_table=11

SEQ ID NO: 77090 - protein, 203 aa, Clostridium acetobutylicum; identical to SEQ ID NO: 30536

SEQ ID NO: 77091 - DNA, 633 bp, Corynebacterium diphtheriae; identical to SEQ ID NO: 30537
  CDS (1)..(633): transl_table=11

SEQ ID NO: 77092 - protein, 210 aa, Corynebacterium diphtheriae; identical to SEQ ID NO: 30538

SEQ ID NO: 77093 - DNA, 636 bp, Corynebacterium efficiens; identical to SEQ ID NO: 30539
  CDS (1)..(636): transl_table=11

SEQ ID NO: 77094 - protein, 211 aa, Corynebacterium efficiens; identical to SEQ ID NO: 30540

SEQ ID NO: 77095 - DNA, 636 bp, Corynebacterium glutamicum; identical to SEQ ID NO: 30541
  CDS (1)..(636): transl_table=11

SEQ ID NO: 77096 - protein, 211 aa, Corynebacterium glutamicum; identical to SEQ ID NO: 30542

SEQ ID NO: 77097 - DNA, 645 bp, Cyanidium caldarium; identical to SEQ ID NO: 30543
  CDS (1)..(645): transl_table=11

SEQ ID NO: 77098 - protein, 214 aa, Cyanidium caldarium; identical to SEQ ID NO: 30544

SEQ ID NO: 77099 - DNA, 648 bp, Cyanophora paradoxa; identical to SEQ ID NO: 30545
  CDS (1)..(648)

SEQ ID NO: 77100 - protein, 215 aa, Cyanophora paradoxa; identical to SEQ ID NO: 30546

SEQ ID NO: 77101 - DNA, 648 bp, Deinococcus radiodurans; identical to SEQ ID NO: 30547
  CDS (1)..(648): transl_table=11

SEQ ID NO: 77102 - protein, 215 aa, Deinococcus radiodurans; identical to SEQ ID NO: 30548

SEQ ID NO: 77103 - DNA, 642 bp, Desulfovibrio vulgaris; identical to SEQ ID NO: 30549
  CDS (1)..(642): transl_table=11

SEQ ID NO: 77104 - protein, 213 aa, Desulfovibrio vulgaris; identical to SEQ ID NO: 30550

SEQ ID NO: 77105 - DNA, 1662 bp, Emericella nidulans; identical to SEQ ID NO: 30551
  CDS (1)..(1662)

SEQ ID NO: 77106 - protein, 553 aa, Emericella nidulans; identical to SEQ ID NO: 30552

SEQ ID NO: 77107 - DNA, 630 bp, Geobacter sulfurreducens; identical to SEQ ID NO: 30553
  CDS (1)..(630): transl_table=11

SEQ ID NO: 77108 - protein, 209 aa, Geobacter sulfurreducens; identical to SEQ ID NO: 30554

SEQ ID NO: 77109 - DNA, 681 bp, Gloeobacter violaceus; identical to SEQ ID NO: 30555
  CDS (1)..(681): transl_table=11

SEQ ID NO: 77110 - protein, 226 aa, Gloeobacter violaceus; identical to SEQ ID NO: 30556

SEQ ID NO: 77111 - DNA, 600 bp, Haemophilus influenzae; identical to SEQ ID NO: 30557
  CDS (1)..(600): transl_table=11

SEQ ID NO: 77112 - protein, 199 aa, Haemophilus influenzae; identical to SEQ ID NO: 30558

SEQ ID NO: 77113 - DNA, 609 bp, Lactococcus lactis; identical to SEQ ID NO: 30559
  CDS (1)..(609): transl_table=11

SEQ ID NO: 77114 - protein, 202 aa, Lactococcus lactis; identical to SEQ ID NO: 30560

SEQ ID NO: 77115 - DNA, 642 bp, Legionella pneumophila; identical to SEQ ID NO: 30561
  CDS (1)..(642): transl_table=11

SEQ ID NO: 77116 - protein, 213 aa, Legionella pneumophila; identical to SEQ ID NO: 30562

SEQ ID NO: 77117 - DNA, 615 bp, Leptospira borgpetersenii; identical to SEQ ID NO: 30563
  CDS (1)..(615): transl_table=11

SEQ ID NO: 77118 - protein, 204 aa, Leptospira borgpetersenii; identical to SEQ ID NO: 30564

SEQ ID NO: 77119 - DNA, 627 bp, Listeria monocytogenes; identical to SEQ ID NO: 30565
  CDS (1)..(627): transl_table=11

SEQ ID NO: 77120 - protein, 208 aa, Listeria monocytogenes; identical to SEQ ID NO: 30566

SEQ ID NO: 77121 - DNA, 609 bp, Methanosarcina acetivorans; identical to SEQ ID NO: 30567
  CDS (1)..(609): transl_table=11

SEQ ID NO: 77122 - protein, 202 aa, Methanosarcina acetivorans; identical to SEQ ID NO: 30568

SEQ ID NO: 77123 - DNA, 597 bp, Methanobacterium thermoautotrophicum; identical to SEQ ID NO: 30569
  CDS (1)..(597): transl_table=11

SEQ ID NO: 77124 - protein, 198 aa, Methanobacterium thermoautotrophicum; identical to SEQ ID NO: 30570

SEQ ID NO: 77125 - DNA, 621 bp, Mycobacterium leprae; identical to SEQ ID NO: 30571
  CDS (1)..(621): transl_table=11

SEQ ID NO: 77126 - protein, 206 aa, Mycobacterium leprae; identical to SEQ ID NO: 30572

SEQ ID NO: 77127 - DNA, 621 bp, Mycobacterium paratuberculosis; identical to SEQ ID NO: 30573
  CDS (1)..(621): transl_table=11

SEQ ID NO: 77128 - protein, 206 aa, Mycobacterium paratuberculosis; identical to SEQ ID NO: 30574

SEQ ID NO: 77129 - DNA, 621 bp, Mycobacterium tuberculosis; identical to SEQ ID NO: 30575
  CDS (1)..(621): transl_table=11

SEQ ID NO: 77130 - protein, 206 aa, Mycobacterium tuberculosis; identical to SEQ ID NO: 30576

SEQ ID NO: 77131 - DNA, 639 bp, Neisseria meningitidis; identical to SEQ ID NO: 30577
  CDS (1)..(639): transl_table=11

SEQ ID NO: 77132 - protein, 212 aa, Neisseria meningitidis; identical to SEQ ID NO: 30578

SEQ ID NO: 77133 - DNA, 639 bp, Nitrosomonas europaea; identical to SEQ ID NO: 30579
  CDS (1)..(639): transl_table=11

SEQ ID NO: 77134 - protein, 212 aa, Nitrosomonas europaea; identical to SEQ ID NO: 30580

SEQ ID NO: 77135 - DNA, 606 bp, Oceanobacillus iheyensis; identical to SEQ ID NO: 30581
  CDS (1)..(606): transl_table=11

SEQ ID NO: 77136 - protein, 201 aa, Oceanobacillus iheyensis; identical to SEQ ID NO: 30582

SEQ ID NO: 77137 - DNA, 597 bp, Pasteurella multocida; identical to SEQ ID NO: 30583
  CDS (1)..(597): transl_table=11

SEQ ID NO: 77138 - protein, 198 aa, Pasteurella multocida; identical to SEQ ID NO: 30584

SEQ ID NO: 77139 - DNA, 606 bp, Photorhabdus luminescens; identical to SEQ ID NO: 30585
  CDS (1)..(606): transl_table=11

SEQ ID NO: 77140 - protein, 201 aa, Photorhabdus luminescens; identical to SEQ ID NO: 30586

SEQ ID NO: 77141 - DNA, 633 bp, Photobacterium profundum; identical to SEQ ID NO: 30587
  CDS (1)..(633): transl_table=11

SEQ ID NO: 77142 - protein, 210 aa, Photobacterium profundum; identical to SEQ ID NO: 30588

SEQ ID NO: 77143 - DNA, 618 bp, Prochlorococcus marinus subsp; identical to SEQ ID NO: 30589
  CDS (1)..(618): transl_table=11

SEQ ID NO: 77144 - protein, 205 aa, Prochlorococcus marinus subsp; identical to SEQ ID NO: 30590

SEQ ID NO: 77145 - DNA, 639 bp, Pseudomonas putida; identical to SEQ ID NO: 30591
  CDS (1)..(639): transl_table=11

SEQ ID NO: 77146 - protein, 212 aa, Pseudomonas putida; identical to SEQ ID NO: 30592

SEQ ID NO: 77147 - DNA, 573 bp, Pyrobaculum aerophilum; identical to SEQ ID NO: 30593
  CDS (1)..(573): transl_table=11

SEQ ID NO: 77148 - protein, 190 aa, Pyrobaculum aerophilum; identical to SEQ ID NO: 30594

SEQ ID NO: 77149 - DNA, 585 bp, Pyrococcus furiosus; identical to SEQ ID NO: 30595
  CDS (1)..(585): transl_table=11

SEQ ID NO: 77150 - protein, 194 aa, Pyrococcus furiosus; identical to SEQ ID NO: 30596

SEQ ID NO: 77151 - DNA, 654 bp, Ralstonia solanacearum; identical to SEQ ID NO: 30597
  CDS (1)..(654): transl_table=11

SEQ ID NO: 77152 - protein, 217 aa, Ralstonia solanacearum; identical to SEQ ID NO: 30598

SEQ ID NO: 77153 - DNA, 651 bp, Rhizobium loti; identical to SEQ ID NO: 30599
  CDS (1)..(651): transl_table=11

SEQ ID NO: 77154 - protein, 216 aa, Rhizobium loti; identical to SEQ ID NO: 30600

SEQ ID NO: 77155 - DNA, 651 bp, Rhizobium meliloti; identical to SEQ ID NO: 30601
  CDS (1)..(651): transl_table=11

SEQ ID NO: 77156 - protein, 216 aa, Rhizobium meliloti; identical to SEQ ID NO: 30602

SEQ ID NO: 77157 - DNA, 618 bp, Rhodopirellula baltica; identical to SEQ ID NO: 30603
  CDS (1)..(618): transl_table=11

SEQ ID NO: 77158 - protein, 205 aa, Rhodopirellula baltica; identical to SEQ ID NO: 30604

SEQ ID NO: 77159 - DNA, 651 bp, Rhodopseudomonas palustris; identical to SEQ ID NO: 30605
  CDS (1)..(651): transl_table=11

SEQ ID NO: 77160 - protein, 216 aa, Rhodopseudomonas palustris; identical to SEQ ID NO: 30606

SEQ ID NO: 77161 - DNA, 636 bp, Rhodobacter sphaeroides; identical to SEQ ID NO: 30607
  CDS (1)..(636): transl_table=11

SEQ ID NO: 77162 - protein, 211 aa, Rhodobacter sphaeroides; identical to SEQ ID NO: 30608

SEQ ID NO: 77163 - DNA, 666 bp, Shewanella oneidensis; identical to SEQ ID NO: 30609
  CDS (1)..(666): transl_table=11

SEQ ID NO: 77164 - protein, 221 aa, Shewanella oneidensis; identical to SEQ ID NO: 30610

SEQ ID NO: 77165 - DNA, 648 bp, Streptomyces avermitilis; identical to SEQ ID NO: 30611
  CDS (1)..(648): transl_table=11

SEQ ID NO: 77166 - protein, 215 aa, Streptomyces avermitilis; identical to SEQ ID NO: 30612

SEQ ID NO: 77167 - DNA, 600 bp, Sulfolobus solfataricus; identical to SEQ ID NO: 30613
  CDS (1)..(600): transl_table=11

SEQ ID NO: 77168 - protein, 199 aa, Sulfolobus solfataricus; identical to SEQ ID NO: 30614

SEQ ID NO: 77169 - DNA, 630 bp, Synechococcus elongatus; identical to SEQ ID NO: 30615
  CDS (1)..(630): transl_table=11

SEQ ID NO: 77170 - protein, 209 aa, Synechococcus elongatus; identical to SEQ ID NO: 30616

SEQ ID NO: 77171 - DNA, 633 bp, Synechocystis sp; identical to SEQ ID NO: 30617
  CDS (1)..(633): transl_table=11

SEQ ID NO: 77172 - protein, 210 aa, Synechocystis sp; identical to SEQ ID NO: 30618

SEQ ID NO: 77173 - DNA, 606 bp, Thermotoga maritima; identical to SEQ ID NO: 30619
  CDS (1)..(606): transl_table=11

SEQ ID NO: 77174 - protein, 201 aa, Thermotoga maritima; identical to SEQ ID NO: 30620

SEQ ID NO: 77175 - DNA, 603 bp, Thermus thermophilus; identical to SEQ ID NO: 30621
  CDS (1)..(603)

SEQ ID NO: 77176 - protein, 200 aa, Thermus thermophilus; identical to SEQ ID NO: 30622

SEQ ID NO: 77177 - DNA, 612 bp, Thermoanaerobacter tengcongensis; identical to SEQ ID NO: 30623
  CDS (1)..(612): transl_table=11

SEQ ID NO: 77178 - protein, 203 aa, Thermoanaerobacter tengcongensis; identical to SEQ ID NO: 30624

SEQ ID NO: 77179 - DNA, 615 bp, Vibrio parahaemolyticus; identical to SEQ ID NO: 30625
  CDS (1)..(615): transl_table=11

SEQ ID NO: 77180 - protein, 204 aa, Vibrio parahaemolyticus; identical to SEQ ID NO: 30626

SEQ ID NO: 77181 - DNA, 618 bp, Wolinella succinogenes; identical to SEQ ID NO: 30627
  CDS (1)..(618): transl_table=11

SEQ ID NO: 77182 - protein, 205 aa, Wolinella succinogenes; identical to SEQ ID NO: 30628

SEQ ID NO: 77183 - DNA, 603 bp, Xanthomonas campestris; identical to SEQ ID NO: 30629
  CDS (1)..(603): transl_table=11

SEQ ID NO: 77184 - protein, 200 aa, Xanthomonas campestris; identical to SEQ ID NO: 30630

SEQ ID NO: 77185 - DNA, 603 bp, Xylella fastidiosa; identical to SEQ ID NO: 30631
  CDS (1)..(603): transl_table=11

SEQ ID NO: 77186 - protein, 200 aa, Xylella fastidiosa; identical to SEQ ID NO: 30632

SEQ ID NO: 77187 - DNA, 1659 bp, Saccharomyces cerevisiae; identical to SEQ ID NO: 30633
  CDS (1)..(1659)

SEQ ID NO: 77188 - protein, 552 aa, Saccharomyces cerevisiae; identical to SEQ ID NO: 30634

SEQ ID NO: 77189 - DNA, 591 bp, Yersinia pestis; identical to SEQ ID NO: 30635
  CDS (1)..(591): transl_table=11

SEQ ID NO: 77190 - protein, 196 aa, Yersinia pestis; identical to SEQ ID NO: 30636

SEQ ID NO: 77191 - DNA, 24 bp, Primer
atgaacgtggtgatccttgatacc

SEQ ID NO: 77192 - DNA, 26 bp, Primer
ttacatctccaggaagtttttcagca

SEQ ID NO: 77193 - protein, 98 aa, consensus; identical to SEQ ID NO: 30639
  MISC_FEATURE (1)..(98): consensus for the disclosure of xaa see table XV

SEQ ID NO: 77194 - protein, 94 aa, consensus; identical to SEQ ID NO: 30640
  MISC_FEATURE (1)..(94): consensus for the disclosure of xaa see table XV

SEQ ID NO: 77195 - protein, 20 aa, consensus
  MISC_FEATURE (1)..(20): consensus for the disclosure of xaa see table XV
XXQFHXEXSXXXGXXXXXXX

SEQ ID NO: 77196 - DNA, 1404 bp, Escherichia coli
  CDS (1)..(1404)
atgaagttctggcgacccggtattaccggcaaactgtttctggcgattttcgccacctgcattgtcttgctgatcagtatgcactgggcggtgcgtatcagttttgagcgtggctttattgattacatcaagcatggtaatgaacagcgattacaactgttaagtgatgcgcttggcgagcagtatgcgcagcatggcaactggcgcttcctgcgcaacaatgatcgctttgtctttcagatcctgcgttcatttgaacacgataattcggaagataaacccggcccgggtatgccaccgcacggctggcgtacccagttctgggtggttgatcaaaacaacaaagtgctggttggtccgcgagcgccgattccacctgacggtacacggcgacccattctggtcaacggtgcggaagttggcgcggtgatcgcctcccccgttgagcggttaacgcgcaatactgatatcaatttcgataaacaacagcggcaaaccagctggttgattgtcgccctggcaacgttactcgcggcacttgccacttttctgctggcgcgcggtttactggcaccggtaaaacgacttgtcgatggcacgcacaaactggcggcgggcgatttcactacccgcgtaacgcccaccagtgaagatgaactgggcaaactggcgcaagacttcaaccagcttgccagcacactggagaaaaaccagcaaatgcggcgcgattttatggccgatatttctcacgaactgcgtacgccattagcggtgctgcgcggtgaactggaagccattcaggatggcgtgcgtaaattcacgccggagacggtggcgtctttacaggcggaggtcggtacactgaccaaactggttgacgatctccatcagttgtcgatgtctgatgaaggcgctctcgcctatcaaaaagcaccggtagatttgatcccactgctggaagtggcgggcggcgcatttcgcgaacgattcgccagtcgtggcctgaaactgcaattttccctgccagacagtattaccgtatttggcgatcgcgaccgtttaatgcagttattcaataacttactggaaaacagcctgcgctacactgacagcggcggcagcctgcaaatctctgccgggcagcgcgacaaaacggtgcgcctgacctttgccgacagtgcgccaggtgtcagtgacgatcagctacaaaaattgtttgaacgtttttatcgcaccgaaggttcccgcaaccgtgccagcggcggttccgggctggggctggcgatttgcctgaacattgttgaagcacataatggtcgcattattgctgcccattcgccttttggcggggtaagcattacagtagagttaccgctggaacgggatttacagagagaagtatga

SEQ ID NO: 77197 - protein, 467 aa, Escherichia coli
MKFWRPGITGKLFLAIFATCIVLLISMHWAVRISFERGFIDYIKHGNEQRLQLLSDALGEQYAQHGNWRFLRNNDRFVFQILRSFEHDNSEDKPGPGMPPHGWRTQFWVVDQNNKVLVGPRAPIPPDGTRRPILVNGAEVGAVIASPVERLTRNTDINFDKQQRQTSWLIVALATLLAALATFLLARGLLAPVKRLVDGTHKLAAGDFTTRVTPTSEDELGKLAQDFNQLASTLEKNQQMRRDFMADISHELRTPLAVLRGELEAIQDGVRKFTPETVASLQAEVGTLTKLVDDLHQLSMSDEGALAYQKAPVDLIPLLEVAGGAFRERFASRGLKLQFSLPDSITVFGDRDRLMQLFNNLLENSLRYTDSGGSLQISAGQRDKTVRLTFADSAPGVSDDQLQKLFERFYRTEGSRNRASGGSGLGLAICLNIVEAHNGRIIAAHSPFGGVSITVELPLERDLQREV

SEQ ID NO: 77198 - DNA, 1359 bp, Mesorhizobium loti MAFF303099
  CDS (1)..(1359): transl_table=11
atgaagatcaatagcctccgcctgcaattgttggcatgggtggtgctgccgctggccggactcgccaccatcaacctgtggaccagccatggcagcgcgctggccaccgccaacctggtcaccgaccgaatgctgctcggctcggcgcggaccatcgccgagcaggtcgccatgaacgacggcgtgctcgatgccacgataccgccggctgcgatcgagatgttcgatacgggcgaccgcgacagcgtctactaccatgtcaagactgccagagggcggcttctgaccggctatcccaatctgccggaggcattgacgccgtccagcaccgaggcaacctatcgcgaccaccggttgcggctgcttaccttcagccagggtgtggtcggcgccggcgaggattcgccgatatcagttaccgtcggcgtcacccttgccggacatgacgcgatggtacggcgtctctggtttggcgcctttgcccagcagttggcgctggtggcgatcgcaggcctcttcgtgctccttggcctgcatcggggcctggcgccgctcatcaggctgcgcgacgcggtgcgttcgccgaaccgcagcgacctcgacccggtcgaagtgcccggcgcccaaagcgaaatccgcccgctgatcgatgcgctcaacgcctatatggcacgcgtgcgggcccagatggcgtcgcaacgccgcttcgtcgccaacgccgcgcaccagttgcgcacgccgctggcattgctgtcgacgcaggcgagctacgcgctgcgagaaaccgtccccgatgcccgccacgaggcgctggtggccttgcaggcaagctccggccgcctggcgcggcttgccgaacaactgctgaccctgtcgagggccgagccgggcagccgacggccgcgcgccgaccgtgtcgacctaaccgaagcggcccgccaggttctggaaacccatgcgccgatcgccgtcagccgcaacgtcgatctcggcctcgaggaggccggccccgtgccggtcatcggcgacggcaccatgctgcgcgaaatgatcgtcaacctcgtcgacaatgcgctgcgctactcctcgtcaggcggcagcgtcacggtgaggctggcggccgtcgacggcgaagccgtgctgacggtcaccgacgacgggcctggcattccggtggatgagcgggatcacgtgttcgaacgcttctaccgcatcgccggctcgaccgaggaaggcagcgggctggggctcgccatcgtgcgcgaggtcgtcgaaaacgccggcggccgcgtcaccctgcgggatggcgcggccggcggtttggtggttgacgtgaggttgccactggcaagcagctag

SEQ ID NO: 77199 - protein, 452 aa, Mesorhizobium loti MAFF303099
MKINSLRLQLLAWVVLPLAGLATINLWTSHGSALATANLVTDRMLLGSARTIAEQVAMNDGVLDATIPPAAIEMFDTGDRDSVYYHVKTARGRLLTGYPNLPEALTPSSTEATYRDHRLRLLTFSQGVVGAGEDSPISVTVGVTLAGHDAMVRRLWFGAFAQQLALVAIAGLFVLLGLHRGLAPLIRLRDAVRSPNRSDLDPVEVPGAQSEIRPLIDALNAYMARVRAQMASQRRFVANAAHQLRTPLALLSTQASYALRETVPDARHEALVALQASSGRLARLAEQLLTLSRAEPGSRRPRADRVDLTEAARQVLETHAPIAVSRNVDLGLEEAGPVPVIGDGTMLREMIVNLVDNALRYSSSGGSVTVRLAAVDGEAVLTVTDDGPGIPVDERDHVFERFYRIAGSTEEGSGLGLAIVREVVENAGGRVTLRDGAAGGLVVDVRLPLASS

SEQ ID NO: 77200 - DNA, 1389 bp, Bacillus halodurans C-125
  CDS (1)..(1389): transl_table=11
atgaaaaattggtcgatcaaagcaaaagtatggagcgctattttcgcaatcatcgtcgccgttagtgttggcgcccttgcgatgacatttttcctttatgaacgactttatatcgacaagcagatcgatcgtttattcatggaagggcaagagcttcgcactgtatatgcggagcatggagcgaatgactattttttcgaacggattcaatgggcaaacgacagcaaagagctcacgctaacttatacagaggatccgatgcagcttgggagtggctcaccatttgaaccttttgcaaatgaacatttgatcacgtttgacgaaagacagcagctgctagaaggggaaacggtcgtcatgatacgggagaatgcgtactttgagcaaaaaattctcggggtagcgctccctttatttgacaatgaacaactcgctggagcgttatttttttcgctgccgctatccgatgtgtatgagccgtttttaaacgtaggaaaaatactattgctttctttaagcaccatcatcttgctcattatcctaatctgtaaaaaggttgtgaaccatgtggttaccccactgaccgacatgaaagaagcagcgattcagatggcgaagggggatttttcgttacgtatttcttcaacaaggagtcgaaaggacgagataggtcaactggctgaatcctttaatacgttatcgtcatccctcgaacgagtggaagaaaagcggcgggagtttcttgctgatgtgtctcatgagctgcgtacgccgcttagttatatgaaaggttacgcagagggtgtagaggaaggagtgattgatccgagcaaagggctttccatcattcaaaaggaagcaaaccgattggagcgactcgttaatgacttattggatttggctcaactagaaggggagtcctatgtgatgaaggatgaaccgattgcattcgcccagctagtctatgaggtagtggagcaatttcgctatctcgcagcgcaaaaaaggcttcaggtccacttagatctagatgaggatgtcattatttcaggagatcctgatcggatcgagcaagtcattcgcaatctgttagataatgcgatcaaatacgcacatgaagagacaacaatctcacttacgatagggcgtgaaggaagcagggcccaatttattctttcggatcaagggatcggcattcccgaggacaagctcgctcttgtgttcgaacgtttttatcgtgtaaataaatctcggtctcggaaaaagggcgggacgggattaggcttggcgatcgcctcacaaattattaaaaagcatgggggcaccatagacatcacttcacaggaactaaaagggacgaccgtaacgattacattgaaaacgttataa

SEQ ID NO: 77201 - protein, 462 aa, Bacillus halodurans C-125
MKNWSIKAKVWSAIFAIIVAVSVGALAMTFFLYERLYIDKQIDRLFMEGQELRTVYAEHGANDYFFERIQWANDSKELTLTYTEDPMQLGSGSPFEPFANEHLITFDERQQLLEGETVVMIRENAYFEQKILGVALPLFDNEQLAGALFFSLPLSDVYEPFLNVGKILLLSLSTIILLIILICKKVVNHVVTPLTDMKEAAIQMAKGDFSLRISSTRSRKDEIGQLAESFNTLSSSLERVEEKRREFLADVSHELRTPLSYMKGYAEGVEEGVIDPSKGLSIIQKEANRLERLVNDLLDLAQLEGESYVMKDEPIAFAQLVYEVVEQFRYLAAQKRLQVHLDLDEDVIISGDPDRIEQVIRNLLDNAIKYAHEETTISLTIGREGSRAQFILSDQGIGIPEDKLALVFERFYRVNKSRSRKKGGTGLGLAIASQIIKKHGGTIDITSQELKGTTVTITLKTL

SEQ ID NO: 77202 - DNA, 1332 bp, Pseudomonas aeruginosa PAO1
  CDS (1)..(1332): transl_table=11
atgagcgccgggttcggctcgcggatgtccctcggcgtccgcctgagcctgctgttcgccgcctgcacggcggcggtctcgctgatcgccggattgatcttcagcagggccatcgacgagcatttcgtcgagctcgaccatatggcgatgtccgccaagctcgcggtgtttcgcgatgagctgcgcggcctcggctcggaacaacagatgcgccgccgcgaagcggaactgctgcgcgaactggcacgccatcccgacctcggcctgcgcctgaacggcccggatggcaacctctggttcgagcgcctgccgcagcctgcgcatcccggcctgcccgccaaccgcgaactcggcgccccgctggagcccggcaacgacgcttcgccgcgactcaccgtgatcctcgacatcagtcatcaccagcacttcctgcaacgcatgcgccagttgatctggctgaccatgagcctgtcggcgctggccacggcgctgctcggcgcctgggccaccggcgccagcctggcgccgctgcgacggatgcgcgaagtcgccgcgcgggtttccgccaactccctcaccacccgcctcgacgccagccggatgccagaggagctgcgcggactggccggcgagctgaacgccatgctggcgcgcctggaagaagccttccagcgcctctcggcgttctccgccgacatcgcccacgagttgcgcaccccgctcaccagcctgctgacccagacccaggtggtactgtcccgcccgcgctcgctggaggactatcgcgaggccctgcacggcaatctcgaggaactggaacggctcaccgcgatggtcaacgacatgctgttgctggccaaggccgaccacggcctgctggcgcccagccgccaggccctggacctgggcgcggaagtcgactcgctgctggagttctaccagccgctggcggaagaccgcgacatccgcctgctgcgcgaaggcagcctgagcctgcccggcgaccgcggcatgctgcggcgggtgctggccaacctgctggacaacgccctgcgcttcaccgccgatggcggcgagatacgtatccgtctcggcgaccgacgcctgagcgtggagaaccagggtccggcgattcctcccgagcgcttgccgcgcctgttcgaccggttctatcgtgccgatccggcgcgccgcgaaggccagggtgaacacgccgggctcggcctggcgatctgccgctccatcgtccaggcccacggcggcgagatccgctgcgagtctgccgacggctggacccgtttcgtcatcgatttcgctcgcccgcgccgatga

SEQ ID NO: 77203 - protein, 443 aa, Pseudomonas aeruginosa PAO1
MSAGFGSRMSLGVRLSLLFAACTAAVSLIAGLIFSRAIDEHFVELDHMAMSAKLAVFRDELRGLGSEQQMRRREAELLRELARHPDLGLRLNGPDGNLWFERLPQPAHPGLPANRELGAPLEPGNDASPRLTVILDISHHQHFLQRMRQLIWLTMSLSALATALLGAWATGASLAPLRRMREVAARVSANSLTTRLDASRMPEELRGLAGELNAMLARLEEAFQRLSAFSADIAHELRTPLTSLLTQTQVVLSRPRSLEDYREALHGNLEELERLTAMVNDMLLLAKADHGLLAPSRQALDLGAEVDSLLEFYQPLAEDRDIRLLREGSLSLPGDRGMLRRVLANLLDNALRFTADGGEIRIRLGDRRLSVENQGPAIPPERLPRLFDRFYRADPARREGQGEHAGLGLAICRSIVQAHGGEIRCESADGWTRFVIDFARPRR

SEQ ID NO: 77204 - DNA, 1701 bp, Deinococcus radiodurans R1
  CDS (1)..(1701): transl_table=11
gtgaccacgggccgttccacttcttcgccttccgcctcgccgggccagggcacgtcggcgcaggacccggccccccggcgctggctgctgcggccctcgtcgctgcaattgcggctgacgttgctgtacgcggcgctgctggcgctgatgctcgcctcggtgtacggtgccgcgctggtgctcatgcgcagcagcttgattaccgggcttgacgaggggatgcgcaacacttacagccagttcagcgagctggtggcgcaacttgcccttgactcgcccaccaccgagcaagagcgcgacaaggaaggcgtgctgccccgcgcccgcacgctgtttcccaacgacgcgattcaaatcgagaagctgcctttcgtggaccacgaccggctcctgacccgcctgagcgacgcccaaaagcccgcgcagcagcgtcaggaattgcaggtggtgcgctcgcagctcacgaagtaccgctacccggtcacggtcaaccgtgcttctccgctcgaactcagcgacgccgagctgctcgaccttatcgagtcgcccacgggccgcatcttcatcgcccggcagattcgtgagccctacagcgacaagacggtgccctaccgcatcctcgtgacattggcggaggtgcagtacgcgccgcgtcccctcgcttcgctacgcgacggcgacgtgacggtggatttcatgccgccgccggtgctttcgattatttacgtagggcgcagcgtggcgggcatcgaggacacgctggggcggctgcaacgggtgttcgccatcgtgatgctcttcggtgctctgctcgcgggcacgctggcttacgtgctggcgggccgggcgctgcggcccctgcaagaagtgcgccaggctgccgagcgcatcgggggacagacgctgaccgagcgcgtgcccgagccccagaccggcgacgaggtgcaggccctcgcccgctcgctcaacgccatgctggggcggctggaagcgagtttcgaggcgcagcgccgctttaccagtgacgccagccacgagctgcggacgcccgtcactgccatcagcgggcacgcgagttacctgctgcgccgcaccaatcccggcgggcaggagcgcgagagcctcaacatcatccgttcagaatccgagcggctgaccaacctgattaccagcctgctgcaactcgcccgctccgacagcggggccctgaccctgaaccccgcgccgattttctcgcgcctctttctggacgacgtgagccgcgaactcgctccgctggcgaccgggggctccgagctgcgggtcagcggtcccgacattcctttcgagggcgaccccgaccggctgcggcaggtcattatcaacttggtcggcaacgcgctcaaggccggggccaagacggtcacgctggagagcagctcgcaggaagagggccgcgaggtccgcctgagcgtgcgcgacgacggccccggcatcccggccgagcacctctcgcgtctctttgaccgcttctaccgcgtggaagacagccgcagccgcgaccagggcggcgcgggcctgggcctgagcatcgcgcacagcatcgtggacgcccacggcgggcgcatctggctggagagcgaggtcgggcgcggcaccgtggcgcacgtccagctcctggtgggcgacgtgccggtgctggacgaagacgacgtgccgtag

SEQ ID NO: 77205 - protein, 566 aa, Deinococcus radiodurans R1
MTTGRSTSSPSASPGQGTSAQDPAPRRWLLRPSSLQLRLTLLYAALLALMLASVYGAALVLMRSSLITGLDEGMRNTYSQFSELVAQLALDSPTTEQERDKEGVLPRARTLFPNDAIQIEKLPFVDHDRLLTRLSDAQKPAQQRQELQVVRSQLTKYRYPVTVNRASPLELSDAELLDLIESPTGRIFIARQIREPYSDKTVPYRILVTLAEVQYAPRPLASLRDGDVTVDFMPPPVLSIIYVGRSVAGIEDTLGRLQRVFAIVMLFGALLAGTLAYVLAGRALRPLQEVRQAAERIGGQTLTERVPEPQTGDEVQALARSLNAMLGRLEASFEAQRRFTSDASHELRTPVTAISGHASYLLRRTNPGGQERESLNIIRSESERLTNLITSLLQLARSDSGALTLNPAPIFSRLFLDDVSRELAPLATGGSELRVSGPDIPFEGDPDRLRQVIINLVGNALKAGAKTVTLESSSQEEGREVRLSVRDDGPGIPAEHLSRLFDRFYRVEDSRSRDQGGAGLGLSIAHSIVDAHGGRIWLESEVGRGTVAHVQLLVGDVPVLDEDDVP

SEQ ID NO: 77206 - DNA, 1497 bp, Clostridium acetobutylicum ATCC 824
  CDS (1)..(1497): transl_table=11
ttgtcaataaaaactaagttggtcttttctaatattgcaatgtgtctaattccactaatattatgtttgattactttatttggattgaataatttgtatagtagaaaattaaaatcctactatgaggtagaagatatgaaaaagaaaccattattgaatccatatatagaattaaagtctataaatataagaccatttaaggagcttcaaagtgaatccgaagctattccagataattttgaggataagaaggttctaaaaaccatcaatgaagcgcttttaaaaaagaatacatatataatagtggagaaaagtggaaatgttgttttcaatggaagtaagaagaacaacaaagatataattagtaagctcgatgatttaaattatagtcgcaatgcagatagaccagagccacctagaactgaaagcatttcagatgacagtgaaaccttaataagacaattcacatttatattttccgatggaagctcgggtaatgtttttcttgtagcagataccagtaaattatcacagttagcaacggaatttataatttctataataatagcaataatagcaataatatcacttactggaggttttataacattcttagtttcaagatcaatacttataccactaaatcagcttaaaattggtacagaaaaaatcaaacatggaaacttagattttaaggttagggctgaatccagtgatgaaataggtgaattatgcgatgcatttgatagcatgagaaaaaaacttaaggaatctgtagagcttcaggctcaatatgaaaataatagaaaagaattaatatctaatatatcacatgatcttaaaacaccaataacttcgataaagggatatattgaaggaataagggatggagtagctgatacgccagaaaaaatggagaaatacgtaaatactatatacaataaaactcaaagcatgaactacttaatagaagaattgttgacttattctaaattagatttgaagaagcttcctttctatttcatagatatggattttgttagctatatgaatgatttaatggaggaattcaaatttgatgtagaaaaaaacaatatggaattttcttatgataatcacataaagggtaaggctaatgttagaattgatgttcaaaatataaacagagttatatctaatataatttctaactctattaaatacatggataaggaacatggaaaaataagtgttgaagtagattctaacaatgaggaagtgttagttggaattaaagataatggaatgggtatatcagaagaagctcttccatatgtatttgatagattttatagagaagatttttctagaaatacctcaaaaggtggaagtgggttaggtttagctatatgtaaaaagataatagaggaacatggtggtagtatatgggcaaaaagccaaaagggtcacggaacggagatatggttttcaataaaactaaaaaatagaataaattaa

SEQ ID NO: 77207 - protein, 498 aa, Clostridium acetobutylicum ATCC 824
MSIKTKLVFSNIAMCLIPLILCLITLFGLNNLYSRKLKSYYEVEDMKKKPLLNPYIELKSINIRPFKELQSESEAIPDNFEDKKVLKTINEALLKKNTYIIVEKSGNVVFNGSKKNNKDIISKLDDLNYSRNADRPEPPRTESISDDSETLIRQFTFIFSDGSSGNVFLVADTSKLSQLATEFIISIIIAIIAIISLTGGFITFLVSRSILIPLNQLKIGTEKIKHGNLDFKVRAESSDEIGELCDAFDSMRKKLKESVELQAQYENNRKELISNISHDLKTPITSIKGYIEGIRDGVADTPEKMEKYVNTIYNKTQSMNYLIEELLTYSKLDLKKLPFYFIDMDFVSYMNDLMEEFKFDVEKNNMEFSYDNHIKGKANVRIDVQNINRVISNIISNSIKYMDKEHGKISVEVDSNNEEVLVGIKDNGMGISEEALPYVFDRFYREDFSRNTSKGGSGLGLAICKKIIEEHGGSIWAKSQKGHGTEIWFSIKLKNRIN

SEQ ID NO: 77208 - DNA, 1374 bp, Clostridium acetobutylicum ATCC 824
  CDS (1)..(1374): transl_table=11
atgaggagtataagaagagaagttagcattatattgatattatgtacaatatctggagtgattctatcagcactttttgtaaatatagccatgaatgctacttttaataaatatatggttaatattcaaaagcaaaggaatagcagaattgtaagttattttgaggaaatttataagagagacaaaaggtggacacaaaactctggagcagaaatgatgcatgaagcctacatgagtgattattgcctaacgttaatggataattctaaaaaagttatttggggtatgaatcctaatgatattagaaacagcaatcactggattatgaaaactgaaggtaaaggtgtatacagttccaaaacctttccgataaaggttgacggaaaggtagaaggctatgttatggtagggcaatatcatgcagtcatattatccgaggcggatatcaactttaagaattccataaatcaaggtattggtttaagtgctcttgttgctattattattgttgcattattaagtttaattgtatcaaaaggattttcacgtccaattaaaaaggtttcagagacctcagtccaactatctaagggaaattacgagtttaggtctgaaataaaaagcaatataaatgaaataaatgatttaataaaaagtattaatatgcttggaggaactttaaagcaccaaaatcttcttagaagaaggcttatatctgatatatcccatgaaataagaactccgcttaatgtgctacaaaataatctagaagctatgatagatggaataatacctgttacagaagataggttagttaaattaaatgaagaagttataaggtttggtgagcttttaaataatttagatttacttaaaagatttgagactgaggagagttcagtgagtatgaagaaaatacccttagataagattataaggggaatttgcaaagaatttctcaatgttgcaaaagaaaataatatagaaattcatacaaatatacctgagggctactatatgattttaggtgatgagaataagttaaagcaagtatttataaatttattatccaattcagttaagtttaataataaaaagggtgatatatggatttctcttgatgaagaagacaaggaaatagtagcaaggataaaggacaatggtattggtataaaaaaagaggatttgccatatgtgtttgaaagattatataggggagataaaagtagacataaggctattggaaacggaataggtttatctattgtaaagactgtacttgatattcatttagcacgcattgaagttaaaagtgaagaaggaattggatctgagtttacaatatattttcctaaagataaaaggaataattaa

SEQ ID NO: 77209 - protein, 457 aa, Clostridium acetobutylicum ATCC 824
MRSIRREVSIILILCTISGVILSALFVNIAMNATFNKYMVNIQKQRNSRIVSYFEEIYKRDKRWTQNSGAEMMHEAYMSDYCLTLMDNSKKVIWGMNPNDIRNSNHWIMKTEGKGVYSSKTFPIKVDGKVEGYVMVGQYHAVILSEADINFKNSINQGIGLSALVAIIIVALLSLIVSKGFSRPIKKVSETSVQLSKGNYEFRSEIKSNINEINDLIKSINMLGGTLKHQNLLRRRLISDISHEIRTPLNVLQNNLEAMIDGIIPVTEDRLVKLNEEVIRFGELLNNLDLLKRFETEESSVSMKKIPLDKIIRGICKEFLNVAKENNIEIHTNIPEGYYMILGDENKLKQVFINLLSNSVKFNNKKGDIWISLDEEDKEIVARIKDNGIGIKKEDLPYVFERLYRGDKSRHKAIGNGIGLSIVKTVLDIHLARIEVKSEEGIGSEFTIYFPKDKRNN

SEQ ID NO: 77210 - DNA, 1701 bp, Clostridium acetobutylicum ATCC 824
  CDS (1)..(1701)
atgaaaaagaaacttgtattgtacaatttgggtattttaataataactcttataatgataactgtattatttataaaaatcgaggattatgaatataggcaaaatacagagcaggatcttaaaagaacaaataatgtagtttccaatgtaattgatatgaacaaaggaaaagatatttcaagtgctcttaaagtcgtaataaaaaattcagatataagagtaacatatataaataaaaatggagtagttttatatgacaatgatataaatgcagaaaagcttgataatcacaacaagagagtggaagttgcagaggcaagaaaaaatggatatggttacagtgtaaggtatagtaaatctttaaaaaacaatataatttattatgcaaaggtcagaggagacggcactgtagtaagaactgctgtagagctttcctctgttgaaaggtttgaagcaagatacttaaagttctatatttatgtaatagctctaagtatcatagcggcagtatatttatcttttaagctttcttatgttattttaaatccaataagggaacttcaaaatacaagctctaggattgcaatgggagaactggaaacaagggttaatgttgaatcaagggatgaaataggtcagcttggaaaaacctttaataacatggcaggaagacttcaatctacaataagagaatctgttgaaaaacaaaaaaagcttgaggctatacttgttagtatggacagtggagttatagcagttgatagaaagcataaaataataatgataaatccatatgcagaaaaaatatttggcatagataaaaatataataggacaaagcctaatggactgtataagaaattatgaatttgaggacatatttaataaaagagcggaaggatatgcagaaataaaaacctcatggccaaaagagagaaatcttagaatcaaaactgccgatataataaatggatatgaatgcattggaactgttgctgtggttcaggatataacagatattagaaaacttgaaaacatgagaacgcagtttgtagcaaatgtatcccatgagcttaaaacaccactgacatcaataaaaggctttgctgaaaccttaagatatgttgaggatgacaatcaaaaaggagaatttcttgatattattgatgatgaagtagatagactaactagactcataagtgatatattaacactttcagatatagaaatcagaccgtttatgaaaaaagaagagtttgatgtcaatgaaataataaaagctgtctgtggacttttagaaaaatcagcctctcgtaagaatataagcttaaaagtatttggagaggatgtacctaatttaattggggataacgataagtttaaacaaatgattataaatttggttgacaatgctataaagtatacagaagctggtggagaggtatcggtatataagaagtatacaaaagatgatgttattatatccgtcaaggataacggtgtaggcataccgaaggagcatcttcaaagaatatttgaaagattttatagagttgataaggctcgttcaagagcaaatggaggaactggtcttgggcttgccatagtaaagcatatagtactgaattttaacggcagcataaatattgaaagtaagttaggtgttggaactgaatttattatcacaataccttataaatag

SEQ ID NO: 77211 - protein, 566 aa, Clostridium acetobutylicum ATCC 824
MKKKLVLYNLGILIITLIMITVLFIKIEDYEYRQNTEQDLKRTNNVVSNVIDMNKGKDISSALKVVIKNSDIRVTYINKNGVVLYDNDINAEKLDNHNKRVEVAEARKNGYGYSVRYSKSLKNNIIYYAKVRGDGTVVRTAVELSSVERFEARYLKFYIYVIALSIIAAVYLSFKLSYVILNPIRELQNTSSRIAMGELETRVNVESRDEIGQLGKTFNNMAGRLQSTIRESVEKQKKLEAILVSMDSGVIAVDRKHKIIMINPYAEKIFGIDKNIIGQSLMDCIRNYEFEDIFNKRAEGYAEIKTSWPKERNLRIKTADIINGYECIGTVAVVQDITDIRKLENMRTQFVANVSHELKTPLTSIKGFAETLRYVEDDNQKGEFLDIIDDEVDRLTRLISDILTLSDIEIRPFMKKEEFDVNEIIKAVCGLLEKSASRKNISLKVFGEDVPNLIGDNDKFKQMIINLVDNAIKYTEAGGEVSVYKKYTKDDVIISVKDNGVGIPKEHLQRIFERFYRVDKARSRANGGTGLGLAIVKHIVLNFNGSINIESKLGVGTEFIITIPYK

SEQ ID NO: 77212 - DNA, 1428 bp, Clostridium acetobutylicum ATCC 824
  CDS (1)..(1428): transl_table=11
atgagaaagggaattttctcaaaaatgatagcaacatatactggcattattgcaataagttttgttgtgacttctgctgtgctatcgttttggtttcaaaatttttatttttcccaaaaaagaagtcaaatcactacagaagccaagtatgttcaggctgttgcatttcaatatatagaaggcaatatgtcggtggcaagggtcaatgaaacattaaaggaagtagttgcgtatataaatacggacataggagcagacatagttgttatggatatgtatggctacgtgtatgctgtttcaaacccaaaatatgattacttagttggaacgcaggttaatactaaagatttgaatgagatagctaagaatcaagaggctatagaaaaaactgttgactatagtgaaatatttaaaaagcctgttagattatatgagatacctatgatttttaataaatcctttgagggagttataatgatagctactccagcatcagaggtaaagcattctgttaatagggtttatcagataatttggttttcggcgataattgcaataattgcagcatgcataattatatactacttctcccaaaagataataataagtcctttaaagaatataaatgatgttgctagaaaaatagctaaaggagaagtagaaaagagggtaaacattgagtccaatgatgaaataggtgaactcggtgaatcctttaattttatggcaaatgctattgaaaaatctgaaaaaaacagaagagaatttatatcaaatgtatcacatgaaatacgttctccaataacttcaataaagggatttattggtggtatgcttgatggtgttattccaaaagaaaaggaaagatattatctatcgcttacctatgatgaaataaatagacttactagattagtaaatgacttattggatttatcttcaatagaggcaggtcaccttaagcttaacttaactaaaattgatataaatgagataataagatttactgttcttaaattcgaaacaaaaataaaagaaaaaaaattaaatgtagatgtatgctttaataacgataaagtatatgttatagctgacaaggataggataagtcaagtagttactaatttgatagataatgctgttaaatacgtatatgctgaaggcgagattaagatatctacaaaagaaagatataataaagcatatataacaatatataataatgggccacaaatccctgaagaggattttaatcatatatgggatagattttataaatctgataaagctagaactactaaaatgagcacaggactcggactgcctatagtaaggagtatacttacagagcacgggcaggatataaatgttataaataaaaaagaaggtggagtggaatttacctttacattaaagttggccaaataa

SEQ ID NO: 77213 - protein, 475 aa, Clostridium acetobutylicum ATCC 824
MRKGIFSKMIATYTGIIAISFVVTSAVLSFWFQNFYFSQKRSQITTEAKYVQAVAFQYIEGNMSVARVNETLKEVVAYINTDIGADIVVMDMYGYVYAVSNPKYDYLVGTQVNTKDLNEIAKNQEAIEKTVDYSEIFKKPVRLYEIPMIFNKSFEGVIMIATPASEVKHSVNRVYQIIWFSAIIAIIAACIIIYYFSQKIIISPLKNINDVARKIAKGEVEKRVNIESNDEIGELGESFNFMANAIEKSEKNRREFISNVSHEIRSPITSIKGFIGGMLDGVIPKEKERYYLSLTYDEINRLTRLVNDLLDLSSIEAGHLKLNLTKIDINEIIRFTVLKFETKIKEKKLNVDVCFNNDKVYVIADKDRISQVVTNLIDNAVKYVYAEGEIKISTKERYNKAYITIYNNGPQIPEEDFNHIWDRFYKSDKARTTKMSTGLGLPIVRSILTEHGQDINVINKKEGGVEFTFTLKLAK

SEQ ID NO: 77214 - DNA, 1974 bp, Caulobacter crescentus CB15
  CDS (1)..(1974): transl_table=11
ttgttttgtcgcgcaactctcctttcggatggaagcgaagcgttaggaacattcaggcatactctcgccaagagtgaagtgctgggtgcgatgtccgaaaaccgcaaccataacgtgtcaagccacgcgccgctgcaggcgcgaatcgccggtgtggccctggccacgacggtgcttgcgctcgtggccgcctgcctttgcttcatgcttcaacaatggagcgtggcgcgccaggaggcgcgcgccaaccacgaggtgctggtgcagatggccgccgccggagccgcggccccgctggcggaccacaacatggtcggcgtctatcgagccctggaagccgtggccaaggcgccgggcgtcgccggggtccgcatcatcgacgccaagggacgcgccgtcgctcagctgggcgaggccaatccttctaacgccgacacactgcagcgcccgatcaagctctcgtcgcaaacggtcggcacgctggtgctcgtggccaagcgccctggcctcgcccagactctggcgcgtgatctggcgctgacgggcgcgctgtttttcggcgcggcgggcatggcgatccttctggccaacagtctggcccgacgcctggcccagcctatggagcggctctccgaagccatgcacgaaaccgccgtcggcggacgcttcaaggctcttgaggagaccgctgacgacgacgtcttccgcagcctcatcgcaagcttcaaccacctagtggcgcgcctggaatgcaatgatcaggatctgcgcggcgccatggccgagctggtcaaagcgcgtgacgacgccaacgccgccaacgtcctgaagtcgcacttcctggccaatatgagccacgagatccgcacgccgctcaacggcgtgttggcgatggccgacgtcatggccatggaccagctcagcgacatccagcgcgagcgcctggcggtgatccgcgagtcaggcgcggtgcttctgggcgttctgaacgacgtgctggacctgtccaagatcgaggccggccggctggagatccaggatcggcccttcgacatcgcgcagctggcgcagtcgatccgcgaaacctttgtgccccaggcccgggccaagggcctggccttcgaggtcggtgtcgcgccggaagctcagggcctgtggcgcggcgacgccgatcgcctgcgccaaatcctgggcaacctgatttcaaacgcgctcaagttcaccctggacggcgcggtcgccgtgcgcttcgcctcggccgaggacggctcgggcctgcggatcgatgtcgctgacaccggtatcgggatctcgccagagattctgccgcgcctgttcgacaagttcgtccaggctgacagcacgaccacgcgccgctttggaggctcgggactgggcctggccatctgccgcgagctggcggcgatgatgaacggttcgatcaaggtgcaaagccgcgaaggccgaggctcgaccttcaccgtgctggtggggctaccgcgcgaggagaccctgaccgacgtccactatatcgatgacggcgatccgatcatggcgccgcccgccgccgaaccgcctcgcctccgggtcctggcggccgacgacaacccgaccaatcagaaggtggtggcggcggtcttggccccgctgaacgccgatgtcaccctggtcgatgacggcgcggcgtgtgtggaggcctggaagaccggcgactttgacgtcgtgctgatggatatccacatgccggtgatggacggcctcgaggccgcccgcagcatccgtgcgacggaacaagcagagatgcgtcggcgcaccccgatcatcgcggtcacggcgaacgccctgactcaccagatcgaggagtatctgtccgtgggcatggacggccacgtcgccaagcctatcgaggtcagcaaactctacgacgccatcgaggcggcgatggctggtacgcggctttcgcgcgccgcgtga

SEQ ID NO: 77215 - protein, 657 aa, Caulobacter crescentus CB15
MFCRATLLSDGSEALGTFRHTLAKSEVLGAMSENRNHNVSSHAPLQARIAGVALATTVLALVAACLCFMLQQWSVARQEARANHEVLVQMAAAGAAAPLADHNMVGVYRALEAVAKAPGVAGVRIIDAKGRAVAQLGEANPSNADTLQRPIKLSSQTVGTLVLVAKRPGLAQTLARDLALTGALFFGAAGMAILLANSLARRLAQPMERLSEAMHETAVGGRFKALEETADDDVFRSLIASFNHLVARLECNDQDLRGAMAELVKARDDANAANVLKSHFLANMSHEIRTPLNGVLAMADVMAMDQLSDIQRERLAVIRESGAVLLGVLNDVLDLSKIEAGRLEIQDRPFDIAQLAQSIRETFVPQARAKGLAFEVGVAPEAQGLWRGDADRLRQILGNLISNALKFTLDGAVAVRFASAEDGSGLRIDVADTGIGISPEILPRLFDKFVQADSTTTRRFGGSGLGLAICRELAAMMNGSIKVQSREGRGSTFTVLVGLPREETLTDVHYIDDGDPIMAPPAAEPPRLRVLAADDNPTNQKVVAAVLAPLNADVTLVDDGAACVEAWKTGDFDVVLMDIHMPVMDGLEAARSIRATEQAEMRRRTPIIAVTANALTHQIEEYLSVGMDGHVAKPIEVSKLYDAIEAAMAGTRLSRAA

SEQ ID NO: 77216 - DNA, 1263 bp, Sinorhizobium meliloti 1021
  CDS (1)..(1263): transl_table=11
atgcgcagccggctgttcctgaaaatctacctgacactgctcgcgagccttgccgcggttgccgtcgccagcgccgcattcgtatggctcgggcagggcgaggaggaatccggctggcaaagccagcgcgcccggttcgtcgccgcgctcattccgccggacatggacaaccggaccgtcgaggcgaccatcgagcggttttcacgcgctttcgatgccgacattgccgtatacgacccgcgcggcaggctgatcgcaagcggcggcagcccgattccgcgcgacattctcgaccagccttggcgccacggcccgggcaattttcacaccatggtgaccgaactgcccgacggccgtaccgtggctgcgcgcatggagcggcccttgcgtccgtccggccgcaatccgctcgcctacctggctttgatcgccggtgtcatcgggctggccgcctatccggtggtccgtcacctgacccgccggctggagcggctgcgcgtgggcgtggatgcctggggcaagggcgatttcgtggttcgcgtgccggaggacggcagcgacgaggtggcggcggtggccaagagcttcaacagggccgccgaccaggtcgagcggctgatcaagtcgcaccgggccttgctcgccaatgccagccatgaattgcgctcgccgcttgcgcgcctgcgcatggcgatcgacctctacgagcaggcgccgaacgacgatcgcaagcaggaaatcatccgcaacctttccgaactggacacgctgatcgaggagatcctgctggcaagcaggctggaccacgtcgagaagctcgatgcgctggagtccgtcgaccttctggctctcgtatcggaagagggcgcgcgcaacgatgtagaggttttcggaatgcctgcgatcgtcgcatgcgatgctcgcctgcttcgcaggctcgtgcgcaacctcctgcagaacgcactgcaccacggcggtccacctgtcacagccgctgtcgcgcaggcagacgatgctgcgatccttagggtccgcgatcacgggcccggcatagcggatagcgagaggcatcgcgttttcgagcctttctaccgcccgtcgggacgtagcgaggccgcgggcggctggggtttgggactggcgctggtgcgccagattgccgaacgtcacggcggcgccgtcagctacgaatctccgccggacggcggtgcctgcttcgtcgtgacgctgccggtgcaaagcaagcctgtgagggatcggtaa

SEQ ID NO: 77217 - protein, 420 aa, Sinorhizobium meliloti 1021
MRSRLFLKIYLTLLASLAAVAVASAAFVWLGQGEEESGWQSQRARFVAALIPPDMDNRTVEATIERFSRAFDADIAVYDPRGRLIASGGSPIPRDILDQPWRHGPGNFHTMVTELPDGRTVAARMERPLRPSGRNPLAYLALIAGVIGLAAYPVVRHLTRRLERLRVGVDAWGKGDFVVRVPEDGSDEVAAVAKSFNRAADQVERLIKSHRALLANASHELRSPLARLRMAIDLYEQAPNDDRKQEIIRNLSELDTLIEEILLASRLDHVEKLDALESVDLLALVSEEGARNDVEVFGMPAIVACDARLLRRLVRNLLQNALHHGGPPVTAAVAQADDAAILRVRDHGPGIADSERHRVFEPFYRPSGRSEAAGGWGLGLALVRQIAERHGGAVSYESPPDGGACFVVTLPVQSKPVRDR

SEQ ID NO: 77218 - DNA, 1218 bp, Synechocystis sp. PCC 6803
  CDS (1)..(1218): transl_table=11
gtgtgctacagacaaatgggggccagggggagtaagccattgcttttcctgaatgatcccccattgtgggcactccttagatccgccaacctcaatcctatggctaaactcagtcttggttcccgtcttttcctttcccatatgctggtgatgctagtcgggttgggcagtttcgtttccctggccaaaatatcttccccccgcatgtttgttctgcgcctagaggagttggaaagtcagggatttataactgttcgttccgccaaaacctatctgatccggggttttgaaaccgcctggaatcgcagttccctctgggcaattatctttggggccagcgccgctggagggttaagcttcctagccgcagaccggattatgcaacccctcgatcgcctaaagttagccacgaaaaatttggcagagggcgatttacaatcccggatgccccccagtgacattcctgaattggaggagttgggccaaagttttaatcgcatggcggatagcttggaaaatgtggaacaacaacggcgggaactggtgagtgacctgacccacgaattacgttcccctttaacggtggtgcggggctatttggaacaattggcggagggcaccattgccggagatccggaactataccaacgactggtgggggaaacccgcaggttggaacggctaacggtggatttacaagaactgtccaaggtggaagcgggttatttatctatccaacggcaacccctagacctttatcccctgttggcaaaattacaacaacggtttgcggatcagttattggaagatggcccggaattaatcctcgctgtccaacctcctctcccaacggtattggcggatccggaccgcgctgagcaaattttggtcaatttaattggcaatgcggtgcgttatacccccagcggtgccattaccatcgacgcctatctttgtacgaataggaaagatatggaaaaggaaaatttactctgggtgactgttactgatacgggcattggcatcgcagagggggatttaccctacgtgtttgagcgattttggcgggctgataaatcccgttcccgttattccggcggcacgggtttggggctggcgatcgccaaacggttggtggaattgcaggggggcagtttgactgtcacgagtaccctgggccaaggtagtgagtttaggttttccctaccattggtctga

SEQ ID NO: 77219 - protein, 405 aa, Synechocystis sp. PCC 6803
MCYRQMGARGSKPLLFLNDPPLWALLRSANLNPMAKLSLGSRLFLSHMLVMLVGLGSFVSLAKISSPRMFVLRLEELESQGFITVRSAKTYLIRGFETAWNRSSLWAIIFGASAAGGLSFLAADRIMQPLDRLKLATKNLAEGDLQSRMPPSDIPELEELGQSFNRMADSLENVEQQRRELVSDLTHELRSPLTVVRGYLEQLAEGTIAGDPELYQRLVGETRRLERLTVDLQELSKVEAGYLSIQRQPLDLYPLLAKLQQRFADQLLEDGPELILAVQPPLPTVLADPDRAEQILVNLIGNAVRYTPSGAITIDAYLCTNRKDMEKENLLWVTVTDTGIGIAEGDLPYVFERFWRADKSRSRYSGGTGLGLAIAKRLVELQGGSLTVTSTLGQGSEFRFSLPLV

SEQ ID NO: 77220 - DNA, 1539 bp, Ralstonia solanacearum GMI1000
  CDS (1)..(1539): transl_table=11
atgcgtctgtctttcggcatcacctccaagctgttcgtcgcgctgttcgcgctgagcatggtcgtcgcgctcgccatgggcgcggcggtgcgctggcgtttcgacaccaactttctcgactacgtcaacgctcgcgaagccgagcgcatggcggtgtttgcccagagcatcgaatcggtctatgccgagcatgggaactggggtgtcctgcgcaatgaccggcaggcctggtaccgcctgatccggcgcgagatcggccgcacgcatgcggggccattcggcggtccgcgcggtgatgcagagcctgtgccgcccttcgctccgccgccgggggacgtgccgccgcccggtctgccgccgccgcctccggatgccggcgatcgcccgccgcagcatccgcctggcgaagggcccggcatgcatccgccgatctggctgctcgatgccgggcgcgtcccgattgtcggcgacggcccgccgcccggcccgggttcgcagtggcatgcgctgcatcacaacggccagaccgtcggctggctggcgaccccgcagcgcatgcacgtgcccgagggggccgaccaggccttcctggcccagcagctgcgcgccacctggatcatcgccgcgctgtcggtgctgctcgcggcgggcgtggcgatcctgctcgcgcgcggcgtgctggcgccgatgcggcggctggcccatgccacgcgccgcatggccgagggcgactacgcggcgcgggtcgatgtgcattcgggcgacgagatcggccacctggccgacgatttcaaccggctggccgaaacgctcgaggccaaccagaagatgcgccgccagctgacggccgacatttcgcacgaactgcgcacgccgctggcggtgctgcgcggcgaactggaggcgctcgaggacggcgtgcgggccctcacgcccgcgtcgctgacctcgctgcaggccgaggtgggcacgctgtccaagctgatcgacgatctgtacgagctgtccctggccgatgtgggcgcgctggctttccacatggagtcgatcgacctggccgataccgtatgcagcgcggcgcaggggttcaccccgcgcctgatggacaagcgcatcgccttgcagctcgacctgccgacggggccgtcgcgcgacgcggccatccagggcgatccgcagcgcctgcgccagctgatgcagaacctgctggagaacacgctgcgctataccgacgcgggcggcacgctgcgcatccacgtccatcgcgcaggcgcgtggtggtgcctggacgtgcaggacagcgcgccgggcgtgccggaggcgatgctgccgcgcgtgttcgaccggctgttccgcgccgatccttcccggggccgcgcgcaaggcggggccgggctgggcctgagcctgtgccagactatcgtgcagacgcacggtggcaccatcgacgccagaccttcaccgctgggcgggctgtggattgcgatccgcctgccggctgccaactcctctgttgctgaccatgatcctgatcgttga

SEQ ID NO: 77221 - protein, 512 aa, Ralstonia solanacearum GMI1000
MRLSFGITSKLFVALFALSMVVALAMGAAVRWRFDTNFLDYVNAREAERMAVFAQSIESVYAEHGNWGVLRNDRQAWYRLIRREIGRTHAGPFGGPRGDAEPVPPFAPPPGDVPPPGLPPPPPDAGDRPPQHPPGEGPGMHPPIWLLDAGRVPIVGDGPPPGPGSQWHALHHNGQTVGWLATPQRMHVPEGADQAFLAQQLRATWIIAALSVLLAAGVAILLARGVLAPMRRLAHATRRMAEGDYAARVDVHSGDEIGHLADDFNRLAETLEANQKMRRQLTADISHELRTPLAVLRGELEALEDGVRALTPASLTSLQAEVGTLSKLIDDLYELSLADVGALAFHMESIDLADTVCSAAQGFTPRLMDKRIALQLDLPTGPSRDAAIQGDPQRLRQLMQNLLENTLRYTDAGGTLRIHVHRAGAWWCLDVQDSAPGVPEAMLPRVFDRLFRADPSRGRAQGGAGLGLSLCQTIVQTHGGTIDARPSPLGGLWIAIRLPAANSSVADHDPDR

SEQ ID NO: 77222 - DNA, 1656 bp, Ralstonia solanacearum GMI1000
  CDS (1)..(1656): transl_table=11
atgcacccctcccggattctcatgttccgtgtcaggctttcgctcgcatttgccctgatggtggcgctcgtctgcgtccaggccggcttcgtctattggggcgccaatcgcgtcaacgactacgcgacgcacagccggctcgccagcgacatcctctccgagttgctcgagctctcggccaacaagcagcgcctgcgggtgtgggcctcccagcgcctgatgaacgccgacgcctcgccggaggtgcgcgaccgcctgctggccagcatgcaggccagcgccgccacgctgcgctacctggcccggcgcgacatcgacctgtggggcgagatttccgcgcgcgacggtgttcccatcccgcccgaagtcaaccagctcaccaccacgaccgacctcctcggcgacaacatcgccgcggtccaggcgcggctggtggcgctggtgccgctgcagcgcgatgccgatttcgccggcgtctggcatgaactgaacgaagtgttcgacatggcgcgtggccgcgacctgcgcgaactgatcaacggcgccatcgaacgccagcggcgggcggtgccgatcgcccgcgcggccaccgagggcggtctggaccgcgtgcgcacgcaggcgctcagcatggtggtcctggtgctgctggccgccttgacgctggccctgcacctgaaccgccgcctgcagcggccgctcgaccgcctgctcgaaggcgcccgggcgctgcgcgccggcgcgctcgaccaccgggtgccgatcgggtcgggcgatgaattcgaccgcgtggccgagggcttcaacgccatggccgccgaactccagcagcaccgcaacgatgccgacgccgcccgccggcgcctggaagacgcggtccaggcgcgcaccggcgagctgcgcaccgcgcacgacgcgctgcagcgcatcgaccagcgccgtcgccagctgttcgccgacctgggccatgaactgcgcacgccgaccaccgccatccgcggcgaagccgagatcgcgctgcgcggcggcgacaagcccgcgcacgaataccgcatggcgctggagcgcatcgtcgggggcgccaagcagctgaccgggcgaatcaacgatctgctgctgatcgccaaggccgaggccgaccagctcgccatgcggccgcaactgatcgacctgccctccgtgctgcacgacgccgcggacctcgccgatgcgctgggcgccgagcacgacgtgaagatccagctcgacctgccgcaggatgccgacgcgctgaccctgccggccgaccccgaccgcctgcgccaggccatcgtgatcgtgctggacaacgccgtccgctattcgccgcgcggcggcacggtgcagctgtgctgccgcatccagcccgacacggtgcgcatcgaagtccaggaccacggcatcggcatcgatgcagacgagctgccgatggtcttcgagcgcttcgtccgcggccggcgcgcgcgcgcgcatcgcgccgacggcaccgggatcggcctgtcgatcgcgcaggccatcgtgcaggctcatcgcggccacatcaccttgcagagcgcgccccagcaaggcacccgcgtctgcatcgaactgccgcgccgcctcgccgccggcgcgaacgacgcccccacactgccatga

SEQ ID NO: 77223 - protein, 551 aa, Ralstonia solanacearum GMI1000
MHPSRILMFRVRLSLAFALMVALVCVQAGFVYWGANRVNDYATHSRLASDILSELLELSANKQRLRVWASQRLMNADASPEVRDRLLASMQASAATLRYLARRDIDLWGEISARDGVPIPPEVNQLTTTTDLLGDNIAAVQARLVALVPLQRDADFAGVWHELNEVFDMARGRDLRELINGAIERQRRAVPIARAATEGGLDRVRTQALSMVVLVLLAALTLALHLNRRLQRPLDRLLEGARALRAGALDHRVPIGSGDEFDRVAEGFNAMAAELQQHRNDADAARRRLEDAVQARTGELRTAHDALQRIDQRRRQLFADLGHELRTPTTAIRGEAEIALRGGDKPAHEYRMALERIVGGAKQLTGRINDLLLIAKAEADQLAMRPQLIDLPSVLHDAADLADALGAEHDVKIQLDLPQDADALTLPADPDRLRQAIVIVLDNAVRYSPRGGTVQLCCRIQPDTVRIEVQDHGIGIDADELPMVFERFVRGRRARAHRADGTGIGLSIAQAIVQAHRGHITLQSAPQQGTRVCIELPRRLAAGANDAPTLP

SEQ ID NO: 77224 - DNA, 1239 bp, Brucella melitensis 16M
  CDS (1)..(1239): transl_table=11
gtgtgcttttcgtcagcatggtgctggcgatctgtgtcatggcgctcgaccttcctttctggttccgcgccatattgctggcgctcgttgtgctgggcgcggtctgggcggcggcgggcattggcaatggggaggatgaaaaggttcccttgcgggaagtggccagcccgtgaaatggcggctgtctcgggcgagcggctggccgatcttctgaccgatccgatgatcgtcttcgatcacaccgcaacggtgcgttttgccaacgtggcggcgcttgaagcgttccagtcgctgcaaaacggcaccgcgctttatctgcgctttcgcgccccggaaatgctcgcgctgatccagggcgtgattgccgacggcgaaccgcgcaatatcgaatatttcgagcgcgttcccatcgatcgctggtacaaggccatggtcaaggcgctgcgtgatgcggaaggaaagccggaactcttcgtgcttattttccgcgaccagagcgaaacacggcgtatcgaccgtatgcgttccgactttatcgccaatgcaagccatgagctgcgcaccccgcttgcctcgctgcgcggcttcatcgaaacgctgcaaggcccggcgcgcaacgatgccgccgcccgtgaccgctttctcgacatcatgcagaaacaggccgagcgcatgtcgcgtttgatcgacgatctcctgtcgctgtcgcggcttgaaatgcgtgctcatctggcggtcaatgaaagcgtggatgtggcggccacgctggcccatgtggccgatacgctgacgccacttgccgccggtctcggcgtgaccatcgagcgccacctgccggaacatccggttcatgtgatgggcgcgcgtgatgagctgattcaggtcttccagaatcttgtcgaaaatgcctgcaaatacgggcaggagggcaagcgcgtcatcataagattaagcgaggaagacacgggaaatgcgacggaagtggtcgcctccatacaggatttcgggccgggcattgctgccgaacaccttccgcgcctcacagagcgtttctatcgcatcgacgtggagacaagccgcgcgcacaagggcacaggtcttggccttgccatcgtcaagcatattctggcccgccatcgcggccggcttgtggtgcgttcgcaattgggggaaggctctactttcatggtgcgcctgccggggcagaacgcgcgctccgccgaggctgcaacaatatga

SEQ ID NO: 77225 - protein, 412 aa, Brucella melitensis 16M
MCFSSAWCWRSVSWRSTFLSGSAPYCWRSLCWARSGRRRALAMGRMKRFPCGKWPAREMAAVSGERLADLLTDPMIVFDHTATVRFANVAALEAFQSLQNGTALYLRFRAPEMLALIQGVIADGEPRNIEYFERVPIDRWYKAMVKALRDAEGKPELFVLIFRDQSETRRIDRMRSDFIANASHELRTPLASLRGFIETLQGPARNDAAARDRFLDIMQKQAERMSRLIDDLLSLSRLEMRAHLAVNESVDVAATLAHVADTLTPLAAGLGVTIERHLPEHPVHVMGARDELIQVFQNLVENACKYGQEGKRVIIRLSEEDTGNATEVVASIQDFGPGIAAEHLPRLTERFYRIDVETSRAHKGTGLGLAIVKHILARHRGRLVVRSQLGEGSTFMVRLPGQNARSAEAATI

SEQ ID NO: 77226 - DNA, 1404 bp, Clostridium perfringens str. 13
  CDS (1)..(1404): transl_table=11
ttgaaggtaagaaaatataaaagtttaaattttaaggttatagttccatctatagttatcataataattgtaactttacttactgtggtcatatctaaattttattttgataaaaaatttggtgactatattatgattaaaaatcagaatacagtacaaaacattttgatggagctaagtgaacaatattccgataatgagtggaattataagaatatagagaagataacttataattccttagataaagggattatagttgctttatatgataaagaagataaggaaataatgaacatagaaaaaaactctaaggataaatgcaatagaattatgaattttataaaaagttctatggaagggaaatatggctctacaacaagtcaatttgaacctgtgtattatcctttaataaagagtggagaaaaaattggagaggttagggtaaaattttatggtcctatattttatatgcagaatgaattagtttttctggatatagtaaataagataatattaggtattggagttttacttattttagcatctacaataatgggatttataatttcaagatccataacaagaccaataaataagctcatgacaaaggcgaagtatatttctaaaggagagtatgacaagaaaattgagataaatacagatattttagagataaatgatttgataaattccataaataatctttcacagagtataaaagagcaagagaatataagaaaaagacttactggggatatttctcatgagttaaaaactcctttaacaaatatacagtctcacttagaggcaatgatagatggcatatgggaacctacagaggaaaggttactaagtgttaaggaagaggcagaaagattatcgtccttagtaagtgatatgcaaaagttaaataagtatgatgagtcttctattaagcttaaaaaggataatgtgaatataagtgatataatttgctttgtaatatttcaattttctaatttagcaaaaagcaaaaatataaagatagaatatgaaaaaaagaatattaatttatattgtgataaggataaaataacacaggctttagtaaatattctttcaaatgctattaggtattcaaatgagggaagtactatttttatagaagaaaaattaaaagataataaggttataatatcaatagaagatcaaggtataggtatttcagaagaggatttaaaatatgtctttgaaagattctatagggcagataaatctagaactagagctactggaggaacaggaataggactaaccatagttaaatccatagtatcttctcatggaggagaagttaagttagagagtaaactaggtgaaggaagtaagtttactataatattacctaaagaagatatatga

SEQ ID NO: 77227 - protein, 467 aa, Clostridium perfringens str. 13
MKVRKYKSLNFKVIVPSIVIIIIVTLLTVVISKFYFDKKFGDYIMIKNQNTVQNILMELSEQYSDNEWNYKNIEKITYNSLDKGIIVALYDKEDKEIMNIEKNSKDKCNRIMNFIKSSMEGKYGSTTSQFEPVYYPLIKSGEKIGEVRVKFYGPIFYMQNELVFLDIVNKIILGIGVLLILASTIMGFIISRSITRPINKLMTKAKYISKGEYDKKIEINTDILEINDLINSINNLSQSIKEQENIRKRLTGDISHELKTPLTNIQSHLEAMIDGIWEPTEERLLSVKEEAERLSSLVSDMQKLNKYDESSIKLKKDNVNISDIICFVIFQFSNLAKSKNIKIEYEKKNINLYCDKDKITQALVNILSNAIRYSNEGSTIFIEEKLKDNKVIISIEDQGIGISEEDLKYVFERFYRADKSRTRATGGTGIGLTIVKSIVSSHGGEVKLESKLGEGSKFTIILPKEDI

SEQ ID NO: 77228 - DNA, 1410 bp, Clostridium perfringens str. 13
  CDS (1)..(1410): transl_table=11
atgagatgtcgtggcttagttccaaagttaatcttaacactaagcgtaacaatatgcattactttctttattgtaggtataatactttctagcttgtttagagaagaatattatcaagaaagattaaaaactttatctggagaagcggaagttatagaacaagttgtaaattcatttatgaatagtgaaactactttaggtgaattagataaatctatatcatttataggagattcattaaaagcagatatttatttaattgatagttatggttacatatattcagtttctaatgaaaaatatgattatttaaaacgcacaaaaatagatgataatgatatgaaaacattaaaggaaaatattcctatagagcagaagaaaaaaaatgaatttatatattctaaacctatcttctacaagggggtatttacaggagctgtttcaatagttactcctttaagtgctttatcagattctcttgttagaattaatcaaattgtatggatgtgtgtagctatagctataattttttctggattagcaatatattttatttcaaaaaagataatcataaaacctttaaaagttataaataatgctgctaaaaagattgctaacggagaaattggaaatagagttaatgtttcttatgatgatgaggtcggtgagttagctgaatcatttaatataatggcaacttctattgaggaggcagaactaaatagaagggaatttatatctaatgtatctcatgagttaagatcaccaatgacatcgattaagggcttcataactgccatattagatggagttattcctaaagataaagaagaatattatcttgttatagtaaatgatgagataagtagattaactagacttataaatgacttactagatttatctgctatgcaagctggaaaactagagtttaatataagtgagttagaattaaatagaattatagagacaactgtattaaagatgaatcaaaaggctgcaagtaaaaatataaaaattgaagttctcttagagagcgaaaaattatatgtttatggagataatgatagattaatacaggttgttactaatttagttgataatgctataaaatactgtgatgaaaatggtgaagttaaaatatcaactaaaacaaagggaagtaagattattgttagcatatttaacactagtaaaggaatagatgaatatgatttaactcatatttgggatatattttataaagttgacaaggcaagaagtaataaaactagtacagggttaggattatctattgtgagaaatataatactgcaactagaagaagatatttgggctgaaaatgtcaaagataaaaatggtgaaataaaaggtgttagatttaattttactttaactaaagttaaataa

SEQ ID NO: 77229 - protein, 469 aa, Clostridium perfringens str. 13
MRCRGLVPKLILTLSVTICITFFIVGIILSSLFREEYYQERLKTLSGEAEVIEQVVNSFMNSETTLGELDKSISFIGDSLKADIYLIDSYGYIYSVSNEKYDYLKRTKIDDNDMKTLKENIPIEQKKKNEFIYSKPIFYKGVFTGAVSIVTPLSALSDSLVRINQIVWMCVAIAIIFSGLAIYFISKKIIIKPLKVINNAAKKIANGEIGNRVNVSYDDEVGELAESFNIMATSIEEAELNRREFISNVSHELRSPMTSIKGFITAILDGVIPKDKEEYYLVIVNDEISRLTRLINDLLDLSAMQAGKLEFNISELELNRIIETTVLKMNQKAASKNIKIEVLLESEKLYVYGDNDRLIQVVTNLVDNAIKYCDENGEVKISTKTKGSKIIVSIFNTSKGIDEYDLTHIWDIFYKVDKARSNKTSTGLGLSIVRNIILQLEEDIWAENVKDKNGEIKGVRFNFTLTKVK

SEQ ID NO: 77230 - DNA, 1119 bp, Corynebacterium glutamicum ATCC 13032
  CDS (1)..(1119): transl_table=11
atgacagccctcatcccagctcgccacagcctgacttttcgtctgctcaccgcgcagcttgctgtggtgttgatcagtctgctggccgccctgattgtggctgccttggtagggcctgcaattttcaattctcacctggatctttccggcccgattgatccccgccagacggatttccacattcaggaggcctaccgggacgccaattacattgccctcgcagcggcacttcccaccgcagtgttgagctccattggtgtgagtttttggctttcccaccgcctgggccagccgttgtggcgactgtcccgggctgcaactgccatgagctccggcgactaccaggtgcgcgtacccatttccgatgtggataaagaggtcgctgctctatctctcgccttcaattccatggcggatcagctcgaacacacagaagaactccgccgaaacatgctctccgatctatcccatgaaatgaacactcccctttccgtcctccttgtttatgtcgacggtttgcaggacggcatggtggagtgggacgccgacacccacgcagttttcgccgagcaacttggccggctttcccgcctcacatcagatcttgatgatgtctctagagcccaagaacaccgcttcgacctggtctacagcaccgtcgccatcggtggtctcattcacaatgccgccggagccgccgcaggttcctaccaagaaaaaggcgtggccctggaagtaacaggcagcgattccaccgaactcatccgcgttgatagccaacgcttcgcccaagtcatggccaacctcttctccaacgccttgcggcacacccccgccggtgggaaagttcacgtccgcgtcctgcgtcaaggcgtgggaaccatcgtcatcgaagtcatagacaacggcgaaggaatcgcccctgaacacgtaaaatacgttttcgaacgctacttccgcgccaaacgatccgactccgacgaccaatccggctccggaatcggcctcaccatctcccgcgcactcatcgaagcgcaaggtggcacactaaccgcagaatccgctggcctgggcaaaggcgcgaaatttaccatccgactaccccttttaagcaaataa

SEQ ID NO: 77231 - protein, 372 aa, Corynebacterium glutamicum ATCC 13032
MTALIPARHSLTFRLLTAQLAVVLISLLAALIVAALVGPAIFNSHLDLSGPIDPRQTDFHIQEAYRDANYIALAAALPTAVLSSIGVSFWLSHRLGQPLWRLSRAATAMSSGDYQVRVPISDVDKEVAALSLAFNSMADQLEHTEELRRNMLSDLSHEMNTPLSVLLVYVDGLQDGMVEWDADTHAVFAEQLGRLSRLTSDLDDVSRAQEHRFDLVYSTVAIGGLIHNAAGAAAGSYQEKGVALEVTGSDSTELIRVDSQRFAQVMANLFSNALRHTPAGGKVHVRVLRQGVGTIVIEVIDNGEGIAPEHVKYVFERYFRAKRSDSDDQSGSGIGLTISRALIEAQGGTLTAESAGLGKGAKFTIRLPLLSK

SEQ ID NO: 77232 - DNA, 1347 bp, Thermoanaerobacter tengcongensis MB4
  CDS (1)..(1347): transl_table=11
ttgaagggaataaggaaaaaactttttatatcatacctttccataggaatggtagtacttttgcttttctggctgacacaggtagtcttcataaacagaatatacgagtattacaagataaatcaattaaaaagctacagcgagcagatagtgcaggccataaacaataacaatgaaatgctaataagcgaactcatagacaagtcaaatgcaagagtaatagcaatcacagaaaacgacatagtaatagctggaaacaatagagggcatggaatgagaggacttggaatccctgaaatactcttaaggcctactaacaccacaaaagtcgtaaaatacgaacacccttttctccacatagaatacctctcaattgtgaggccttttttgtacaacggcaaacccgctatcttaattatgagtttacctgaggcttctataaacgactctgtcaatctctttaaagaggtcttctggtggatctttgcactcaccatagtttctactcttgttgtgtccagctatatgtccaaaaaattcactcgcccaatacagatcctaaaaaatgcggcccatgaaatcgcctcaggaaatttgaacgtaaaaataaattacaaagaggaagatgaactgggagatctggcaaagtccatgaacacaatggtaaagcagctttctataacagacaagtttagaaaagatttaattgcaaatataagccatgacttaaaaacacctttaggcctcataagaggatattcagaaatgcttttagattattacggagaagacaaagaaaaaagagaaaaatatttaaacacagtaatcaaagaaacagagaggatgtcaaaactggtagacgatgttctgcagctttctaaacttcaatcaggaatgatagaggtaaaggaagaaacaattgacttagaaaaattaatatttgagatacttgatatatttgaaatccaaattttagaaaagaacattgaagtaaaacttgaaaacttgaaagttaaagtcgtagcagatagagagatgataaaaagggcaataataaacataataagcaatgccatagcaagcatggaaaatggaggaacgctttctatcaccgcagaacttcaggataaaaacgtcctcattaaaatatcagataccggatgtggaataccggaaaaagaccttgaacatatatttgatagattctacaaagggaataaatctggaacaggacttggccttgcaatagtgaaagaaatacttaccctacatcaaagcgatttcggaataaggagcaaagaaggagaagggacaactttttattttactttaaaagcggggaaatag

SEQ ID NO: 77233 - protein, 448 aa, Thermoanaerobacter tengcongensis MB4
MKGIRKKLFISYLSIGMVVLLLFWLTQVVFINRIYEYYKINQLKSYSEQIVQAINNNNEMLISELIDKSNARVIAITENDIVIAGNNRGHGMRGLGIPEILLRPTNTTKVVKYEHPFLHIEYLSIVRPFLYNGKPAILIMSLPEASINDSVNLFKEVFWWIFALTIVSTLVVSSYMSKKFTRPIQILKNAAHEIASGNLNVKINYKEEDELGDLAKSMNTMVKQLSITDKFRKDLIANISHDLKTPLGLIRGYSEMLLDYYGEDKEKREKYLNTVIKETERMSKLVDDVLQLSKLQSGMIEVKEETIDLEKLIFEILDIFEIQILEKNIEVKLENLKVKVVADREMIKRAIINIISNAIASMENGGTLSITAELQDKNVLIKISDTGCGIPEKDLEHIFDRFYKGNKSGTGLGLAIVKEILTLHQSDFGIRSKEGEGTTFYFTLKAGK

SEQ ID NO: 77234 - DNA, 1356 bp, Thermoanaerobacter tengcongensis MB4
  CDS (1)..(1356): transl_table=11
atgtttagaaataatttaagaacaaagacggctattgtatttatttcaatagctcttatatcgattgttattgtaagtattacaacaaacatcttaataataaatagctttggaaattatgttacaaagtcaacagataaagaatttagcaatatagctaacactcttgctgcagtgtataaatctgagggaggttggaaaagtacaacagggcgtgaaattggtcatgcagctatgatggaaggatatggattaaggcttagagataaagatggcaaaattatatgggatttttcttcaatgtcatatatgatgaatatgatgggaaaatggaataagaaaaatatttctgaaaaaactcttcccatcattgtagatgaaaaaacagtgggatatgtagatataatttattatgggccgataatgatgagtgacttggattttaagtttttatgtgatattagcagatataatgttatagcaacggtgatagctatttttatagcattgactataagtatttatgtgtcaaattatattacaagaccgttaattaatattacggaagttgctaaaaagcttgaaaaaggtgattttactgcaaaggtttatgatatacctaaagaagatgagctatttaagctcacagctgcaataaaccaccttggagaatctttaaaaaatcaagaaatactaagaaaacaaatgacctctgacattgcacatgagcttagaacaccattgacaacattgcagagtcatattgaagcaatgcttgatgggatttgggagccgacgcatgaaagattgaagagtttaaatgaagaggtcttaaggcttataaatattgtaaaagaccttgaaacattgaataaatttgaatctgatatgttaaagcttaataaaatcaaatttgacgcaagcgaattagtaaagagcattttgacaaattttgaagcatcttttgctgaaaaagaacaagaagttgtaaagaacatcgaagataacattatgttgtttggtgataaggacaggatagcacaggttttcgttaacctaatatcaaattcaaataaatatactcctgtaggtggcaaaataaaaatagacttttataaagatggcgattatgcagtatttgtaatagaagataatggaatgggcatatcaaaagatgatattccttttatttttgaaaggttttacagaggagaaaaatcaagaaatcgtgaaacaggtggaagtggaatagggctttcgattgcaaaagctatagtactagcccatggaggcgaaataagcgttgaaagcgagataaataaagggagtaagtttactgttaaaattcctttgtaa

SEQ ID NO: 77235 - protein, 451 aa, Thermoanaerobacter tengcongensis MB4
MFRNNLRTKTAIVFISIALISIVIVSITTNILIINSFGNYVTKSTDKEFSNIANTLAAVYKSEGGWKSTTGREIGHAAMMEGYGLRLRDKDGKIIWDFSSMSYMMNMMGKWNKKNISEKTLPIIVDEKTVGYVDIIYYGPIMMSDLDFKFLCDISRYNVIATVIAIFIALTISIYVSNYITRPLINITEVAKKLEKGDFTAKVYDIPKEDELFKLTAAINHLGESLKNQEILRKQMTSDIAHELRTPLTTLQSHIEAMLDGIWEPTHERLKSLNEEVLRLINIVKDLETLNKFESDMLKLNKIKFDASELVKSILTNFEASFAEKEQEVVKNIEDNIMLFGDKDRIAQVFVNLISNSNKYTPVGGKIKIDFYKDGDYAVFVIEDNGMGISKDDIPFIFERFYRGEKSRNRETGGSGIGLSIAKAIVLAHGGEISVESEINKGSKFTVKIPL

SEQ ID NO: 77236 - DNA, 1410 bp, Thermoanaerobacter tengcongensis MB4
  CDS (1)..(1410): transl_table=11
ttgaagaaaaacaggctttttaaaaagctttttataagcaatataataattgttgccataactttggctgtcgtctctataatgttttacatcatgtttcagaattactattttgctgaaaaagaaaaaataatgctggaagaggcacaggagataaacgctattttgaacgagtttgcggtaggggatataaatttagataagtggaatcaggagcttaatgttgtgacgagacttattaatgcaacagtgtggattgtggacaaggagggccttgtttacagccagtctcagcagggaaagccgtggatgaagattactctcagtaaggctgatatacaaaatattttaaaaggagaatccattgtaaaaaaaggctattttggaggggcttttacaagccctgtgcttacagtgggagttcctcttgtgataaaggggcatattgaaggagccatattcatgcacgcatcactggaagagatgaacaggacggttttgaacattttccttttgatgcttttatcaggcggaatggcttttgtagtgagctttatattgatatcctacacttcaaacagaatatctgagcctcttaagaaaatgagccttgctgcaagagagatagcaaaagggaatttttctgcaagagttgaccattttgaagaggatgagataggggatttagcacggtcttttaatgtgatggcaagggaacttgcacagctcgaagatatgaggaaagaatttgtcgcaaatgtctcccatgagctcaggtctccaataacctcaatacaaggctatatagacggcatattggatgggactattcctaaagaaaaaacttatgattacctcaaagtggtgcaggaagagacgagaaggatgtcccggttgataaatgaccttctggagatgacaaagcttgagtcgggagagtttcctcttaatagaactgagtttgacataaatgagctcataagaatttgcattataaagtttgaaaaaagaatagtagaaaaagaccttacagtaaaggtggattttgaggaggataggaggtttgtttttgcagatagagacaagatagagcaggtcttgacaaatttaatagacaatgctataaagttttctaagccaaagggcattattcacctctttactgaggttaaaggggataaggtctttatcactgttaaagacaatggaataggtatatctcctgaagatttagagcacatatgggaaagattttacaaagcggataagtcaagaggaaaggacggcgctggtcttggcctttacattgtgaagaagataatagaggctcacaaagaggagatatgggcagaaagtgagcttaagaaagggacttcttttaccttcactcttccgataaaaaaagtttaa

SEQ ID NO: 77237 - protein, 469 aa, Thermoanaerobacter tengcongensis MB4
MKKNRLFKKLFISNIIIVAITLAVVSIMFYIMFQNYYFAEKEKIMLEEAQEINAILNEFAVGDINLDKWNQELNVVTRLINATVWIVDKEGLVYSQSQQGKPWMKITLSKADIQNILKGESIVKKGYFGGAFTSPVLTVGVPLVIKGHIEGAIFMHASLEEMNRTVLNIFLLMLLSGGMAFVVSFILISYTSNRISEPLKKMSLAAREIAKGNFSARVDHFEEDEIGDLARSFNVMARELAQLEDMRKEFVANVSHELRSPITSIQGYIDGILDGTIPKEKTYDYLKVVQEETRRMSRLINDLLEMTKLESGEFPLNRTEFDINELIRICIIKFEKRIVEKDLTVKVDFEEDRRFVFADRDKIEQVLTNLIDNAIKFSKPKGIIHLFTEVKGDKVFITVKDNGIGISPEDLEHIWERFYKADKSRGKDGAGLGLYIVKKIIEAHKEEIWAESELKKGTSFTFTLPIKKV

SEQ ID NO: 77238 - DNA, 1128 bp, Streptomyces coelicolor A3(2)
  CDS (1)..(1128)
atgagcagcagaggacgggaagccgcacggaggaaccccggccctcggaccaccggggagccctggggcggcgtgcgcccgttctcgatcaagaccaagctgggcgcgctggtcgtcacgtcggtgctgatcaccaccggcctgtcggtgatagcggtgcacaccaagacggagctgcggttcatcacggtcttctcgatgatcgccacgctgctgatcacgcagttcgtggcgcactcgctgaccgccccgctggacgagatgaacgcggtggcccggtccatctcgcacggcgactacacccgccgggtgcgcgagaaccgccgcgacgagctgggcgacctggccgtcaccatcaaccgcatggccgacgacctggaggcccaggacctccagcgcaaggagctggtggcgaacgtctcgcacgagctgcgcaccccgatcgcgggcctgcgcgcggtgctggagaacatcgtcgacggcgtcaccgaggccgacccggagaccatgcgcacggcgctcgggcagaccgagcggctcggccggctggtggagacgctgctcgacctctcccgcctggacaacggcgtcataccgctgcgcaagcgccgcttcgaggtgtggccgtacctgtcgggcgtgctgaaggaggccaacatggtcgcctccgcgcgcgcgggcatcgcctcggggtccggcagccactcccgcaccgacgtgcacctggccctggacgtcttcccgccggagctgaccgcgcacgccgaccccgagcgcatccaccaggtcgtcgccaacctgatcgacaacgccgtcaagcacagcccgccgcacggccgggtgacggtccgggcgcggcgcggcgagctgccggaatcgcttgagctggaggttctcgacgaagggcccggcatcccgcgctcggagtggcgccgggtgttcgagcggttcaaccggggttcggtgtcgcggccgcacggtccgggcagcgacgggggcaccggcctgggcctcgcgatcgcgcgctgggcggtggatctgcacggcggccggatcggggtggccgaatccgagcggggctgccgcatcctcatcactcttccgggcctgccgtcgacgtccggttga

SEQ ID NO: 77239 - protein, 375 aa, Streptomyces coelicolor A3(2)
MSSRGREAARRNPGPRTTGEPWGGVRPFSIKTKLGALVVTSVLITTGLSVIAVHTKTELRFITVFSMIATLLITQFVAHSLTAPLDEMNAVARSISHGDYTRRVRENRRDELGDLAVTINRMADDLEAQDLQRKELVANVSHELRTPIAGLRAVLENIVDGVTEADPETMRTALGQTERLGRLVETLLDLSRLDNGVIPLRKRRFEVWPYLSGVLKEANMVASARAGIASGSGSHSRTDVHLALDVFPPELTAHADPERIHQVVANLIDNAVKHSPPHGRVTVRARRGELPESLELEVLDEGPGIPRSEWRRVFERFNRGSVSRPHGPGSDGGTGLGLAIARWAVDLHGGRIGVAESERGCRILITLPGLPSTSG

SEQ ID NO: 77240 - DNA, 1380 bp, Xanthomonas axonopodis pv. citri str. 306
  CDS (1)..(1380): transl_table=11
atgaaattgggtatcaccgccaagttgtttctcgccatcctcgctgcgtgcgtggcggtgctgctgatcaacggcatcgccgtgcaggccttcgtcaaacgccagttcctggactatctcaacgaacagggcgtggagcgcatgcaagagaccttgccgcgggtcagggccgaatacgcgcggcacggcaactgggagttcgtgcgcgacaaccccgatgcctggttcgtgctgatgcgcccggaacgtggccccggcccgccacgcgaggcgccgccgatttccgaccagaccggtgcggtgtttcgcttcgcgctgctcgaccaggactacacgccggtgatcggcaatccggaggtcggccgccacgacatcctgcgcccggtggtggttggcggccgcaccgtcggctggatggcgatgctgccgttccagaaggcgctggcggcggcggacgcgcgcttctacgccgcgcagcaacgcgcgtggtgggcgatcggcggcgcctgcctgctggtcgccgcgctgctcggctggctgttgtcgcgcaccttgctgcggcgcctgcgtggcctgacccaggccacccacctgctcgctgcgggcgactacgccacccgcatcgacgccgcggcgcgcgacgaactgggccagctggcgcgcgatttcaacctgctggcgcaagcgctggagcacaacgaacgcgcgcgacgcgacttcatggccgacatctcgcacgagctgcgcacgccgctggcggtcctgcgcgccgaactggaagcgctgcaggacggcatccggccgatgacacccaactcgctggggtcgctgcaccagcaggtcggccagctgggcaagctgatcgaagacctgtacgacgtgtcgctgaccgatgtcggtgcgctggcgtatcggcgcgctcccgtcgatctggcggtcatcctggcgaccgtgctggacggcttgcgcgcgcgctttgccgccgcgcagctgcaggtgcaggcgcagatcgatgccggcccgctgcaggtggacggcgacgaacgccgtctgcagcaactgctgggcaacctgctggaaaacacgctgcgctacaccgacgccggtggcacggtgcaggtgcgctgcgtgcgccgcggcgcggtgctggagatggtggtcgaagacagcgcgccaggcgtggatgcggacaagcgcgcgcggctgttcgaacgcttctaccgcaccgaggcctcgcgcaatcgtgccagcggcggcagcggcctgggcctggcgatctgccgcaacatcgccgaggcacatggcggctcgatccacgccgaggcttcggcactgggcgggctgcgcatggtgctgcgcctgccggcgctggtcgcatga

SEQ ID NO: 77241 - protein, 459 aa, Xanthomonas axonopodis pv. citri str. 306
MKLGITAKLFLAILAACVAVLLINGIAVQAFVKRQFLDYLNEQGVERMQETLPRVRAEYARHGNWEFVRDNPDAWFVLMRPERGPGPPREAPPISDQTGAVFRFALLDQDYTPVIGNPEVGRHDILRPVVVGGRTVGWMAMLPFQKALAAADARFYAAQQRAWWAIGGACLLVAALLGWLLSRTLLRRLRGLTQATHLLAAGDYATRIDAAARDELGQLARDFNLLAQALEHNERARRDFMADISHELRTPLAVLRAELEALQDGIRPMTPNSLGSLHQQVGQLGKLIEDLYDVSLTDVGALAYRRAPVDLAVILATVLDGLRARFAAAQLQVQAQIDAGPLQVDGDERRLQQLLGNLLENTLRYTDAGGTVQVRCVRRGAVLEMVVEDSAPGVDADKRARLFERFYRTEASRNRASGGSGLGLAICRNIAEAHGGSIHAEASALGGLRMVLRLPALVA

SEQ ID NO: 77242 - DNA, 1698 bp, Bifidobacterium longum NCC2705
  CDS (1)..(1698): transl_table=11
atgaacctgcgccctcgattcagcctcaaacgcttgctgcgccacggacgcgctgaagttcgtcgctcgctgcaggcccgcaccgtggccctcaccgtgattcttacgctggccgtggccatcgtcttctctggcgtatcgatggtatcagtgcgcgcctcgctgcttacccaaatcacttcgcagtcgcgtgccgactattcaaacatggtgcagcaggcccaaaccagtctggacgcggccgatgtctccaccgcagtgcagatccaacagctggtcaatgacttggcgtcctcgttgcaatccgaggggtcctccaacctgataggtgtgtatttgtggagtcgtgataccaactcgcgtgccatcatccccgtatccaccgaacccagctatcaaagtctgatttctgacgacatccgttcatccgtggcttccgacttggatgacagcgtgttctatcagccggtcgaaattcccggtgattccggcatgccgggcagcgggacgcccgcagcggtgctcggcaccgtattggactttggcgtggccggcaacctcgaattcttcgccatttattcgtacacgttccagcagcagtccttgacgcagattcagctcagtctggtggtcatctgtgcgttgctgtccatcgtggtgggcgtagtaatctggctggtgattcgtggcatcgtgcgcccgattgaacgagtggcagcggcctcggaaacactggcctccggcaatctcgatatgcgcgttaccgtggatcgtaaggatgagcttggtgtgctgcagcaatccttcaatacgatggctgatgcgctcaaccagaagatcgatgagctggaggaagcaagcgttttccagaaacgatttgtgtccgacgtcagtcatgaattgcgtaccccggtgaccaccatgcgtatggcttccgacctgctcgaaatgaaaaaagacggcttcgacccctccaccaagcgtacggtcgaactgttggccggccagatcagtcgattccaagacatgctcgccgatctgttggaaatctcccgctacgatgccggttatgcggcactcgaccttgtggaaaccgatttatgcgaaccaattgaaacggcagtggaccaagttgacggcatcgcccaagccaaacgggtgccgattcacacgtatctgcccaatgtgcaggttttgactcgtatcgattcgcgtcgagtgattcgcatcgtcagaaatctgttggccaatgccgtcgatttcgctgaggaccggccgatcgaagtgcgcgtcgcggccaaccgcaaagccgtggccatcagcgttcgcgactatggcgttggtatcgacgaagacaaagtcgctcatgtattcgatcgattctggagaggcgacctttcacgttcacgcgttaccggcggcaccggattgggcctgtccatcgccatgactgatgccttgctgcaccacggtagtatccgtgtacgttcggcagtgggggagggcacctggttcttggtattgctgccgcgtgaccccgaccaaggtgaggtggcggacgctgaactgccggtgaattttgcttctgaaacgccggatgacctgcgtgttaccggtgggtttggtgtggccaccagccaagtcacacatgattatcatgaggttcgccgcgacacgatgatggggaggccactatga

SEQ ID NO: 77243 - protein, 565 aa, Bifidobacterium longum NCC2705
MNLRPRFSLKRLLRHGRAEVRRSLQARTVALTVILTLAVAIVFSGVSMVSVRASLLTQITSQSRADYSNMVQQAQTSLDAADVSTAVQIQQLVNDLASSLQSEGSSNLIGVYLWSRDTNSRAIIPVSTEPSYQSLISDDIRSSVASDLDDSVFYQPVEIPGDSGMPGSGTPAAVLGTVLDFGVAGNLEFFAIYSYTFQQQSLTQIQLSLVVICALLSIVVGVVIWLVIRGIVRPIERVAAASETLASGNLDMRVTVDRKDELGVLQQSFNTMADALNQKIDELEEASVFQKRFVSDVSHELRTPVTTMRMASDLLEMKKDGFDPSTKRTVELLAGQISRFQDMLADLLEISRYDAGYAALDLVETDLCEPIETAVDQVDGIAQAKRVPIHTYLPNVQVLTRIDSRRVIRIVRNLLANAVDFAEDRPIEVRVAANRKAVAISVRDYGVGIDEDKVAHVFDRFWRGDLSRSRVTGGTGLGLSIAMTDALLHHGSIRVRSAVGEGTWFLVLLPRDPDQGEVADAELPVNFASETPDDLRVTGGFGVATSQVTHDYHEVRRDTMMGRPL

SEQ ID NO: 77244 - DNA, 1446 bp, Streptomyces coelicolor A3(2)
  CDS (1)..(1446)
atgagcacccgactgctcccgctgctcatcgtcctgatggcggccgtcctgctcgcgctcggggtgccgctcggcgtcagcgtcgcccgcgcggagcagcagaaggtcgtcatcgaccgcatcgacgacacggcacgcttcgcctcgctcgcccagttcgtcacggaggacggctcgggcggctcacgccggacggacacggacgagcgcctggagaccctgcagaccgagctgaccagctactacgaggtctacggcatcaaggcgggcgtcttctaccgcaaccacatcccgatggccaacgcgcccacgacgtggttcctgccccaggccggcgaggtccgcgactccttcgacgaggcgctgctcagccgccgcagccacgaccccgcgcaggtgtggccctggcaggacggcacgctcgtggtggcctcgccggtcatccgggacggggacgtggtcgcggtcgtggtcaccgagtcgccgaccgactcgatgcgttcgagcaccctgcgcggctggctcgtcatcggcgccggggaggtcgccgcgatgctgctcgccgtcggtgcggcgctgcggctgaccggctgggtgctcaggccggtacgggtactcgacgccaccacccacgacatcgccaccgggaggctgaagtcccgggtcgcgccgtccggggggccgccggagctgagacgtctggcccggtcgttcaacgagatggccgaccacgtggaggacgttctggagcagcagcgggccttcgtcgccgacgcctcccaccagctgcgcaacccgctcgccgccctcctgctgcgcatcgagctgctcgccctcgaactgcccgagggcaacgaggagatcgcctccgtccagaccgagggcaaacgcctggcccgggtcctggacgacctgctcgacctggcgctggccgagcacagccaggccgatctgaaggtcaccgacgtcggtgcgctggccgccgagcgggtggccgcctggtcaccgacggccgacgtcaagggcgtacggctggtcggcgactgcccgccgaccacgggctgggccgacccggttgccctgtcgagcgccctggacgcggtcatcgacaacgcggtgaagttcacgccgcacggcgagagcgtccgggtcgaggtcgcctccaccggggacgccgccaccgtcgtcgtcaccgacaacggtcccggactcaccgacgaggagctcacgcgcgtgggcgaccgtttctggcgcagcggccggcaccagaacatcaacggctccggcctcggcctgtccatctgccgggcgctgctcgcggcgggcaacggctcgatctccttcggccaccacgagccgcacggacttcgggtcacggtcacggtgcccaggaccggcacggtgcccaaggagcccgagcgggtctacggcttgaccgaccggtag

SEQ ID NO: 77245 - protein, 481 aa, Streptomyces coelicolor A3(2)
MSTRLLPLLIVLMAAVLLALGVPLGVSVARAEQQKVVIDRIDDTARFASLAQFVTEDGSGGSRRTDTDERLETLQTELTSYYEVYGIKAGVFYRNHIPMANAPTTWFLPQAGEVRDSFDEALLSRRSHDPAQVWPWQDGTLVVASPVIRDGDVVAVVVTESPTDSMRSSTLRGWLVIGAGEVAAMLLAVGAALRLTGWVLRPVRVLDATTHDIATGRLKSRVAPSGGPPELRRLARSFNEMADHVEDVLEQQRAFVADASHQLRNPLAALLLRIELLALELPEGNEEIASVQTEGKRLARVLDDLLDLALAEHSQADLKVTDVGALAAERVAAWSPTADVKGVRLVGDCPPTTGWADPVALSSALDAVIDNAVKFTPHGESVRVEVASTGDAATVVVTDNGPGLTDEELTRVGDRFWRSGRHQNINGSGLGLSICRALLAAGNGSISFGHHEPHGLRVTVTVPRTGTVPKEPERVYGLTDR

SEQ ID NO: 77246 - DNA, 1476 bp, Corynebacterium efficiens YS-314
  CDS (1)..(1476): transl_table=11
atgagcagactcaagctcctcaacaattcgccagcatcacttcgctggcgaattgttttctggatgaccgcggtcgtggtcaccacgctgaccagcgtcgtggtgatcacgcgttctgtgttgctctctgatgtggtcgctgcggccaacgcagctgttgaacaggagatcagcgagttccgccgttttgccgatgagggtacggatcccaccacagccgcccccttccactccccccagcgattgattgaggtgtatctctcccggcagatcccggatgacaatgaagccatcgtgggtatcttctccgatcaactgatccaggtggatttctcccagctcagtgggccacacccggaaccgctgacctataacgaacccctcgtcgatgaagtcctcgcatccccatcccattccggggtgtttgatgatccggttcgggggagggcctattgggggcgggtggcctttgaaacagctcccggtaccacggatgggcatttcatcgtcgcctatttcacggaaccaggtgaagcagccgtcaagcagcaggtcagggtcctgtcgttcgtaggtgccggaggcgtgttggcttccgtcttgattgcctgggtgatcgcagggcagatcatcgcccccatcaggcgggtcagcaaggtcgcttcaacgatttccaattctgacctgacccggcgcgttccggtggagggtaacgatgagattgcacagttggcccgtaccttcaatgagatgctggatcgtttggagacggcgtacaacgatcagcgtcagtttgtggatgatgcaggtcatgaactgcggacaccgatcacggtcgtgcgtggtcaattggagttgctggagagttcgccaccggaggagcgcacacggtcaattgagttggccaccacggaattggatcggatggcacggatggttaatgatctgttgaccctggcggtggcggattcaggtgaatttctccacacagcaccggtggatgttacggagttgaccattgatcttgaggataaggcacgcaccatcaatggtcgggtgatgttggtcgatgctgccgaaggtgtggtgatcctggatgagcagcgggtcacagaggcgattcttgagctctatggcaatgcgctgcgctattcggagggaccggtggctctcggttctgatttccaggggtcgggagctcagcgggtattccggatctgggtgcgggacagtggtccgggtattgagcaggatgcacaggaggcacttttcagtaggttctcccgtggccggcaggctgatccccggcatccgaaccggccgaagggtgcgggtctgggtttgtccattgtgaaagccattggcgaggcccatggtgggcgtgcctatgttgagtccacggttggcctggggtcgatcttcggcctggagatccccgccccggacacagcacttgtaacagagacggaggagtag

SEQ ID NO: 77247 - protein, 491 aa, Corynebacterium efficiens YS-314
MSRLKLLNNSPASLRWRIVFWMTAVVVTTLTSVVVITRSVLLSDVVAAANAAVEQEISEFRRFADEGTDPTTAAPFHSPQRLIEVYLSRQIPDDNEAIVGIFSDQLIQVDFSQLSGPHPEPLTYNEPLVDEVLASPSHSGVFDDPVRGRAYWGRVAFETAPGTTDGHFIVAYFTEPGEAAVKQQVRVLSFVGAGGVLASVLIAWVIAGQIIAPIRRVSKVASTISNSDLTRRVPVEGNDEIAQLARTFNEMLDRLETAYNDQRQFVDDAGHELRTPITVVRGQLELLESSPPEERTRSIELATTELDRMARMVNDLLTLAVADSGEFLHTAPVDVTELTIDLEDKARTINGRVMLVDAAEGVVILDEQRVTEAILELYGNALRYSEGPVALGSDFQGSGAQRVFRIWVRDSGPGIEQDAQEALFSRFSRGRQADPRHPNRPKGAGLGLSIVKAIGEAHGGRAYVESTVGLGSIFGLEIPAPDTALVTETEE

SEQ ID NO: 77248 - DNA, 1197 bp, Corynebacterium efficiens YS-314
  CDS (1)..(1197): transl_table=11
atgactcacaggcctggactgatgttccgttttctggctgcccaggtactggtcgtggcgatcagtttgagtgtggcagtggcagtggcatccctggtgggccctcccctgtttcacgagcacctggtcatggctggtctggaggatccgtccctggagcagttccacgctgaacaggcctaccggtatgccaacctgatcacgctggccgtcgctctgcccaccgcactgatctgtgcggtgctgaccagtctggtgttgtctcgtcgactgcgggcacccctgcgggatcttacctgtgcagctgcgggcatggcgaatgggaattaccatgtcagggtgcctgtggggcaggccggacctgaggtagacacgttggcgcgggccttcaacacgatggccaccaggttggagcagaccgaacaggtgcgacgccagatgctgtcggatctcgcacatgagatgggcacaccattatcggtactcgcggtctacctcgacgggctccaggacggggtgatcgactggaataccgccacgcagaaggtcatcagtgaccagttgagccgattgacccggttgaccgaggacatggatgaggtctcccgggtccaggagcaccgcattgctctcgagctggcggaagagaacctggcagaggtgctctccacctcactgaacgcagtccgggaggcatatcaggccaagtctgtggatctgcagctgattcccgttccgccacggaccacggtggttctcgatcagcaaaggttcggccaggtgatgggcaacctgctctccaacgcacttcgtcatacccccgctggtggccgggtgaccgtccgaaccagccagcagggacaggattttgtcgccatcgaggtcgctgacaccggtgagggcatggcagaaggccagattgagcatattttcgaacgtttctaccgcggggacaccgctcgcagccgggataacggggggtcaggtatcggcttgaccatctcccgggctctgatcgaagcccatgggggaaccctgggtgctacctcacccggcctcggggcgggatctgtctttaccatccgtcttccgctttatccagatggtatgtcgacgaacccctccaggggtgttgcgccggggcatgtgcacccgcctccccagccccttccccatataccccatgggggtatatga

SEQ ID NO: 77249 - protein, 398 aa, Corynebacterium efficiens YS-314
MTHRPGLMFRFLAAQVLVVAISLSVAVAVASLVGPPLFHEHLVMAGLEDPSLEQFHAEQAYRYANLITLAVALPTALICAVLTSLVLSRRLRAPLRDLTCAAAGMANGNYHVRVPVGQAGPEVDTLARAFNTMATRLEQTEQVRRQMLSDLAHEMGTPLSVLAVYLDGLQDGVIDWNTATQKVISDQLSRLTRLTEDMDEVSRVQEHRIALELAEENLAEVLSTSLNAVREAYQAKSVDLQLIPVPPRTTVVLDQQRFGQVMGNLLSNALRHTPAGGRVTVRTSQQGQDFVAIEVADTGEGMAEGQIEHIFERFYRGDTARSRDNGGSGIGLTISRALIEAHGGTLGATSPGLGAGSVFTIRLPLYPDGMSTNPSRGVAPGHVHPPPQPLPHIPHGGI

SEQ ID NO: 77250 - DNA, 1437 bp, Clostridium tetani E88
  CDS (1)..(1437): transl_table=11
atgaatataaaaaagcgacttataatatctaatactataactgttatagtgccaataattataacaaccataattatgtcttgtgtattgtttgtttttgcaaaaattggtggaaataaattagaacatgatgaatttgaaaaaagaatgattatatcatctgaacttactcaaattagtgacgacatattaaaacaagataataaaaatattgaagaagataaatttcaaaaggatttatcacaaaaactttcaagtataaatggtaaatttgttattgttaaatctcacaaaatcatagctaagcctgaagatattaataaaatagatatagaaaaatgtattaatatatccaaaggaataataatagataaaaggattattcttaataatacttcatatataattaaaactgtggagttaaattttaaggataaatccaatggtattataatattattagcacctatagaaggagaaaaaataaatttacttattaattttataatgattgccattgttattttcataatatcttttataataactaatgtaattatgtcttatattctttcaaaaaagataattaaacccattaaatctttaaagaaggctacaaatgaaattagcaatggaaatttagattgtagtattgccgaagaaggagatacggaaataagggaattatgccgtggatttgagtctatgagggtacaacttaaagattctataattatgaaaatgaaatatgatgacaatcgtaaaggacttatatcaagtatttctcatgatttaagaacgccaataacatcaataaagggctatgtggaaggaattttagacggagttgccaatactcctcaaaaaagagaaagctatttaagaactatttattctaaagcagaacatgtagatcttatgattgatgatttacttttatattcaaagcttgacttaaatcaaataccttttaactttgaaaaggtggatattgttgaatattttaactactgtatatatgaaagtgagccggagcttaaaaaggataatataaaaatatggttaaataatgagctaaaaacaactaattttgttatgatggatagagaaaggctaaaaagggttatattaaatattataggaaattcccaaaaatatatgaataaagaacaaggtgaaatagttgtaaacttaagggagacaacctcaaacattatcattgaaataagagataatggtgctggaattgataataatgatgcaaataaaatatttgatagattctatagaactgacaaggcaagaagtggagcaaaaggtagtggactaggactttccattgccaaacaaattgtagaaggacataatggacggatatgggcaattagccatggtaacaaagggacaagcattatgatatccttgtgtaaaatttaa

SEQ ID NO: 77251 - protein, 478 aa, Clostridium tetani E88
MNIKKRLIISNTITVIVPIIITTIIMSCVLFVFAKIGGNKLEHDEFEKRMIISSELTQISDDILKQDNKNIEEDKFQKDLSQKLSSINGKFVIVKSHKIIAKPEDINKIDIEKCINISKGIIIDKRIILNNTSYIIKTVELNFKDKSNGIIILLAPIEGEKINLLINFIMIAIVIFIISFIITNVIMSYILSKKIIKPIKSLKKATNEISNGNLDCSIAEEGDTEIRELCRGFESMRVQLKDSIIMKMKYDDNRKGLISSISHDLRTPITSIKGYVEGILDGVANTPQKRESYLRTIYSKAEHVDLMIDDLLLYSKLDLNQIPFNFEKVDIVEYFNYCIYESEPELKKDNIKIWLNNELKTTNFVMMDRERLKRVILNIIGNSQKYMNKEQGEIVVNLRETTSNIIIEIRDNGAGIDNNDANKIFDRFYRTDKARSGAKGSGLGLSIAKQIVEGHNGRIWAISHGNKGTSIMISLCKI

SEQ ID NO: 77252 - DNA, 1524 bp, Lactobacillus plantarum WCFS1
  CDS (1)..(1524): transl_table=11
atgaaactgatttatcaacaaatgctagcgttctttgccgtcattattacggtaatcgtcgtcctcggattttcatttattcgaacgactagaacgatgctttatcaaaactcatggcaacaattgcagcagtacgccgcgagtattgaaaaggaagctattcggtataatacgaagactaatcaagttgtcgggtttaatcaacaatttctaaatgatgggaccgtcatcttacgagatcaacatattcacttttcggtatatgatgctaacaaaaagttggtctatccaagtggtatggggacaacaatgagtgggacccctggtggctcgatttatgatcccaagatctcagccaaagattggaagaagctgaagcggaataagattattacgcagtcgccccacgtaacgttcagaacacgcaatcgtgatcaacccgtgaatacaccgtcgttgcgaaccattgacgttttagtgccccttttctataagaatggagcaacgaagaagtttgttggggccatctcgattgggtcgtttgaacagaccttgcaggccaatgaacagcagatcgaaaaaaatctgttcattgcactgttagtctcggggattgcggctctgttgttaagttacattttggcacgttattccgttcgtcgtattaatcgattgcggtacgcgacgcactcggtcgcaaatggtgattttgacattcaagttgacagtaatcataaggatgagattgatgacttggcggatgatttcaacggcatggtcaactccctgcgaacttccaatgaagaaattaagcgacaggaaaagcggcgtcgggagtttatggccgatgcggcccacgaaatgcgaacgccgttgactacgatcaatggtattttggaagggttagcgtacgatgctattccagaagaagacaagggtcattcaattgaactgatgcaaaatgagacgaaacggttgattcgactagtcaatgagaacttggattacgaaaaaattcgaaccggacagattgctttgaacaagaccaattttgatggcgccgaggttttgcataacttagttgaacagctcacaaagaaagcggccgccgcggatgatgaattcaagctgacggttcccgagaaactgccagtatgggccgattatgatcgctttgttcaggtcttgtttaacatcatgcagaatgccattcagttttcacaagctaacgtgatcgaagtaacgggtagccgtacggatcatgcgacggttgtcgcgattcaagaccatgggattgggatgacaccggaccaagtcaaaaatatttgggaacggtattataaggctgacccatcacgaaagaatacgaagtatggtgaatcaggtttagggctagcgatttcacatcaattagtccaacaacatggtggttcgatcaaggttgacagtgtggagaacgaagggacgtgctttaccgttactttcccagatgaaggttttgataaaccgattattgatgattaa

SEQ ID NO: 77253 - protein, 507 aa, Lactobacillus plantarum WCFS1
MKLIYQQMLAFFAVIITVIVVLGFSFIRTTRTMLYQNSWQQLQQYAASIEKEAIRYNTKTNQVVGFNQQFLNDGTVILRDQHIHFSVYDANKKLVYPSGMGTTMSGTPGGSIYDPKISAKDWKKLKRNKIITQSPHVTFRTRNRDQPVNTPSLRTIDVLVPLFYKNGATKKFVGAISIGSFEQTLQANEQQIEKNLFIALLVSGIAALLLSYILARYSVRRINRLRYATHSVANGDFDIQVDSNHKDEIDDLADDFNGMVNSLRTSNEEIKRQEKRRREFMADAAHEMRTPLTTINGILEGLAYDAIPEEDKGHSIELMQNETKRLIRLVNENLDYEKIRTGQIALNKTNFDGAEVLHNLVEQLTKKAAAADDEFKLTVPEKLPVWADYDRFVQVLFNIMQNAIQFSQANVIEVTGSRTDHATVVAIQDHGIGMTPDQVKNIWERYYKADPSRKNTKYGESGLGLAISHQLVQQHGGSIKVDSVENEGTCFTVTFPDEGFDKPIIDD

SEQ ID NO: 77254 - DNA, 1455 bp, Tropheryma whipplei str. Twist
  CDS (1)..(1455): transl_table=11
gtgtcagcaaagtttcccagtaagctgtacagactcgttgcacgctcttcgataaagagtaaggtggtaacgcttgtagcgcttgtgcttgcattttcgttcactgctgtgggtattggaaccactctggttataaagaacgagatgataaaaacaattgatgagcagctaattcatataagcggtacatttccgctgtttgaaagcagttttgaagtgttcagtccgggaagggcaagctacaaagctcatatttataaattcgacgggacactgatttggcctatcggagaaaacccttctatcgagtttgacaggaaaattgacattacactttacaacgaaaagggtaacacgccgtttactttgcactcgatatcgagacaaaagaaatatagaatgctcttgcagccactggaaacgggcagtgggcaagaaatccttgcttattacctgccgcagtctggtactgaaaataccgccaatttttatcaaagaagctatatttggtttagtcttgcggtatttgcaatcgctgcgtacatagtttatctaataaccgcacatacactatctccactatatgctcttgagaagaccgcaagggcgtttgcaagaggggattattcaaggcggataaggtctgaatatgtttctgcagaaatactcaatctaaacaaatctctgaattccatgctggacagtctcgaaaaagcccttggtgagcgagataaaacacttggcgagatgaagcaattcttggcagatgcaagtcacgaattgcgaacgccacttgtatctcttaggggttatgccgagctctataggattggcgcccttaagggtaaggaggatattgacaacgcgattgagcggattgaaaaagaggcaatacgaatgggcacaatggttgaagacttgctgtctctgacgcgccttgaaaaggctacagaccttgtgcctgtcgatgtgaaatatcttgtccaagagtcagttattgacatgaatgtcctggaaaaaactcgtaagatcacaaccggtattccgaaaaggcaatcctgtatgattctcgggaacgaaaatatgcttcggcggttacttgcaaatctgattaacaatgccctgcactataccccgccaggctctccaatagagattgtgttacgcactgataaaacagatgttgtgattgatgtgcgcgaccatggtccgggcgtgccaagacagctacacgataaagtgttcaagcggttttggcgatctgacgcatcgcgggcacggaacagcggtggtgtggggcttgggctttctattgtggcatctattgtaaaagtccataaaggcacaatagagatattgcgcacacgaggtggtggcgctacatttagaaccaggattcccaagcttgttaataaacaccgttctggatcctctagtcatagtctcacacggtga

SEQ ID NO: 77255 - protein, 484 aa, Tropheryma whipplei str. Twist
MSAKFPSKLYRLVARSSIKSKVVTLVALVLAFSFTAVGIGTTLVIKNEMIKTIDEQLIHISGTFPLFESSFEVFSPGRASYKAHIYKFDGTLIWPIGENPSIEFDRKIDITLYNEKGNTPFTLHSISRQKKYRMLLQPLETGSGQEILAYYLPQSGTENTANFYQRSYIWFSLAVFAIAAYIVYLITAHTLSPLYALEKTARAFARGDYSRRIRSEYVSAEILNLNKSLNSMLDSLEKALGERDKTLGEMKQFLADASHELRTPLVSLRGYAELYRIGALKGKEDIDNAIERIEKEAIRMGTMVEDLLSLTRLEKATDLVPVDVKYLVQESVIDMNVLEKTRKITTGIPKRQSCMILGNENMLRRLLANLINNALHYTPPGSPIEIVLRTDKTDVVIDVRDHGPGVPRQLHDKVFKRFWRSDASRARNSGGVGLGLSIVASIVKVHKGTIEILRTRGGGATFRTRIPKLVNKHRSGSSSHSLTR

SEQ ID NO: 77256 - DNA, 1404 bp, Salmonella enterica subsp. enterica serovar Typhi Ty2
  CDS (1)..(1404): transl_table=11
atgaaagtctggcggcccggaatcaccggcaagctgtttctggcgattttcgccacctgcatcgtgctgctgatcagtatgcattgggccgtgcgcgtcagttttgaacgcggatttattgactatatcaaacacggcaacgagcagcggctacaaatgctgggcgatgcgctgggcgaccagtaccagcaacacggcaactggcgttttttacgtaacaatgatcgcttcgttttccagattctgcgttcatttgagcatgacaacgaccgggataaacccggccccggtatgccgccgcacggttggcgcacccagttctgggtcgtcgatcaaaatggccgggtgctggtcggcccacgcggtccggtgccgcatgacggtactcgccgccccattctggttaatggcgtcgaagtaggcgcgattatcgcctctcctgtcgagcggctgacgcgcaatacggatattaattttgatatgcagcagcggcgtgccagttggatgatcgtggcgttatcaaccttgctggccgcgctggcgacgtttttgctggcgcgtggcctgctcgccccggtcaaacggttggtcgagggtacgcacaggctggcggcgggggattttaccacgcgcgtgaccccaaccagcgccgatgagctgggaaaactggcgcaagactttaaccagcttgccagcacgctggaaaaaaatcagcagatgcgccgcgactttatggcggatatttcccacgaactgcgcacgccgctggcggtattgcgcggcgaactggaagccattcaggatggcgttcgccagttcacgccagaatcggttacctcgctacaggcggaagtcggtacgcttaccaaactggttgacgacctgcatcagctgtcgttgtctgacgagggcgcgctggcttaccaaaaaacgaccgtcgatcttgttccccagttggaagtcgctggcggcgcgtttagagaacgctttaccagccgggggctaacgctacattacgcgttgccggatagtatgaccgtcttcggcgacccggatcgcctgatgcaactgtttaataatctactggaaaacagtctgcgctacaccgacagcggcggcggcctgcatatttccgccgaacaacgcgacaaatcattattcctgacctttgccgattctgcaccgggcgtcagcgatgagcagttacaaaagctttttgaccgtttttaccgcacggaagtgtcccgtaaccgcgccagcggcggttctggactggggctggcgatatgcgtcaatattgtacacgcgcataacggtcatcttcacgccgctcattcgccttttggcggggttagcattacagtagagttaccgctggatcgcgatttacagagagaagtatga

SEQ ID NO: 77257 - protein, 467 aa, Salmonella enterica subsp. enterica serovar Typhi Ty2
MKVWRPGITGKLFLAIFATCIVLLISMHWAVRVSFERGFIDYIKHGNEQRLQMLGDALGDQYQQHGNWRFLRNNDRFVFQILRSFEHDNDRDKPGPGMPPHGWRTQFWVVDQNGRVLVGPRGPVPHDGTRRPILVNGVEVGAIIASPVERLTRNTDINFDMQQRRASWMIVALSTLLAALATFLLARGLLAPVKRLVEGTHRLAAGDFTTRVTPTSADELGKLAQDFNQLASTLEKNQQMRRDFMADISHELRTPLAVLRGELEAIQDGVRQFTPESVTSLQAEVGTLTKLVDDLHQLSLSDEGALAYQKTTVDLVPQLEVAGGAFRERFTSRGLTLHYALPDSMTVFGDPDRLMQLFNNLLENSLRYTDSGGGLHISAEQRDKSLFLTFADSAPGVSDEQLQKLFDRFYRTEVSRNRASGGSGLGLAICVNIVHAHNGHLHAAHSPFGGVSITVELPLDRDLQREV

SEQ ID NO: 77258 - DNA, 1437 bp, Streptomyces avermitilis MA-4680
  CDS (1)..(1437)
atgaccgggcggctgcggcggacgtaccgcaggctgcgcctgggcacccggctggcgctgggccttggcgtgctgtccctcgtcgtgttcgccgtcgtcggcacggcgctgaccacgtacatgcgcgactatctggaagcccagctgggcgaccagatgaagctcgtccaggtcctgcagtcgaaggacgcccaagtgcacggcgtcgtgcagcgccagccgtactacggctggtacaccgcggtgtacgacgtctcgggcgactcggccgtgctgcgcaggccggccgacgtaccggccgacacccgggcgctcaccgctctcgccgagacgatggcgcactcggacacggaccttcggcgcaccgtgcggatcgacggcaagggcacctaccggctacaggcgtgcgaggtggaacccggtgtggtcctcgtcagtgccgcgcccatggcggacgtccaggcgaccgtgcggcagctgatcacggtccaggtggtcgcgttcgtcctcgcgctgctggccctggtggtgttcggccgggcgatgctgcggcgcggtctgaaaccgctgagcgacatggcgcacaccgcccacggcatcgcctcgcacaatctgaccgggtcggcggcgcggctgccgctgcgcgacgacggccgcagcggcggtccggaggtcgaggagctgcgcaccgcgttcaacaccatgctggagcacatcgacggttcgctcgccgtccgcgcggaggccgaacagcggctgcgccgcttcgtcgcggacgcctcgcacgagctgcgtacgcccctgatgtcggtacggggttacgcggacctgttccagtacgcggccgccaacgcgcccggggaacgggacaggcatctggcgcggctgcgtgccgaggccgccaggatggggctgctcctggacgacctgctgctgctcgcccgcctggacgccgcggaggtggagacaccgctgcggatggaggacgccgacctggtggagctggtgcgccaggcggcggacgccttccgcgcgggccacccggaccgtccgctgacggtgacgaccggtcccgacgccgtaccgctgcggctcgaccccctgcgcatccggcaggtgctggacaacctgctcaccaacgccgccgtgcacacccccgccggaacggaggtgtccgtggaggtctcggtctcgtccggcacggcgtgggtgggggtcgccgactcgggcccgggcgttccggcggccgaccgggagcgggtcttcgaccgcttctaccgggtggacaaggcccgcagccgcgaccgcgggggcagcggcctgggcctggcggtcgcccgctccctggtgcgggcgcacggcggcaccgtcgcactgaccggcgaaccgggggcgacggtcttcaccctcgggatcccgctgggccgcagggactag

SEQ ID NO: 77259 - protein, 478 aa, Streptomyces avermitilis MA-4680
MTGRLRRTYRRLRLGTRLALGLGVLSLVVFAVVGTALTTYMRDYLEAQLGDQMKLVQVLQSKDAQVHGVVQRQPYYGWYTAVYDVSGDSAVLRRPADVPADTRALTALAETMAHSDTDLRRTVRIDGKGTYRLQACEVEPGVVLVSAAPMADVQATVRQLITVQVVAFVLALLALVVFGRAMLRRGLKPLSDMAHTAHGIASHNLTGSAARLPLRDDGRSGGPEVEELRTAFNTMLEHIDGSLAVRAEAEQRLRRFVADASHELRTPLMSVRGYADLFQYAAANAPGERDRHLARLRAEAARMGLLLDDLLLLARLDAAEVETPLRMEDADLVELVRQAADAFRAGHPDRPLTVTTGPDAVPLRLDPLRIRQVLDNLLTNAAVHTPAGTEVSVEVSVSSGTAWVGVADSGPGVPAADRERVFDRFYRVDKARSRDRGGSGLGLAVARSLVRAHGGTVALTGEPGATVFTLGIPLGRRD

SEQ ID NO: 77260 - DNA, 1407 bp, Streptomyces avermitilis MA-4680
  CDS (1)..(1407)
atgcgcacacgtctcctcccgctgctcatcgtcctgatggcggccgtgctgctcgcgctcggcttcccgctggccgtgagcatcgcggcggcgcagcagcagcgggtcgtcgtcgaccgcatagacgacacggcgcggttcgcggccctcgcgcagttcgtcaccgaccggcccaccggctcccgggtggccgtcacggacgaacgcggcgagacgctgagcaaggaactcgccatgtaccacgacgtgtacggcatccaggccggcgtcttctacctggacgacgcgcccatggcccacgcgccccagaactggtacctgcccgaacggggcgaggggcgcgacgcgttcgacgaggcccggctgggccgccgcagccacgaccccgagcaggtctggccctgggagcacaagcggctcgtcgtcgcctccccggtcatcagggacggcgacgtcatcgccgtcgtcgtcaccgactcgcccaccgggcagatgcgttccaagacccagcacggctggctgctcatcggggcgggcgagatcgccgcgatgctgctggccgtcggcgccgcactgcgcctgacgggctgggtgctgcgccccgtacgcgtcctcgacgccaccacccacgacatcgccaccggacgcctcaagtcccgggtggcggccgccggcggaccgccggaactgcggcgcctggcccggtcgttcaacgagatggcggacaacgtcgaggacgtcctggagcagcagcgcgccttcgtcgccgacgcctcccaccaactgcgcaacccgctgtcggcgctgctgctgcgcatcgaactgctcgccctcgaactgcccgagggcaacgaggagatcgcctcggtgcagaccgagggcaagcgcctcgcccaggtcctcgacgacctgctcgacctggcgctcgccgagcacgccgaggcggacctgcggctcaccgacatcggcgagctgacggccgagcgcgtcgccgcctgggggccggtcgccgccgccaacggcgtacgactggccgggacctgcccggccaccacggcctgggccgaccccatcactctctccagcgccctcgacgcggtcatcgacaacgcgctgaagttcacgcccgagggagagagcgtggaggtcgaggtgacgtccaacggcgcggtgtcgtcggtcgtcgtcacggacggcggcccgggcctcggcgacgaggaactcgcgcgcgtcggcgaccgcttctggcgcagcgcgggccaccagaacatcaagggctcgggcctcggcctgtccatctcgcgggcactgctcgcggcgggcggcgggacgatctcgtacgcgcaccacgagccgcacggactgaaggtgacggtgacggtgccgaggacggtgccgacggcctga

SEQ ID NO: 77261 - protein, 468 aa, Streptomyces avermitilis MA-4680
MRTRLLPLLIVLMAAVLLALGFPLAVSIAAAQQQRVVVDRIDDTARFAALAQFVTDRPTGSRVAVTDERGETLSKELAMYHDVYGIQAGVFYLDDAPMAHAPQNWYLPERGEGRDAFDEARLGRRSHDPEQVWPWEHKRLVVASPVIRDGDVIAVVVTDSPTGQMRSKTQHGWLLIGAGEIAAMLLAVGAALRLTGWVLRPVRVLDATTHDIATGRLKSRVAAAGGPPELRRLARSFNEMADNVEDVLEQQRAFVADASHQLRNPLSALLLRIELLALELPEGNEEIASVQTEGKRLAQVLDDLLDLALAEHAEADLRLTDIGELTAERVAAWGPVAAANGVRLAGTCPATTAWADPITLSSALDAVIDNALKFTPEGESVEVEVTSNGAVSSVVVTDGGPGLGDEELARVGDRFWRSAGHQNIKGSGLGLSISRALLAAGGGTISYAHHEPHGLKVTVTVPRTVPTA

SEQ ID NO: 77262 - DNA, 1107 bp, Streptomyces avermitilis MA-4680
  CDS (1)..(1107)
atgagcgacgggccggccgcacggaggggccccggggatccctggggcggagtacgcccgttctcgatcaagaccaagctgggcgcgctggtcgtcatctcggtgctgatcaccacaggcctgtcgatgatcgcggtgcacaccaagacggagctccgcttcatcacggtcttctcgatgatcgccacactgttgataacgcagttcgtggcgcattcgctcaccgcgccgctggacgacatgaacacggtggcccggtccatctcgcgcggtgactacacgcggcgggtgcgcgagaaccgctgggacgagctgggtgacctggcccacacgatcaacctcatggccgacgagctggaggcccaggaccgccagcgcaaggaactcgtggcaaatgtctcccacgagctgcgcacccccatcgcgggcctgcgcgcggtcctggagaacatcgtggacggcatctccgccgccgaccccgagacgatgcgcacggccctgaagcagacggagcgactgggacggctggtggagaccctgctggacctctcccggctggacaacggcgtcgtccccctccgcaagcgccgcttcgaggtgtggccctacctgtccggcgtcctgaaggaggccaacatggtcgcctcggcacgcgcgagcctggcgacgggctccggcagccacacccgcacggacgtccatctgcacctcgatgtgtccccgcccgagctgaccgcgcacgcggacccggagcggatccaccaggtcgtcgccaacctgatcgacaacgcggtcaagcacagcccgccgcacgggcgcgtgacggtcaaggcccggcggggccccgcacccgagtcgctggacctggaggtcctggacgagggcccgggcatccccgagtcggagtggcaccgggtcttcgagcggttcaaccgcggcgccgtcagcgcgccgcacggcccgggcagcgacggcggtacgggcctggggctcgccatcgcgcgctgggcggtcgatctgcacggcggccggatcggtgtggccgaatcccagcggggctgccggatccaggtcacccttccgggacttccctctctgccaagttga

SEQ ID NO: 77263 - protein, 368 aa, Streptomyces avermitilis MA-4680
MSDGPAARRGPGDPWGGVRPFSIKTKLGALVVISVLITTGLSMIAVHTKTELRFITVFSMIATLLITQFVAHSLTAPLDDMNTVARSISRGDYTRRVRENRWDELGDLAHTINLMADELEAQDRQRKELVANVSHELRTPIAGLRAVLENIVDGISAADPETMRTALKQTERLGRLVETLLDLSRLDNGVVPLRKRRFEVWPYLSGVLKEANMVASARASLATGSGSHTRTDVHLHLDVSPPELTAHADPERIHQVVANLIDNAVKHSPPHGRVTVKARRGPAPESLDLEVLDEGPGIPESEWHRVFERFNRGAVSAPHGPGSDGGTGLGLAIARWAVDLHGGRIGVAESQRGCRIQVTLPGLPSLPS

SEQ ID NO: 77264 - DNA, 1566 bp, Streptomyces avermitilis MA-4680
  CDS (1)..(1566)
atgaccaaaccgcaggacaagctccgcggctgggccgcggcccgcaaggcgatcctgtccggtctgcgcttcaccagcctgcggctgcgtctcgtcgtcgtcttcggcctggtggcgctcaccgccgccgtctcggcctccgggatcgcgtactggctcaaccgcgaggccgtgctcacccgcacccaggacgcggtgctgcgtgacttccagcaggagatgcagaaccgggcgagcgcgctgcccgtgcacccgacgcaggacgaactccagcacaccgccgggcagatgggaaccagcagccagcgcttcagcgtgctgctggtcgccgaggacgcgaacggcaagaccgtcaccggcaactccgacctggacaccttcacgctggaggacgtaccggagtccctgcgaacggcggtgaacaagaagcagtccgtgtcgggcggcaacaagcacgcgtaccacctgtactggcagcgggtcaccgaaggcggcaagccgtatctggtgggcggcgcgaaggtgatcggcggcggcccgaccggctacatgctcaagtcactagagccggaggccaaggacctcaactccctcgcctggtcgctgggcatcgcgacgggcctcgccctgatcggttcggcgctgctcgcgcaggccgccgcgacgaccgtcctgaagccggtgcaccgcctcggcatcgccgcccggcgcctcggcgagggcaagctcgacacccgtctgcgggtgtccggcaccgatgaactggccgatctgtcacggacgttcaaccggacggccgagtccctggagaagcgggtcgcggacatgagcgcccgtgacgaggcctcgcggcgcttcgtcgccgacatgtcccacgaactccgtacgcccctcacggcgatcaccgccgtcaccgaggtcctcgaggaggagctcgacgccgagacgggcagcgtggacccgatgatcgaaccggccgtacggctggtggtcagcgagacgcgccggctgaacgacctggtcgagaacctcatggaggtcacccgcttcgacgcgggcacggcacggctcgtcctcgaccacgtggacatcgccgaccagatcaccgcgtgcatcgacgcgcgcgcctggctggacgccgtcgatctcgacgccgagcgcggcaacatctgccgcctcgacccgcgccgcctcgacgtcatcctggcgaacctgatcggcaacgcgctcaagcacggcggctcgccggtccgcgtgtccgtccgtacggaggcggaggacctggtcatcgaggtgcgggaccacggtccgggcatccccgaggacgtcctgccgcacgtcttcgaccgcttctacaaggcgagcgcctcgcgcccccgttccgagggcagcggtctgggactgtccatcgcgctggagaacgcgcacatccacggcggcgagatcacggccgccaactccctgaagggcggcgccgtgttcacgctgcgtctgccccgcgacccgtcaccgctgatcgcggaggacgaggggcagaacgggcacggcacggagggcaacgcctga

SEQ ID NO: 77265 - protein, 521 aa, Streptomyces avermitilis MA-4680
MTKPQDKLRGWAAARKAILSGLRFTSLRLRLVVVFGLVALTAAVSASGIAYWLNREAVLTRTQDAVLRDFQQEMQNRASALPVHPTQDELQHTAGQMGTSSQRFSVLLVAEDANGKTVTGNSDLDTFTLEDVPESLRTAVNKKQSVSGGNKHAYHLYWQRVTEGGKPYLVGGAKVIGGGPTGYMLKSLEPEAKDLNSLAWSLGIATGLALIGSALLAQAAATTVLKPVHRLGIAARRLGEGKLDTRLRVSGTDELADLSRTFNRTAESLEKRVADMSARDEASRRFVADMSHELRTPLTAITAVTEVLEEELDAETGSVDPMIEPAVRLVVSETRRLNDLVENLMEVTRFDAGTARLVLDHVDIADQITACIDARAWLDAVDLDAERGNICRLDPRRLDVILANLIGNALKHGGSPVRVSVRTEAEDLVIEVRDHGPGIPEDVLPHVFDRFYKASASRPRSEGSGLGLSIALENAHIHGGEITAANSLKGGAVFTLRLPRDPSPLIAEDEGQNGHGTEGNA

SEQ ID NO: 77266 - DNA, 1506 bp, Bacillus cereus ATCC 14579
  CDS (1)..(1506): transl_table=11
ttgaaaaagatatttaatccgtttacttatataaggaaaataagacaattaattgagaaattagtaaagagcgtacgaaagagtataaggattcaattgattactacttttgctgcttgtgcgttattaggagttttgtcagcaaaggcagcagcaccgttttttgagaatgcgaatcgtcaagcaactatcgattatcgggctggtatggaacaaattaatcaccaagctcaaggagcggcaaatagttcggttcatgaaaataaattagaagctatatcaaatatgatcgaaatggagaaccaaaatttagagcaagggtctagagctttgaagatattggttactgatgaaagtggcaaagttttatataaaacaaagcaagcgcaagaagagcaaatcgatttgcataatacgattcgtaatgcagcatcattcgcgattaattatacagatggtagaaatgtatttgaaagtacaagaaaagagtttatatctttttcacctattactattgatggaaagaatttgtacatgtttgttagtggaattccagagggagaggtaatatatgatacgcaagaaggaccattcccgtttttaattggtgtacttgtattcattttctctttcttctatataacaaagagaaagatgaagcagattgaagcaatggcacaaggcgtaaaggaaatagaaagaggtaacttagcctaccgcattgagaaaaaaggtgaagatgagattgcagctttaacggagaatattaataatatggcagaagagcttatgaataatatagaaaaggaacgtaaattagaaaagcaaaagaatgagcttatcacaaatgtatcgcatgatttgcgtacaccacttacttctattatgggttacttacgattacttcgagattctaaatatgaaaataaagaacaacacgatgagtatacgagaattgcttttgcaaagtcggagcagttaaaaaatttaatagaagatttatttgagtatacgaagttaacaaatgaacaagttgtattagaaaaacaagaagtatgtgtaaatgagttgcttgagcaattaatagaagagttagtaccgcaagcggaagagcatggacttacgtttgttaagaagtttcctgaggaacgtgcttatgcatcgattgattcggaaaagatggttcgtgtatttgataatttactaatgaatgcaattaagtatagtaaagatgatggagagataaaagtttctcttcaaaggcagcgtagggatatacaaattgtaattgcgaatcatagtgaagagtttacgagagaagagttagcgaatttgtttgaacgtttctataagaaggatcaatctcgaagtagagtaacggaagggtcgggactcggtttagcgattgcgaaaagtattgttgagttacaaggtggtagtattcgagcggaatatagggatggcattattcaatttatcgtctcgttaccaattatagaaaaataa

SEQ ID NO: 77267 - protein, 501 aa, Bacillus cereus ATCC 14579
MKKIFNPFTYIRKIRQLIEKLVKSVRKSIRIQLITTFAACALLGVLSAKAAAPFFENANRQATIDYRAGMEQINHQAQGAANSSVHENKLEAISNMIEMENQNLEQGSRALKILVTDESGKVLYKTKQAQEEQIDLHNTIRNAASFAINYTDGRNVFESTRKEFISFSPITIDGKNLYMFVSGIPEGEVIYDTQEGPFPFLIGVLVFIFSFFYITKRKMKQIEAMAQGVKEIERGNLAYRIEKKGEDEIAALTENINNMAEELMNNIEKERKLEKQKNELITNVSHDLRTPLTSIMGYLRLLRDSKYENKEQHDEYTRIAFAKSEQLKNLIEDLFEYTKLTNEQVVLEKQEVCVNELLEQLIEELVPQAEEHGLTFVKKFPEERAYASIDSEKMVRVFDNLLMNAIKYSKDDGEIKVSLQRQRRDIQIVIANHSEEFTREELANLFERFYKKDQSRSRVTEGSGLGLAIAKSIVELQGGSIRAEYRDGIIQFIVSLPIIEK

SEQ ID NO: 77268 - DNA, 1392 bp, Bacillus cereus ATCC 14579
  CDS (1)..(1392): transl_table=11
atgaaacgaatttcaattcaattcggattttattttttaattgttacacttttaattgaaagtgttctctttattttgctctattatagtcttgtaaacactagagtaaatgaagaaatgacagctttattaaagcgaggaaatagtcatcgagatgtacttgaaaaatattacgatgagcaaaccatctctcacgtagcattaatggaatctgaagctgaaacaactgtcgttattacaaatgcaaataaagaaatactagctaaatctaacgaaataaacacgactataaacgatcatattagtaaaatgcaaactcgaacagaccataatggagcgattatagaaaatcattggaaaacatctaattatatatgtacagttagccccattgtagtagatggaaaacatgaaggctatgtgtacatgtttcttggaacagaatcaattgaaaagttagttaatggattaacaaaacaattcattattgctggtgccatcacatttctactcacagtcatcacaattttcctattatctcgattattaacaaaaccattgttacacatgaaacatgccactgaaaaaatgagtaaaggtgatttatctgtttcattaacaactactcgaaatgatgaaattggtgaactagcatcatctattcagacgctcgcaaatgatctacattatatgaaaacagagcgaagtgaatttctagcaagtgttgctcacgaattacgaacaccgttaacatacgtaagaggttatgctgacattgctttaaaagaaagcaccccttctgaacaacgtttgcgatatttatcaattataaaagatgagtctgattacattacaaacttagttcaagatttattttcacttgcacaaatggaacaacataacttttctattcaagtaaaggaagtgcatttacacaccttccttacgcgtatatgtgaaaaagtaaacgccatgtataaagaaaggtacattaaagtttctttctcttgtcctcctacactgctagtaaacttagatgaacaacgattcgaacaagttgttgtgaatattttaaataacgcttatagacattcaaaagagcattctcatataaacatttctattacagaagaacataaacgtatctccattacaattgaagatgaaggcgaaggtattccgcttgaagacctccctcacatttttgaccgcttttaccgtgtcgataaagcaagaacacgatctacaggcggaactggtttagggctatctatcgtaaaagaaattgtagaactacacggcggaaatattactgtaacgagcgaagtcgattacgggtcttgctttataatttcattaccatccataaaaaaacacgactatcatcaatag

SEQ ID NO: 77269 - protein, 463 aa, Bacillus cereus ATCC 14579
MKRISIQFGFYFLIVTLLIESVLFILLYYSLVNTRVNEEMTALLKRGNSHRDVLEKYYDEQTISHVALMESEAETTVVITNANKEILAKSNEINTTINDHISKMQTRTDHNGAIIENHWKTSNYICTVSPIVVDGKHEGYVYMFLGTESIEKLVNGLTKQFIIAGAITFLLTVITIFLLSRLLTKPLLHMKHATEKMSKGDLSVSLTTTRNDEIGELASSIQTLANDLHYMKTERSEFLASVAHELRTPLTYVRGYADIALKESTPSEQRLRYLSIIKDESDYITNLVQDLFSLAQMEQHNFSIQVKEVHLHTFLTRICEKVNAMYKERYIKVSFSCPPTLLVNLDEQRFEQVVVNILNNAYRHSKEHSHINISITEEHKRISITIEDEGEGIPLEDLPHIFDRFYRVDKARTRSTGGTGLGLSIVKEIVELHGGNITVTSEVDYGSCFIISLPSIKKHDYHQ

SEQ ID NO: 77270 - DNA, 1776 bp, Bacillus cereus ATCC 14579
  CDS (1)..(1776): transl_table=11
atgctttggagaagtgtagtagggaagttatggatgaccatattacttctcgtttcgtttgttcttggatttgttgcgattttactttcacagttttttagaacgtattatgttgatatgagtgaagctaggcttcaaaaagttgcaacaagtgtttcagagttaattgaagaaggtgccgatgtaaaaacgattgagaatatcgcttacaaattctctgacccactttcaaggattattattgtagaagatggtaaagaaatctcttcttcaccgaaacaagaagggttagtcactcttacaatggatgacttaaaagaagataaagaattagcggctgtgtttacagacaaaaaagaaattaagaataatattagaaaagcgtctaatagtaggaagaataaaaacaccgaaaatgatattatgatcgtcggaaaaccagtgcaatcaaaaaatcaaagtgcagtgttcgtatatgaatctttacaagtaccgatacaaggtatggaaagaacaactgattttattttcttatcggctggaattgcgattatattaacaactttctttgcgttcttcttatctactcggattacagcaccgcttcgtaaaatgcgtgaggttgcttttgaagtgtcacgtgggaagtttgatgcaaaggctcctatggtatctcaggatgagattggtgagcttgcaacggccttaaatcaaatgggaaaacagttgaagtttaatatgaacgccttgcaacaagaaaaagagcagttagcaagtattttgagtagtatggcagatggggttattacgttaaatcaagaaggtgaagtcgttgtaatcaatccgccggccgaacatttcttacaagtttggcaagaagaaaaagagatagagctcagtaaaaaactaccttctgaacttgtggaattattccatctcgttgtagaaagcgaacaacaacaagttgttgaaattaatttacaaaaaggaaactatgtagttcttatgacgccgctttacaatcaaacgaaaattcgtggagctgtagcagtgctgcgagatatgacggaagaacgtcgtcttgaaaagatgcgtcaagattttattgcgaatgtatcacatgaacttcgtacaccaatggtcatgctgcaagggtatagtgaagcgattttagatgatattgtgcaaacgaaagaggaaatagatgagtttgttcaaattatttatgatgaatctgttcgtttaggtaaacttgtaaatgaattgttagatttagctcgtatggaaagcggtcatgtagagttacatattggtgaagtggatatacatccgtttgttgaaaaaattggtcgtaaattccaagggattgcaaaggataaagaggtcgcgttaacggttgatttcaaaggtccaattgaacaatacccgtttgatgcagatcgtatggaacaagtattgacgaatttaattgataacgcaatacgtcatacgaatgcaggcggacatgtaacgcttgtaattgatacgaaaaataacggtcttatttttgaagtacaagattcgggtgcaggcattccagaagaagatattccatttttatttgatcgtttctataaagctgataaagcaagaacacgtgggaaaaagggtggaacaggactcgggcttgcgattgcgaaaaatattgttcaaggccatgatggtaaaatttctgtatcaagtgttgttggagaaggaactacattctctgtatatttaccgaatcgtataatttag

SEQ ID NO: 77271 - protein, 591 aa, Bacillus cereus ATCC 14579
MLWRSVVGKLWMTILLLVSFVLGFVAILLSQFFRTYYVDMSEARLQKVATSVSELIEEGADVKTIENIAYKFSDPLSRIIIVEDGKEISSSPKQEGLVTLTMDDLKEDKELAAVFTDKKEIKNNIRKASNSRKNKNTENDIMIVGKPVQSKNQSAVFVYESLQVPIQGMERTTDFIFLSAGIAIILTTFFAFFLSTRITAPLRKMREVAFEVSRGKFDAKAPMVSQDEIGELATALNQMGKQLKFNMNALQQEKEQLASILSSMADGVITLNQEGEVVVINPPAEHFLQVWQEEKEIELSKKLPSELVELFHLVVESEQQQVVEINLQKGNYVVLMTPLYNQTKIRGAVAVLRDMTEERRLEKMRQDFIANVSHELRTPMVMLQGYSEAILDDIVQTKEEIDEFVQIIYDESVRLGKLVNELLDLARMESGHVELHIGEVDIHPFVEKIGRKFQGIAKDKEVALTVDFKGPIEQYPFDADRMEQVLTNLIDNAIRHTNAGGHVTLVIDTKNNGLIFEVQDSGAGIPEEDIPFLFDRFYKADKARTRGKKGGTGLGLAIAKNIVQGHDGKISVSSVVGEGTTFSVYLPNRII

SEQ ID NO: 77272 - DNA, 1437 bp, Nitrosomonas europaea ATCC 19718
  CDS (1)..(1437): transl_table=11
atgtccatccgaatcaaattattcctggcctttctgctgactacgttcgtagtggtgatggggatgcattttttcacccgttggtccctggagaaaggattcaccgagttcatcgaaaaaagacagcaggaacggctggataaaatcatcgatgtactggaggaacactatgctgagcaccgtggctggggagagctggccggaaacaagcaacactggatttcgttattgtggcatgccggcccgcaccggcatcgtccgccgaagtggattatcgaacaggcacagcatgagcccgatcgacagtggccaccagcagtaacacccggaacagccgaaagaaagtggtctccattcgagttacgggtaatactgctggatgcagatcgatcgattctgttcgggcggaaggaactgatttctcaactgagcctgcatcctgttcagtatgaacaccggacggtcgggtttcttggcctgttgccaggaaacccggtcagtcaggccagcgacatttatttcatggaacaacaggccgactttttcttctggattgcgttgaccatggtagtactgtctgcactgatcgcttggttgatggcctatcacctcggacggccgctcaagcagatcgcagcggtggtacaaaggctggcgacgggggattacaaagccagactacctgtcatatcgaaggatgaaatgggccaactggcactgaatttcaatgatacggctgctgcactggagcaagcagaacaaagtcgcagacggtgggtggccgatatttctcatgaattgcgtacaccactggccgttttgcgtggtgagctggaagccatcctggatggggttcacccattgactcccgcagcgatagaatccctgtccggtgatgtgctgcggctcaatcgtctgacagaagatctttaccagcttgctttatccgatcagggtgcattgagttaccggaaagtactgctcgaccccgtacccttgctgcgagaagatctggcaacgttcacaactgatttcaatcataagcagatcagtgtcagatggatcaaccggctgttcaaacctgtactggtcaatgctgatcctgaccggttatcacaattgttccgcaatctgctgaccaacagtctgaaccatacggatgcgagaggacaactggaaatcacggttcagcgcctggcagacaagctggtgatcgaactggcggacagcagtcccggtgtctcggatcaggatatcgcgcatctgttcgatcgtttctatcgtgtcgatcattcacgcaaccggcatctgggaggagccggcctggggttggccatctgcagcaatatcgtcagagcgcatgaaggaacgctgatggcatcccattcggctctgggcggtctggcgatacatatcgagctgccaattacgccatga

SEQ ID NO: 77273 - protein, 478 aa, Nitrosomonas europaea ATCC 19718
MSIRIKLFLAFLLTTFVVVMGMHFFTRWSLEKGFTEFIEKRQQERLDKIIDVLEEHYAEHRGWGELAGNKQHWISLLWHAGPHRHRPPKWIIEQAQHEPDRQWPPAVTPGTAERKWSPFELRVILLDADRSILFGRKELISQLSLHPVQYEHRTVGFLGLLPGNPVSQASDIYFMEQQADFFFWIALTMVVLSALIAWLMAYHLGRPLKQIAAVVQRLATGDYKARLPVISKDEMGQLALNFNDTAAALEQAEQSRRRWVADISHELRTPLAVLRGELEAILDGVHPLTPAAIESLSGDVLRLNRLTEDLYQLALSDQGALSYRKVLLDPVPLLREDLATFTTDFNHKQISVRWINRLFKPVLVNADPDRLSQLFRNLLTNSLNHTDARGQLEITVQRLADKLVIELADSSPGVSDQDIAHLFDRFYRVDHSRNRHLGGAGLGLAICSNIVRAHEGTLMASHSALGGLAIHIELPITP

SEQ ID NO: 77274 - DNA, 1392 bp, Bacillus anthracis str. Ames
  CDS (1)..(1392): transl_table=11
atgaaacgcatctctattcaattcggattttattttttaattgtcacacttttaattgaaagtgttctatttgttttgctctattatagtctcgtaaacactagagtaaatgaagaaatgactgctttattaaaacgtggaaacagccatcgtgatgtacttgaaaaatattatgatgagcaaacaatctctcacgttgcactaatggaatctgaagctgaaactactgtcgttattacaaatacaaataaagaagtactagctaaatctaacaaaataaacacaactataaaaaatcacattagtagcatgcaaacacgcacaaatcatgacggagcgattatagagaatcactggaaaacatctaattatatatgtacggtcagtcccatcatagtagctggaaaacatgaggggtatgtgtatatgtttcttgggacagaatccattgaaaagttggtaaatggattaacgaaacaattcattattgctggtgccatcacgtttctactcacagtcattaccatttttcttttatctcggttattaacaaaaccattgttacatatgaaacatgccactgaaaaaatgagtaaaggcgatttatccgtttcgttaacaactactcgaaatgatgaaattggtgaactatcctcatcaattcaaacgcttgctaatgatttacattatatgaaaacagagcgaagtgaatttctagcaagtgttgctcatgaattacgaacacctttaacatacgtaagaggctacgctgacattgctttaaaagaaaccacatctcccgagcaacgtttacggtatttatctattataaaagatgagtctgattacattacaaacttagttcaagatttattttcactggcacaaatggaacaacataacttttctattcaagtaaaggaagtacatttacacactttccttactcgcatatctgaaaaagtaaacgccatgtataaagaaagatacattacagtttctttctcttgtcctcctacactgctagtaaacttagatgaacaacgatttgaacaagttgtagtgaatattttaaataacgcttatagacattcaaaagaacattctcaaattcatatttctgttatagaagaaaataaacgtatctccattacaatggaagatgaaggcgaaggtattcctcctgaagacctccctcacattttcgaacgcttttatcgagttgataaagctagatcacgagctaccggtgggactggtttagggctatctatcgtgaaagaaattgtagaactacacggcggaaatattactgtaacgagcgaagttgatcacgggtcttgttttacaatttccttgccatctataaagaaacacgactaccatcagtag

SEQ ID NO: 77275 - protein, 463 aa, Bacillus anthracis str. Ames
MKRISIQFGFYFLIVTLLIESVLFVLLYYSLVNTRVNEEMTALLKRGNSHRDVLEKYYDEQTISHVALMESEAETTVVITNTNKEVLAKSNKINTTIKNHISSMQTRTNHDGAIIENHWKTSNYICTVSPIIVAGKHEGYVYMFLGTESIEKLVNGLTKQFIIAGAITFLLTVITIFLLSRLLTKPLLHMKHATEKMSKGDLSVSLTTTRNDEIGELSSSIQTLANDLHYMKTERSEFLASVAHELRTPLTYVRGYADIALKETTSPEQRLRYLSIIKDESDYITNLVQDLFSLAQMEQHNFSIQVKEVHLHTFLTRISEKVNAMYKERYITVSFSCPPTLLVNLDEQRFEQVVVNILNNAYRHSKEHSQIHISVIEENKRISITMEDEGEGIPPEDLPHIFERFYRVDKARSRATGGTGLGLSIVKEIVELHGGNITVTSEVDHGSCFTISLPSIKKHDYHQ

SEQ ID NO: 77276 - DNA, 1527 bp, Gloeobacter violaceus PCC 7421
  CDS (1)..(1527): transl_table=11
gtgggcgcagggcgtttttcagattgggacaagcaattgaacccatccgtcgcacggctctggcggcgaaccttcgggggagtgcgcacgcgcatcctcgcctggtacgtgctgttgatcgccctgtgcggagtgacctcggtcctggcggtgcgcgagattctgtttatgcaattgcaggagcggctggagacctcgttggtgcgggaggtgcggctttttgagcttttgagcgccgaggagccggttgtgcaggagcagccgatgcgcgaacgcgccgcccacatcttcgatcgttttttttaccgctacgtcccgcacgacaacgagttcatgctcgcctacatcgacggcgaactctaccggacgatgccccagaagctcgacggcaccatgcgcgccaacggcaagctcacctcccgctggtcgcatttgcgcgcgccggagcgcgacgagcgcacgggctcgagcggcgagaagtttttgtacatcgccgagccgttgcgcctgggcggcgagccgcgcggactgttggtggcggcttattgtgtctcctgcgagcgccgcgaggtggagcggtcggtgatggtggtggcccaggtctttattggggcgacgctgctcgcttcgctattggcctggatcgccgccggccgggtgctggcgcctttgcggctgctcgccgagacggcccgatcgattggcgaatcggatctgacccggcgcatcccggcgggcgaccgcggcgagttgggcgaactggccgccaccttcaaccagatgctcgatcgtctggaggcggccttcgcgagccagcgcaactttatcagcgacgcaggccacgaactgcgcacgccgattacgattgtccggggtcacttggagttgttgggagacgatcccggcgagcgggccgagacgatggcgatcgtgtacgacgaactcgatcgcatgaaccgctttgtcgacgacctgctgcttttggccagggccgagcgaccggactttttgttctttgagctgttcgatgtcggcgaactgaccgacgaactgtacgcaaaggcccgtgccctcgccccgcgcgagtggtccatcgaggcgcgcggcagcggccggatggtcgccgatcgccagcggttgacccaggcggtgatcaatctggcccaaaacgccgtgcagcacactgccccgggcgatcgcatcgccatcggctcggccctgcggggggtgtgggtgtatctgtgggtgagcgactgcgggccgggcattgcgccggaagatcagcggcgcatcttcgagcgcttcgagcgcggcagccatagccgctacgagggcagcggcctgggactcgccatcgtacaggcgatcgccaccacccacggcggcagcatccaactgacaagcgtaccgggcgcaggggcgacctttacgctggtgctgcccctcgacccgccccaggaactgcaattgcacaatcaactcgcaggtcagagctgctcgacggtgctctcggtctattcgcactga

SEQ ID NO: 77277 - protein, 508 aa, Gloeobacter violaceus PCC 7421
MGAGRFSDWDKQLNPSVARLWRRTFGGVRTRILAWYVLLIALCGVTSVLAVREILFMQLQERLETSLVREVRLFELLSAEEPVVQEQPMRERAAHIFDRFFYRYVPHDNEFMLAYIDGELYRTMPQKLDGTMRANGKLTSRWSHLRAPERDERTGSSGEKFLYIAEPLRLGGEPRGLLVAAYCVSCERREVERSVMVVAQVFIGATLLASLLAWIAAGRVLAPLRLLAETARSIGESDLTRRIPAGDRGELGELAATFNQMLDRLEAAFASQRNFISDAGHELRTPITIVRGHLELLGDDPGERAETMAIVYDELDRMNRFVDDLLLLARAERPDFLFFELFDVGELTDELYAKARALAPREWSIEARGSGRMVADRQRLTQAVINLAQNAVQHTAPGDRIAIGSALRGVWVYLWVSDCGPGIAPEDQRRIFERFERGSHSRYEGSGLGLAIVQAIATTHGGSIQLTSVPGAGATFTLVLPLDPPQELQLHNQLAGQSCSTVLSVYSH

SEQ ID NO: 77278 - DNA, 1443 bp, Gloeobacter violaceus PCC 7421
  CDS (1)..(1443): transl_table=11
gtgagcttccacccaagggccctggtgccccgcacgctctggggccgcctgaccctcgccttcgtgggcctgacggccgcctgcctgtggggaatcggcctggtgctcggcgacgccctcaacaatttttttgttcaagacgcccaggcgcgcctcgaccgccaggctcgcgggctcgcggagttggcgccctccgattggcgggcggcgactcgcctgagcgcccgtcaaaatcaactgcaggtgctcgtcttcgacgcgcgggagaacacggtggcgagcgcccaggggctcgccggggtgcaccaggtggtgatcccccgcggcatcgtccgcaagaccctcacaggccagggccagcggggccgcctctgggtcgagggggagaccaagtatccctggtggctctacagcaccgcacccgtgcgcaccagcggcgcgatcggcgcggcggtctacgtggcgatgcccctgctgcggccccgccgttttgcccagcaggtgaccggtcttgcgatgctgtgcgtgggcggggcgatggtgctggcggtactggccggtttgggcctcgcccgcacgatcgcgggtcctttgcagcggttgacccggcaggccagacagctggaagcgggggactaccaggcccgctgcggcctggacggggacgatgaaatcgcccgcctgggcttgacgctcgacgcgatggccggacgactggaggagacgatcgcgagcctcaaagcccaggaagcttcccgccgggagttgctggccaacatttcccacgatctgcgcacgccgttgacggcaatgcgcctcagcttagaggcggtgctcgacggggtcgtcaacggcgagcaggtgggcggctacctggagaagatgcggcgcgaagcgatttacctcgggcaactggttgatcaattgatgctgttggcccgctccgacagcggccaactcgaagtcagcctgcgggaggtcccgatcgccgcactgctcggcgaagcgctcgagcggatcgagccgcaggccatcgcccggggcgtcttcctggatgggcgctggtccgggcacctgccggccgtcaggttggacgcgcatctgagcgcccaggtgctcgccaacctgctcgacaacgccgtcaagtacacccctgaaggcggttcggtgatcctctcggcgcgcgacaccggcggcggggcggtgcagatcaccgtcgaagacaccggatccggcatggacgcgcaggtgctcaaacgggcgaccgaacgcttctggcgggcggatccggctcgctcgggaggcgggttcggcctggggctcgccatcgccgagcgcctgtgccgcctgcagggggtcggcctcgaaatcgccagcgccccgggccggggaacggcggtgatcctgcgcctgcccgtgcggcgccccgactcggcggcgtag

SEQ ID NO: 77279 - protein, 480 aa, Gloeobacter violaceus PCC 7421
MSFHPRALVPRTLWGRLTLAFVGLTAACLWGIGLVLGDALNNFFVQDAQARLDRQARGLAELAPSDWRAATRLSARQNQLQVLVFDARENTVASAQGLAGVHQVVIPRGIVRKTLTGQGQRGRLWVEGETKYPWWLYSTAPVRTSGAIGAAVYVAMPLLRPRRFAQQVTGLAMLCVGGAMVLAVLAGLGLARTIAGPLQRLTRQARQLEAGDYQARCGLDGDDEIARLGLTLDAMAGRLEETIASLKAQEASRRELLANISHDLRTPLTAMRLSLEAVLDGVVNGEQVGGYLEKMRREAIYLGQLVDQLMLLARSDSGQLEVSLREVPIAALLGEALERIEPQAIARGVFLDGRWSGHLPAVRLDAHLSAQVLANLLDNAVKYTPEGGSVILSARDTGGGAVQITVEDTGSGMDAQVLKRATERFWRADPARSGGGFGLGLAIAERLCRLQGVGLEIASAPGRGTAVILRLPVRRPDSAA

SEQ ID NO: 77280 - DNA, 1389 bp, Photorhabdus luminescens subsp. laumondii TTO1
  CDS (1)..(1389): transl_table=11
atgaaactcggcatcagtggtaaactgtttatggccattttcgccacttgcatgctagtactcatcaccatgcactggggcgtaagaagcagcttccagcatggttttattggttatataaaacaaaatatccagctacgtactgccatgttagccgaagcactggctgaacaatatcaacaacatggcaactggaaattcttaaagaggaatgaccgggcaatttttcaaatcatccgctccattgaacaaaccagtgaaagccgtcaaggtccaccacctcgcggttggcgaactcaattttgggtggtggacagtgacatgaaactgctggtcggtcatgaaggtaaaatcccgtcagagacttatcgcaaaccgattatctatcatcatcaagtcgttggttgggtcattgttagcacatcagataaaattacccgtcaagctgatatcagttttgatcgccagcaacaactgacaagctggataattgccggtttatctaccttgctggcaatgatagccacgctattattatcccgcggtatgttaaaacccgttaaacgtttggttgaaggaacacataaactggcagccggtgattttagtgtccgagtcacaccatcaagtaaagatgaaattggtcagcttgcccacaattttaaccaactcgccagtaccctggaaaaaaacgagcagatgcgtcgcgattatatggccgatatttctcatgaactgcgcactcccctttccatattgcgtggtgaattggaagcgttacaggatggtgttcacaaaccaacgccagaaactctcaattcgttattggctgaaattaccacattgaccaaactggttgatgatttacatcaactatctctatccgatcgcggggcgctggcataccggaaagaatttatcaacatcagtgagttaattcaggttgctatcgcatcttatcatggccgtttccttgataaacaaatccaagtggatgttaaacttcctgaaatgattacgttgtttgctgacccaagcagattgactcagctatttcataatttactggaaaatagtcttcgctataccgctgataatggaaaattgatcattaaaggttgttctgacgataaccacttcattctgaattgggaggacagcaagcccggtttgtcaccagagcaatgccaacgggtttttgaacgattctaccgcagtgaatcctcacgaaaccgcgccagtggtggctcaggacttggtttagccatttgctataacatcgttgaagcccataacggtacgatccatgccgaaccctcacctttaggtggcctgagaattatcgtagaattgtcgctcactgaatccctcgacggcgaaacgttatga

SEQ ID NO: 77281 - protein, 462 aa, Photorhabdus luminescens subsp. laumondii TTO1
MKLGISGKLFMAIFATCMLVLITMHWGVRSSFQHGFIGYIKQNIQLRTAMLAEALAEQYQQHGNWKFLKRNDRAIFQIIRSIEQTSESRQGPPPRGWRTQFWVVDSDMKLLVGHEGKIPSETYRKPIIYHHQVVGWVIVSTSDKITRQADISFDRQQQLTSWIIAGLSTLLAMIATLLLSRGMLKPVKRLVEGTHKLAAGDFSVRVTPSSKDEIGQLAHNFNQLASTLEKNEQMRRDYMADISHELRTPLSILRGELEALQDGVHKPTPETLNSLLAEITTLTKLVDDLHQLSLSDRGALAYRKEFINISELIQVAIASYHGRFLDKQIQVDVKLPEMITLFADPSRLTQLFHNLLENSLRYTADNGKLIIKGCSDDNHFILNWEDSKPGLSPEQCQRVFERFYRSESSRNRASGGSGLGLAICYNIVEAHNGTIHAEPSPLGGLRIIVELSLTESLDGETL

SEQ ID NO: 77282 - DNA, 1128 bp, Corynebacterium diphtheriae NCTC 13129
  CDS (1)..(1128): transl_table=11
atgaatcccggacccggcctgaccttccgcttcctggctgcccaggtgttggtcgtggtaattagcctgatggtggccgcggccgtggccacgatggtgggcccgaccctgttccatgatcatatgttgatggccggccgggaggacccctcgctggggctgttccatgccgagcaggcctaccgggacgccaacctgatcaccctggctgtcgccctgcccactgccttgatcagcgccctactggccagcctgtggttatcgcgtcgtctgcgcacccccctgcaggatctcacccgcgccgctaccagcctggcggccggtaactcccgtatccgcgtgcccgccggaggagcaggccccgaggtcgccaccctggcacatgccttcaacaccatggccgaccggctggaacacaccgaacaggtccgccgccagatgctctctgatctggcccacgaaatgggcacccccctatcggtgctcacggcctacctcgatggtctccaggacggggtcgtggactggaataatgccaaccacacgatcatggctgaccaactcacccgcctgacccggttgatggaagacattgactatgtctcccgggcccaggaacaccggatcgatttggacctggcagaggaagggctcggggatctgctccataccgccgctgctgccgcgggggaagcttatgctgacaaaggcgtcgatttacaggttgagaccattacggacaccgcccgggtggtcgtggaccggcaacgcttcggccaggtgatgagcaatctcctgtcgaacgcgctacggcacaccccggtcggcgggcaggtccggatcagcgtccaccgacagggggcgtccaccgcgctcatccacgtcgccgatgacggcgagggcatcccacctggccagctcggacacatcttcgaacgcttctaccggggagatgccgcccgcagccgggacaacggcgggtccggtatcggtctgaccatctccaaggcattgatcgaggcccacggcggcactctcaccgccacctcccccggacccggtcgcggagcggtgtttaccctccgcctcccgctgtcccctcccgacagtgaggaggctgctcggtga

SEQ ID NO: 77283 - protein, 375 aa, Corynebacterium diphtheriae NCTC 13129
MNPGPGLTFRFLAAQVLVVVISLMVAAAVATMVGPTLFHDHMLMAGREDPSLGLFHAEQAYRDANLITLAVALPTALISALLASLWLSRRLRTPLQDLTRAATSLAAGNSRIRVPAGGAGPEVATLAHAFNTMADRLEHTEQVRRQMLSDLAHEMGTPLSVLTAYLDGLQDGVVDWNNANHTIMADQLTRLTRLMEDIDYVSRAQEHRIDLDLAEEGLGDLLHTAAAAAGEAYADKGVDLQVETITDTARVVVDRQRFGQVMSNLLSNALRHTPVGGQVRISVHRQGASTALIHVADDGEGIPPGQLGHIFERFYRGDAARSRDNGGSGIGLTISKALIEAHGGTLTATSPGPGRGAVFTLRLPLSPPDSEEAAR

SEQ ID NO: 77284 - DNA, 1560 bp, Corynebacterium diphtheriae NCTC 13129
  CDS (1)..(1560): transl_table=11
atgaacaatccttacgccagagcggttgtttcggaaccaatagatgaaacgcaatgttcatctgttggagatcaccggtacccgaattttgccaagaaaaaacaggaagaccacaagccctcctggatcagcacagtcgtgcgttctccacgaatttcggctatcaaacatctacgtttgagcgggattcccctgcgctccggtttgatggcgattgttcttgttgtctctgcaattgggctgatcggaagctcttttgcagttaatcgaacgatgcagcagttgtcctattctcgcattgatatggaacttgaaagcggactcaacggctgggccgctcaagactccttgtttgaaacgcagcttaatggtgcgctggttcgcccaccgacagaattctatgtggtgaagatctaccctaatgggacaacgagcatctataacgagggaaaaacgagccctgacctgggtcgcgtcgttatcggcaaaggggcgcaaaccgttgattcctcggaggaaagcgctgcaaacgtggaatggcgggtcatcgcggagcgccgtgctggtgtaaccattgtagtggccaaggatattactcaagaagtaaatgtcttaaaacgcctcgcattaggccaggtcatcattgttctagcagtgcttttgctcatggcgttattggcctatgtgctgatccaacgtgcacttcggccattacgtgaagtcgagatgaccgccaaagcgattgccgcgggtgatttggaccgccgagtgcccaacactacggcaaatactgaagtgggagcgttgtcgagcgcgctgaacagtatgatctctcagctgcagggatccattgtggagctgcgggataaagaggcccaaatgcgtcgtttcgttggcgatgcctcacatgagttgcgaaccccactgacctcggtcaaaggctatgccgagctgtatcgctcgggtgctacaacggacgcagacctcgtgattgaaaagatcgaagacgaggctaagcgaatgagtttgctggtagaagacctcttagcgctcacgcgagcagagggggcacgccatgattccaagcctgttgatcttcttgatctagcactgaacgtttcgtcttcacttcggggagcttatcccgatcgcgacatcgatgttcgctccgaatgcacggatgtgcccgttgtggaaggagacgcagcccgcctgcaccaagttctgaccaacttggttgcaaatgccttgaagcacggcggagactcggcacgcgtcaccatcaaactagccgacgcgggatccaattttgccgtcaaagtgatcgatgacggcataggcctcagcgaagaagatgcctcgcatatcttcgaacgcttctacagggcagacagttcgcgcgcccgcagcacaggcggaagtggcctagggctcgccatcgtgaaatcccttgtggaatcccacggtggtgaagtatcagtggaatctgaacaaggccatggcaccacattcatcgtggaactacccaaaactgcaccgaaagagactaaaaaccgctaa

SEQ ID NO: 77285 - protein, 519 aa, Corynebacterium diphtheriae NCTC 13129
MNNPYARAVVSEPIDETQCSSVGDHRYPNFAKKKQEDHKPSWISTVVRSPRISAIKHLRLSGIPLRSGLMAIVLVVSAIGLIGSSFAVNRTMQQLSYSRIDMELESGLNGWAAQDSLFETQLNGALVRPPTEFYVVKIYPNGTTSIYNEGKTSPDLGRVVIGKGAQTVDSSEESAANVEWRVIAERRAGVTIVVAKDITQEVNVLKRLALGQVIIVLAVLLLMALLAYVLIQRALRPLREVEMTAKAIAAGDLDRRVPNTTANTEVGALSSALNSMISQLQGSIVELRDKEAQMRRFVGDASHELRTPLTSVKGYAELYRSGATTDADLVIEKIEDEAKRMSLLVEDLLALTRAEGARHDSKPVDLLDLALNVSSSLRGAYPDRDIDVRSECTDVPVVEGDAARLHQVLTNLVANALKHGGDSARVTIKLADAGSNFAVKVIDDGIGLSEEDASHIFERFYRADSSRARSTGGSGLGLAIVKSLVESHGGEVSVESEQGHGTTFIVELPKTAPKETKNR

SEQ ID NO: 77286 - DNA, 1104 bp, Rhodopseudomonas palustris CGA009
  CDS (1)..(1104): transl_table=11
atgagacgtcatcgcctcagcgggcagatcacactgtcgatgagcgtcgtcgtcgccatcgcggtgctgatggtgttcgtcggcacgttcatcttctacagcatctatatgacctggttcccgccgccgccgggtccgcccccgctgctgccggaagcacccgacttcatcctgatcgcgatcttccttctgctcggcctcgccatcgcgatccacgccgcgcttcggctgacgcggcgcatccttgcaccactcaattcgctggccgaaggcgctcgcaagatcgcagctggcgacctcaccgcacgcgcggtcgccggcgatcgctcactcggcgaaacggcgcaactcgtcgacgatttcaacgcgatggctcggcgtctggaagacgcggcggaatcgatgacctcgtggaatgctgccatcgcgcatgaactgcgcacaccgctgacaattctgcgtggccgcctgcaaggcctcaccgacggcgtcttcgaacccagcgacgagctgttcaggagcctgttggttcaggtcgagaacctgtcgcgtctcgtcgacgatctgcgggtcgtgaccctgtcggacagccagcgcctcgacatgcgtgtcgaaccgacggatctcgccaacgaggtggcgcaggccgtcgatgcgatgcgccctgccctcgaaggagccggcttttctattcggatgacaaccgagccggtgacgctgccatgcgacggcccgcggatccgacaggccctactcgcgcttttggaaaacgcgcgccgctacgcaacgcccggcatgatcgtgatccggatgactctggagacgttcgaggtggccatcgctgttgaagacgagggtcccggcttgagcgccgagttcgcggcacgagcattcgatgctttcgtacgggccgagccttcccggtcccggcaattcggcggctcgggcctcggattgtcggtagtgcgtgcgatcgccgaggcgcatggcggacacgcccgatacagcacttcggaaaaaggcggctctgtattcgagatcgtttttcccatcgacggcgcctctgccgactccaatgctgcatcttgcgcgccgaaggtctga

SEQ ID NO: 77287 - protein, 367 aa, Rhodopseudomonas palustris CGA009
MRRHRLSGQITLSMSVVVAIAVLMVFVGTFIFYSIYMTWFPPPPGPPPLLPEAPDFILIAIFLLLGLAIAIHAALRLTRRILAPLNSLAEGARKIAAGDLTARAVAGDRSLGETAQLVDDFNAMARRLEDAAESMTSWNAAIAHELRTPLTILRGRLQGLTDGVFEPSDELFRSLLVQVENLSRLVDDLRVVTLSDSQRLDMRVEPTDLANEVAQAVDAMRPALEGAGFSIRMTTEPVTLPCDGPRIRQALLALLENARRYATPGMIVIRMTLETFEVAIAVEDEGPGLSAEFAARAFDAFVRAEPSRSRQFGGSGLGLSVVRAIAEAHGGHARYSTSEKGGSVFEIVFPIDGASADSNAASCAPKV

SEQ ID NO: 77288 - DNA, 1290 bp, Geobacter sulfurreducens PCA
  CDS (1)..(1290): transl_table=11
gtgcgcgatttcactcttcttgccgaagcagagcaggaggaccgcgtctcatgggtcgtcaccgacctggaatccgcctttgccaaccagaaagggtgggacaaggcgatggcggcggaagactccatctgggcgcttcaactcggcctggaaacccgtctggtggacctggacggcaaaaccgtcatggaaactgccgtagcgctgaactctttgcagccggaacagcgggcacgtttcaaacatggaactcgcaccgactccgcgcccggcaagggtgactaccacgcctatcctctgtttcaccacggcgaggaagtcggacaactggaagtcaggtttcttccagatgagcgcaaccgtgtcttcattgcgcgaaccaaccggctcctcacctattcggccatcattctcggtattgcggcctgcatcctgagcgtcatctttgcccgccggttgagccgtccgatcatcaggatatcgcaggcagcgcacgacatcagccagggtaatctgaccgaacgcgtcgctatatccggcaacgatgagctggctgcccttggccagtcgttcaaccagatggcgcacactctccaggtacagaacaaactgcgcaagcagatctgcgccaaccttgcccatgaattgcgtaccccgctgaccgtcatgcgagggcagcttgaaggtattctggacggtgtattgccgaatgacacgtcacgcatgagcctgctccttgaagagaaccagcggctcactaagattgtggcttcgatggaggagttttttcaggcccaggccagcgccctcagtcttgcccccgtcaatctgaacgtcaggcagatattcgataatctggcaacatacttcgaggctgccgcccgtaaccttgagatagagttcagggtagagactgacgatggtgccacggtctatgccgaccccgaacggctctcgcagattctcatcaatctgatcagtaatagtctcaaggcaacggctccgggaggcgccataacgcttggtgccaggaggaccccggatggttgctccctcacagtagccgacaccggttgcggcatcgccgcagaagaactccccctgatattcgagcggttctaccggggtaaagacggcgggctcgggctcggactcgccatcgtcagggaactggcagatgcgcacggcgcatccatcagcgtcaccagtaaccaggcggtaggaacaacaatttcactggcgtttcccgacaaggcggaatctccacaattctccacaaccgcttcataa

SEQ ID NO: 77289 - protein, 429 aa, Geobacter sulfurreducens PCA
MRDFTLLAEAEQEDRVSWVVTDLESAFANQKGWDKAMAAEDSIWALQLGLETRLVDLDGKTVMETAVALNSLQPEQRARFKHGTRTDSAPGKGDYHAYPLFHHGEEVGQLEVRFLPDERNRVFIARTNRLLTYSAIILGIAACILSVIFARRLSRPIIRISQAAHDISQGNLTERVAISGNDELAALGQSFNQMAHTLQVQNKLRKQICANLAHELRTPLTVMRGQLEGILDGVLPNDTSRMSLLLEENQRLTKIVASMEEFFQAQASALSLAPVNLNVRQIFDNLATYFEAAARNLEIEFRVETDDGATVYADPERLSQILINLISNSLKATAPGGAITLGARRTPDGCSLTVADTGCGIAAEELPLIFERFYRGKDGGLGLGLAIVRELADAHGASISVTSNQAVGTTISLAFPDKAESPQFSTTAS

SEQ ID NO: 77290 - DNA, 1551 bp, Geobacter sulfurreducens PCA
  CDS (1)..(1551): transl_table=11
gtggaagaaatgaggaaaagtgccgggcgcttgtcataccggtctctctacccccggtggatgtggtacaacattcacgagagcgtttcgccgggcacaaggacgaggaccatgaagatcggcattacccatcggctgttcctggccatgctggcagccgccgtgatggcggtaatcagcatggtcgtcatcatgacgtggagtgttgaccgcgggtttctccgctatgtcaacgccatggagcagcgtcagattgaccggctggcagcggagctggaaaagcgattcgctgctgcaggaaactgggatttcctgcgccgtgagccggccatgctggccagactcgtggcggagtcgctacccgcacgggaggaaatgccgttcgaacccgggccgcccgggccgctccccggcgatgggatgcggccgcctccgccgcccgaacgcatggttcatcacctgacggagcgtctcctcattctcgacgcacgccgggagcatgtgctgcccgtcgacttttccggcgacgtggcggagctgaaagccctgcgttacaagggggcggttgcggggtacctggggctcgccccccgccgcaagctctccgaggcacaccaactccggttcatccgggaacagaaactggccgtggccctggtggcgggagtggtggtctgtctcgcggccggcctgtcgcttctggtcgcgaagcggctcgtgcgccccatccgggatctggccggggccaccggtcagcttgcggccggccggttcgacaccaggatccccgtggcgtcgtcggacgaactgggacacctggcccgcgacttcaatgccctggccctcaccttggagaagaacgagcaggcacggaggcagtgggtggcggacatttcgcacgagctccgtactccgcttgccgtgctccggggcgaaatagaagcgatccaggatggcgtccgacaaccgtcgccggattccatccgctccctccatggggaggtcctgcgcctgaatcggttggtggacgatctttaccagctttccctcaccgacatcggcgcgctcgcctaccggaaagagccgctggacttggggagggtactggtcggcgcactggtcagctaccgtgccgaattcgccggcaaggggattgccgtccgcgaggagatatccgtccggcagccaatcacggtgttcggcgatgccgagcgattgcagcaactcttcgtcaacctgctggacaatgttctcaaatacaccgatatcggcggcgagttgctcgttcggctcacgtgccatgacggggcagtgaccgtcgacctgcaggattcggtgcccggggtgccggaagaagccctcgggatgctcttcgagcggctttaccgggttgagggctcccgtagtcgggccaggggcggcgcggggctcggcctggcgatctgccggaacattgtcgaggctcacaacggcaccatcacggcccgttactcgcccctgggcggggtctggattgccgtgacgctgccggtcggggagcatcagccatga

SEQ ID NO: 77291 - protein, 516 aa, Geobacter sulfurreducens PCA
MEEMRKSAGRLSYRSLYPRWMWYNIHESVSPGTRTRTMKIGITHRLFLAMLAAAVMAVISMVVIMTWSVDRGFLRYVNAMEQRQIDRLAAELEKRFAAAGNWDFLRREPAMLARLVAESLPAREEMPFEPGPPGPLPGDGMRPPPPPERMVHHLTERLLILDARREHVLPVDFSGDVAELKALRYKGAVAGYLGLAPRRKLSEAHQLRFIREQKLAVALVAGVVVCLAAGLSLLVAKRLVRPIRDLAGATGQLAAGRFDTRIPVASSDELGHLARDFNALALTLEKNEQARRQWVADISHELRTPLAVLRGEIEAIQDGVRQPSPDSIRSLHGEVLRLNRLVDDLYQLSLTDIGALAYRKEPLDLGRVLVGALVSYRAEFAGKGIAVREEISVRQPITVFGDAERLQQLFVNLLDNVLKYTDIGGELLVRLTCHDGAVTVDLQDSVPGVPEEALGMLFERLYRVEGSRSRARGGAGLGLAICRNIVEAHNGTITARYSPLGGVWIAVTLPVGEHQP

SEQ ID NO: 77292 - DNA, 1491 bp, Mycobacterium avium subsp. paratuberculosis str. k10
  CDS (1)..(1491): transl_table=11
ttggctgacacgcgccgggtctggtcgctgcggctgcggctgctggtcggacagatcgtcgtgctggcgctggtgtgtctgggcatcaccgcggtcaccgaactggcgctgaaccatcacctggtcaagcagctcgacggccaactcgccggaacctcgttccgttcggcgctgatgtaccccgagcccaaccatccgcgccacgagcactcgccgtatccgaggccgggccccggcccgcggttcctggacgccccggggcagccggcgggcatggtcgccgcggtggtcagccacggcaagaccgtcgacgccggctacctcaccagcagcggcgcccgggacgcgctgacgtcgaccgcccagacccaactcgaacagatcgccggcagccgcgcaccggtcaccgtgaacctggacggtctgggtcgctaccgcgtcgtcgccgcccccagccgcaacggcagcgacatcatcgtcaccggcctgtcgatggccaacatcgacgccaccctgatccggatgctggtcatcttcgggatcgtcaccgtgatcgcgctggcggccgcgaccatcgccggggtggtgatcatcaggcgggcactggcgccgttgcgccgggtggcacaaaccgcgcgcgaggtggccgacctgccgctggcgcgcggcgaggtcgaattgccggtgcgggtacgggaatcggacgccaacccgtccaccgaggtgggccagctcggcgccgcgctcaaccggatgctcgaccacatcgccgacgcgctgtcggcgcgccaggccagcgagacccgggtacgccagttcgtcgccgacgccagtcacgaactgcgcaccccgctggccgcgatccgcggctacaccgagctgacccagcgcatgggcgacgaccgcgaggcggtggcgcaggcgatgagccgggtggcctcggagaccgagcggatgacccggctggtcgaggacctgctgctgctggcgcggctggattccggccgcccgctggagcgcgaaccggtcgacctgtcccggctcgcggtggacgcggtcaacgacgcccacgtcgccggccctgaccatcagtgggaactcgacctgcccgaggaaccggtggtggtcaccggggacgcggcgcggctgcaccaggtgctgaccaacctgctcgccaacgcgcgggtgcacaccggcgcgggcaccgtggtgaccacccggctgagcaccgagccggcgcacaccgtgctgcaggtcatcgacaacgggccgggcattccggcggagctgcagtcggaggtgttcgaacggttcgcccgcggcgactcctcgcggtcgcgcaagggtggcagcaccgggctgggcctggccatcgtctcggcggtggtcaaggcgcacaacgggacgatctcggtgaacagctcgccgggccacaccgagttcacggtgcggttgccacccaacggatggcaaccgcacgcgtcggcgtag

SEQ ID NO: 77293 - protein, 496 aa, Mycobacterium avium subsp. paratuberculosis str. k10
MADTRRVWSLRLRLLVGQIVVLALVCLGITAVTELALNHHLVKQLDGQLAGTSFRSALMYPEPNHPRHEHSPYPRPGPGPRFLDAPGQPAGMVAAVVSHGKTVDAGYLTSSGARDALTSTAQTQLEQIAGSRAPVTVNLDGLGRYRVVAAPSRNGSDIIVTGLSMANIDATLIRMLVIFGIVTVIALAAATIAGVVIIRRALAPLRRVAQTAREVADLPLARGEVELPVRVRESDANPSTEVGQLGAALNRMLDHIADALSARQASETRVRQFVADASHELRTPLAAIRGYTELTQRMGDDREAVAQAMSRVASETERMTRLVEDLLLLARLDSGRPLEREPVDLSRLAVDAVNDAHVAGPDHQWELDLPEEPVVVTGDAARLHQVLTNLLANARVHTGAGTVVTTRLSTEPAHTVLQVIDNGPGIPAELQSEVFERFARGDSSRSRKGGSTGLGLAIVSAVVKAHNGTISVNSSPGHTEFTVRLPPNGWQPHASA

SEQ ID NO: 77294 - DNA, 1437 bp, Mycobacterium avium subsp. paratuberculosis str. k10
  CDS (1)..(1437): transl_table=11
atggtggtgacaaggcctcgacgcggactacccctgcgggtggggctggtcgccgccaccctggccctggtcgcctgcggtctggccgtctccggcatcgcggtcacgtcgatcctgcggcacagcctggtcagccgcatcgactccaccctgctcgacgcctcccgcggctgggcgcaggccccgcggcgccagtcgtcctcggcctacgagggcccggacccgggccgcccgccgtcgaagttctacgtgcgcggcgtcagcaccgacgggacgccgttcaccgccatcaacgaccgcaacgccgaaccggcgctgcccgccaacaacgacgtcggacccaacccgacgacgttgccctcggtgaacggttcggacatccagtggcgcgccgtgtcggtgcgcggcccgcacgggctgaccacggtggccatcgacctgtccgacgtccagcacaccgtcagctcgctggtctggctgcagatcggcatcggggtcgcggtgctggccgtggtgggcatcgccagcttcgcggtggtgcagcgcagcctgcggccgctggtcgaagtcgaacagaccgccgcggcgatcgccgctggccagctggatcgccgtgtgccggaacgtgatccgcgcaccgaggtgggccggctgtcgctcgcgctcaacggcatgctcgcgcagatccagcaggcactggcgtcctcggagtcctcggctgaaaaggcccgcggctccgaggaccggatgcggcgcttcatcaccgacgccagccacgagctgcgcaccccgctgaccaccatccggggattcgccgaactgtatcgccagggcgcggcccgcgacgtcgcgatgttgttgtcgcgcatcgaaagtgaggcctcgcggatgggcctgctggtcgacgacctgctgctgctggcccggctggacgtgcagcggccgctggaacaccaccgggtggacctgctggcgctggccagcgacgccgtgcacgacgcgcaggcgatggaccccaagcgcaccatcaccctggaggtcctcgacggccccggcaccccggaggtgttcggcgacgagccccgcatccggcaggtgctgggcaacctgatcgccaacgccctgcagcacaccccggaaagcgccgacgtcacggtgcgggtgggcaccgacggcgacgacgcggtcctcgaggtggccgaccggggtcccggaatgaacgagcaggacgcgtcgcgggtgttcgagcggttctaccgcaccgactcgtcaagggcgcgggccagcggcggtaccgggctggggctgtccatcgtcgagtcgctggtgcgcgcgcacggcggcaccgtcggcgtgacgaccgcgcccggccagggttgctgcttccgggtgacgttgccgcggatcagcgacgtgcccgcggttcaggccagctga

SEQ ID NO: 77295 - protein, 478 aa, Mycobacterium avium subsp. paratuberculosis str. k10
MVVTRPRRGLPLRVGLVAATLALVACGLAVSGIAVTSILRHSLVSRIDSTLLDASRGWAQAPRRQSSSAYEGPDPGRPPSKFYVRGVSTDGTPFTAINDRNAEPALPANNDVGPNPTTLPSVNGSDIQWRAVSVRGPHGLTTVAIDLSDVQHTVSSLVWLQIGIGVAVLAVVGIASFAVVQRSLRPLVEVEQTAAAIAAGQLDRRVPERDPRTEVGRLSLALNGMLAQIQQALASSESSAEKARGSEDRMRRFITDASHELRTPLTTIRGFAELYRQGAARDVAMLLSRIESEASRMGLLVDDLLLLARLDVQRPLEHHRVDLLALASDAVHDAQAMDPKRTITLEVLDGPGTPEVFGDEPRIRQVLGNLIANALQHTPESADVTVRVGTDGDDAVLEVADRGPGMNEQDASRVFERFYRTDSSRARASGGTGLGLSIVESLVRAHGGTVGVTTAPGQGCCFRVTLPRISDVPAVQAS

SEQ ID NO: 77296 - DNA, 1539 bp, Mycobacterium avium subsp. paratuberculosis str. k10
  CDS (1)..(1539): transl_table=11
atgacccgagaccgcgacaccgcatccgggggatttccccggtggtttccctcctcgctgcgccgccaactgctgttcggcgtgctggcggtggtcagcgtggtgctggtgacggtcggcttcgtctcggtgttgagcctgcgcggctacgtcaacgccatgagcgacgccgacgtcgccgaatcgttggacgcgttcagccaccagtacaccaaataccgcaacggcgaacatgtttcgccacatccgggcaccccgccgatccaacaggccatcctggaattcaccggccagacgccggggaatctgatcgcggtgctgcgcaacggcgccgtgatcggctcggcggtcttctccgaggacgaaccccggcccgcgccccccgacgtcgtccgcgacctcgccgcccagtcgtggaaggacagcccgccgcgcaccgaaatcctgggcaggctggggccgtaccgggtcaacagcaccgtgaacggctcggacgtgctggtggtcggggtgtcacacaacctggccgaccggatcatcgcgcgcaaacagctcaccaccgtggcgctgaccgcatcggcgctgctgctcaccgccgggctgacggtgtgggtggtcggctacacgctgcgcccgctgcgccggctggcggcgatcgccgcccacgtcgccgccatgccgctcaccgacgacgaccaccggatcacggtccgggtgcaaccgcaagacaccgacccgcaaaacgaggtcgggatcgtcgggcatgcgctgaatcggttgctggacaacgtggatagcgccctggcgcatcgggtcgactccgatctgcggatgcgccaattcatcaccgacgccagccatgagctccggacaccgctggccgccattcagggctacgccgaactgacccgtcaggacagctcgacgctgccgcccaccaccgaatacgcgctggcccgcatcgagtccgaggcgcggcggatggcgctcctggtcgacgagctgctgctgctttcccggctgggtgagggccaggacctgcagtccgaggacgtcgacttgaccgaggtggtcagcgacgcggtgaacgacgcgatggtggccgcccccacccaccactgggtcaaagacctgccggacgaaccggtctgggtgcgcggcgaccaggcccgactgcatcagctggtcagcaatctgctcggcaacgcccgcgtgcacaccccgcccggggtcacggtgacgaccgcgatccgctgtcaccgcggcggccgcgaggcgccgttcgccgagctgaccgtcaccgacgacggccccggcatcgacgcggacctgctgcccaacctgttcgagcggttcgtccgggccgacaagtcgaggtccgacggctcgggccacgggctggggctggccatcgtcagctcgatcgtcaaggcccaccacggctcggtgggcgtcgaatccaccgcgggcaggacggtgttccgggtccggctcccgctgatcggcggaccgggaacccttggcgtagcgggtctttga

SEQ ID NO: 77297 - protein, 512 aa, Mycobacterium avium subsp. paratuberculosis str. k10
MTRDRDTASGGFPRWFPSSLRRQLLFGVLAVVSVVLVTVGFVSVLSLRGYVNAMSDADVAESLDAFSHQYTKYRNGEHVSPHPGTPPIQQAILEFTGQTPGNLIAVLRNGAVIGSAVFSEDEPRPAPPDVVRDLAAQSWKDSPPRTEILGRLGPYRVNSTVNGSDVLVVGVSHNLADRIIARKQLTTVALTASALLLTAGLTVWVVGYTLRPLRRLAAIAAHVAAMPLTDDDHRITVRVQPQDTDPQNEVGIVGHALNRLLDNVDSALAHRVDSDLRMRQFITDASHELRTPLAAIQGYAELTRQDSSTLPPTTEYALARIESEARRMALLVDELLLLSRLGEGQDLQSEDVDLTEVVSDAVNDAMVAAPTHHWVKDLPDEPVWVRGDQARLHQLVSNLLGNARVHTPPGVTVTTAIRCHRGGREAPFAELTVTDDGPGIDADLLPNLFERFVRADKSRSDGSGHGLGLAIVSSIVKAHHGSVGVESTAGRTVFRVRLPLIGGPGTLGVAGL

SEQ ID NO: 77298 - DNA, 1404 bp, Mycobacterium avium subsp. paratuberculosis str. k10
  CDS (1)..(1404): transl_table=11
gtgttctccggcggggcgcgggcctgcagaatcgaaggcgtgcacctgggtatctccgcccgctcggcggcggtcgcggcgatcgtcgtcttctgcgcgctgacggtggccggcgcgggattggacgccatcctgtaccggtcgttgctgtccggcgtggattacgctgcggccgaacgggttcgcgacatcgccaaggcgctgcagtcggattcgcgcgaggaactcgacaacgccctgctgaccaccgaccagcgggtggtggccacccagttgatcggtccggacggcagcgtggtcaagcggtccggctccgcgccggccaccccgttggtgccgaccgccgatttcgacttcaccctgcgtcgcggcctgcccgacgacgcggtgtccggcgacgacatgcgggtcagcggccagaaggtcgccacccggtcgggggtgtacacggtgctggtcggcgggggcagcgaggcggtcgaggcgaccgcacgcaccctggcgatcctgttggccaccaccgcaccggtcatcgtcgcggtggcggccggcgcgacgtactggctggtgcgccgatcgctgaagtcggtggacgccatccgcgcccgggtggccgacatctcggcgtcggacctggccgagcgggtgccggtcccggacggccgcgacgagatcgcggccctggcggtcaccatgaacgagatgctgtcccggctggaagcgggacaccgtgcgcagcaacgctttgtcggcgacgcgtcacacgagctgcgcagcccgctgaccaccatcatctccgggctggaggtggccgaggcgcaccccgagctgctcgacgccgagctggcggtcaacaccctgctgcccgaggcgcaccggatgcgcgccctgatcgacgacctgctgctgctggcccgcgccgacgagcgaaacctgttgcggcgcaaggagccggtggccctcgacgacctcgccgaggcggaagctgcccgggtgcgccgcgacgccgactgcgcggtccacaccgacatccgcccggcgcggctgctcgccgacccgacggccatgacgcgcatgatccgcaacctggtggataacgctgtgcgccacgcggtttcgtgcgtcgccatcgaggtcggcagccgtgacgggacggcggtgctcaccgtcggcgatgacggcccgggcataccgccggcgcagcgaagccgggtgttcgagcggttcgtgcggctggacaccgatcgcgcgcgcagcggcggtggggccgggctgggcctggccatcgtcgccgaggtggtcgccgcgcacggcggcaccgtcaccatcggcgaccggccgggcgggggcaccaccctgacggtggccctgccgcaacacccggctcagcacagcagccggtaa

SEQ ID NO: 77299 - protein, 467 aa, Mycobacterium avium subsp. paratuberculosis str. k10
MFSGGARACRIEGVHLGISARSAAVAAIVVFCALTVAGAGLDAILYRSLLSGVDYAAAERVRDIAKALQSDSREELDNALLTTDQRVVATQLIGPDGSVVKRSGSAPATPLVPTADFDFTLRRGLPDDAVSGDDMRVSGQKVATRSGVYTVLVGGGSEAVEATARTLAILLATTAPVIVAVAAGATYWLVRRSLKSVDAIRARVADISASDLAERVPVPDGRDEIAALAVTMNEMLSRLEAGHRAQQRFVGDASHELRSPLTTIISGLEVAEAHPELLDAELAVNTLLPEAHRMRALIDDLLLLARADERNLLRRKEPVALDDLAEAEAARVRRDADCAVHTDIRPARLLADPTAMTRMIRNLVDNAVRHAVSCVAIEVGSRDGTAVLTVGDDGPGIPPAQRSRVFERFVRLDTDRARSGGGAGLGLAIVAEVVAAHGGTVTIGDRPGGGTTLTVALPQHPAQHSSR

SEQ ID NO: 77300 - DNA, 1443 bp, Mycobacterium avium subsp. paratuberculosis str. k10
  CDS (1)..(1443): transl_table=11
atgacgccgacgccgtcgctgcaacgccgggtgacgctggtggtgctggcgctgttgaccgtgctgctggtggtgctcggcgtcaccatcgacgtcacgatgggcgtgctcgcccgccgcaacctgcacgaccggctgctcgccgcgacgtcgcgggccgacgcgctgagcgccgcgcacaccgcccccgacctgctcgccgccgagctcaacggcggcgggatccgcgcgctcgtcgtcaccgcggacggccaggcctacggggaccgcgcgatcagccccgacctggccgaggggccggtcgaaccgcccccgccgtacccgccgccgttaccgccgccggcctacccgccgccgtacccaccgccctatccgcccccgcccggcccgccgccggatacgactgcgacggccgtcgtgcacccgttgcccgacggcgcgcggctgatcctggtcgccgacaccacgcaaaccactcaggtcacccggcaactgcggggtctgatgatcgccgccggcatcgtgaccctgctgatcgcggcgctgctgttgatcgcggtcagccgggcggccctgcgcccgctggaccggctcaccgcgctggccaacgccatcaccaccggggaccgcggccgccggttgcgcccgcaccgcgccgacaccgaattaggccgcgccgcaagcgctttcgacacgatgctggacgccctggagatgtcggaacgccgggcccaacaggccgcccaggccgcccagcgcgccgagacggcgacccggcgcttcctcgtcgacgccgcccacgagctgcgcaccccgatcgccggcatgcaggtcgccgccgagcaactcgcgcacggcgcctccgaacaccccgacgacgggcaataccgtcgggcgggcctgctgctctccgacgcgcgccgcgccgggcgactcgtcaacgacatgctggacctgagccgcatcgacgccgggcttccgctggaactgcacgacgtcgacgtggccgccgtgctgcgcgacgaagccgaccgggcggccctgctggcaccccaaatcggcgtgcgccgcacgggactcaccgcgctgaacgtccgggccgacgccacccggctgtcgcagatcgtgtccaacctgctcgacaacgctcgccgctacaccccgcccggcggcgccatcgagatcgacctgcgcgccggcgacggcgccgccgagatcaccgtcaccgacaccggcccgggcatcccggacgacgagcgggagcgcattttcgaccggctggtgcgcctggatgccggccgcgcccgcgaccacggcggcgccgggctgggcctggccatcgcccgggcgctggcccgcgcgcacggcggcgacctggtgtgcctgccgcatcggggcggtgcccggttccggctcacattgccgcgggcgaccacacagtga

SEQ ID NO: 77301 - protein, 480 aa, Mycobacterium avium subsp. paratuberculosis str. k10
MTPTPSLQRRVTLVVLALLTVLLVVLGVTIDVTMGVLARRNLHDRLLAATSRADALSAAHTAPDLLAAELNGGGIRALVVTADGQAYGDRAISPDLAEGPVEPPPPYPPPLPPPAYPPPYPPPYPPPPGPPPDTTATAVVHPLPDGARLILVADTTQTTQVTRQLRGLMIAAGIVTLLIAALLLIAVSRAALRPLDRLTALANAITTGDRGRRLRPHRADTELGRAASAFDTMLDALEMSERRAQQAAQAAQRAETATRRFLVDAAHELRTPIAGMQVAAEQLAHGASEHPDDGQYRRAGLLLSDARRAGRLVNDMLDLSRIDAGLPLELHDVDVAAVLRDEADRAALLAPQIGVRRTGLTALNVRADATRLSQIVSNLLDNARRYTPPGGAIEIDLRAGDGAAEITVTDTGPGIPDDERERIFDRLVRLDAGRARDHGGAGLGLAIARALARAHGGDLVCLPHRGGARFRLTLPRATTQ

SEQ ID NO: 77302 - DNA, 1695 bp, Mycobacterium avium subsp. paratuberculosis str. k10
  CDS (1)..(1695): transl_table=11
atgtggggctcccggcgacgtacgcggagccgctgggggcgctccggtccgatgactcgcggcatgggcgcggtgagccgggcggtgggcacggcctggcggcgctcgctgcagctgcgggtggtggcgctgaccctgggactgtccctggcggtcatcctggcgctgggcttcgtgctgacgtcccaggtcaccaatcgcgtgctcgacgtcaaggtgaaggccgccatcgagcagatcgagcgggcccgcaccacggtcggcgggatcgtcaacggcgaagaggcgcgctcgctggacagcagcctgcagctggcccgcaacacgctgacgtctaagaccgattcagcctcgggggcggggacggccggcaccttcgacgccgtgctgatggtgcccggtgacggcccacgcgcggccaccacggccggccccgtcgatcaggtgcccgcttcgctgcggggcttcgtcaaggccgggcaggcgtcctaccagtacgccaccgtgcacaccgacgggttctccgggccggcgctgatcgtcggcagcccggcctcctcccaggtggccaacctggagctgtacctgatcttcccgctgaagaacgaacaggccaccatccagctggtgcgcggcaccatgatcaccggcggcgccgtgctgctggtgctgctggccgggatcgcgctgctggtgtcgcggcaggtggtggtgccggtgcgttcggcgtcgcgcatcgccgaacggttcgccgaggggcatctgtccgagcggatgccggtgcgcggcgaggacgacatggcccggctggcgatgtcgttcaacgacatggccgagagcctgtcgcggcagatcacccaactggaggagttcggaaacctgcagcgccgcttcacttccgacgtgagccacgagctgcgcaccccgctgaccacggtgcgcatggccgccgacctgatctacgaccacagcgccgacctcgatccgacgctggcgcgctccaccgagctgatggtcaacgagctggaccggttcgagtcgctgctcaacgacctgctggagatctcccggcacgacgccggggtcgccgagctgtccgtcgaggcggtcgacctgcgcagcacggtgcagagcgcgctgagcaacgtggggcatctggccgaggacgccggcatcgaactgcaggtggagctgccggccgaggaggtcatcgccgaggtcgacacccgccgggtggagcggatcttgcgcaacctgatcgccaacgccatcgaccacgccgagcacaagccggtcaagatccggatggccgccgacgaggacaccgtcgcggtcaccgtccgcgactacggggtggggttgcggcccggcgaggagaagctggtgttcagccggttctggcgggcggacccgtcgcgggtgcgccgctccggcggcaccggcctgggcctggcgatcagcatcgaggacgcccggctgcatcagggccggctggaggcgtggggcgaaccgggcgtcggctcgtgcttccggctcaccctgccgctggtccgcggccacaaggtgaccaccagcccgctgccgatgaagccgatcccgcagccgtccccgtccggtgggcagtccccgtcgaccggcccgcaacacgcgaaagaccgtgcgcgccaacgcgagcacgccgaaaggtcgctgtga

SEQ ID NO: 77303 - protein, 564 aa, Mycobacterium avium subsp. paratuberculosis str. k10
MWGSRRRTRSRWGRSGPMTRGMGAVSRAVGTAWRRSLQLRVVALTLGLSLAVILALGFVLTSQVTNRVLDVKVKAAIEQIERARTTVGGIVNGEEARSLDSSLQLARNTLTSKTDSASGAGTAGTFDAVLMVPGDGPRAATTAGPVDQVPASLRGFVKAGQASYQYATVHTDGFSGPALIVGSPASSQVANLELYLIFPLKNEQATIQLVRGTMITGGAVLLVLLAGIALLVSRQVVVPVRSASRIAERFAEGHLSERMPVRGEDDMARLAMSFNDMAESLSRQITQLEEFGNLQRRFTSDVSHELRTPLTTVRMAADLIYDHSADLDPTLARSTELMVNELDRFESLLNDLLEISRHDAGVAELSVEAVDLRSTVQSALSNVGHLAEDAGIELQVELPAEEVIAEVDTRRVERILRNLIANAIDHAEHKPVKIRMAADEDTVAVTVRDYGVGLRPGEEKLVFSRFWRADPSRVRRSGGTGLGLAISIEDARLHQGRLEAWGEPGVGSCFRLTLPLVRGHKVTTSPLPMKPIPQPSPSGGQSPSTGPQHAKDRARQREHAERSL

SEQ ID NO: 77304 - DNA, 1452 bp, Lactobacillus johnsonii NCC 533
  CDS (1)..(1452): transl_table=11
ttgaagttattctatcaagaaattttaggttttttgctagtaataattactagtattgtaattattggctcatcaactattcattttgcgactattcaagcctattctcaaagttacactcgcttagaagaatatggaacttcgattggaaaactagctttagcgaaagataatcctaaacatgaattagatgctaaatttttgaaaaatttacaggtagtaatggaaggcgaagatgtaaatcttcgcatttttaataataaaaatagacaagtttatccagaaactacaatgaactgggctttaccgcaaaagttatttaagcaattaaagaatggtaaaaagattcgcattagaaatgatcatgaggatggacgagtaagttctttttcaaataaagatgcatatactagtgtaattgttccctggcgtagtaaaggaaaactggtgggagtaatctggatcggttcacgtgtgcaaaatgtggaacaaatgattgtacgagaaaagcataatctgttaacagctttacttagttctttagttattggcgggttgatcagttttatcttgtcgtactatatttcaagaaagattaagcttttatctaatgctactaagaaagtcgcacaaggggactttaatgtccatctaaaacacaaggatactgatgagattgatgatttagcacgtaattttaatattatggttaatgctttaaaagaatcaaacgatgaaattaaggcacaagaaaagcgacgagagcaatttatggctgatgccgctcatgaaatgcgaactccgcttactacaattaacggtttgttagaagggtttgaatatgatgctattcctgaagaggccaaacctaagtctattgctttaatgcacagtgaaacaaaacgattaattagattagtaaatgaaaacttagattacgaaaaaattagaaataataaaattagtctgattcaatcaaaattcaatgcgactgaagttttagctaatttattaacacaaatgaagcaaaaagctgctcaaaagaatgatgagttgattttaaattgtccgcagcaagttgaagtttatgcagataaagaccgtttcactcagataatggttaatctagttcaaaatgcattacaatttactgaaaatggaaagattacaatttctgctaagaggattgagcatggcgcccaatttaaaatagccgatacaggaattggaatgaataagaaacagatgaaatacatttttgaaagattctataaggcagatccatcgagagcaaaaattggctcgggagaatctggcttaggactttcgattgttttatctcttattaaacagcatggcggtaagattaacgtcgattcagaacctggaaagggtgcaacgtttaccgtaaccttatatgataagggttataaggaatttattaaagactaa

SEQ ID NO: 77305 - protein, 483 aa, Lactobacillus johnsonii NCC 533
MKLFYQEILGFLLVIITSIVIIGSSTIHFATIQAYSQSYTRLEEYGTSIGKLALAKDNPKHELDAKFLKNLQVVMEGEDVNLRIFNNKNRQVYPETTMNWALPQKLFKQLKNGKKIRIRNDHEDGRVSSFSNKDAYTSVIVPWRSKGKLVGVIWIGSRVQNVEQMIVREKHNLLTALLSSLVIGGLISFILSYYISRKIKLLSNATKKVAQGDFNVHLKHKDTDEIDDLARNFNIMVNALKESNDEIKAQEKRREQFMADAAHEMRTPLTTINGLLEGFEYDAIPEEAKPKSIALMHSETKRLIRLVNENLDYEKIRNNKISLIQSKFNATEVLANLLTQMKQKAAQKNDELILNCPQQVEVYADKDRFTQIMVNLVQNALQFTENGKITISAKRIEHGAQFKIADTGIGMNKKQMKYIFERFYKADPSRAKIGSGESGLGLSIVLSLIKQHGGKINVDSEPGKGATFTVTLYDKGYKEFIKD

SEQ ID NO: 77306 - DNA, 1458 bp, Bdellovibrio bacteriovorus HD100
  CDS (1)..(1458): transl_table=11
atgttcttaaagaaaatctataatttctttcaaagcttcagcattcgtctgcgcctgtcgctgatcttcgtgctgatcttcggcgcgaccacggtcttttttaacatgttcctgttccaaatgatgatcgacacccttcaacaggatttcgacgacgcacttttcaactattgcgtggacgtttcggacgggattgaaatcggcatcaagggcgatctcagttttccgcctctaagactggatcacggtaaaatcctgcccttcccgctgggaacagccctgattcaggtgcgccacagctccggcgccgtgctggcgcgcgtggggaatttcggtgaattcaatccgccttacaaaaaggatttcgaacgcatctggaagggtgaagaagccacctaccgtaccatcgaacacattcgcaacattccctctgccgaggccgattcctaccgtctgatctccttccccctggataacgccgccaagccccagttgatgctgcagattgcggtgcccatgactttgatggaaacgcagattcaaaagcgcctgacgctgttgcaactgggtattccgtttgtgttgttcatcgccaccctgggaggaatgttcttgtcggctcgtgcgctgaatccggtgaataacatcatcaaaattgccaaggaaatcaaagtcaccgaactttccaagcgcgtccccgttcccaatgccaacgatgaaatcaaacagctgtcactgacgctgaatgaaatgctggatcgtatccagcaggccttccagtcgcaggagcgcttcgttgcggacgcctcacaccagttgctgacgccgctgacgatcatgcggggtgaaatggagctgctgcaaaaaactgaaaagcgcgatgtggatcagttcattaaaagtgcgctgcaggaagtggacaatctgtccagcatcgtgcaggagatgctgctgttggcccgtgtggacgccgggattggcgcattaaatctggaagatctggattttgatgagctggtgtttgaagccctggctcgctgtgaaaaactggccaagtccaaggatatcaaattgaaagtcacgattaacaatgaaaccggcgaagagcacaaacgcattcgcggtgacaacgatctgctgacgaatctgattgtgaacatcgtggaaaatgccatcaagtattctccgaatcaggaagtggtttcagtcaccgtaaatcacggcaatgaaaacaccgagctgctggtggaagacaacggccccggcatcccggaagaacagttaccgttcatctttgaacgcttctcacgcgggtccaacatggagacgcgtgttaaaggctttggtctaggtttggcgatcgcacaaaaaatcgccatccttcacaatgccaagctaagtgcccagaatcactcagggaccggcgcgaagttcggatttgaaattaaaaacatttaa

SEQ ID NO: 77307 - protein, 485 aa, Bdellovibrio bacteriovorus HD100
MFLKKIYNFFQSFSIRLRLSLIFVLIFGATTVFFNMFLFQMMIDTLQQDFDDALFNYCVDVSDGIEIGIKGDLSFPPLRLDHGKILPFPLGTALIQVRHSSGAVLARVGNFGEFNPPYKKDFERIWKGEEATYRTIEHIRNIPSAEADSYRLISFPLDNAAKPQLMLQIAVPMTLMETQIQKRLTLLQLGIPFVLFIATLGGMFLSARALNPVNNIIKIAKEIKVTELSKRVPVPNANDEIKQLSLTLNEMLDRIQQAFQSQERFVADASHQLLTPLTIMRGEMELLQKTEKRDVDQFIKSALQEVDNLSSIVQEMLLLARVDAGIGALNLEDLDFDELVFEALARCEKLAKSKDIKLKVTINNETGEEHKRIRGDNDLLTNLIVNIVENAIKYSPNQEVVSVTVNHGNENTELLVEDNGPGIPEEQLPFIFERFSRGSNMETRVKGFGLGLAIAQKIAILHNAKLSAQNHSGTGAKFGFEIKNI

SEQ ID NO: 77308 - DNA, 1506 bp, Bacillus cereus ATCC 10987
  CDS (1)..(1506): transl_table=11
ttgaaaaagatatttaatccatttacttatgttaggaaatttcgagagttaatcggaaagctagtgaagagtgtgaaacggagtgtgcggattcaacttattactgcgttcactgcttgtgcgttattagggattttgtcagcgaaggcagcagcgccattttttgagaatgcgaatcgagaggcgacgatcgattatcggactggtatggaacaaattaaccaacaagcacaaagtgtggcaaatagttcagttcatgaaaataaattagaagctatatcaagtatgattgaaatagagaatcaaaatttagaacgagactctagagctttaaaagtattggttactgacgagagtggtaaagttttatataaaacgaagcaggcacaagaagaacaaattgatttgcataatacaattcgtaatgcatcatcgtttgcgattaattatatgaatggtagaaaagaatttgaaagtacgagaaaagaatttatagcctttgcgcctattacaatagaagataagaatttatacatgtttgttagtgggattccagaaggtgaagtaatatatgatacgcaagaaggaccattcccatttttaattggtgtactcgtattcattttttctttcttctatataacaaagagaaagatgaagcaaattgaagcgatggcagaaggtgtaaaggaaatagaaaaaggtaatttagcgtaccgtattgagaagaaaggtgaagacgagattgcgtctttaactgagaatattaataatatggcagaagagcttatgaataatatagaaaaggaacgtaaattagagaagcaaaaaaacgaacttattacgaatgtatctcacgatttacgtacaccacttacttctattatgggttacttacgattacttcgagattctaaatatgaaaataaagaacaacatgatgagtatacgagaattgcttttgcgaagtcggagcagttaaagaatttaatagaagatttatttgagtatacgaagttaacaaatgagcaagttatattagaaaaacaagaggtttgtataaatgagttactcgagcaattaatagaagagttagtaccgcaagcagaagagcatgggcttacgttcgttaagaagtttcctgaggaacgtgcctatgcagcgattgattcggaaaagatggttcgtgtatttgataatttattaatgaacgcgattaagtatagtaaagatgatggggagataaaagtttctcttcaaaggcagcgccgggatatacaaattgtaattgcgaatcatagtgaagcgtttacgagagaagagttagcgagtttgtttgaacgtttttataagaaagatcaatctagaagtagagtaacagaaggatcgggccttggattggcgattgcgaaaagtattgttgaattacaaggggggagtattcgagctgaatatgaggatggtgttattcagtttgtcgtctcgttgccaattatagaaagataa

SEQ ID NO: 77309 - protein, 501 aa, Bacillus cereus ATCC 10987
MKKIFNPFTYVRKFRELIGKLVKSVKRSVRIQLITAFTACALLGILSAKAAAPFFENANREATIDYRTGMEQINQQAQSVANSSVHENKLEAISSMIEIENQNLERDSRALKVLVTDESGKVLYKTKQAQEEQIDLHNTIRNASSFAINYMNGRKEFESTRKEFIAFAPITIEDKNLYMFVSGIPEGEVIYDTQEGPFPFLIGVLVFIFSFFYITKRKMKQIEAMAEGVKEIEKGNLAYRIEKKGEDEIASLTENINNMAEELMNNIEKERKLEKQKNELITNVSHDLRTPLTSIMGYLRLLRDSKYENKEQHDEYTRIAFAKSEQLKNLIEDLFEYTKLTNEQVILEKQEVCINELLEQLIEELVPQAEEHGLTFVKKFPEERAYAAIDSEKMVRVFDNLLMNAIKYSKDDGEIKVSLQRQRRDIQIVIANHSEAFTREELASLFERFYKKDQSRSRVTEGSGLGLAIAKSIVELQGGSIRAEYEDGVIQFVVSLPIIER

SEQ ID NO: 77310 - DNA, 1392 bp, Bacillus cereus ATCC 10987
  CDS (1)..(1392): transl_table=11
atgaagcgaatttctattcagctcggattttattttttaattgttacacttttaatcgaaagtgttctatttgtcttgctttattatagccttgtcaacaatagagtaaatgaagaaatgacagctttattaaagcgcggaaatagtcacagagatgtccttgaaaagtattttgataagcaaacaatttcccatgttgcgctaatggaatccgaggccgaaacgactgttgttattacaaatgcaaataaggatgtactagctaaatccaacgaaataaatactactataaaaagacatattgaaaagatgcaaacacggacagatcatgaaggcgcaattatagagaatcattggaaaacatctaattatatatgtacagttagtcccattgtaatagatggaaaacatgaaggctatgtgtacatgtttcttgggacagaatccattgaaaagatggtgaatgggctaacaagacaattcattattgctgggatcattacttttctattaacagccatcaccatctttctattatcacggttgttaacaaaaccattgttacacatgaaacatgccactgaaaaaatgagtaaaggcgatttatccgtttcattaacaactactcgaaatgatgaaattggtgaactagcctcatcaattcaaacacttgctaatgatttacattatatgaaaacagagcgaagtgaatttctagcaagtgttgctcatgaattacgaacacctttgacatacgtaagaggttacgctgacattgctttaaaagaaaccacatcttccaagcaacgtttacgatatttatctattataaaagatgaatctgattacattacaaacttagttcaagatttgttttcccttgcacaaatggaacaacataacttttctattcaagtaaaggaagtgcatttacacaacttcctgactcgcatagctgaaaaagtaaatgccatatataaagaaaaacacattagagtttctttctcttgtcctcctacactgctagtgaacctagatgaacaacgcttcgaacaagttgtggtgaacattttaaataacgcttatagacattcaaaagagtattctcttatccacatttctgttactgaagaacataaaagtatttccattacaattgaagatgaaggtgaaggtattccgcttgaagacctccctcacattttcgaccgcttttatcgagttgataaagcgagatcacgagctacaggcggaactggtttaggattatctatcgtgaaagaaattgtagagctacacggtgggaatattactgtaacgagtgaagtcgaccacggatcttgctttattatttcattgccatctatacaaaaacacgactaccatcagtag

SEQ ID NO: 77311 - protein, 463 aa, Bacillus cereus ATCC 10987
MKRISIQLGFYFLIVTLLIESVLFVLLYYSLVNNRVNEEMTALLKRGNSHRDVLEKYFDKQTISHVALMESEAETTVVITNANKDVLAKSNEINTTIKRHIEKMQTRTDHEGAIIENHWKTSNYICTVSPIVIDGKHEGYVYMFLGTESIEKMVNGLTRQFIIAGIITFLLTAITIFLLSRLLTKPLLHMKHATEKMSKGDLSVSLTTTRNDEIGELASSIQTLANDLHYMKTERSEFLASVAHELRTPLTYVRGYADIALKETTSSKQRLRYLSIIKDESDYITNLVQDLFSLAQMEQHNFSIQVKEVHLHNFLTRIAEKVNAIYKEKHIRVSFSCPPTLLVNLDEQRFEQVVVNILNNAYRHSKEYSLIHISVTEEHKSISITIEDEGEGIPLEDLPHIFDRFYRVDKARSRATGGTGLGLSIVKEIVELHGGNITVTSEVDHGSCFIISLPSIQKHDYHQ

SEQ ID NO: 77312 - DNA, 1848 bp, Bacillus cereus ATCC 10987
  CDS (1)..(1848): transl_table=11
atgagaaagaaaattgtatttcagttattttctcttacctttttactatgctgcatgatcatcgcaactatcttttttggacaaatgtatgtgatgaagtatatgtatgtagataaggaaaaagaaaatgttcagaaacaattaaaacaatattatacattttacgaagaacataaacaggatgaaaataaactccagagtaaagaactatcatatgcgaatcagcaaggtattatgattgctaggcttgatgaagtagcaaacattaagaaattaccatcaggagattactatataaaagcgactgataaaaataatccaagtcgaacatctaaagtcgtatttaataatttaattaacgcaaagagagatatggattctaattttagcattttaattacgagtttaatcgataagacgacccaaacagctatcatggatacagtgagtaaaggaccaaataaggatattgttgttcctacaacactaaggataaaaggatacgatggaaactttgtagctcctacatatcatcagacaatgaaatacatgatgtcaggcgctaaaaatggaattaaaattttttcaaaagaagaaagtgataaatattattacttagaaggacttgtaacagaaattagcttcccgaattatagcaacccagaaattgataacacgttgtacagtaatgaagtatttgcaaatcgtattttgcaatttcagtcggattggattagcgataaagtaaaattacgcggagaagaatgggtgcagaatgaaattagtatagatggaatcaagtatctagaaacgataaaaccactcatgaaagatggtcaagtaaaggaatttatttatacgctatcttcgttacaaccaattacaaaagcaacagatgtaatgagtgattattacatatatattatagtatttgtgctggttctatcgcttattgtatgtttttattactcgagaattatcactaagccattattaaaggttaatgaagcaacgaaaaaaataatggaattccagtttcaagacaagctttctatcaagtcgaaaaatgaaattggagagctttcctctaacattaatcagctctcagaaagaatggaagggtatatcaatcagttaaaaaaggacttagagaaagaaaagaaactagaacagacaagaaaagatttcattgcaggtgtttcacatgaattaaaaacccccctcagtgtgatgcaaatatctgcttccatgctgcaagatggtattgcacctgaaatgaatcaatactattgggacgcattagaaaaagaaatagagaaaatgaatgtactaattgatgaaatgttaaacttagctaaatatgaatcaggaacatatcaaatacagatggagcaagttaatatagttgacttaattcaaaaggcagaacaagatttacaagttcaaattgatgaaaaatccctacaaatcaaattaaatatagatgatgtgtgtgtcaaggggaaaacgaatttattggaacaggttataacaaacttgtttacaaatgcgattcgttatacagatgcaaaacaaatcattgtgattgatgtaaaagagaaacaacacgacgtatatatagggtttgaaaataaaggttcacatatagcagaagaaaatatagataaaatatgggatcagttctataggggcgataaatcaagaaaacgagtatgtggtggaacgggtcttgggctgtccattgtaaaaaatatatttgatttacatgatgcgaaatacggtgtgaccaacactgaagacggtgtattattctacttccgtttagaaaagtgggatggaaaacagtaa

SEQ ID NO: 77313 - protein, 615 aa, Bacillus cereus ATCC 10987
MRKKIVFQLFSLTFLLCCMIIATIFFGQMYVMKYMYVDKEKENVQKQLKQYYTFYEEHKQDENKLQSKELSYANQQGIMIARLDEVANIKKLPSGDYYIKATDKNNPSRTSKVVFNNLINAKRDMDSNFSILITSLIDKTTQTAIMDTVSKGPNKDIVVPTTLRIKGYDGNFVAPTYHQTMKYMMSGAKNGIKIFSKEESDKYYYLEGLVTEISFPNYSNPEIDNTLYSNEVFANRILQFQSDWISDKVKLRGEEWVQNEISIDGIKYLETIKPLMKDGQVKEFIYTLSSLQPITKATDVMSDYYIYIIVFVLVLSLIVCFYYSRIITKPLLKVNEATKKIMEFQFQDKLSIKSKNEIGELSSNINQLSERMEGYINQLKKDLEKEKKLEQTRKDFIAGVSHELKTPLSVMQISASMLQDGIAPEMNQYYWDALEKEIEKMNVLIDEMLNLAKYESGTYQIQMEQVNIVDLIQKAEQDLQVQIDEKSLQIKLNIDDVCVKGKTNLLEQVITNLFTNAIRYTDAKQIIVIDVKEKQHDVYIGFENKGSHIAEENIDKIWDQFYRGDKSRKRVCGGTGLGLSIVKNIFDLHDAKYGVTNTEDGVLFYFRLEKWDGKQ

SEQ ID NO: 77314 - DNA, 1377 bp, Bacillus cereus ATCC 10987
  CDS (1)..(1377): transl_table=11
atgaaatcactatattctagatttgtatttatgacagtcggtattatgctacttagtagtattatcggctttttattaacaaacgtatattatcaagtgaagttaaagccatataacagcgaaaagattttaaagtatgcggaagaagttaagtcattatatgaaaagcaaagcgaagaaaatcaagaggcgtacttacaatctattgcgaagttagggtatgaaatttatattgtcgatgatcaaaagaatggaaagcgtatcggcaatgcgtttcgtaagacgtctattagtgatgataccgttcataaagtattgcaaggtgaaacgtttaatggtgtttctacatatccgactcgcctatttattactggttttttcgataatgaattaataaatagtgttggtgtcccggtaaaacacggtgataaacagtacgctttatttattcgtcctgacattcagaaccaatttggcgagatgcgaattttcttagcggtattacttgggtttatcgtactattaagtattatctttatagcgattgcagcaggttacatcgttcgtccgattcgtaaatttacgaaggctacgcaaaaaattgcgagtggggaatatgaaattgaattagacgtaaaacgaaaagatgaaataggaacgttatctacaagcttccaaaagatgacgaaaagtataaaagaattagatgaaatgagacaagaatttgtttcgaacgtttcacatgaattccagtcgccgctttcttctatacaaggtttttcgaaaacgttgcaaacagaaaagatgagcatggaagaaagaaatcattacttacaaattattgaaggtgaaagtaagcgaatgtctagtttatgtaaacagttacttacgctcgcttcattagataaagaagagaaagtgttacaaataaaagaattcaatttgcagaagcaaattaaagacgtcatttttatgctcgaatggaaatggcgtgaaaaagatatcgccgttgaatttgatgtgccggatatcgtcataaaaggtgatgaaaaccttcttcatcaagtatggagtaacattttcacgaatagcattaagttttcaaacgatggtgggaccattgagttttttgtcgaagagttagagtctagtgttattatttctatatccgataacggaatcggtatggaacaagaagaaatggatcgtatttttgatcgcttttacaaggtggatacagcaagggcaagaaatgtagaaggtagcggtttaggattatcgatcgtgcaaaagattgtggaactgcataacggaaacgtttcagtttatagcacgaaaggggaagggacgaccgttcgggtggaacttcctaaatag

SEQ ID NO: 77315 - protein, 458 aa, Bacillus cereus ATCC 10987
MKSLYSRFVFMTVGIMLLSSIIGFLLTNVYYQVKLKPYNSEKILKYAEEVKSLYEKQSEENQEAYLQSIAKLGYEIYIVDDQKNGKRIGNAFRKTSISDDTVHKVLQGETFNGVSTYPTRLFITGFFDNELINSVGVPVKHGDKQYALFIRPDIQNQFGEMRIFLAVLLGFIVLLSIIFIAIAAGYIVRPIRKFTKATQKIASGEYEIELDVKRKDEIGTLSTSFQKMTKSIKELDEMRQEFVSNVSHEFQSPLSSIQGFSKTLQTEKMSMEERNHYLQIIEGESKRMSSLCKQLLTLASLDKEEKVLQIKEFNLQKQIKDVIFMLEWKWREKDIAVEFDVPDIVIKGDENLLHQVWSNIFTNSIKFSNDGGTIEFFVEELESSVIISISDNGIGMEQEEMDRIFDRFYKVDTARARNVEGSGLGLSIVQKIVELHNGNVSVYSTKGEGTTVRVELPK

SEQ ID NO: 77316 - DNA, 1920 bp, Methanococcus maripaludis S2
  CDS (1)..(1920): transl_table=11
atgaacactataccacctattaaacgattagggactaaattaataatttattccataatcacggcattaattccgatagtgatgcttggtgcggtatctactgacacgataaataccgaaatgaccaaacaagcacaggaaaaaataaatgatgatttaaatactgcagaaagtgtagtaaatctcaaactggataaaatttcttcattaaataagtatattatttcaaatgacaacacaattactagtctgaagaataataatactgcagagctaaaaactttggcaatatcctataaaaatacttctgcgccggatttcgtagttttttttgatgggcagggaaatgttgttgcaagatcaaattctgatgtaactggggataattcttacgaagatcttttcaaaaaagtagtaaacagtacaggatatacctcaatagaagttcttgacaaagattccataaaatacgaaaatgtaggcgaacttgtaaatattgatataaaaggaactgaagattcaataaactattcagacagtgtccaagacagtgcaatggctcttgtatccatagaaccaatttatgataaaaatggaaaactgcttggagctgcaatggctgccgatattttaaacaaagactattctattgttgatactgtaaaagatgcttcaaaagatgccacaaccatatttttagatggcgtcagggtttctactaatgttcaggacaacggcggaagggctattggaacccttgtttccgaggaagtttataatcacgttgttttggatggaaaaacctattatggtagggcctttgttgtaaacgaatggtatttgacagcttatgagccaatatatgattctgataataaaatcataggaatgctctttgtaggaactcctgaaagtaaatttttagcactgcaggcagatgttagaaatcaaacatttgtagttggattgatcgggttactaattgctttaatagtttcataccttataaatcgaggaataataaaaccactcgaacagttaaaacaaggagccgaatgggtaagtaacggtaggtacgatcaaaaagttattgttgattcagacgacgaatttggtgaacttgcaaaagcatttaataaaatggcaacccagatcaatatctcagatgacaaactaaaaaaacacgcagaagagttaaaaatatcctacaatgaattaaaagaacttgataagttaaaatcggaattaattgcagttgtttcacatgaattaagaacacctcttacatccataaaaggttacgttgaactggttttggatggaacaatgggcgcaataaatgattcccagaaaaagtgcctgcaggttgcagatgacaacatcgtaagacttagaagattgattgagagcatgctagatctttcaaaaatagagcgtggagaactcgagatgtatcgagaaaaggtaaatctaaggtcgattgtatgcgatgtaattgaatatttaaaaccgcttgccacagaaaagaatatcaaattaaataaggaagttgaagatattgcaattgaagcagataaagatagaattactcaagttttgacaaatctgatagaaaatgcgataaaattcagtcctgcaaatgaatccatacttgtaagcggtgttttagaagatgaacacatccatttaaaagtaacggatcgtggggcaggtattcctaaaaaagacatggaaaaaatatttaaccggttctaccaggttgattcatcaacaaaacggaaaaaaggtggatctggtcttggtcttgcagtatgtaaaagtattgttgaagcacacaagggttcgatatgggttgagagtgaacttggaaaaggaagtacattccatatcattcttccaatttctgcaaaagatcagtaa

SEQ ID NO: 77317 - protein, 639 aa, Methanococcus maripaludis S2
MNTIPPIKRLGTKLIIYSIITALIPIVMLGAVSTDTINTEMTKQAQEKINDDLNTAESVVNLKLDKISSLNKYIISNDNTITSLKNNNTAELKTLAISYKNTSAPDFVVFFDGQGNVVARSNSDVTGDNSYEDLFKKVVNSTGYTSIEVLDKDSIKYENVGELVNIDIKGTEDSINYSDSVQDSAMALVSIEPIYDKNGKLLGAAMAADILNKDYSIVDTVKDASKDATTIFLDGVRVSTNVQDNGGRAIGTLVSEEVYNHVVLDGKTYYGRAFVVNEWYLTAYEPIYDSDNKIIGMLFVGTPESKFLALQADVRNQTFVVGLIGLLIALIVSYLINRGIIKPLEQLKQGAEWVSNGRYDQKVIVDSDDEFGELAKAFNKMATQINISDDKLKKHAEELKISYNELKELDKLKSELIAVVSHELRTPLTSIKGYVELVLDGTMGAINDSQKKCLQVADDNIVRLRRLIESMLDLSKIERGELEMYREKVNLRSIVCDVIEYLKPLATEKNIKLNKEVEDIAIEADKDRITQVLTNLIENAIKFSPANESILVSGVLEDEHIHLKVTDRGAGIPKKDMEKIFNRFYQVDSSTKRKKGGSGLGLAVCKSIVEAHKGSIWVESELGKGSTFHIILPISAKDQ

SEQ ID NO: 77318 - DNA, 1332 bp, Yersinia pestis biovar Medievalis str. 91001
  CDS (1)..(1332): transl_table=11
atgttggtattgataaccatgcactggggcgtcaggaccagttttgaacgcggtttcattgactacatcaagcaaagtaatgaacagcggatcgccatgctaagtcatgcgcttgaaggcgaatatcagcactacggtaactgggattttctgcgtaataatgaccaagtgatttaccagatcatgcgatcctttgagcaaaaccaaaacagtgagagcagacccagtatgccgccccgtggctggcgcgcccaattttgggtggttgatcaagacaataatctgctggtcgggcactccgggcatctccccacagaagctagccgcagtgccataaaagtcaatgatcaggttgtcggctgggtgatttcgaccccatcggaaaaactgacccgtaatgcagatatcacctttgatcaacaacagcgccgcaccagttggtttattgttggcctctcgacgctgctggcggcggccgtcacatgggtactctcacgcggcatgttagccccagtaaaacggctggttgaaggcacgcatcggctggccgcgggggattttagcacccgtgttgccgtcagtagccgcgatgaactgggccacctggcacaagattttaaccagctagccagttcactggaaaaaaatgaacaaatgcgccgtgattttatggccgatgtctcccatgaactccgcacgccactggcagtattacgcggagaactggaagccttacaagatggcctacgccaacccacccccgagtcattaagttcgctccaagctgaagtggcgattttgacgaaactggtcaatgacctgcaccagttatcacagtctgatcgcggggcgctggcttaccgtaaaacccaactggatgtggtccggctattgcaagtggcgattgccagctttcatggccgcttccagaacaaaaagatgaccatcaccgcccacctgcctgaacacgcggttatttttggcgaccctgaccggctcaatcagttatttcacaatttactggaaaacagcctgcgttataccaacgaggggggggcattagaaattatcgcgttgatccaagaagagacactcacgctgcactggcaagacagtaaaccgggggttagcgatgaacagctcgagcgcctttttgaacgtttttatcgtacggaaagttcacgcaatcgcgccagtggcggctctgggttggggttggcgatttgccataatattgtcgatgcgcatagtggaaaaatcagcgctaaacattcacctttgggtggcctgcggattacggtagtattccccctatttcattccatagggtaa

SEQ ID NO: 77319 - protein, 443 aa, Yersinia pestis biovar Medievalis str. 91001
MLVLITMHWGVRTSFERGFIDYIKQSNEQRIAMLSHALEGEYQHYGNWDFLRNNDQVIYQIMRSFEQNQNSESRPSMPPRGWRAQFWVVDQDNNLLVGHSGHLPTEASRSAIKVNDQVVGWVISTPSEKLTRNADITFDQQQRRTSWFIVGLSTLLAAAVTWVLSRGMLAPVKRLVEGTHRLAAGDFSTRVAVSSRDELGHLAQDFNQLASSLEKNEQMRRDFMADVSHELRTPLAVLRGELEALQDGLRQPTPESLSSLQAEVAILTKLVNDLHQLSQSDRGALAYRKTQLDVVRLLQVAIASFHGRFQNKKMTITAHLPEHAVIFGDPDRLNQLFHNLLENSLRYTNEGGALEIIALIQEETLTLHWQDSKPGVSDEQLERLFERFYRTESSRNRASGGSGLGLAICHNIVDAHSGKISAKHSPLGGLRITVVFPLFHSIG

SEQ ID NO: 77320 - DNA, 1122 bp, Thermus thermophilus HB27
  CDS (1)..(1122): transl_table=11
atgcgcctcttccttaaactcttcctgagccacctcctggtggccctcctcgcccttttgctcctcctgctgctggcggaggccttcgcccccgccttctaccgggggcacgtggagcgcatgctccacgccctctccatgatggggggcggcatgatgggcgaggccctgaggcgggacctggaggaggggcttcgctccaccctcaccgccgcccttctcgccgctttacccctcgccgccctgggcgccctcctcaccgcctccttcgccagcctgcgcctcgccaggaccgcaaggctcctcgccgaggggagccgccggatggccgagggggagtacggggtccgccttccccttttggagcgggacgagctcggggagctcgccctccacttcaaccgcctggccgaggccctggagaaggtggagaagacccgggccgagctcatcggcaccgtggcccacgagctcagaacccccctggccgccctccaggggtacgcggaggggcttatggacggggtcctttccaaggagaaggccgcggaggggattctgcgggaggtgaaggccatgcgccgcctggtggaggacctttccttggtctcccgggtggaggcgaaggcggtggagatccgtcccaagcccctggaccccaagggcctcctcgaggaggccctggcccgcttccaaagcgccttccaggccaagggggtggcgctttccctggaggcccaagacccccttccccaggtgtgggccgacgaggaaagggtcctccaggtgctagccaacctcctcaccaacgccctccgccacaccccgcaaggcggcgaggtgcgccttagggccttccgccagggggaggccgtggccttccaagtggcggacaccggccccggcattcccgaggagcacctgccccacatctttgagcgcttctaccgggtggacaaggcacgtagccgcaaggagggaggaagcggggtggggctcaccgtcgccaagggcctggtggaggccatgggggggaggatctttgtggaaagccgggtgggcgagggaacaaccttcaccttcaccctccccctttacacgggcttaacgctcaagggttag

SEQ ID NO: 77321 - protein, 373 aa, Thermus thermophilus HB27
MRLFLKLFLSHLLVALLALLLLLLLAEAFAPAFYRGHVERMLHALSMMGGGMMGEALRRDLEEGLRSTLTAALLAALPLAALGALLTASFASLRLARTARLLAEGSRRMAEGEYGVRLPLLERDELGELALHFNRLAEALEKVEKTRAELIGTVAHELRTPLAALQGYAEGLMDGVLSKEKAAEGILREVKAMRRLVEDLSLVSRVEAKAVEIRPKPLDPKGLLEEALARFQSAFQAKGVALSLEAQDPLPQVWADEERVLQVLANLLTNALRHTPQGGEVRLRAFRQGEAVAFQVADTGPGIPEEHLPHIFERFYRVDKARSRKEGGSGVGLTVAKGLVEAMGGRIFVESRVGEGTTFTFTLPLYTGLTLKG

SEQ ID NO: 77322 - DNA, 1386 bp, Desulfovibrio vulgaris subsp. vulgaris str. Hildenborough
  CDS (1)..(1386): transl_table=11
atgtcttcggactcgcagacgccgtggcatagccgtctcgttgcgcggctggccatcatccacgcactgttcttctgcgtgtctgcactggccttcagtctggcggtgtacggctacatgcagcgtacccttgaagggcgcgacatggacatcgcccgtgaggcgttgcggcagttcacggccgtgaaggaggccacggacgaggaacgctacgatgccgcactcgaaatcatcaatctcattgggtcgcggcgccttatcgtacgccttgtcacaccgcaatccgacgagatgctcccctcgcccgaagactggacggagttcctctccgtcatggacgccaccccggccgatatggtgggacgcaacctcatcgtcgaaggggtggtgagcggggtcgaattgcgccttgtgacggggcgcctcgatgatggcaccatcgtgcaggtgggccatcgcgacttcaccagtcgcacgacgctgaccatgctcgggcgagctgccgccctgtgcttcctccccggcatcgtgctcgcgctgcttgcgggggcagccgccacgcgcacgtcgcttctcggtgtgtcgcgcgtgcgcgaggctgcgttacgcatctacaggggtgaccttacggcgcgggtccaacgcaccggcaacggggacgaggtcgacctgttggcagccacgttcaatctgatgctctctcgcatcgattcgctcatcgagaacatgcgaaggatgctcgacaatgtggcccacgatttgcgcacgccgttgacgcggttgcgcacacaggcggagatgaccctgctgaagggcgcatccgtcgaggaatgccgcgaccttctcgcccggcaactctcggaatacgacaggctggtacagatggtgggcatggtgctcgacctgtctgaagccgaatcgggtaccatgcagcttcggcgtaccagcttccccatgcgcgacctgctggaggaggtggaggagttcttcgcaccactggccgagggcgagggaatagccctttcggtggcatgccccaagtcgcttcagatggaggcggacagggaacggctgcgtcttgtgctgctcaacatgctggacaacgccttcaggttcacacccggtggttcggtgcgggtcgagggcgcggcgacggtgggtggggtggtcatcgccgtgtccgacacgggcgtaggcatcgccccggagcatcttgcccgcgtgttcgacaagctcttccgcgtcggtcgcggtgacaggccatccggtcatggactgggcctttcgctgtgcaaggccatcgtcgagcagcatggaggcagcatcgatgtggcgagcacacccggtgaagggacggtgttcagcatcttcctgccacagcactag

SEQ ID NO: 77323 - protein, 461 aa, Desulfovibrio vulgaris subsp. vulgaris str. Hildenborough
MSSDSQTPWHSRLVARLAIIHALFFCVSALAFSLAVYGYMQRTLEGRDMDIAREALRQFTAVKEATDEERYDAALEIINLIGSRRLIVRLVTPQSDEMLPSPEDWTEFLSVMDATPADMVGRNLIVEGVVSGVELRLVTGRLDDGTIVQVGHRDFTSRTTLTMLGRAAALCFLPGIVLALLAGAAATRTSLLGVSRVREAALRIYRGDLTARVQRTGNGDEVDLLAATFNLMLSRIDSLIENMRRMLDNVAHDLRTPLTRLRTQAEMTLLKGASVEECRDLLARQLSEYDRLVQMVGMVLDLSEAESGTMQLRRTSFPMRDLLEEVEEFFAPLAEGEGIALSVACPKSLQMEADRERLRLVLLNMLDNAFRFTPGGSVRVEGAATVGGVVIAVSDTGVGIAPEHLARVFDKLFRVGRGDRPSGHGLGLSLCKAIVEQHGGSIDVASTPGEGTVFSIFLPQH

SEQ ID NO: 77324 - DNA, 1392 bp, Bacillus thuringiensis serovar konkukian str. 97-27
  CDS (1)..(1392): transl_table=11
atgaaacgcatctctattcaattcggattttattttttaattgtcacacttttaattgaaagtgttctatttgttttgctctattatagtctcgtaaacactagagtaaatgaagaaatgactgctttattaaaacgtggaaacagccatcgtgatgtacttgaaaaatattatgatgagcaaacaatctctcacgttgcactaatggaatctgaagctgaaactactgtcgttattacaaatacaaataaagaagtgctagctaaatctaacgaaataaacacaactataaaagatcacattagtagcatgcaaacacgcacaaatcatgacggagcgattatagaaaatcactggaaaacatctaattatatatgtacggtcagtcccatcatagtagctggaaaagatgaggggtatgtgtatatgtttcttgggacagaatccattgaaaagttggtgaatggattaacaaaacaattcattattgctggtgccatcacgtttctactcacagtcattaccatttttcttttatctcggttattaacaaaaccattgttacacatgaaacatgccactgaaaaaatgagtaaaggcgatttatcggtttcgttaacaactactcgaaatgatgaaattggtgaactatcctcatcaattcaaacgcttgctaatgatttacattatatgaaaacagagcgaagtgaatttctagcaagtgttgctcatgaattacgaacacctttaacatacgtaagaggctacgctgacattgctttaaaagaaaccacatctcccgagcaacgtttgcgatatttatctattataaaagatgagtctgattacattacaaacttagttcaagatttattttcacttgcacaaatggaacaacataacttttctattcaagtaaaggaagtacatttacacactttccttactcgcatagtcgaaaaagtaaatgctatgtataaagaaaggtacattacagtttctttctcttgccctcccactctgctagtaaacttagatgaacaacgattcgaacaagttgtgatgaacattttaaataacgcttatagacattcaaaagaacattctcaaattcatatttctgttatagaagaaaataaacgtatctccattacaatggaagatgaaggcgaaggtattcctcctgaagacctccctcacattttcgaacgcttttatcgagttgataaagctagatcacgagctactggtgggactggtttagggctatctatcgtgaaagaaattgtagaactacacggcggaaatattactgtaacgagcgaagttgatcacgggtcttgttttacaatttcattgccatctataaagaaacacgactaccatcagtag

SEQ ID NO: 77325 - protein, 463 aa, Bacillus thuringiensis serovar konkukian str. 97-27
MKRISIQFGFYFLIVTLLIESVLFVLLYYSLVNTRVNEEMTALLKRGNSHRDVLEKYYDEQTISHVALMESEAETTVVITNTNKEVLAKSNEINTTIKDHISSMQTRTNHDGAIIENHWKTSNYICTVSPIIVAGKDEGYVYMFLGTESIEKLVNGLTKQFIIAGAITFLLTVITIFLLSRLLTKPLLHMKHATEKMSKGDLSVSLTTTRNDEIGELSSSIQTLANDLHYMKTERSEFLASVAHELRTPLTYVRGYADIALKETTSPEQRLRYLSIIKDESDYITNLVQDLFSLAQMEQHNFSIQVKEVHLHTFLTRIVEKVNAMYKERYITVSFSCPPTLLVNLDEQRFEQVVMNILNNAYRHSKEHSQIHISVIEENKRISITMEDEGEGIPPEDLPHIFERFYRVDKARSRATGGTGLGLSIVKEIVELHGGNITVTSEVDHGSCFTISLPSIKKHDYHQ

SEQ ID NO: 77326 - DNA, 1698 bp, Acinetobacter sp. ADP1
  CDS (1)..(1698): transl_table=11
ttgaaaatccgccgtgtaccgatagcacttcgactgttcctgacggttttattgacaacactggtcattacgacgttgagtctaggtgtattgcactggaccatgcaaaaaaactttgccaagtatgttgcagatgtagagatgcagaaacttgatcatctgattaccaatctggcgaatgtttataatatttatggtgattggggaaatgcgattcaggcgcaaattttacaaatcgaaggcaatgctgcaccagatgattatgatcgactctctcgctggtggttacggcggcaatatgatattgcattacagcagcgtttttttaatgaacaaaacatgattatgctttcaccgagtctggcgaatgaaaatcgactgaaaaatagaccgatattggatgaacaggagcgacgttttttacaggataatctaccttctgaatatcaaccatttgaaggtcttaagtttccactcaattcaaatcaaaattttttccgtccagacggtgacaacaagaaaaaagagccaccgcgagggcctgaaatggccaatctgatgcaccacgatgggaaaaaacgtttcattgccatgccagatcgtttaggtttaagttcgcgtctttcattatatgatgccaaacatcagttcattgtaggcgaatactccaatgagcaaatttcatatcgtccaattatggtcaatgatcgggtggtgggttatttaggcttaaaacctgtactagatgaagatgatgccttaagtattaatttttttagtaaccagaaacgatttttgttgctgatttacctgttttctgtattggcgagcttggtggcagcactgttacttgcaacctatttcaaaaaacctattcagcgtttgctgaatgccacacgagagctaacacgtggtcgctatcagcatcaggtagagattaaacgtaatgatgaactgggagacttggcaactgaactgaatcaattggccaaaattctgtatcaacatgaagaatctcgtcgtcaatgggtggcagatacctcacatgagttgaaaactccgttaagcgttttacaggctcagattgaagcgatgcaagatggtattcgtaaggcaacaccagaacatttagcagccatgatgagtcagatcagtagccttaaaaaactgactcaggatctggccgatctggctcaggccgatgcgcaacaattaaaatgttattttgctgaagtcgacccttgggatgttattttgcaagaagttgaaaactttaagcctaaaattgaacaggctcagctttctattgtagtagagggtgcaggcaccaagttacaattagatatagatcgctttaaacaaattatggtgaacttgctaagcaacagcgtacgttacaccgaagcaggtggacagattaagttgcatacacttcaagatgaagaacagtggagtgtgattgtggatgacagtcctttgggcttaaacgatgagcaactctctcgattgggtgagcgtttttatcgtgttgatgactcacgtacacgcagcactggaggtacaggattaggtctggcgttgtcatataagttagcacaggcgcttggcggtcaattacgttttgatcattcgcctttgggtggtctgcgttgcattctgacttttccaaaaacacattcaaatattaaggaaatttga

SEQ ID NO: 77327 - protein, 565 aa, Acinetobacter sp. ADP1
MKIRRVPIALRLFLTVLLTTLVITTLSLGVLHWTMQKNFAKYVADVEMQKLDHLITNLANVYNIYGDWGNAIQAQILQIEGNAAPDDYDRLSRWWLRRQYDIALQQRFFNEQNMIMLSPSLANENRLKNRPILDEQERRFLQDNLPSEYQPFEGLKFPLNSNQNFFRPDGDNKKKEPPRGPEMANLMHHDGKKRFIAMPDRLGLSSRLSLYDAKHQFIVGEYSNEQISYRPIMVNDRVVGYLGLKPVLDEDDALSINFFSNQKRFLLLIYLFSVLASLVAALLLATYFKKPIQRLLNATRELTRGRYQHQVEIKRNDELGDLATELNQLAKILYQHEESRRQWVADTSHELKTPLSVLQAQIEAMQDGIRKATPEHLAAMMSQISSLKKLTQDLADLAQADAQQLKCYFAEVDPWDVILQEVENFKPKIEQAQLSIVVEGAGTKLQLDIDRFKQIMVNLLSNSVRYTEAGGQIKLHTLQDEEQWSVIVDDSPLGLNDEQLSRLGERFYRVDDSRTRSTGGTGLGLALSYKLAQALGGQLRFDHSPLGGLRCILTFPKTHSNIKEI

SEQ ID NO: 77328 - DNA, 1368 bp, Erwinia carotovora subsp. atroseptica SCRI1043
  CDS (1)..(1368)
atgaaattcggaatcaccgccaagctgtttctcgccattttcgcgacctgcatgttggtactggtcaccatgcactggggcgtacgcgtcagcttcgagcgcggctttatcgactacattaagcgcggtaacgaacagcgggttacgcaactgcgtgatgcactggcggagcaatatcagctgcacggcgattggtcatttctgcgtaacaatgagcgtctggtattcaaaatgctgcactccatggatcagaacaacgacaccgataacagcatgcaagggtggcgagtgcgtctctgggtgctagatgcaaacaaacgcaaattgttcggatcgccggcaccgatacccaatgaaggcacctcgcagcccattcaggtacagaatcagaccgtcggctggattgtcgcttcgcccgttgaacgcctgacccgcaatgccgacatcagtttcgatcaacagcaacagcgcaccagttggctgattgtcgccctctcaatgctgctcgctatcattgccacctggctgaccgctcgcggcctgctcgcgcccgtcaaacggctggtcagcggcatgcacagcttggcgtcgggagatttcagcacgcgggtgacggcaagctcgcacgacgaactgggcaggctggcacaggatttcaaccagcttgccaagacgttggaaaaaaacgagcagtcccgccgcgcgtttatggccgatgtatcccacgagcttcgcacgccgctggcggtgctgcgcggcgaactggaagccttgcaggatggcgtgcgcaagcccgacgcacattctctgcactcgctccagtcggaggtcgccacgctcaccaagctggtggacgatctgcatcagctcacgctgtccgatcgcggcgcgctggcctaccgcaaaacgtctgtagacgtcgtgcaaatcctacacattgctatcgccgcgtttcatgaacgcttccagaaaaaacagattatgctcaccaccgattttccggctcaggctggcgtttttggcgatccagacaggctaagtcagttatttaataatttgctggaaaatagcctgcgttacaccgatgaacagggccagttggctattaccgtggttcagcagcataaacgctgggccattatctggcaggatagcgcccccggcgtcaccgacgagcagcttacgctgattttcgagcgcttttaccgtgcagaaagttcgcgcaaccgcgccagcggcggttccggtctggggctggctatctgcaataatatcgttgaggcgcatagcggacgtctgtatgctgaacattcgccattagggggagtgatgattaccattgagcttccgtcgcacgtacctgattaa

SEQ ID NO: 77329 - protein, 455 aa, Erwinia carotovora subsp. atroseptica SCRI1043
MKFGITAKLFLAIFATCMLVLVTMHWGVRVSFERGFIDYIKRGNEQRVTQLRDALAEQYQLHGDWSFLRNNERLVFKMLHSMDQNNDTDNSMQGWRVRLWVLDANKRKLFGSPAPIPNEGTSQPIQVQNQTVGWIVASPVERLTRNADISFDQQQQRTSWLIVALSMLLAIIATWLTARGLLAPVKRLVSGMHSLASGDFSTRVTASSHDELGRLAQDFNQLAKTLEKNEQSRRAFMADVSHELRTPLAVLRGELEALQDGVRKPDAHSLHSLQSEVATLTKLVDDLHQLTLSDRGALAYRKTSVDVVQILHIAIAAFHERFQKKQIMLTTDFPAQAGVFGDPDRLSQLFNNLLENSLRYTDEQGQLAITVVQQHKRWAIIWQDSAPGVTDEQLTLIFERFYRAESSRNRASGGSGLGLAICNNIVEAHSGRLYAEHSPLGGVMITIELPSHVPD

SEQ ID NO: 77330 - DNA, 1431 bp, Propionibacterium acnes KPA171202
  CDS (1)..(1431): transl_table=11
gtgatccgtcactggtggcggaggttactcgattggcgtccgcgtcccttgcgtatgaccatggggcgccgagtcagcctcctggtatcggtgtctgtcgtcgtcgcggtagctctgacctctttggcggcatggctcatgacgcgcatctcgctgtatagcgagctggacgagcagctcacccgaatggcggccactatctcgccaagtgtcgccgccgatcctcaaaacctcggtggtttggaagccagctcgttggccgccaccaacaccaccctcatcctggtacgcgccgacggccaagtcaccacagcccctggaactgaggtcaccgtcaccgcaggacctcaagagctagcagtcgcccgcaccgggatcggggttaaagcacacaccgtcattgactcccgcggtgttccggtgcgtatcgtcgcggtccccttcacctcagatggcgtccactacgctctcgtcacaggccaagacctcaccgggaccagggccaccctaggatcactatggatcgtcctcgtaggcaccggattcgtcggcatcgtgctcaccgccatcgctggatacgtggcaggcaactctgcaactagccctttgcgcgacctctcgcgagctgttcatcacgtcaccaccaccgaagacctgacacccatccaggtccactcccatgatgagctaggcgatcttgccgtgtcgttcaacaacatgctgtcctcgttgtcgaactcccgggagcgtcagaagcagctcatcgctgacgcctcccacgaactgcgaaccccactgacctcgatgcgcaccaacgtcgagttgctgatggccgatcagaagagccacatgctcccggaggaagcacgcggggagatccttgacgacgtcgccgcccagctcggtgagttctccagcctcattggcgacctcgtccagctctcgcgcgaggacgcccctcccccgcgcccggagtacttcgacttgtcagatgcggtatccaaagcggtcgagaggggacgacgacgcggcccgaacctggaattcgacgtccacctggagtcccatttggtgcttggtgacgaggccaccctggagcgggctgtcaccaacctgctcgataatgcggtgaagttctcccccgccggtggaactgtaacggtgtctatggagggcgacaccgtcgtcgtcagtgacgaaggacctggcatcgcggaggccgatctgccttatatcttcgatcggttttaccgctctgatcgcgcccgcaacacccccggaaccggcctcggcctgtcaattgtggctcataccgtcactagccatcagggttggatcaaagcgtcgcgggccccaagcggtggcgccatgttcacgatgtacttgccgcgagcagaacctccggttgaggagcccacggtattctcatga

SEQ ID NO: 77331 - protein, 476 aa, Propionibacterium acnes KPA171202
MIRHWWRRLLDWRPRPLRMTMGRRVSLLVSVSVVVAVALTSLAAWLMTRISLYSELDEQLTRMAATISPSVAADPQNLGGLEASSLAATNTTLILVRADGQVTTAPGTEVTVTAGPQELAVARTGIGVKAHTVIDSRGVPVRIVAVPFTSDGVHYALVTGQDLTGTRATLGSLWIVLVGTGFVGIVLTAIAGYVAGNSATSPLRDLSRAVHHVTTTEDLTPIQVHSHDELGDLAVSFNNMLSSLSNSRERQKQLIADASHELRTPLTSMRTNVELLMADQKSHMLPEEARGEILDDVAAQLGEFSSLIGDLVQLSREDAPPPRPEYFDLSDAVSKAVERGRRRGPNLEFDVHLESHLVLGDEATLERAVTNLLDNAVKFSPAGGTVTVSMEGDTVVVSDEGPGIAEADLPYIFDRFYRSDRARNTPGTGLGLSIVAHTVTSHQGWIKASRAPSGGAMFTMYLPRAEPPVEEPTVFS

SEQ ID NO: 77332 - DNA, 1659 bp, Leifsonia xyli subsp. xyli str. CTCB07
  CDS (1)..(1659): transl_table=11
atgcgcttccggtggccggacagggaatggtggcggcaggcgccgctgcgcttggcgagcctgtggcggcggtcgctgcaggtccggacggtggcgatcacgctgctgctcaccggggtcgccattctcatcacgggggtctacatggtgctcagcatcagcaacgacctgtaccagtcccggctctcggaggcccttcgcgactccagccgggcgacgacggcagcccaggccaccctcaacgcttcggatgtgtcggcgggcgacagcggcaagaacctgctcaccaccgcgctccagtcggtgcagggctcgacctccagccggctcgtcgccgcctaccgggtgccggggcaggacaccagcatcctcgcgccgcccgaccgcggcagtccggcgctgaacccggtcatatccgccccgctccggaccctggtgcagaacggagggacgaagcagttctaccagtccgtcgcgctgccggccgggaccggttcgaccgaccccggcatcgtcgtggggacccagctgacgctgccctcctacggccactacgagctctacatcggctacaatctgcgcgactccgagacgaccttgattttcgtccagaacacgctgctgttcgcgggcctcgcgctgatcgcgctgatcggcgggatcgcctgggtggtcgtccgtttcgtggtggagcccatccgggtcgcagcccacaccagcgagcggctggcggcgggggatctcgccgtccgcatcccggagcgaggtgaggacgtcctcgcctccctcgcccgctctttcaatgggatggccgacagcctccagaaccagatcaaccagctcgcgaccctgtcacagctgcaacagcgcttcgtctcggatgtgtcgcatgagctgcgcacaccgctgacgacgatccgcctcgccggggacgtcctctacgaccagcgcgacacgttcccgccggccaccgagcggaccgccgagctgctgcacacccaggtcgagcgtttcgaccgcctcctctccgatctcctcgagatcagtcgctacgacgccggttccgtcgcgctcgacctcgggccgaccaatctggtccggctggccggggaggtcatggacgagctgcgcaccctgtccgggcagaatggctccgtgctccgcctggatgcgcccggtgggcacttcgatgtcgggatggacccgcgccgtatccgccgcgtcgtccgcaatctcctcggcaatgcgatcgagcacggcgagggcaaacccgtcgtcgtcacggtcgacagcaacgagacggccgtcgcgctgaccgtccgcgacgacgggatcgggatgaaccagcaggacgtcaaccatgtcttcgaccgcttctggcgggctgacccgtcgcgcaaacgcacgatcggcggcaccggcctcgggctcgccatttcccttgaggatgtgacgctgcactccggatggcttcaggtgtggtcggccccgggggagggctcctgcttccggctgactctgccgcgggtccctggcggggagatcgccgcttcgccgctcccgctgccaccgatcgacgcggatgccgccgctggggcttcgcgccgtgccgccacggaggaaccgcgtcccctccccgagagcggagcacgcgcatga

SEQ ID NO: 77333 - protein, 552 aa, Leifsonia xyli subsp. xyli str. CTCB07
MRFRWPDREWWRQAPLRLASLWRRSLQVRTVAITLLLTGVAILITGVYMVLSISNDLYQSRLSEALRDSSRATTAAQATLNASDVSAGDSGKNLLTTALQSVQGSTSSRLVAAYRVPGQDTSILAPPDRGSPALNPVISAPLRTLVQNGGTKQFYQSVALPAGTGSTDPGIVVGTQLTLPSYGHYELYIGYNLRDSETTLIFVQNTLLFAGLALIALIGGIAWVVVRFVVEPIRVAAHTSERLAAGDLAVRIPERGEDVLASLARSFNGMADSLQNQINQLATLSQLQQRFVSDVSHELRTPLTTIRLAGDVLYDQRDTFPPATERTAELLHTQVERFDRLLSDLLEISRYDAGSVALDLGPTNLVRLAGEVMDELRTLSGQNGSVLRLDAPGGHFDVGMDPRRIRRVVRNLLGNAIEHGEGKPVVVTVDSNETAVALTVRDDGIGMNQQDVNHVFDRFWRADPSRKRTIGGTGLGLAISLEDVTLHSGWLQVWSAPGEGSCFRLTLPRVPGGEIAASPLPLPPIDADAAAGASRRAATEEPRPLPESGARA

SEQ ID NO: 77334 - DNA, 1386 bp, Yersinia pseudotuberculosis IP 32953
  CDS (1)..(1386): transl_table=11
atgataaggatcggcattaccggaaaactgtttatggctattttcgccacttgcatgttggtattgataaccatgcactggggcgtcaggaccagttttgaacgcggtttcattgactacatcaagcaaagtaatgaacagcggatcgccatgctaagtcatgcgcttgaaggcgaatatcagcactacggtaactgggattttctgcgtaataatgaccaagtgatttaccagatcatgcgatcctttgagcaaaaccaaaacagtgagaacagacccagtatgccgccccgtggctggcgcgcccaattttgggtggttgatcaagacaataatctgctggtcgggcactccgggcatctccccacagaagctagccgcagtgccataaaagtcaatgatcaggttgtcggctgggtgatttcgaccccatcggaaaaactgacccgtaatgcagatatcacctttgatcaacaacagcgccgcaccagttggtttattgttggcctctcgacgctgctggcggctgccgtcacatgggtgctatcacgcggcatgttagccccagtaaaacggctggttgaaggcacgcatcggctggccgcgggggattttagcacccgtgttgccgtcagtagccgcgatgaactgggccacctggcacaagattttaaccagctagccagttcactggaaaaaaatgaacaaatgcgccgtgattttatggccgatgtctcccatgaactccgcacgccactggcagtattacgcggagaactggaagccttacaagacggcctacgccaacccacccccgagtcattaagttcgctccaagccgaggtggcgattttgacaaaactggtcaatgacctgcaccagttatcacagtctgatcgcggggcgctggcttaccgtaaaacccaactggatgtggtccggctattgcaagtggcgattgccagctttcatggccgcttccagaacaaaaagatgaccatcaccgcccacctgcctgaacacgcggttatttttggcgaccctgaccggctcaatcagttatttcacaatttactggaaaacagcctgcgttataccaacgaggggggggcattagaaattatcgcgttgatccaagaagagacactcacgctgcactggcaagacagtaaaccgggggtcagcgatgaacagctcgagcgcctttttgaacgtttttatcgtacggaaagttcacgtaatcgcgccagtggcggctctgggttggggttggcgatttgccacaatattgtcgatgcgcatggcggaaaaatcagcgctaaacattcacctttgggtggcctgcggattacggtagtattccccctatttcattccatagggtaa

SEQ ID NO: 77335 - protein, 461 aa, Yersinia pseudotuberculosis IP 32953
MIRIGITGKLFMAIFATCMLVLITMHWGVRTSFERGFIDYIKQSNEQRIAMLSHALEGEYQHYGNWDFLRNNDQVIYQIMRSFEQNQNSENRPSMPPRGWRAQFWVVDQDNNLLVGHSGHLPTEASRSAIKVNDQVVGWVISTPSEKLTRNADITFDQQQRRTSWFIVGLSTLLAAAVTWVLSRGMLAPVKRLVEGTHRLAAGDFSTRVAVSSRDELGHLAQDFNQLASSLEKNEQMRRDFMADVSHELRTPLAVLRGELEALQDGLRQPTPESLSSLQAEVAILTKLVNDLHQLSQSDRGALAYRKTQLDVVRLLQVAIASFHGRFQNKKMTITAHLPEHAVIFGDPDRLNQLFHNLLENSLRYTNEGGALEIIALIQEETLTLHWQDSKPGVSDEQLERLFERFYRTESSRNRASGGSGLGLAICHNIVDAHGGKISAKHSPLGGLRITVVFPLFHSIG

SEQ ID NO: 77336 - DNA, 1377 bp, Symbiobacterium thermophilum IAM 14863
  CDS (1)..(1377): transl_table=11
gtgtcgcttcgcctgcggctcgccctgttctacacggggcagctcgtggttgccctgctgctgttcagcttcctgatgtacggcgtgctgcggtggaactacatccgggaggtggatgcctccctgtactccgtggcctggcgggtggccgagagcatgcagcggtactggcgtatcccgtcgctgaaaggcctcgccgaccggtcgaccttcatcctggtgcgcaccgacgagctggtcatcgcgcagtccaccgacttcggcaccttccccgtgcccgcggaggcgatggccggccgggccacctacaccaccgagcgggacgtcaacggggagccctaccggctctacaccctgcccgtctacgtcaacggcgagccggtgttctgggtgcaggtggcgcaacccttgcaactgttggagcgggtgcttacgaccctccggcccatcctcggcgccgggatcgccggcttcgccctcctcacgggcgccgcggcctggtggctggcgggccgggcgatcgccccggtgcagcgggtggccagcgcggcggagtctgtcgggcagtctgcggacctcagcctgcgggtgccgtaccaggggccccaggacgaggtgggccgcctcgtccacacgttcaacgggatgctggaccagttgcaggagctctacgcgcgcctggcgacggcggtggatgcccagaagcgtttcgttgccgacgcctcccacgagctgcgcacgccgctcaccatcatccggggcaacatcgactacctggagcgggccggcacactggaccctgaggccctcgccgacatgaaggcggaggccgcccgcatgtcggagctgctggaggagcttctggcgatggcccgggccgatgccggccagacgccggagctcgagccgctggccctgggcccgctggtgcgcgacgtctgccgccgggccggggccctgccgcatcaggtcgacttcgtggtcgagcttccgccggcgctggaccgaatcatggtgctgggccacgccgagtggctgcgccgcgccctgctcattctcctggacaacgcgttcaagtacacccccagcgggtcggtgaccgtgcgggccggccggcagggcgagggcgtcgtcctgcaggtgatcgacaccggccccggcattccgccggaggacctgccccgggtcttcgaccggttcttccgcggggacccggcccgttcccggggcggcagcgggctggggctggccatcgcgtcgtgggtggcgggcctgcacgggggccggctcaccgcggagagcaaggtcggcgaggggtcgacgttcagcctgtggctgcccgtctaccggccggccgcgggcggaacgaattcttag

SEQ ID NO: 77337 - protein, 458 aa, Symbiobacterium thermophilum IAM 14863
MSLRLRLALFYTGQLVVALLLFSFLMYGVLRWNYIREVDASLYSVAWRVAESMQRYWRIPSLKGLADRSTFILVRTDELVIAQSTDFGTFPVPAEAMAGRATYTTERDVNGEPYRLYTLPVYVNGEPVFWVQVAQPLQLLERVLTTLRPILGAGIAGFALLTGAAAWWLAGRAIAPVQRVASAAESVGQSADLSLRVPYQGPQDEVGRLVHTFNGMLDQLQELYARLATAVDAQKRFVADASHELRTPLTIIRGNIDYLERAGTLDPEALADMKAEAARMSELLEELLAMARADAGQTPELEPLALGPLVRDVCRRAGALPHQVDFVVELPPALDRIMVLGHAEWLRRALLILLDNAFKYTPSGSVTVRAGRQGEGVVLQVIDTGPGIPPEDLPRVFDRFFRGDPARSRGGSGLGLAIASWVAGLHGGRLTAESKVGEGSTFSLWLPVYRPAAGGTNS

SEQ ID NO: 77338 - DNA, 1380 bp, Symbiobacterium thermophilum IAM 14863
  CDS (1)..(1380): transl_table=11
atgacccgccgctggagcctgcggaccctggccctgaccgccgtgctggcggccctgctcctgcccctgctggccctgggcggcgggctcgtgggcacggtggccctcaacgccgggatggtcagcctggccgaggacgaggtggccgcggcggagcgggcggtcgcccggctggtgacggaacggtgggacgagctgggcggaccggcgttcgccgcggaactcggagagctgcagtctcgatggtctttcgccctggaggtgcgcggcctggatgaccgggtgcgctacgccagcccgtcggtggcggacggcagactggtgagcagcggctttcgcctcgagcccacccagcgggtccggcttctgcagcggaacggcgaaccgctgggcctcctggtgctctgggtctggccgcaggcggcgctctccggtgtgggcgccgcggccagggtgggcttcgggctcgcgctggcctcgctgctcgccctgctcgtgggggtgctggtctggaccggccgggcggtgctgcgcccgctgcgcgcgctggaggccgccacccgggcggtggccgagggcgacctggattttgccttgccccgctcgcgggtccaggaactggacgccctgggacaggccttcaccgcgatgcgggaccggctgcaggcggccctggagcggcaggcggcgctgcaggaggagcgccggcagctgatcgccgcgatcggccatgacctgcggacgccgctctcctcggtgcgcgccttcgccgaggggctgcgggacggcctcgcccgggagccggcgaaggcggcgcactacgccgacgtgatcctccggaagaccgcggaggtcgagcggctggtggaggacctgtttcagttctcccggctggagctgccggagacccgggcggcgctgcgggaggtggacctggccgcgttcctgaaggccaccctgggcgccttcggcgcgcaggccgagcagaagggggtggtcctggccgccgaggggcctgacctgacggccgggcttgacccggcgctgctgggccgcgccctcgacaacctgatcgccaacgccctgcgccacacgccccccggggggcagatccgcctcacctggggccgccacggcggggaggtgtgcatcgccgtggccgacaccggggagggcatcccgccggaggagctgccgcacctcttcacgcccatgcaccgccctgaccgctcccgttcccggcgcagcggcggggccggtctgggactggccatcgccgcccgcatcgcggcgctccacggcgggcggatcacctgcgagagccgggtgggggagggtaccacgtttacgctcatcctgcccgcggcgccgctgccctga

SEQ ID NO: 77339 - protein, 459 aa, Symbiobacterium thermophilum IAM 14863
MTRRWSLRTLALTAVLAALLLPLLALGGGLVGTVALNAGMVSLAEDEVAAAERAVARLVTERWDELGGPAFAAELGELQSRWSFALEVRGLDDRVRYASPSVADGRLVSSGFRLEPTQRVRLLQRNGEPLGLLVLWVWPQAALSGVGAAARVGFGLALASLLALLVGVLVWTGRAVLRPLRALEAATRAVAEGDLDFALPRSRVQELDALGQAFTAMRDRLQAALERQAALQEERRQLIAAIGHDLRTPLSSVRAFAEGLRDGLAREPAKAAHYADVILRKTAEVERLVEDLFQFSRLELPETRAALREVDLAAFLKATLGAFGAQAEQKGVVLAAEGPDLTAGLDPALLGRALDNLIANALRHTPPGGQIRLTWGRHGGEVCIAVADTGEGIPPEELPHLFTPMHRPDRSRSRRSGGAGLGLAIAARIAALHGGRITCESRVGEGTTFTLILPAAPLP

SEQ ID NO: 77340 - DNA, 1521 bp, Symbiobacterium thermophilum IAM 14863
  CDS (1)..(1521): transl_table=11
gtgaggcggccgggtcagtggccgctggccgtccagctggccctggcgtttgcgctggtcacggtcctggccctcggcggcagcggggcgctcctgctgtaccagaccacggcccggctgctggaggagcgggaggcgtccgtcatggcctgggggcaggctgcagcgggcctggcggccgagtactgggccgatccgcaggaaggcctgacgctggccttctaccgcttccaccagcagagcgggatgcggccggtggccgtggacggacagggagttgtcgtcgccgacatcacctcggagacggagctcctggggcagcggctgacgcacccggaggtccgggacgccctggccggccgggcgacggcaggcacccgccggctccccggcggcgagtgggtgatgtacgccggcgtgccggtggtcgtgggcgagcggctggtcggggcggtgctggtggcggcggacatcacctcggtgcgggaggcccgggacgacctgctccggcagctggcctgggtggccggggcgatggcgctcctggccgtgggggcgggcgtgatgctcgcacgctacctcacccggccgctggtccggctgcgggaggcggtgtcgtgcctggcccgcgggcggctggagacacgggtggtgccgggcggcagcagcgagctgctggacctcgggcgggggttcaaccgcatggccgaggagttgggaaggctggatcagcagcggcgggcgttcgtcgcggacgcctcccacgagctgcgcacgcccatcgcggcgatccgggcgctggccgagccgctgctcagcgaccggcctgtggatccggcgatctacaaggagcacctgcaggacatcgtgcacgagtgcgaccgggccggccggctggtgaacgcgctgctggagctggcccgcctggatatgcgggccggggcccgccgcgcggcgggcgacccggtcgagctgcgccggctggtggcggaggtggtgcacgccctggagccgctcgccgccgagcggggcgtgcggctggagctgcagccgggtctgccggtgacggcgccggccgacccgcagctgctggaggcggtggtgggcaacctggtggagaacggcatcaagtacaccccgcggggcggttccgtgcaggtggccgtaggcatcgggccggcggagcccgcacccgggccgggcggaagcgagccggacagcggcggatggcacgggacggtgtcggggggcgacgcgggggaggcgacccgcgggggtgcgcagccgggccaggtggcctgggtgacggtggcggactcgggcatcggcatcccgcccgagcacctgccgcacatcttcgaccgcttctaccgggtggacaaggcccggtcgcgcgccaccggcggcgcgggactcggcctggccatcgcggcggaggccgcagcgcgcctgggcggccggatccacgtggcgtcgaaggtcggcgagggcagccggtttacgctgacgctgccggtttaa

SEQ ID NO: 77341 - protein, 506 aa, Symbiobacterium thermophilum IAM 14863
MRRPGQWPLAVQLALAFALVTVLALGGSGALLLYQTTARLLEEREASVMAWGQAAAGLAAEYWADPQEGLTLAFYRFHQQSGMRPVAVDGQGVVVADITSETELLGQRLTHPEVRDALAGRATAGTRRLPGGEWVMYAGVPVVVGERLVGAVLVAADITSVREARDDLLRQLAWVAGAMALLAVGAGVMLARYLTRPLVRLREAVSCLARGRLETRVVPGGSSELLDLGRGFNRMAEELGRLDQQRRAFVADASHELRTPIAAIRALAEPLLSDRPVDPAIYKEHLQDIVHECDRAGRLVNALLELARLDMRAGARRAAGDPVELRRLVAEVVHALEPLAAERGVRLELQPGLPVTAPADPQLLEAVVGNLVENGIKYTPRGGSVQVAVGIGPAEPAPGPGGSEPDSGGWHGTVSGGDAGEATRGGAQPGQVAWVTVADSGIGIPPEHLPHIFDRFYRVDKARSRATGGAGLGLAIAAEAAARLGGRIHVASKVGEGSRFTLTLPV

SEQ ID NO: 77342 - DNA, 1389 bp, Bacillus cereus ZK
  CDS (1)..(1389): transl_table=11
atgaaacgaatttctattcagctcggattttattttttaattgttacacttttaatcgaaagtgttctatttgttttgctttattatagccttgtcaacaatagagtaaatgaagaaatgacagctttattaaagcgcggaaatagtcacagagatgtccttgaaaagtattttgataagcaaacaatctcccatgttgcgctaatggaatccgaagccgaaacgactgttgttattacaaatgcaaataaggatgtactagccaaatccaacaaaataaatactactataaaaaagcatattgaaaagatgcaaacacggacagatcatgaaggtgcaattatagagaatcattggaaaacatctaattatatatgtacagttagtcccattgtagtagatggaaaacatgaaggctatgtgtacatgtttcttgggacagaatctattgaaaaaatggtgaatgggctaacaatacaattcattattgccggagtcattacgtttctattaacagccattaccatctttctcttatcacggttgttaacaaaaccattgttacacatgaaacatgccactgaaaaaatgagtaaaggtgatttatccgtttcgttaacgactactcgaaatgatgaaattggtgaactagcatcgtctattcaaacgcttgctaatgatttacattatatgaaaacagagcgaagtgaatttctagcaagtgttgctcacgaattacgaacaccattaacgtacgtaagaggttacgctgatattgctttaaaagaaagcacatctcctgagcaacgtttgcgatatttatctattataaaagatgagtctgattacattacaaacttagttcaagatttattttcacttgcacaaatggaacaacataacttttctattcaagtaaaggaagtacatttacacaccttcctgactcgcatagtcgaaaaagtaaatgctatgtataaagaaaggtacattacagtttctttctcttgccctcctactctgctagtaaacttagatgaacaacgattcgaacaagttgtgatgaacattttaaataacgcttatagacattcaaaagaacattctcatataaacatttctgttacagaagaacataaacgtatttctattacaattgaagatgaaggcgaaggtattccgtctgaagatctccctcacattttcgatcgcttttatcgagttgataaagcaagatcacgagctaccggtggaactggtttaggactatctattgtgaaagaaattgtagaactacacggcggaactattactgtaacgagcgaagtcgatcacgggtcttgctttattatttcattgccatctatacaaaaacacgactattattaa

SEQ ID NO: 77343 - protein, 462 aa, Bacillus cereus ZK
MKRISIQLGFYFLIVTLLIESVLFVLLYYSLVNNRVNEEMTALLKRGNSHRDVLEKYFDKQTISHVALMESEAETTVVITNANKDVLAKSNKINTTIKKHIEKMQTRTDHEGAIIENHWKTSNYICTVSPIVVDGKHEGYVYMFLGTESIEKMVNGLTIQFIIAGVITFLLTAITIFLLSRLLTKPLLHMKHATEKMSKGDLSVSLTTTRNDEIGELASSIQTLANDLHYMKTERSEFLASVAHELRTPLTYVRGYADIALKESTSPEQRLRYLSIIKDESDYITNLVQDLFSLAQMEQHNFSIQVKEVHLHTFLTRIVEKVNAMYKERYITVSFSCPPTLLVNLDEQRFEQVVMNILNNAYRHSKEHSHINISVTEEHKRISITIEDEGEGIPSEDLPHIFDRFYRVDKARSRATGGTGLGLSIVKEIVELHGGTITVTSEVDHGSCFIISLPSIQKHDYY

SEQ ID NO: 77344 - DNA, 1317 bp, Burkholderia pseudomallei K96243
  CDS (1)..(1317): transl_table=11
gtgaggtcgattcgccatcaattgctgatctggctgctcgcgatcgtcgtggccggcgtggggctcgccggctggatgatctaccggcaggcgcttgccgccgccaacgagctgttcgactatcagctgcagcagatcgcggccgcgctgccgtccgagccgttctcgcaggtgctcggctcgcagacgaacggcgacgaagggatcgtgatccagatctggaaccgcaacggcgtgctgatgtacttctcgcatccgcgcgcgccgatcgccccgcgcgccgagctcggcttctcgaccgagcgcaccgagcgcggcgcgtggcgcgtgtacggcgcgatcgtcggcgacaacgtcgtgcagctcgcgcagccgctatcggtgcgcaaccggctcgccgcgagcgtcgcgctgcgcacgctctggccgctcatcgtgctgctgcccttcctcggcgcggccgtctggatgatcgtcgggcgcgggctcgcgccgctgcagcgcgtgacccgcgcagtcgaggcacgccggcccgaggcgctcgatccgctgcccgattcgccgctgccgctcgaggtgcgtccgctcgtgcgcgcgctcaacgggctgcttgcacggctgtcggccgcgctcgacacgcaaaaggcgttcgtcgcagacgccgcgcacgagctgcgcacgccgcttgccgccgtgcagattcaagcgcaactcgtcgcgcgtgcgcaggacgacgtgtcgcgccgcgaggcgatcgtcgatctgcaaagcggcgtcacgcgcgcgacgcgcctcgccgagcagttgctcgcgctcgcgcgcgccgaacccggcgacgcgacggtgcgcgagcgcgtcgatctgcgcgcgatcgtcgaagagtgcgtcgccgcacacgcgccgctcgcgcagcggcgcgacatcgatctgggcttcgagcgggtcgaggacgcgagcgtggacgccgatcccgccgcgttgcgcgtgatgttcaacaacctgctcgacaacgcggtgaagtacacgccggcgggcgggcgcatcgacgtgtcgctcacgcgcggcgaaggcgcgcgtgcgtgcgtgcagattggcgacagcggccccggcatcccggccgccgagcgcgagcgcgtattcgatcgtttctaccgcgacacgtccgcgcgggcgcgcaccgacgtcgcgggcagcggcctcggtctcgcgatcgtcaagcgggtggccgcgcagcagcgcgcgagcgtgacgctcggcgaggcggcggcgggcgggctgctcgtcagcgtctcgctgccgtgcgtgggccccgcgtga

SEQ ID NO: 77345 - protein, 438 aa, Burkholderia pseudomallei K96243
MRSIRHQLLIWLLAIVVAGVGLAGWMIYRQALAAANELFDYQLQQIAAALPSEPFSQVLGSQTNGDEGIVIQIWNRNGVLMYFSHPRAPIAPRAELGFSTERTERGAWRVYGAIVGDNVVQLAQPLSVRNRLAASVALRTLWPLIVLLPFLGAAVWMIVGRGLAPLQRVTRAVEARRPEALDPLPDSPLPLEVRPLVRALNGLLARLSAALDTQKAFVADAAHELRTPLAAVQIQAQLVARAQDDVSRREAIVDLQSGVTRATRLAEQLLALARAEPGDATVRERVDLRAIVEECVAAHAPLAQRRDIDLGFERVEDASVDADPAALRVMFNNLLDNAVKYTPAGGRIDVSLTRGEGARACVQIGDSGPGIPAAERERVFDRFYRDTSARARTDVAGSGLGLAIVKRVAAQQRASVTLGEAAAGGLLVSVSLPCVGPA

SEQ ID NO: 77346 - DNA, 1401 bp, Methylococcus capsulatus str. Bath
  CDS (1)..(1401): transl_table=11
gtgatcctcggtttacgggcacgtctgatcctcgtccacctggccgtcgtcgtcatcgtgctggcctgctccgccgccggcgcctactggatgctgcgccaggcggtccacagtcggctcgacgccgcgctgctggcccttgcggaaaccgaacgggcgatgctgctggaaggcggagaacagtcgatcaagatccatgaagccgcccccggccccgcgcctccctccttcatccgtctcgaccggctggtgcagattgtcgacggcgacggccgcgttctggcacgtagcgcaaacctcggcaccgctcggcttccctcgccgcccggcctgctgtcgcgcctgagccggggggaaacggtcttcgacaccctcccggcgttcggcgaggaaccggttcgaatggtatccattccggtacggaaggacggttcgcgactggcgatccaggttgccggatcactggatgacgcaagaaacgtcatgaaatcggccggcctgttgttcatcgtcatgacctccggtttgctggtggcggtaggcattgccggcacatcgctgactcgcagggcattccacgcgatcgacgaggtcgtccgtcaagcccgccggatcggtgaggccaacctcggcgaacgtctccctcatccgggcagccgcgacgaaatcggcagactggtcgacacgctgaacgagatgctcggtcgtctggagcggagcttcgaggtccagcgccgcttcacggctgacgcctcccacgaacttcgctcgcctttgtcccgactgcgcgcggaactcgaaatcaccctccgtcgcccccggcgcccggacgaatatgaacggaccctgcactcctgcctcgaggaagtggaacggctgacccaactggtggaagcactgctcgaattggcacggctcgacgcacagcaggaagccattcccggcgagaacgtttgcctgaacacggttctggccgaagtcgtgcgtcgccagcaaccgctggcgcaggaacgctcgatcgggatcgtcgtcgaaacctcgcaacccgtgaccgcctgggtgtccggcgcttcgatcggcgtcgttttctccaacgtcctggagaacgccttgaagttctcgccacccggcggaaccgtccacatcggactggctgccgacgcacgggaggcggtagtgagcatttgcgacaacggaccgggaatcgagcccggcgaaaaagaccggctgttcgagcgttttttccggggttcggtcgcccgctccggtgctatgcccggaaccggcctgggcctcgcgctgtcacaggccctcgtccggcattgcgggggaaccatcgaagccacgaatatcccggggggcggcgcccggttcacgatacgcctgccattgggaccctga

SEQ ID NO: 77347 - protein, 466 aa, Methylococcus capsulatus str. Bath
MILGLRARLILVHLAVVVIVLACSAAGAYWMLRQAVHSRLDAALLALAETERAMLLEGGEQSIKIHEAAPGPAPPSFIRLDRLVQIVDGDGRVLARSANLGTARLPSPPGLLSRLSRGETVFDTLPAFGEEPVRMVSIPVRKDGSRLAIQVAGSLDDARNVMKSAGLLFIVMTSGLLVAVGIAGTSLTRRAFHAIDEVVRQARRIGEANLGERLPHPGSRDEIGRLVDTLNEMLGRLERSFEVQRRFTADASHELRSPLSRLRAELEITLRRPRRPDEYERTLHSCLEEVERLTQLVEALLELARLDAQQEAIPGENVCLNTVLAEVVRRQQPLAQERSIGIVVETSQPVTAWVSGASIGVVFSNVLENALKFSPPGGTVHIGLAADAREAVVSICDNGPGIEPGEKDRLFERFFRGSVARSGAMPGTGLGLALSQALVRHCGGTIEATNIPGGGARFTIRLPLGP

SEQ ID NO: 77348 - DNA, 1536 bp, Nocardia farcinica IFM 10152
  CDS (1)..(1536): transl_table=11
gtgagcacggggcgaccgggccgggacgccgcccgcaccgcgccgggccggttgcggcaggggcgcgagtggatcggccaccggctcggcgccgtgccgttgcgggtgaccctggtgctcgcgctggtggtgttcgccgggctcggcctgctggtctccggcacggtggtcacctcggcgctggagaagtcgctgctggcccgcaccgatcagcagttgcgcgacgcggtgacgacgcgcccacgggtgcgcccgacggtgccgccgccggccaccgatccacgcaccccgccgagcccgttctacatcgtcagcgaaagcacctcgggcgccggcacgctcgtgctgcggccgttcaacgtggacgccgcacccgacctgtccggcacgcccgtgggtgaaccggtgaccgtcgactcggtgggtgacgcgccggtgcgctggcgggtgctcaccgtcgtcagcggcgacgaccgcaccacgatcgcgctgccgatgacgcagaacgaggagaccgtgcagcggctggtgatgctgcaagtggtggtgggactggcggtgctggcggtgttggcgctggccgcctatttcgtgatccggcgcagtctgcgcccgctgcggcgggtggagaacatcgccgccgccatcgcgcgcggcgatctgttccgccgcgtcccggtgcgcggcaccaacaccgaggtggaccggctctcccgctcgctgaacgggatgctggcccagatccagtcggccttcgccgcgacggaggcctcggaggcggcggcgcgggaatcggaggccaggatgcgccgcttcgtcgccgacgccagccacgaactgcgcaccccgctgacgacgatccgcggcttcgccgagctgtaccggcagggcgccaccaccgatcccgcgatgttcatggaccgcatcgagcacgaggcgcggcggatgggcctgctggtggaggatctgctcatgctggcgcgcctggacgcgcaacgcccgctcgagatcggcaccgtggatctgctgacggtcgcgggcgacgcggtgcacaacgcccgcgcggtggccgcggcggcggacccggccggcccccggcgccggatcgaactcgacgtccacgcgggcacgggcaccctggaggtgcccggcgacgaggaccggctgcgacaggtgctggcgaatctgctcaacaacgcgctgacgcacacaccaccggacgccgcggtgaccgtccggctcaccccggagcccgacgaggtgatcctggcggtcgccgacaccggccccgggctcacgccggaggccgccgagcgggtgttcgagcgcttctatcgcaccgacgtctcccgggcgcgggccagcggcgggtcggggctcgggctgtcgatcgtgcaggcgctggtggtggcgcacggcggcagcgtgtcggtggacagtgcccccggcgcgggcgcgacgttcaccgtgcggctgccgcgagcgggccgccgtgccccgcaccggggcgcggccgggaacgtcagatcggcgtga

SEQ ID NO: 77349 - protein, 511 aa, Nocardia farcinica IFM 10152
MSTGRPGRDAARTAPGRLRQGREWIGHRLGAVPLRVTLVLALVVFAGLGLLVSGTVVTSALEKSLLARTDQQLRDAVTTRPRVRPTVPPPATDPRTPPSPFYIVSESTSGAGTLVLRPFNVDAAPDLSGTPVGEPVTVDSVGDAPVRWRVLTVVSGDDRTTIALPMTQNEETVQRLVMLQVVVGLAVLAVLALAAYFVIRRSLRPLRRVENIAAAIARGDLFRRVPVRGTNTEVDRLSRSLNGMLAQIQSAFAATEASEAAARESEARMRRFVADASHELRTPLTTIRGFAELYRQGATTDPAMFMDRIEHEARRMGLLVEDLLMLARLDAQRPLEIGTVDLLTVAGDAVHNARAVAAAADPAGPRRRIELDVHAGTGTLEVPGDEDRLRQVLANLLNNALTHTPPDAAVTVRLTPEPDEVILAVADTGPGLTPEAAERVFERFYRTDVSRARASGGSGLGLSIVQALVVAHGGSVSVDSAPGAGATFTVRLPRAGRRAPHRGAAGNVRSA

SEQ ID NO: 77350 - DNA, 1467 bp, Nocardia farcinica IFM 10152
  CDS (1)..(1467): transl_table=11
atggcacgaagcgcgccccggcggcccgccgtcgccccggtcggccggccggtcgaaccgccgccgatgcgtccgccgatgcccctgaccagttcggtgtcgctgcgctggcgggtcaccctgctggccgcctcggtggtggcgatcgcggtggcggtcacctcgatcgccgcctacgcgatggtggccagggcgctctacgccgatgtcgacgagcagctgcgcgcccgcgccgccaccatgatcgacaacaatttcgacagcctgggtttccaatcgatcatcctggccgggctgtactccaacgatgtcggcgtggcgctgatcttcgccgaccacaagtcctacatgcccccgcagcagaccattccgccggtgggcgagcaggaactcggggtcgccgacggccagctcgcctcctcgctgcgcacggtgagcagccagcgggtgctggccgtgcacaccaactccggcgccacgctggtcatctcgcagcggctcgaaccgaccagggaggtgctcgaccggctggcctggctgctgttcgtggtgggcggctgcggcgtggtcctcgcggccgcggcgggcaccgcggtgggccgcaccggcctgcgtccgatcgcccggctcaccgccgccaccgaacgcatcgcgcgcaccgacgacctcaccccgatcccggtgaccggcgacgacgaattggcgcggttgaccgagagtttcaacaccatgctgcgggcgctcgccgaatcccgcgaccgccagcgcaggctcgtcgccgacgcgggacacgaactgcgcaccccgctgacctcgttgcgcaccaacatggaactgctcatcgcctccagccgccccggcgcgccgcaactgcccgagcaggacatggccgaactgcgcgcggacgtggtcgcccagatcgaggaactgtccaccctggtcggagacctggtcgacctggcgcgcgaggacgcgccggagacggtctacgaccgggtcgacctcggtgaggtggccgaacgcgcgctggagcgcgcccggcgccgccgcgccgatgtggaattcgtggcggaactgcggccctggttcgtctacggccacgacgccgcgctcgaacgcgcgatcctcaacgtgctcgacaacgccgcgaagtggagcccggcgggggagcaggtcggggtgcgcatgcgcgagaccggccgcgggctgctcgagctcaccgtggacgacgccggtcccggtatcccgcccgaggagcgcgagctggtgttcgagcgcttctaccgcaccaccgcctcccggtcgatgccgggatcgggcctcggcctggcgatcgtcaagcaggtggtgaccaaacacggcggcaccatcaccatcgacacctccgaccgcggcggcgcctgcattcgtatcgtgttacccggtgagacgggtgcccccggtcctggcctggaccagcgggaatga

SEQ ID NO: 77351 - protein, 488 aa, Nocardia farcinica IFM 10152
MARSAPRRPAVAPVGRPVEPPPMRPPMPLTSSVSLRWRVTLLAASVVAIAVAVTSIAAYAMVARALYADVDEQLRARAATMIDNNFDSLGFQSIILAGLYSNDVGVALIFADHKSYMPPQQTIPPVGEQELGVADGQLASSLRTVSSQRVLAVHTNSGATLVISQRLEPTREVLDRLAWLLFVVGGCGVVLAAAAGTAVGRTGLRPIARLTAATERIARTDDLTPIPVTGDDELARLTESFNTMLRALAESRDRQRRLVADAGHELRTPLTSLRTNMELLIASSRPGAPQLPEQDMAELRADVVAQIEELSTLVGDLVDLAREDAPETVYDRVDLGEVAERALERARRRRADVEFVAELRPWFVYGHDAALERAILNVLDNAAKWSPAGEQVGVRMRETGRGLLELTVDDAGPGIPPEERELVFERFYRTTASRSMPGSGLGLAIVKQVVTKHGGTITIDTSDRGGACIRIVLPGETGAPGPGLDQRE

SEQ ID NO: 77352 - DNA, 1065 bp, Geobacillus kaustophilus HTA426
  CDS (1)..(1065): transl_table=11
atgaaacgattgcgatttgtgcttaaatccatcttgacggttatcgctgtaatgtccatcgtctctctcttttggactgcggcatatttcatcacagaagcgctctacacccaattcgcttggcggccgcacccgctcgttcgtcaaatcatttcatcgatcctcggctttttgctgttcgggatgactatgagcgcgatcagtccttttttgcgaaagcgcgaaaaagtattttggcaacacttaatagatgccattaatcgaatcgccaaaggcgattttcgagtaaatctccaggctgactggggcggacggaatcatccgtttgccgaactcgtgacacgcattaacgacatggccgcgaatttgcaggccatggaagaaatgcggcaagaatttatttctaatgtgtctcatgagatcggctctccgctcacatcgatccgcgggttcgcccgagcgctcaaaaacgaggacctaagccgtgaacagcggttgcattatctcgacattattgaaacggagtgcgtccgtttgtcgaagttaagtgagaatttgctgcggttggcgatgttagactccgatcactacccgtttcatcccacatcctatcgcttggacacacagctgcaaacactcattcttcactgcgagccacagtgggcggaaaaagaattgaacatgtgtgtcctgtttgagaaagtcatcattacagccgatgaagatttgcttagccaagtatggctgaacttgatccataatgcgattaaatttacaccgaaagggggaaccatcaccatccagctacaacgccgcggtgaacaagccatcgtcaccgtttccgatacagggccaggaatcaacgaacatgaccagctccgcatttttgaacgattttataaggccgataaatcccgccatcgcgccgcagggggtagcgggctcgggttgtcgatcgccaagaagattgtcgatatccatcatggaatcatctccgtgcagagccagccgggagaaggagcgacttttacggtggaactccccgttcatggcccggtttcttag

SEQ ID NO: 77353 - protein, 354 aa, Geobacillus kaustophilus HTA426
MKRLRFVLKSILTVIAVMSIVSLFWTAAYFITEALYTQFAWRPHPLVRQIISSILGFLLFGMTMSAISPFLRKREKVFWQHLIDAINRIAKGDFRVNLQADWGGRNHPFAELVTRINDMAANLQAMEEMRQEFISNVSHEIGSPLTSIRGFARALKNEDLSREQRLHYLDIIETECVRLSKLSENLLRLAMLDSDHYPFHPTSYRLDTQLQTLILHCEPQWAEKELNMCVLFEKVIITADEDLLSQVWLNLIHNAIKFTPKGGTITIQLQRRGEQAIVTVSDTGPGINEHDQLRIFERFYKADKSRHRAAGGSGLGLSIAKKIVDIHHGIISVQSQPGEGATFTVELPVHGPVS

SEQ ID NO: 77354 - DNA, 1638 bp, Zymomonas mobilis subsp. mobilis ZM4
  CDS (1)..(1638): transl_table=11
atggtatcggctaccgatttgccgaagaataaagaagaagacgcggcttcccgctatcactggcggagaaacgagcttgcgcttggttggtcagcgcgttggtcgctgactgcccgtattctggccgtgaatattttcgttcttctgatatttgctggcacctttttctatgtcgcccaatatcgcgatcgcctgacgggtcttcagaccggtaaatataaagcgatggtcgagcttattaccgataatctcgaaaatacaccggaagcggaatgggatcgcctgatcggtaagatgggacagcaaaccggctttcgtattcggatttttaattccgacggaaaaaggcaatttgatagctgggacggacagccgcctacttataccattcatgacccgaaaaaagatgactggcagcaccgtcttgcccgcacattggatcggatcaatgatattgtcgtccatgccagcccgttaagttattatcaggaaccgaaagatgaccggctgcaagcctggccggaagcggtgactgcccgtagccagaatgaaatggcagcgcagataagatgggcggcggatcggacaccgttgatttcaatcgcgacccctatcgggaaagatggcgctaccttatttgcaacggataacccgcgttatattacccataaggtcagacggcagcgtttctgggcaatgatcgttttattggtcgttacctgtgtttctgtcggattgtctttatttttggcgcgaacaattgttcacccattgaaaagccttgccaaagcagcggtacgcgtccgtttaggacgggcaagagaggttaaagtccctcgcctgcccgcgcgccgtgatgaaattggtctattggcgagatcgctgtctgatatgaataccgccttgcaacagcggattgatgcgacagaggcttttgcggctgatgtaacgcatgagctgaaaaatccgttggcttcgttgcggtcggcggtcgatagtctggaaatgataaaagacgatcatttgcggcagcaattgatcggcgtcattcgtgacgatattcagcggttagatcgcctgattaccgatatttcagaggcttcgcgtgttgacgcagaaatggcgcgttccagctttgaagtcattgacttgggcccgttaattcaaggtgtcaccaagcattgcgagaggcggcctgatgcagccgatgtccgtattgcttttgcccgcccgcaatccggtattgccgtggttttgggcgatggcacaagattgacgcgggttgttgaaaatctgatcgataacgcgatttcattttcgccgccggatggtttggtaacgattaccacaacccgcgacaaagatgatgttgtcatcagagtagaagatgaaggccccggcgtgccggatgatgccaaggaagaaattttccggcgattccattctgtccgccccagtcaggaagcctttggtcgccatagtggtttgggattggcgattgcgaaagcgacggttgaagctcatcacggcacgattgaggtcgccaagcggtcgcatgggaaagccggtgccagctttattgtccatcttcccgccgctccgatcatttatccgacccaaaatggtaaaaaagcctag

SEQ ID NO: 77355 - protein, 545 aa, Zymomonas mobilis subsp. mobilis ZM4
MVSATDLPKNKEEDAASRYHWRRNELALGWSARWSLTARILAVNIFVLLIFAGTFFYVAQYRDRLTGLQTGKYKAMVELITDNLENTPEAEWDRLIGKMGQQTGFRIRIFNSDGKRQFDSWDGQPPTYTIHDPKKDDWQHRLARTLDRINDIVVHASPLSYYQEPKDDRLQAWPEAVTARSQNEMAAQIRWAADRTPLISIATPIGKDGATLFATDNPRYITHKVRRQRFWAMIVLLVVTCVSVGLSLFLARTIVHPLKSLAKAAVRVRLGRAREVKVPRLPARRDEIGLLARSLSDMNTALQQRIDATEAFAADVTHELKNPLASLRSAVDSLEMIKDDHLRQQLIGVIRDDIQRLDRLITDISEASRVDAEMARSSFEVIDLGPLIQGVTKHCERRPDAADVRIAFARPQSGIAVVLGDGTRLTRVVENLIDNAISFSPPDGLVTITTTRDKDDVVIRVEDEGPGVPDDAKEEIFRRFHSVRPSQEAFGRHSGLGLAIAKATVEAHHGTIEVAKRSHGKAGASFIVHLPAAPIIYPTQNGKKA

SEQ ID NO: 77356 - DNA, 1419 bp, Bacillus clausii KSM-K16
  CDS (1)..(1419): transl_table=11
atgaagcctttatccattggcgcaaaaatttggctggccattggcactgctgcgttggcctttgtcgtctctggtggttttttaattgcgtttttgtatgaaaagctttatgtagacgaacaacttggccagtttatggaagaaggcagcgcccttgtgtctttttatgaaaaggaaggtttgtcggaagagctgtatgaacgagtggagtgggcgaatgagagaagccgcgctcaatttttactgacagatgatccaatggaattggcgagcggcgccccttttgcagccgatgaagatgcacaactgatcacatttgaggaacggcaaagtttgctggacggagagacagttgtaattcgccgcgaacatcctcgttttcaacaagagttgctagggattgcccttccgttaatcagtgaaaataaattagaaggtgcaatttttatttcgatgccattagctgttgtttatgaggcgtttgttgatatccagtgggcgctttatgcagcagtgttgttcgctgctttctttgtcgtcatttcaggcaagcgcatgacgaaacatattgtagagccgctaagggaaatgaaagcaagtgccaaagaaatggaaaatggccatttttcaaagcgtgtcgctattggaaaaagccatgatgagctcaccgaactggctcattcttttaatgagcttgccaaatcattagagcaagtagatcgagagcggaatgcatttttggccaatgtcgcccacgaattgagaacgcctttaagctatatgatcggctatgcagagggcattcaagaaggtgtcattgaaagaaataaaggaatggccgttattgaaaaagaggcaaagcgattagatcgccttgtcaatgatttgcttgatttggcccagctagaaggcagcgattaccgtctagacaaagaagcacttccatttgcagagcttgctcgagaagcggtagctgcattcgcttggcaagctgaacaaaaacacatccaactggaacttgagttagacgaggacagcattattgatgccgattgggaccggatgcagcaagtgttaacaaacttgctcgcaaatgcgattgcttattctccgccttttacaacggttacggtacggatcacttccagcaacggctgggcagaaatggttgttgaagatgaaggagctggtatccctgaagcagacctgtcgtctgtacaaaagcgtttttatcgtgtcaagaagggcaggagcaggcagaatggcggtacgggtctgggcctagcaattgtgcaagagattgtcgccaaacatggcggcgactttcagctagtgtcacaagaagggaaaggcacaaaagccattatacggattaaagaaatcgatgttggcgcttttaaggaaggagaacaaagatga

SEQ ID NO: 77357 - protein, 472 aa, Bacillus clausii KSM-K16
MKPLSIGAKIWLAIGTAALAFVVSGGFLIAFLYEKLYVDEQLGQFMEEGSALVSFYEKEGLSEELYERVEWANERSRAQFLLTDDPMELASGAPFAADEDAQLITFEERQSLLDGETVVIRREHPRFQQELLGIALPLISENKLEGAIFISMPLAVVYEAFVDIQWALYAAVLFAAFFVVISGKRMTKHIVEPLREMKASAKEMENGHFSKRVAIGKSHDELTELAHSFNELAKSLEQVDRERNAFLANVAHELRTPLSYMIGYAEGIQEGVIERNKGMAVIEKEAKRLDRLVNDLLDLAQLEGSDYRLDKEALPFAELAREAVAAFAWQAEQKHIQLELELDEDSIIDADWDRMQQVLTNLLANAIAYSPPFTTVTVRITSSNGWAEMVVEDEGAGIPEADLSSVQKRFYRVKKGRSRQNGGTGLGLAIVQEIVAKHGGDFQLVSQEGKGTKAIIRIKEIDVGAFKEGEQR

SEQ ID NO: 77358 - DNA, 1422 bp, Dehalococcoides ethenogenes 195
  CDS (1)..(1422): transl_table=11
gtgtcccgcttaagctataaaattttcggtgccctgctgctgactgttttgctgtcggtgggtcttacttcgtttgccgccaaccagctgaccgccagccagttccgccagtatattatccgggggaataccgaatttataaccagcgtggaaagtgcactgggtacatattatgcccaatatcaaggctgggataacgtaaatggtgtccttatccagctgctgggcagtaacggcgggcgtttagtattaagcgatgccagcgggctgatagtagctgacacccaaaacaaatggataggctaccagacagacgaatacagcctgtcaaacggtactttgataagcatttcgggtacagatgcaggctatctctactggattggcagccagggcagcggctccggcagcggttacggtaaagggatgcagagcgggcagaacaatagcggtaatgccgctgctggcataatcagcgaatcccagcagcaactgctggatgaaatgaacaggtctatctggctgtccgggggcttagccggtctggcggccctgggtctggggctgctgctggccagccagattatccgtccgcttaaagccctcagccggagtgccagacggattgccgggggagagctttcccagcgggtaaaggtagactcccgtgacgaactgggcgaactggctgaaagcttcaaccacatggcccaaagcctggaaaccaacgaacagtcacgccagagactgctggctgatattgcccatgaacttcgtaccccacttacagttattgaggggaccgtagacggaatactggacggggtatttgaggctgatgcccagcaccttaccactatcaaagaagaatccgccacccttacccgccttataaaggacctccgggatatatctctggctgaatccggcaaactcaagctggaaatgacccagctggatatcgcagacattatccgccgtcaggccaaacaggcatctatactggccaaagacaaatctattgccctattaagtgatattcccgctaatctatctaccgttacgggtgatgccacccgcttaaaccagataacagccaacctgctcagtaatgccctgcggcacacacctgccggcgggcaaatcagcctcagcctgaaaaatatgctttaccgggataaacccgggattatggtatccgtaactgacaacggagaggggataccaccggcagacttaccccatatttttgaccgcttttaccgggtaaatacgtccagagcccgaagcgaaggcggcagcgggcttggtctggctattgtaaaagagatggcagaagcccacggcggttatgtctgggccgaaagcttacttgggaaaggcagcacctttaactactggctgcctgccagccatacctga

SEQ ID NO: 77359 - protein, 473 aa, Dehalococcoides ethenogenes 195
MSRLSYKIFGALLLTVLLSVGLTSFAANQLTASQFRQYIIRGNTEFITSVESALGTYYAQYQGWDNVNGVLIQLLGSNGGRLVLSDASGLIVADTQNKWIGYQTDEYSLSNGTLISISGTDAGYLYWIGSQGSGSGSGYGKGMQSGQNNSGNAAAGIISESQQQLLDEMNRSIWLSGGLAGLAALGLGLLLASQIIRPLKALSRSARRIAGGELSQRVKVDSRDELGELAESFNHMAQSLETNEQSRQRLLADIAHELRTPLTVIEGTVDGILDGVFEADAQHLTTIKEESATLTRLIKDLRDISLAESGKLKLEMTQLDIADIIRRQAKQASILAKDKSIALLSDIPANLSTVTGDATRLNQITANLLSNALRHTPAGGQISLSLKNMLYRDKPGIMVSVTDNGEGIPPADLPHIFDRFYRVNTSRARSEGGSGLGLAIVKEMAEAHGGYVWAESLLGKGSTFNYWLPASHT

SEQ ID NO: 77360 - DNA, 1347 bp, Dehalococcoides ethenogenes 195
  CDS (1)..(1347): transl_table=11
atgagcgtaaagataaagctgaccattattaatgccctggtattgctctcggtacttgggttttttggtctcatatcgtacttctttttgtcttaccatttattcagcagcctgaatgattctttggcggctgatgctgaaaaagcagccggagaaattatccgatctgagggcaatagcctgtattatgcgggggatgtgtttgcggaagtggtttatatatatgatattgaaaccggtcttatatccgggagtgaaaggtacaaatctgttatccaggattccattgccgacataaccgccataaatgagtatatgcccgccatgcgcttggaaattccggattcccagttaaggttttatgtagcctggtatgataatgattataagcccaaccagctccttatacttgtgggtgatgccgggtatatttataaaactctggatcagtataaacagattctctttatggccattccctttgtccttattatcgccgctgccttaggctattttttggcttaccggtgtttaaaacaggttcaggtaatcacccataccaccaataatataaatccgtctgacctgaaagaccgtattccggtgaaacaaaatgatgaattaggccagctttcggcaaccttaaattcactttttgaccgggtttacgggtttattcaaagccagcaccgctttacttctgatgcctcccatgatttgaaagccccgcttacggtaattagggcggaatccgagttggcgcttcgcaaagagcggaataccgaggaataccgtcaggcttttaagaatattgtaaagcaagttgagaaaatggcgctgattattgatgatttgatggctctggccagtctggatgccggtccgcgtccggctctaagcttgaaaatagatttgggtgctgccctggaaagcagtgctgataaatggcagaccgcttttgaaacgaaaaagattaagctgattcgggatatccagcccggtttaaacatatacggagagcccgaacagttcagccgtctctttgataatcttttttcaaatgctgccaagtatacccctgacggagggcaggtaatgatttcccttagagacgaaagcgggtttatggtgcttgccataaaagataccggaattgggataagtaaggagcacctcccccgtatatttgacaggttttaccgggctgattggagtgcagaaggtactggcttaggtttatctatagtaaagagtacctctgagatatacaaagggcgggttgaggtggaaagtgaaccgggcaaaggcactgtctttaaggtatttttgcccaagcagtcggtatag

SEQ ID NO: 77361 - protein, 448 aa, Dehalococcoides ethenogenes 195
MSVKIKLTIINALVLLSVLGFFGLISYFFLSYHLFSSLNDSLAADAEKAAGEIIRSEGNSLYYAGDVFAEVVYIYDIETGLISGSERYKSVIQDSIADITAINEYMPAMRLEIPDSQLRFYVAWYDNDYKPNQLLILVGDAGYIYKTLDQYKQILFMAIPFVLIIAAALGYFLAYRCLKQVQVITHTTNNINPSDLKDRIPVKQNDELGQLSATLNSLFDRVYGFIQSQHRFTSDASHDLKAPLTVIRAESELALRKERNTEEYRQAFKNIVKQVEKMALIIDDLMALASLDAGPRPALSLKIDLGAALESSADKWQTAFETKKIKLIRDIQPGLNIYGEPEQFSRLFDNLFSNAAKYTPDGGQVMISLRDESGFMVLAIKDTGIGISKEHLPRIFDRFYRADWSAEGTGLGLSIVKSTSEIYKGRVEVESEPGKGTVFKVFLPKQSV

SEQ ID NO: 77362 - DNA, 1194 bp, Xanthomonas oryzae pv. oryzae KACC10331
  CDS (1)..(1194): transl_table=11
atgaaggcgctgcggcgatttcatgcgtggcgcaaccaggccccgctgtggtggtgggtggggctgcgcatgagcgcgctggcggtcctgaccatgatggtcatcgccttcggcatgtggtgctatttcaatcttcgctacagcctgattctgagcaacgtgcccgccgagccgcgtgccgagatctcccagctgatcgcgcagcccagggccaaccaggcccgcctgtgggagctgttccagcgctattacgacattgaaaatttcctgcccgggctggccaatccggactggtggatgctgggcgccatgatgaccatctcggtcccggtcatcctgttctgcggcctgctcgcgtcgcggccgctgtcgcggcaattttcgcaggtggctttcgcggcgcatcgggtcagcgatggcgatttcggcgcacgcgcacacgtggtgcgcggcgcaccggacgagctcaccgccctggccgacgacttcaatacgatgagcggcaggctgcagcagtacgagcgcgaattacgcgactccagcgcgatgttggcgcatgaattgcgcaccccgctcaatgccgcgatgggacgcgtgcaaggcatgctggatgaggtcttcccgcgcgaacccgagcaactgcggctggtgcatcgtcagctggagcagatcaatcgcctgatcggggatttgcacctggtgtcgctggcgcgtgccggccaattggtgctggagccggaaagtgtcgagctgcgggagctcgtcgccgaacgcatcgagtgggcggggccggcgctgcgccaggcgcagatggcgatccattaccccatgcatcccccgctgcgcttgcgtgccgaccggcaccggctgggccaggtgttgtcgatcctcatcgataacgcgttgcgctacgccgcagccggcaagctgctggaaatcgaggtgcaccgcgagggcaccagcgtgcagctcactttgggcgaccgtgggccgggcgtagagcctgcgcaattaccgcatctgttggaccgcttctggcgcgccgacagctcgcgcgcacggcattccggcggcagcggcctgggcctggcgatcgcctcggccatctgccaggcgcacgatggccggctggtcgtcagcaaccgccccggcggtggcctgctggccggcgtgcggttaccgctggggcgttga

SEQ ID NO: 77363 - protein, 397 aa, Xanthomonas oryzae pv. oryzae KACC10331
MKALRRFHAWRNQAPLWWWVGLRMSALAVLTMMVIAFGMWCYFNLRYSLILSNVPAEPRAEISQLIAQPRANQARLWELFQRYYDIENFLPGLANPDWWMLGAMMTISVPVILFCGLLASRPLSRQFSQVAFAAHRVSDGDFGARAHVVRGAPDELTALADDFNTMSGRLQQYERELRDSSAMLAHELRTPLNAAMGRVQGMLDEVFPREPEQLRLVHRQLEQINRLIGDLHLVSLARAGQLVLEPESVELRELVAERIEWAGPALRQAQMAIHYPMHPPLRLRADRHRLGQVLSILIDNALRYAAAGKLLEIEVHREGTSVQLTLGDRGPGVEPAQLPHLLDRFWRADSSRARHSGGSGLGLAIASAICQAHDGRLVVSNRPGGGLLAGVRLPLGR

SEQ ID NO: 77364 - DNA, 1407 bp, Neisseria gonorrhoeae FA 1090
  CDS (1)..(1407): transl_table=11
atgaaactgttccaacgcattttcgccacattttgcgcggttatcgtctgcgcaatctttgtggcgagtttttctttttggctggtgcagaacacccttgccgaaaaccaattcaaccaacgccgcaccatcgaaaccacattgatgggcagcattatttccgcattcaagacacggggcgacaacggcgcgcgcgaaatcctgaccgaatggaaaaacagccccgtctcatccgccgtttacgtcatacagggcgacgagaaaaaagacatcttaaaccgctatatcgacaattacaccatagaacgcgcccggctgtttgccgccaacaacccccattccaaccttgtccgcatcgaatacgaccgtttcggcgaagaatacctgttcttcattaaaggctgggacaaccaccaggcacaacgcctgcccagcccgctgtttatcccgggcctgccgcttgccccgatttggcacgaattcatcatcctctccttcatcatcattgtcggactgctgatggcatatatccttgccggcaacattgccaaacccatcagaatcttaggcaacggcatggacagggtggcaaacggagaacttgaaacccgcatctcccaacaggtcgacgaccgcgacgacgaattgtcccatcttgccatccaattcgacaaaatggcggaaaaactcgaaaaacttgtcgccaaagaacgttacctactccaccacgtttcccacgaaatgcgctccccgcttgcccgtatgcaggcaattgtcggactgattcaggcacagccccaaaaacgggagcaatatctcaaacggctggaaggcgaactgacccgcatggatacgctggccggggaactgttaaccctgtcccgcctcgaaacctccaatatggctttggaaaaagaaagcctgaaactcctgcccttcctgggcaacctggtagaagacaaccaaagtatcgcccaaaagaacggacagacggtcgccctgtctgccgacggaaaaatccccgaaaacacaaccatccttgccaacgaaagctacctgtaccgcgccttcgacaacgtcatccgcaacgccgtcaactacagccccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggtttcaaaacagaaaaaagtgcgaactga

SEQ ID NO: 77365 - protein, 468 aa, Neisseria gonorrhoeae FA 1090
MKLFQRIFATFCAVIVCAIFVASFSFWLVQNTLAENQFNQRRTIETTLMGSIISAFKTRGDNGAREILTEWKNSPVSSAVYVIQGDEKKDILNRYIDNYTIERARLFAANNPHSNLVRIEYDRFGEEYLFFIKGWDNHQAQRLPSPLFIPGLPLAPIWHEFIILSFIIIVGLLMAYILAGNIAKPIRILGNGMDRVANGELETRISQQVDDRDDELSHLAIQFDKMAEKLEKLVAKERYLLHHVSHEMRSPLARMQAIVGLIQAQPQKREQYLKRLEGELTRMDTLAGELLTLSRLETSNMALEKESLKLLPFLGNLVEDNQSIAQKNGQTVALSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGFKTEKSAN

SEQ ID NO: 77366 - DNA, 1296 bp, Azotobacter vinelandii
  CDS (1)..(1296)
atgaggccgctgtccctcggtacgcgcctgagcctgctgttcgccgtctgcagcgcggccgtctcgctgctcgccgggctcttcttcaaccaggccagcgaggcgcacttcgtcgaactcgaccggcaacgactggcgggcgaactggcggtgctgcgcggcctgcttgacggcgtcgccgaccaggcggacctgccgggccgcctgcccgccgtgcgggaagagctggcccggcatccggagctgagcctgcatatcatcggcggcgacggtcgcctctggttcgacagcctccccgatagcgatcccgccgcccagcgcaccctggaggcacggaacgccgatggcacgcggctggtcgtgcgcctgaacatcgctcaccaccggcattttctcgaagacatgcagcgcatgatctggctcggcgtcggtctgtccgccctggccaccgccctgctcggcgcctgggcggtgcgccgcagcctgcgcccgttgcggcggatgggcgaggtggcgggcgggatttccgccagctcgctgaccacccgcctggaacaggaccgccagcccgccgagctggccgaactggcgcaggccttcaacgccatgctggcgcggctggaggatgccttcgccaggctctcggccttctccgcggacatcgcccacgagttgcgcacgccactgtccaacctgctgacccagacccaggtgaccctctcccggccacgcgccctggaggagtaccgcgaggccctgcattccaacctggaggaactgcagcggctggcgcagatggtcgccgacatgttgctgctggccaaggcggaccacggcctgctgttgccgaaccgcgagccgctggcgctcggcgcggagatcgacacgctgctcgactacttcgcaccgctggccgaggatgccgggatacgcctggaacgccgtggcgatgcccggctgatggccgaccgcggcatgctgctccgggcgctgtccaacctgctggacaacgctctgcgcttcactccggccggcggcgagatccgcctggagctgagcggcaccccgggccgcctgcgcctcgaggtcggcaacagcggcccggccataccgcccgagcagttgccgaaactgttcgaccgcttctaccgggtcgatccggcacggcgcgaaggcgacggcgagcacgccggcctgggcctcgccctggcccgctccatcgtccgcgcccatggcggggagatccgctgcgagtccagcgagggctggacgcgcttcatcctcgaattcgcctga

SEQ ID NO: 77367 - protein, 431 aa, Azotobacter vinelandii
MRPLSLGTRLSLLFAVCSAAVSLLAGLFFNQASEAHFVELDRQRLAGELAVLRGLLDGVADQADLPGRLPAVREELARHPELSLHIIGGDGRLWFDSLPDSDPAAQRTLEARNADGTRLVVRLNIAHHRHFLEDMQRMIWLGVGLSALATALLGAWAVRRSLRPLRRMGEVAGGISASSLTTRLEQDRQPAELAELAQAFNAMLARLEDAFARLSAFSADIAHELRTPLSNLLTQTQVTLSRPRALEEYREALHSNLEELQRLAQMVADMLLLAKADHGLLLPNREPLALGAEIDTLLDYFAPLAEDAGIRLERRGDARLMADRGMLLRALSNLLDNALRFTPAGGEIRLELSGTPGRLRLEVGNSGPAIPPEQLPKLFDRFYRVDPARREGDGEHAGLGLALARSIVRAHGGEIRCESSEGWTRFILEFA

SEQ ID NO: 77368 - DNA, 1392 bp, Desulfitobacterium hafniense DCB-2
  CDS (1)..(1392)
atgcgtaaacgcttatttctctccttcctggccattattctcctgaccttattgctcagcattctgtccgttaactttgtcttccaaaaacatttcagtgattatctcgcccgctccacggaagtaactctggaacaattgcccgagcgtttaagcagcagtttcttcagccatgggtgctggaattccgattctctgtataacatcgcccactctcttccctttggaacccatatcgtgatcaaagagccctccgggaagaccatcttgaccctcatcaatcccatggaatctatgctgaaaaatgatcccggtctatggatggacatgggtttaaactacaccattgaggaatggaaaaacaagacccttatgatctccggtcccaatggagtctttgctgttgcggaagttcgctatccggccagggccaaggttttgaaccctgctgatcagtcttttatttccgctatctaccaatccttgtttctggccggagctttggccttgatcattggcataatcctgagttattggatcagccggcgcctgacttcccctttgcaggggttgacgaaggccgtgcagagggtaggggaaggatttctggacgaacaagtcccggttgccactaaggatgaagtcggtcaattggctaccgctttcaatgggatggccgaaagcctgaaaaagcaggaacggctccgcaagcagctcactgcagatattgctcacgaattgcgcactcccttaacctctatccgcagttatatcgaagccttccaagacggagttctgccagccgacaaggagaaccttgccattatcaatgaagaaattgagcggttgacaaggttatccagcgatcttaaagatctcaatgtcgcggagatgggagccttacgcccttatttgactcaggtcaatctttccgcccttatcgataaaacagtgaatatgctctccccgcttatccaggaaaaaggaatttctttaacatggcacaagcctgaatcaattcttatcgaaggggatgaatacctgctaacccgcctcttctacaatcttcttcacaatgcttacaaatttacggaaagtccgggcaaaattgaggttcaaatggagcttcgccatcaggaggtcctgatcaccatttccgactctggaatcggtattcctgaagaagatcttccctttattttcgaacggttctatcgctcagaaaaatcccgctctcgggaaactggcggtacaggcatcggcctcgccttagctcaacagatcgctcttcttcatcaagggacacttacggtcgaaagctgcccagataaaggcagccgatttatgctcctacttcccctaaccattggagaaaaatccacctccgtctaa

SEQ ID NO: 77369 - protein, 463 aa, Desulfitobacterium hafniense DCB-2
MRKRLFLSFLAIILLTLLLSILSVNFVFQKHFSDYLARSTEVTLEQLPERLSSSFFSHGCWNSDSLYNIAHSLPFGTHIVIKEPSGKTILTLINPMESMLKNDPGLWMDMGLNYTIEEWKNKTLMISGPNGVFAVAEVRYPARAKVLNPADQSFISAIYQSLFLAGALALIIGIILSYWISRRLTSPLQGLTKAVQRVGEGFLDEQVPVATKDEVGQLATAFNGMAESLKKQERLRKQLTADIAHELRTPLTSIRSYIEAFQDGVLPADKENLAIINEEIERLTRLSSDLKDLNVAEMGALRPYLTQVNLSALIDKTVNMLSPLIQEKGISLTWHKPESILIEGDEYLLTRLFYNLLHNAYKFTESPGKIEVQMELRHQEVLITISDSGIGIPEEDLPFIFERFYRSEKSRSRETGGTGIGLALAQQIALLHQGTLTVESCPDKGSRFMLLLPLTIGEKSTSV

SEQ ID NO: 77370 - DNA, 1431 bp, Desulfitobacterium hafniense DCB-2
  CDS (1)..(1431)
ttggctattatcttattgctgatcgggatctttcagtatgttttcttgaaggacttcattctcggcagcactgcggcaagcattcgatcccaaattgcgtcggttccccgggacagttggacgcagatgctgctctatgcggagattaatgccaaattcaatctggataaagatatagtggagctggtacccggtaaaacccaggaagggcctcccaatcgtattcccatcaacctaatggattctacgattgcttttgtggatttgaatgggaacgtgaccagcctggccaataccatgaatcggtcaggggccccgccgctcctcagtgccgaccagtatcagcaagccttagatccatcggagtcgccgaggttttgggtagtgaactcagagtcggggacggaattgctggtggttctgcaccccttggaactgcgcggctatctggttggttttattcaggttagccttagcacccaatttgttcaggatgttttgttccggcagttgtctatatttatgctcctttctgtgcttgcccttgtgggcggactggtggcttaccaagcggtcatcaaaaagactctggttcctttgtccaatatcgttcatactatggagaatatggatgcggggaaccttaacgaacgccttcctgtggaacaaggtcaaaaagaaatcgatactttggccgtatccctcaatgggatgctggagcggctggagtcctcttttacagcggaaaaggaggctaaagaacagatgcggcgctttgtagccgatgcctctcatgaactgcggaccccccttacttctatccatggcttcttagaggttctgctgcggggagctatgaatcaaccggataagctgcagaaatccttaaccagtatgtatgcggaatcggagcgaatgaagaagcttattcaggatctattgctcctggctaagctggaccgttctccctatcttgaaaaatcggaaaaggatattggggtactgatactggagatggagccccaactgcgtatgctggctgaagaacgggagattcaattggatttggcccctgaggaattggtccctatcgatgtggataaaatgaaacaggtcattctcaaccttttccataatgcggtccagcatacggacccggataaggggttgattcaaatcagcttgaaatctgaggcttccggggtggaattgacggtccaggataacggaccgggaattcccgaggagcatttacctcatctttttgaaaggttctaccgcagcgattcttcccggacccggaaatatgggggagctggactgggcttagctattactcactccctggtagagcttcatgggggaacacttcgcgtcgaaagtaaagtgggtgaaggaagtcggtttattgtcgggctgcctaaaatataa

SEQ ID NO: 77371 - protein, 476 aa, Desulfitobacterium hafniense DCB-2
MAIILLLIGIFQYVFLKDFILGSTAASIRSQIASVPRDSWTQMLLYAEINAKFNLDKDIVELVPGKTQEGPPNRIPINLMDSTIAFVDLNGNVTSLANTMNRSGAPPLLSADQYQQALDPSESPRFWVVNSESGTELLVVLHPLELRGYLVGFIQVSLSTQFVQDVLFRQLSIFMLLSVLALVGGLVAYQAVIKKTLVPLSNIVHTMENMDAGNLNERLPVEQGQKEIDTLAVSLNGMLERLESSFTAEKEAKEQMRRFVADASHELRTPLTSIHGFLEVLLRGAMNQPDKLQKSLTSMYAESERMKKLIQDLLLLAKLDRSPYLEKSEKDIGVLILEMEPQLRMLAEEREIQLDLAPEELVPIDVDKMKQVILNLFHNAVQHTDPDKGLIQISLKSEASGVELTVQDNGPGIPEEHLPHLFERFYRSDSSRTRKYGGAGLGLAITHSLVELHGGTLRVESKVGEGSRFIVGLPKI

SEQ ID NO: 77372 - DNA, 1428 bp, Desulfitobacterium hafniense DCB-2
  CDS (1)..(1428)
ttggcggataccatgtactcttttgccggggaattttctgccgatgttctatcatccttaacggtcggcgacgaggtcatcattgatactgtcaatataggtgaggaaaggataccttatcatatccagaccggctcgacgggtgttgtcaatttaaaccttgcccacaagctccatgggcctcaggccgatcaggcttatagtcacctgagcaccgggctgtataagggaacgataacagaaaccgtatttccggaacgaccggaagatattgcctttccctatcaggaacattattttttggaacaggtcaaagaatttcaagccggtctgctggctgagcaggggcagcctcttcaggacagcaaagaatggggggctgtagagaattttgcggagtataagctgatcagcgaaccgattagggaacatggggcaaagggatatattctcgccatgacttctctccagccggtggatgaggccatcggtgtgatccggcaattctacccttactttttgggagttgccttgctgtgcatgctggttttggccttcgttctttccaaatggctggccaagcccctcctatccatcaaccggatcaccgggaagatagcggcgatggattttaccgaaaagctgccggtgggttctgaggatgaaatcggccagttatcccgaaatatcaatcacctgtccagccggatggaaggatatattgagcaattgaagcgggatctcgatcaagagaagcgcttggaaaagacacggaaggaatttatcgccggagtatctcatgaactgaaaacccccctggctgtgatgaaaagttgcctggcgattatcaaagacggcattgccgctgaaaaaagggaacattattttcaggccatggaagaggaaatagagcggatggatttgctggttgtgaatatgctggatctggctaagtttgcctcaggcacctataagccggaaatggctccttttgccatcgatcaggcgattgccgaagcagccaggtcattggctgagcccatcggggagaaaaatctcacccttaccttaaacctttgttctctgcgggtcgtagggcatcaaggactgatcagccgcgtgatcaccaattttctcagtaatgccatccggcatacggaggagggcggggccatcgccattgccgtcagtgacaaggggcagaccgcggaaatcagtgtagaaaaccagggaagccccctggcagaagcagacaggaaaaagatctgggagcaattctaccgcggggaggcgagagcagccaaagcaggtacgggtctgggacttgctctgtccaaggagatactggaacttcatcatggggtttatggtgtggaaaatacccgggacggcgtccgctttttctttaccttgccggtgcagccctga

SEQ ID NO: 77373 - protein, 475 aa, Desulfitobacterium hafniense DCB-2
MADTMYSFAGEFSADVLSSLTVGDEVIIDTVNIGEERIPYHIQTGSTGVVNLNLAHKLHGPQADQAYSHLSTGLYKGTITETVFPERPEDIAFPYQEHYFLEQVKEFQAGLLAEQGQPLQDSKEWGAVENFAEYKLISEPIREHGAKGYILAMTSLQPVDEAIGVIRQFYPYFLGVALLCMLVLAFVLSKWLAKPLLSINRITGKIAAMDFTEKLPVGSEDEIGQLSRNINHLSSRMEGYIEQLKRDLDQEKRLEKTRKEFIAGVSHELKTPLAVMKSCLAIIKDGIAAEKREHYFQAMEEEIERMDLLVVNMLDLAKFASGTYKPEMAPFAIDQAIAEAARSLAEPIGEKNLTLTLNLCSLRVVGHQGLISRVITNFLSNAIRHTEEGGAIAIAVSDKGQTAEISVENQGSPLAEADRKKIWEQFYRGEARAAKAGTGLGLALSKEILELHHGVYGVENTRDGVRFFFTLPVQP

SEQ ID NO: 77374 - DNA, 1428 bp, Nostoc punctiforme PCC 73102
  CDS (1)..(1428)
atgagaggctggatacctgggattaaattaaatacaatttatgccaagttgttaggtagatacctgatgctaacagcttttggaacgtcactgatggcaggttatatcctttggtcgttccatgattattttatgcgatcgcgacaagtagatttggataactggacgagtgcgttaagtgaaagtgtggcagatcgactagaagaaaaagatattaaacaggtaaaggtgctggtgcaacggtatggcgcaccacaaactataaccctacgtgtttttaatccacaaggcagtttattagccacttctgacccaaggttagatagtcaagttaaagattggtctcaggttccgggaatacgggaagctctacaacatcgtgtaaaacaaggtgttgccaaaggcgttttatcaaatagcgatcgcctctacattaccagacctattgagcgtaacggtcaattgttgggcgtaatccgaatgtctatgactttggagcagttccagcgacagtttgctagggtaatttggagtattttgggaacgctagcagtaacaattctactatgtgcgttaattagcagtcgattcgctcgcagtctctcaaaaccgattgagattatgcagaattttgctattcgcttgggtggcggtcattttggcgataaactaacgatccatgaaaacaatgagttggatcaattggcagcagaactcaaccgcatgagtgagcggttagcttccttagacaaagagcgacgggtgtttttagccaatgtctcccatgaactgcgtacccctatcagtaacgttcaggtgacagtagacgcactcaaagcaggagcatctgaagaaccagaattacgcgatcgctttttccaaactatcgaaaacgaaaccaagcgtttatcacgattgattcatgacttgctggatttaggacgtttggaagcaggagtttttgaactagaaaagcaacccatctcgttgcatggattaattaaccgtgctgttaatgcactagaaccgcgaatgctatctttgggaatttctacacaggttaacgtcggaaacctaatgattcagggcgatccagagcggttattacaagcgatccttaatttgttggataatgcgattaagcactcaccagccaattctcaagtatctatttctggatacagccaaggcaaacaagctattattcaaattcaagaccagggaaaagggataaaagagggtgatttacccagaatttttgagcaattttatacaacagaccccgcacgcaaaggtagcggtaatggtctggggttagcaatttccaagcggattattgaagcccatcaaggcagtattatcgccagcagcacatcaaatcaaggggcaacttttactatatacttgccgataattcgtaattcgtaa

SEQ ID NO: 77375 - protein, 475 aa, Nostoc punctiforme PCC 73102
MRGWIPGIKLNTIYAKLLGRYLMLTAFGTSLMAGYILWSFHDYFMRSRQVDLDNWTSALSESVADRLEEKDIKQVKVLVQRYGAPQTITLRVFNPQGSLLATSDPRLDSQVKDWSQVPGIREALQHRVKQGVAKGVLSNSDRLYITRPIERNGQLLGVIRMSMTLEQFQRQFARVIWSILGTLAVTILLCALISSRFARSLSKPIEIMQNFAIRLGGGHFGDKLTIHENNELDQLAAELNRMSERLASLDKERRVFLANVSHELRTPISNVQVTVDALKAGASEEPELRDRFFQTIENETKRLSRLIHDLLDLGRLEAGVFELEKQPISLHGLINRAVNALEPRMLSLGISTQVNVGNLMIQGDPERLLQAILNLLDNAIKHSPANSQVSISGYSQGKQAIIQIQDQGKGIKEGDLPRIFEQFYTTDPARKGSGNGLGLAISKRIIEAHQGSIIASSTSNQGATFTIYLPIIRNS

SEQ ID NO: 77376 - DNA, 1434 bp, Nostoc punctiforme PCC 73102
  CDS (1)..(1434)
atgaagcaaatcagagaaatttggataaatatagacccattttcattacagtcacggctcacgatcggcactgctacattttcagctttggtattaggtagccttgcaacatggcttagctggagaatgcagcaaatattagttgatagtcataagtataatatagaacaaatcgccaagcgtttgccgcaagatgtgcaaatttatagtgaaatgatgcaaccggaaactgggttgcaaaaggctattaataacttggcaaataccaacattttattatggttaaaaagtcctgataataaaattttagtaaaatctgcaactttagatttggtatctgatactaaagtagctgagttaatgtctttaactaagatgccgataaaaccacaagtttacaaagtcaacgaaagctattttgttttatgtggtagttctgtacaagttcaaggtaagttactcggtgagctatttgtagtcaaggatattacccgcgagcaaaaaatgtttctgggaatggtgcagagtttagcaattattagtgttttggcaattattattttaactgctgcgatcgcattttacatccagcgttctctgcaacctctacgccagctaaatcaaatggcttctgtgatttcggctgaagatttaggacaatcgcagctatcggttaaaaatgcacccagcgaagttaaagaattagctcaaactttaactatgctgttatcgcgcctctctcaatcttggaagcaagaacgagaatttgtgagtaatgtttctcatgaattacgcacgccattaacaatagtacatggttacttgcaaagcgtgttgcggaggcaaaataatttaacacaaacccaacaagaagctttagaaactgcggcatcggaagctgaacgaactatccgtctgctacaagatttacttgatttagcgcgagccgatagcggttacttatattttcaaatgaaatcttatgtgctgaatgacttgattgaagaagtggtgatgatggcaaaaaaatatagcgatcgcataattaaaatcgagtcaaaagttgatcgaattgaggtgaaagcagactacagccgtctcaaacaagtattattgaatttgattgataatgctattaaatattctgagattgatacacctatagcttttaaattaaatcaacttgaagatcgggcaattgttgaagtttgcgatcgaggctatggaattcctttgcaacagcaagcacggatatttgaaagattttaccgcgtagatgaatcccgctctcatactactgggggttgtggtttgggtttatctattgtcaagacacttgtagaaggtatggggggtagtgtcagtgtgcaatcaaagttaggggaagggagtacatttacaatcagtttaccgatgtatagcagtgctatctga

SEQ ID NO: 77377 - protein, 477 aa, Nostoc punctiforme PCC 73102
MKQIREIWINIDPFSLQSRLTIGTATFSALVLGSLATWLSWRMQQILVDSHKYNIEQIAKRLPQDVQIYSEMMQPETGLQKAINNLANTNILLWLKSPDNKILVKSATLDLVSDTKVAELMSLTKMPIKPQVYKVNESYFVLCGSSVQVQGKLLGELFVVKDITREQKMFLGMVQSLAIISVLAIIILTAAIAFYIQRSLQPLRQLNQMASVISAEDLGQSQLSVKNAPSEVKELAQTLTMLLSRLSQSWKQEREFVSNVSHELRTPLTIVHGYLQSVLRRQNNLTQTQQEALETAASEAERTIRLLQDLLDLARADSGYLYFQMKSYVLNDLIEEVVMMAKKYSDRIIKIESKVDRIEVKADYSRLKQVLLNLIDNAIKYSEIDTPIAFKLNQLEDRAIVEVCDRGYGIPLQQQARIFERFYRVDESRSHTTGGCGLGLSIVKTLVEGMGGSVSVQSKLGEGSTFTISLPMYSSAI

SEQ ID NO: 77378 - DNA, 1251 bp, Pseudomonas syringae pv. syringae B728a
  CDS (1)..(1251)
atgaggccgaaccggctgttctggaagctgttcctggcattctggctagcgaccagcctgaccttcatggtcggtgccggcctgttcatgttcacccagtcagggcggggcgatccttcgttcagcacggtgctcgataacgaagtgcgcattttgcagcgctcgggcattgccgcagggcaggcgttgctcgatgcctggcagccggaggggcaaggcagggtcgggctgtacgacaaccagggtctgctgctggcgggcgaggcgctggagaatcctcgcttcgaactggctgtgcacacacgcgaaggtgcactcgtgcacatccgctctacccagcgccccaaccatgacgatcaaccttctcacctcaatccgctgatcaccggcacggtcatgagtgcgctgttcagctggtttctcagcagctatctggtggcgccgctgatgaaattgcgagaggcgatgggcaaggtcgccagaggccgtttcgacacacgggtaaaacccgacatgggccggcggcgcgatgaaatcgtcgaccttgccgaggattgcgaccgcatggccaatcagctcaaggtcatggccgactcccagcaacaactgctgcatgatatttcccatgagctgcgttcgccgctgacgcgcatgagtgccgccatcggcctgttgcgccaggagccgacccaactggacatgctcgaacgcatcgagcgcgaatcggagcgcatggactcactgatcgaagaattgctgaccctggcgcgcatgcagagcgatgtcgaaagcctgacgcgggaaaaggtcgatgtcatcagcctgctggcggccatcgtcgaggatgccgaattcgaggccggactgaagcagtgttgggtcaggctgcaggctcccgggtctttcgtcgcgcaggtcgacagcgaactgctctaccgggccttcgaaaacgtgatccgcaatgccgttcgccacacggcggtcggcacggatgtggtggttgtcgccaacgttcaggcccagccgctgtgcctgatggtcaatgtcatcgatcaggggccaggtgtggacgaggcgtgcctgcaacggattttccagcccttcgagcgcggcccggagaatgccgcgcagggctttggcctgggcctggccatcgccctgcgggctatcgaaatgcacggcgggcagatcgccgcgcgcaataggcccggcggcggtctggtggtcgatgtgctgctgccggtgtcgtga

SEQ ID NO: 77379 - protein, 416 aa, Pseudomonas syringae pv. syringae B728a
MRPNRLFWKLFLAFWLATSLTFMVGAGLFMFTQSGRGDPSFSTVLDNEVRILQRSGIAAGQALLDAWQPEGQGRVGLYDNQGLLLAGEALENPRFELAVHTREGALVHIRSTQRPNHDDQPSHLNPLITGTVMSALFSWFLSSYLVAPLMKLREAMGKVARGRFDTRVKPDMGRRRDEIVDLAEDCDRMANQLKVMADSQQQLLHDISHELRSPLTRMSAAIGLLRQEPTQLDMLERIERESERMDSLIEELLTLARMQSDVESLTREKVDVISLLAAIVEDAEFEAGLKQCWVRLQAPGSFVAQVDSELLYRAFENVIRNAVRHTAVGTDVVVVANVQAQPLCLMVNVIDQGPGVDEACLQRIFQPFERGPENAAQGFGLGLAIALRAIEMHGGQIAARNRPGGGLVVDVLLPVS

SEQ ID NO: 77380 - DNA, 1392 bp, Pseudomonas syringae pv. syringae B728a
  CDS (1)..(1392)
atgaaatcgagcatctccaccaaactgtttgtcgcggtactggccagcgtgctgtcagtgatcctgatcatgggcctgaccgcgaactggagttttgcccgcggctttctgggctacctcaacgaacaggccatgcaacgcatgtcgccggtcctgccgcggttggccgctgcctatgcacgcgaaggcagttgggaattcatgcgtgacaacaaggatcgctggttcgaagtgatgcgcccggaaccggcacaggatttcgccatccccggactggcgacaccgcctacttccgacttgaccggcgcggtgttccggatcgcgctgctggatgcgcagaagaacctggtgatgggattcccaggggtccatgacgatgaattcatgcgcccggtggaagtcgacggcaacgtcgttggctggatggcggtcacgccctttcaaagtgtcagcgaagccggtggcgagcgctttcagcagtatcagttgcgcgccagcctggcgatgggtgtgctgtcactgctgctggcggtgctgattgcctggtggatcgcgcgcaccctgctcgacccggtcaagcgggtggccgcagcaacccatcgcctcgccgcaggtgaatacgccagccgcgtggcggtgtcctccaacgacgaggtgggtcaactggcgcgcgacttcaaccagctggcgtacaccctggaacgcaatgagaagatgcgccgcgaattcatggccgatgtgtcccatgagctgcgcaccccgctgtcggtcttgcgtggcgaactggaagccatcgaggatggcgtgcgcacactggatcaggcatcgatgaagtccctgcagggcgaagtcggcatgctcagcaagctggtggatgatctgtatgagctgtccctggcggatgtgggcgccctgacctaccgcaaggtcgactgtgacctggcggagctgctgacgaatatcactgacatgttcgaagagcgttgcgcagcccgtcagttgcatttgcagttggagcttgctggcggagctctgccggtgcatgcagacccagggcgcctgcagcaattgatcggcaaccttctggaaaactcggtgcgctacaccgatgccggggggacagtgcatgtgcgtgccgctctgcagggcgatgaggtgcgcgtcgatgtgatggattccggacccggcgtcgacccgcagcaattgcccagactgttcgaacgcttctatcgcggtgaaacctcgcgtaaccgcgccagcggcggtgcgggtctggggttggcgatctgtcacagcatcgccctcgcccacggcggcaccctgagcgccgaccactcgcccacaggcggcctctggctgaccctgtgcctgccaggacacctgcgcccatga

SEQ ID NO: 77381 - protein, 463 aa, Pseudomonas syringae pv. syringae B728a
MKSSISTKLFVAVLASVLSVILIMGLTANWSFARGFLGYLNEQAMQRMSPVLPRLAAAYAREGSWEFMRDNKDRWFEVMRPEPAQDFAIPGLATPPTSDLTGAVFRIALLDAQKNLVMGFPGVHDDEFMRPVEVDGNVVGWMAVTPFQSVSEAGGERFQQYQLRASLAMGVLSLLLAVLIAWWIARTLLDPVKRVAAATHRLAAGEYASRVAVSSNDEVGQLARDFNQLAYTLERNEKMRREFMADVSHELRTPLSVLRGELEAIEDGVRTLDQASMKSLQGEVGMLSKLVDDLYELSLADVGALTYRKVDCDLAELLTNITDMFEERCAARQLHLQLELAGGALPVHADPGRLQQLIGNLLENSVRYTDAGGTVHVRAALQGDEVRVDVMDSGPGVDPQQLPRLFERFYRGETSRNRASGGAGLGLAICHSIALAHGGTLSADHSPTGGLWLTLCLPGHLRP

SEQ ID NO: 77382 - DNA, 1332 bp, Pseudomonas aeruginosa UCBPP-PA14
  CDS (1)..(1332)
atgagcgccgggttcggctcgcggatgtccctcggcgtccgcctgagcctgctgttcgccgcctgcacggcggcggtctcgctgatcgccggattgatcttcagcagggccatcgacgagcatttcgtcgaactcgaccacctggcgatgtccgccaagctcgcggtgtttcgcgacgaactgcgcggcctcggctcggaacagcagatgcgccgccgcgaagcggaactgctgcgcgaactggcacgccaccccgacctcggcctgcgcctgaacggcccggatggcaacctctggttcgagcgcctgccgcagcctgcgcatcccggtctgcccgccaaccgcgaactcggcgccccgctggagcccggcaacgacgcttcgccgcgactcaccgtgatcctcgacatcagtcatcaccagcacttcctgcaacgcatgcgccagttgatctggctgaccatgagcctgtcggcgctggccaccgcgctgctcggcgcctgggccaccggcgccagcctggcgccgctgcgacggatgcgcgaagtcgccgcgcgggtttccgccaactccctcaccacccgcctcgacgccagccggatgccggaggagctgcgcggcctggccggcgagctgaacgccatgctggcgcgcctggaagaagccttccagcgcctctcggcgttctccgccgacatcgcccacgagttgcgcaccccgctcaccagtctgctgacccagacccaggtggtattgtcccgcccgcgctcgctggaggactatcgcgaggccctgcacggcaacctcgaggagctggaacggctcaccgcgatggtcaacgacatgctgttgctggccaaggccgaccacggcctgctggcgcccagccgccaggccctggacctgggcgcggaagtcgactcgctgctggagttctaccagccgctggcggaagaccacgatatccgcctgctgcgcgaaggcagcctgagcctgcccggcgaccgcggcatgctgcggcgggtgctggccaacctgctggacaacgccctgcgcttcaccgccgatggcggagagatacgtatccgtctcggcgaccgacgcctgagcgtggagaaccagggtccggcgattcctcccgagcgcttgccgcgcctgttcgaccggttctatcgtgccgatccggcgcgccgcgaaggccagggtgaacacgccgggctcggcctggcgatctgccgctccatcgtccaggcccacggcggcgagatccgctgcgagtctgccgacggctggacccgtttcgtcatcgatttcgctcgcccgcgccgatga

SEQ ID NO: 77383 - protein, 443 aa, Pseudomonas aeruginosa UCBPP-PA14
MSAGFGSRMSLGVRLSLLFAACTAAVSLIAGLIFSRAIDEHFVELDHLAMSAKLAVFRDELRGLGSEQQMRRREAELLRELARHPDLGLRLNGPDGNLWFERLPQPAHPGLPANRELGAPLEPGNDASPRLTVILDISHHQHFLQRMRQLIWLTMSLSALATALLGAWATGASLAPLRRMREVAARVSANSLTTRLDASRMPEELRGLAGELNAMLARLEEAFQRLSAFSADIAHELRTPLTSLLTQTQVVLSRPRSLEDYREALHGNLEELERLTAMVNDMLLLAKADHGLLAPSRQALDLGAEVDSLLEFYQPLAEDHDIRLLREGSLSLPGDRGMLRRVLANLLDNALRFTADGGEIRIRLGDRRLSVENQGPAIPPERLPRLFDRFYRADPARREGQGEHAGLGLAICRSIVQAHGGEIRCESADGWTRFVIDFARPRR

SEQ ID NO: 77384 - DNA, 1902 bp, Methanococcoides burtonii DSM 6242
  CDS (1)..(1902)
atggatgaagtaccgttaaaaataaaattgatcatatacataggattaagcgttcttttagtaatggctgctaccacagctatcattatttctaccagcacatcccagcatgaagaccttgcatataagaagtctattgagaaggcaagcaattatgcaaacaagttcaactcagatatgcaatctaacatggcaatggcaagaacaattgcaagtacgctgacagtttacaattcctctgacagggaagaggtcaatgatattctaaaggaaatactcattgataatcccaatctgatcggtacctatacagcttttgaacccaatgcgtttgatggaaaggatgctgaatatgccggtactgaaggttatgattccacaggtcggcttgtgccatactggaacaaaattggtggtaccatattcatggaaccccttctatactatgaaatctctgattattatcaattgccaaaacagcttgagcaggaagtactgacagagtcatacctgtatcagggcgagcttattgtgagctatgtgtctccaataataagggatggcgagttcattggtattggaggtgttgatgtatcccttaactatattgatgagatagtatcaaatgttactgcttttgagactggttatgcattcactacaagcaatactggaatgctattatcccatcctgtgcataaggattggatcggtaaaaagacccttaatgatctcaatgactctgaaataacgtttatggcggataatattcgtgttgggcaagggggacatatagagacagttgacccgaccacaggggaagatgtgatcatattctatgaaccggtacgtacaggcaattattcttttattctggtgatcccgaaagaggacatgcttgcagatgtcagagccctgcggaatgaacttatactcatctcatcgattgcacttatttttatggccggtgcagcctatctcgttgcgatatccataacccgtccgataaacgagatcatttccaattttgaagatatctctaagtctgccctgaaaggtgatctgaacagaagggctgaggctgatgtgggagttgatttcaggaagattccctctggcttgaatgacatccttgattcgctacagatctattcgaatgatctggaaaaagcaaataaggagctcaaatcactggaccagatgaaggacgttttcctctcaaatgtcagccatgagctaaggacaccgcttaccagcatcaaaggctatactcagaatttgtatgatgagtccctgggtgatatcaacggctcacaaaagacatcccttgagaccgtactacgcaatgcagacagactcaggcgtttggtagattccctgctatatataagccaggcacaggcagagatcattgaatacgactttaaagaatgctatatagcaaaaataataagcaacaccattatggataccatcatgctcgttgaagaaaacgatctccatatcgaaaagaaaataccttcagatctccctaccatcgaagccgatgaggcccgcctggtcgatatgctgaacaacatcgttgataacgccatcaagttcactcctcccggtggtatgatcatccttggagtatttgatgacgaaaattatcttcacctcactgtcagtgacactggcatcggcatccccaaagaactgatcccgaacctgttcaagaagttctaccagatcgattcgtccataagacgaaaatacggcggaaccggtctgggtctttacatctgtaaaaagatagtggatgctcattccggtgagatctggatcgagagcgaaccccataaggggaccactgttcatatcaggcttccaaaggttagggatggtgaggaagttggttga

SEQ ID NO: 77385 - protein, 633 aa, Methanococcoides burtonii DSM 6242
MDEVPLKIKLIIYIGLSVLLVMAATTAIIISTSTSQHEDLAYKKSIEKASNYANKFNSDMQSNMAMARTIASTLTVYNSSDREEVNDILKEILIDNPNLIGTYTAFEPNAFDGKDAEYAGTEGYDSTGRLVPYWNKIGGTIFMEPLLYYEISDYYQLPKQLEQEVLTESYLYQGELIVSYVSPIIRDGEFIGIGGVDVSLNYIDEIVSNVTAFETGYAFTTSNTGMLLSHPVHKDWIGKKTLNDLNDSEITFMADNIRVGQGGHIETVDPTTGEDVIIFYEPVRTGNYSFILVIPKEDMLADVRALRNELILISSIALIFMAGAAYLVAISITRPINEIISNFEDISKSALKGDLNRRAEADVGVDFRKIPSGLNDILDSLQIYSNDLEKANKELKSLDQMKDVFLSNVSHELRTPLTSIKGYTQNLYDESLGDINGSQKTSLETVLRNADRLRRLVDSLLYISQAQAEIIEYDFKECYIAKIISNTIMDTIMLVEENDLHIEKKIPSDLPTIEADEARLVDMLNNIVDNAIKFTPPGGMIILGVFDDENYLHLTVSDTGIGIPKELIPNLFKKFYQIDSSIRRKYGGTGLGLYICKKIVDAHSGEIWIESEPHKGTTVHIRLPKVRDGEEVG

SEQ ID NO: 77386 - DNA, 1431 bp, Anabaena variabilis ATCC 29413
  CDS (1)..(1431)
atgaaaggctggtggcctgctattaaattaaatactattcattccaagttgttagctacttatctgctgctgatagtcttggggacttcctgtatggccagctatattctctggtctttccatgtttactttatgcgatcgcgacaaagcgacttagagaactggacaaatgctttgagcgagagtgtagcagatgctttggaagaaaaaaatctgcaacgcgtcaatctattagtgcagagatatggcgcaccacaaaaccttacactccgtatttttaatcagaaaggtagcttgctagccacttctgatcccaatttagatcaacaagttcaaaactggtacgcagttccgggaatggctgaagctctgcaaaaacgtcaatcccagggggtcgctaaaggtattttatcgcgtaaagatcgcctgtacgttgccaaacccattgtgcggaacggtcaattcctgggtgtgctgcgaatgtcaattactttggagcaatttcagcgtcagtttgcaagagtgattgttagtgtactgggtagcttggcgttaactatcgttttatgcgcgttgattagcacgcgctttgctcgcagtctttctagaccgattgaaattatgggtaacttcgcaattcggttgggtagtggtcaatttggcgataccttaactatccatgagaataatgaattggatcagctagcggtggaactgaaccggatgagtgaaagattagcctctctagaccaagagcgcagaacttttctggcaaatgtttctcatgaactccgcacacctattagcaatgttcaggtgacagtagatgcactgaaagggggagcttacgaagaacctcaattgcgcgatcgcttttttcaaacaattgaaaatgaaactaaacgtttatcacgactgattcatgacctgttagatttaggacgcttagaagcgggggtcagccagctagaacagcaaaatttatcattatcaggtttgatcaaccgtgcggttaatgctatggaacctagaatgcaggctgctggcgtatcattgcaagttaaagtaagcgatttactcatccaaggtgatccagaacgcctattacaagccattttgaatttactggataatgccatcaaacactcacaacctgattctcaagtcttgatttctggctacagcgacggtaaacaagcagttatcaaaattcaagaccaaggcaaaggcattcgggaacaggatttaccccggatttttgaacagttttatacaacagatccctcacgcacaggtaaaagtagcggtttaggactagcgattactaaacgaattatagaagcccatcaaggacgtattacagccaacagcactgcccatcaaggggcaacctttaccatttatctcccgttgccagcaaaaaataactaa

SEQ ID NO: 77387 - protein, 476 aa, Anabaena variabilis ATCC 29413
MKGWWPAIKLNTIHSKLLATYLLLIVLGTSCMASYILWSFHVYFMRSRQSDLENWTNALSESVADALEEKNLQRVNLLVQRYGAPQNLTLRIFNQKGSLLATSDPNLDQQVQNWYAVPGMAEALQKRQSQGVAKGILSRKDRLYVAKPIVRNGQFLGVLRMSITLEQFQRQFARVIVSVLGSLALTIVLCALISTRFARSLSRPIEIMGNFAIRLGSGQFGDTLTIHENNELDQLAVELNRMSERLASLDQERRTFLANVSHELRTPISNVQVTVDALKGGAYEEPQLRDRFFQTIENETKRLSRLIHDLLDLGRLEAGVSQLEQQNLSLSGLINRAVNAMEPRMQAAGVSLQVKVSDLLIQGDPERLLQAILNLLDNAIKHSQPDSQVLISGYSDGKQAVIKIQDQGKGIREQDLPRIFEQFYTTDPSRTGKSSGLGLAITKRIIEAHQGRITANSTAHQGATFTIYLPLPAKNN

SEQ ID NO: 77388 - DNA, 1338 bp, Methylobacillus flagellatus KT
  CDS (1)..(1338)
atgggcaaactgttctggaaaatatttcttgggttctcgctgacattactggtgacggtcgctggtgtcggcggtgccatctatttaaatgaaaagactgcttccggcgaggaaggcttcctgcgtgaccgcagggctgattttgtcgtcggtgtcaccgccaatgccctgcagtatggcggagaggcgggtgccaaggcactactcgaacactggcccgggcacaaggtgccaaccgtactggtcatcaaccagcatcatcaggatatcctcaaccgcaccgtcaggtcggaaaccttgcaacaagccatccatgcgctggaccaatccccgccgattcccagcgtgcggcgcgtccaggcaagcaatggcaaccaatacattctcttcattcctgcagaaggggcagactctgcaggaccaccccgctacaacctgcaactgcagattttcatcgccctgcttgcaagcctgctgttcagcgccggatttgcactctacctgagccgtccaatcaagctgttgcggcgggccagccgcaggctcgcagaaggcgacttgagcacgcgtgtaagcccagagctcggcaatcgcaacgatgaactcatagaactcggcgcggactttgactatatggcaacacgccttcagaccttgctggatgcccagcgattattgctgcacgatgtttctcatgagctgcgttccccggtcgcccgcatgcggcttgccgtggggctcgcccagcagcaaccggacaaactggcctcggcgctgagccgtatcgagcgtgaaaccgagaggctggacgaactgcttggccagatgctgacgctttcgcggttggagtcaggcatcagcagtgaaaacagcgagacactcaacctcaatgatttgcttgccaccattattcaggacgccaatttcgaggcgcaagccgtgggcagcagcatcacgtttcatgctgcagatgaagtaatactacagggacattatgaattgctgcgccgcgcattcgagaacattatccgtaatgcgctcaaatataatcaagctggtcaagcagtaacagtctcaattctcaagacgcagagtgcggtgatcgtcgaagtgcgggaccatggcccaggcttgccggaaacagagattgagtcagtgttccagccattctatcgcgtccgcggtacggaaaaggcaggacatgtcggatacggcctgggacttgccatcgccaagcgcgccatcgagcatcatcagggcaacatttcgctcagtaattgcgatgatggcggcctgtgcgtacggtgcacttttccgctcaccgccgctcctgcctga

SEQ ID NO: 77389 - protein, 445 aa, Methylobacillus flagellatus KT
MGKLFWKIFLGFSLTLLVTVAGVGGAIYLNEKTASGEEGFLRDRRADFVVGVTANALQYGGEAGAKALLEHWPGHKVPTVLVINQHHQDILNRTVRSETLQQAIHALDQSPPIPSVRRVQASNGNQYILFIPAEGADSAGPPRYNLQLQIFIALLASLLFSAGFALYLSRPIKLLRRASRRLAEGDLSTRVSPELGNRNDELIELGADFDYMATRLQTLLDAQRLLLHDVSHELRSPVARMRLAVGLAQQQPDKLASALSRIERETERLDELLGQMLTLSRLESGISSENSETLNLNDLLATIIQDANFEAQAVGSSITFHAADEVILQGHYELLRRAFENIIRNALKYNQAGQAVTVSILKTQSAVIVEVRDHGPGLPETEIESVFQPFYRVRGTEKAGHVGYGLGLAIAKRAIEHHQGNISLSNCDDGGLCVRCTFPLTAAPA

SEQ ID NO: 77390 - DNA, 1362 bp, Exiguobacterium sp. 255-15
  CDS (1)..(1362)
atgcgacatatttcttactacatcggtctgctttttttgactgcgattcttgtcatcggcggtattctgttcagtaccctctactttaatcttgtgaatcaacggacggacgaagtggtccttggtttgttgaaccggggaaatacacaccgtgatgtcctcgaggaatcttttaatgcagaaacattggaacatgtcagtttgatggaatcagcatccgaatttaccgtcgttatcacggatcaaaaaggaaaaattttaaaggcttcgcatccacttactcccaaaatgaaagtagagcttatccatacggaatttcaaacacaacgaaaagatcggattttaagagctcaagcggaaacgaagggtttttttatgacagatagtccaatcacgatttcaggtgttcatcgtgggcatgtcttcatgtttgctccggaaacgttaattcaacaagtcgtcgacccgttaagacaacaattcattcaagttggtatcattgccgtccttctgtcgcttacgactgtcgtgctgtgtacacgattgatttcaagaccactcattgagatggagcgtgcgacggccaagttgaaagaaggaaaccttgacgtggatttaccggtaaaccgctcggatgagcttggggcactggcacgctccatcacacagttggcaaaagatcttgattttttgaatcgtgaacggacagaatttttagcaaatatctcgcacgaacttcgaactccgctgacctacatgaagggttatgcggatatattacatcgtccaaacttgccggaatctgaaaaaacagcttatctgtcgattatcaaagaagaaagcgatcatttgagcacattgattgaacagatgatgttactggcacgttccgatacgaatgcattctcagtcgaacgagtgccgcttgcgctcgatcaattgattgtctcgacgacagagaaaatgcgacctgcaattgaagaaaaagggctgcatttgcatgtatcaggggaaccggtagagatagcaggagatgaaattcggctcaagcaagtgctgataaatgtattggataacgcaaaaaaatatacagcaaccggtgaaatcgtcgtccgatacggcaggaatgaaacaggaccgtattttcaagtacgtgatacaggaagcggcatcagccaagaaagtttaccccatgtgacaaaacgtctgtaccgcagtgaaccgtcacgatcacgaagccggggcggatcagggcttggtttgacgattgccttggcaatcgttcaagcacacgatgcgacattagatatcaagagtgaaaagaatgccgggacgagtgtgatgattcaatggaaggtgtga

SEQ ID NO: 77391 - protein, 453 aa, Exiguobacterium sp. 255-15
MRHISYYIGLLFLTAILVIGGILFSTLYFNLVNQRTDEVVLGLLNRGNTHRDVLEESFNAETLEHVSLMESASEFTVVITDQKGKILKASHPLTPKMKVELIHTEFQTQRKDRILRAQAETKGFFMTDSPITISGVHRGHVFMFAPETLIQQVVDPLRQQFIQVGIIAVLLSLTTVVLCTRLISRPLIEMERATAKLKEGNLDVDLPVNRSDELGALARSITQLAKDLDFLNRERTEFLANISHELRTPLTYMKGYADILHRPNLPESEKTAYLSIIKEESDHLSTLIEQMMLLARSDTNAFSVERVPLALDQLIVSTTEKMRPAIEEKGLHLHVSGEPVEIAGDEIRLKQVLINVLDNAKKYTATGEIVVRYGRNETGPYFQVRDTGSGISQESLPHVTKRLYRSEPSRSRSRGGSGLGLTIALAIVQAHDATLDIKSEKNAGTSVMIQWKV

SEQ ID NO: 77392 - DNA, 1755 bp, Rubrobacter xylanophilus DSM 9941
  CDS (1)..(1755)
atgatcgggctggtgctcttctacttcgcccagcagcggctcgtcgaggcggagaacaccctgctcatccagcgctcccgcacggcgaacgcgggggcgaccgagttcatcgagggcctccggcgtcccgaggaccagaccctgccgccgcccgagagctacgccggggagctcgtgcagaccgtctccgaccccacggggctcgcggtgctctacgtgggccccggcggcaggcccctcgccgcccgcgacgggctcggcaacccgctcgacccgcacaggacctacgagcgcctggggctcgagcggggcctcatacagcgggtggcctcctcgccgcagggcaagggcatcctcacccgcgccgacggctcctacataaccgtgtggccgctgctcgacgcggggggcgtctccaggggcgtcatggtctacgacgtcccgcaggacgagctggaccagagcctctcgtacctgcggctggggatagtcggggccatcggcacgagcgtcctgctcgccgggggggccagcctgctgctgacccgccagatcacccgccccctctccgagacccgcgacgccgccataagggtcgcctccggcgactacagcacgcccgtgccggtcaccagcagggacgagctcggggagatggcgcgggccttcaactacatggccggcgagatagagcactacataagcgagatccaggaccagaaaaagcatctggaggcggtgctggaggcctcgctggaggcccttgtggccaccgaccacgcgggcggcatcaccatggccaacgccgccgcggcccggatgctcggggtgcgccccggagacaggggacgcagcctgagggaggtcggcgtggccccggagatcctgggcatcgtccgggaggcggcggagaccggcttctccgtcagggaggtcgagctcggcgagaagtccttctgggcctacgccgcgcggatggacagcggcgggcgctcgcagggcggggtcatactcgcggtcagggacataagcgagtaccgggccctggagcgggccaagtccgccttcgtctcggacttctcgcacgagctcaggacgccgctcaccaccatccagagcgccgtggggctgctgcagcgggcccgcgagaggctcgacccgctggagaaccgggccctggagctcgccgagggggagctcagcaggatccgggcgatggtggaggagctcatgacgctcgcccagatggactcctggcagtactcgctgcagctcgcgccggccggcctcgaccgcatcctgcgggacgcggtcgaggcggtcgagcccaaggcgctgcgcttcgggatagagataaacctctacgaggctggggtgcacctcacctgcgacgcccagaagctctaccaggtgttcctgaacctgctggacaacgccgtgaagtactccgaggagggctcccgggtggacgtaacggtcgcggagagcggggagcaggcggtcgtgcgggtcaaggacaccggggtggggatacccgagaaggacctcccccacctcttcgagcgcttctaccgggtggagaaggaccgctcgaggtccaccggcggcagcgggctcgggctcgccatctgcaagcagatcgtggagatgcacggcggttcgatctccgtggagagccggctgggggagggctcgaccttcaccgtgcggctccccaagaacccccggcgtccggaggccccgcgtgcggggtag

SEQ ID NO: 77393 - protein, 584 aa, Rubrobacter xylanophilus DSM 9941
MIGLVLFYFAQQRLVEAENTLLIQRSRTANAGATEFIEGLRRPEDQTLPPPESYAGELVQTVSDPTGLAVLYVGPGGRPLAARDGLGNPLDPHRTYERLGLERGLIQRVASSPQGKGILTRADGSYITVWPLLDAGGVSRGVMVYDVPQDELDQSLSYLRLGIVGAIGTSVLLAGGASLLLTRQITRPLSETRDAAIRVASGDYSTPVPVTSRDELGEMARAFNYMAGEIEHYISEIQDQKKHLEAVLEASLEALVATDHAGGITMANAAAARMLGVRPGDRGRSLREVGVAPEILGIVREAAETGFSVREVELGEKSFWAYAARMDSGGRSQGGVILAVRDISEYRALERAKSAFVSDFSHELRTPLTTIQSAVGLLQRARERLDPLENRALELAEGELSRIRAMVEELMTLAQMDSWQYSLQLAPAGLDRILRDAVEAVEPKALRFGIEINLYEAGVHLTCDAQKLYQVFLNLLDNAVKYSEEGSRVDVTVAESGEQAVVRVKDTGVGIPEKDLPHLFERFYRVEKDRSRSTGGSGLGLAICKQIVEMHGGSISVESRLGEGSTFTVRLPKNPRRPEAPRAG

SEQ ID NO: 77394 - DNA, 1125 bp, Crocosphaera watsonii WH 8501
  CDS (1)..(1125)
atgttgaatcaaagtaaattgagtaaaaaaatgtcaagattaagtctaggaactcggttgtttttatcccatttattagtgatgtttgtcggtttaggaagttttattagtattgccaaagtttcctcccctagaatgtttgttgttcgcttagaaaagttagaacaacaaggatttttcaccgttcgttctgctagaacatatttagtaagagggtttgaaaccgcctggaataatagtgcattttggtctgttattttcggagttagtgctgctggaggtgttagttatattgtctctcgtcgtactatgaaacccctcaatcaaatgaaagaaattacccaaaaattagggcaaggatatctagaagaaagaatgccggatagtgatatccctgaatggaatcaattaggaaaaagcttcaatattatggccagtagtttacaagatgtagagacaagaagacgagaattaattagtgatatgacccatgaattacgcactcctttaactattatgagagggtatttagaagaactagctaacggttcgatagaaggttctcccgaactatatttaaacttagtcaaagaaaccagaagactagagagattaattcatgatctccaagaactttctaaagcagaagcaggttatctttctattagtttatatcccataaatattcttcctttactaacttctttagtagaaagatttgcagatcagattatggattatggaccaactattaaattagaatgtatccaagaattacccccagttttagcagatagcgatcgcacagaacagatattagttaatttaattggtaacgctattcgttatacagaaaaaggaactattactattaaagcatggtcagaaaataaacaagtttgggtggaaattattgatacagggataggaattaaaccagaagatttaccctatgtatttgaaagattttggcgcgccgataagtcccgttcacggtattctggaggaactggtattggactagctattacccgtcgtttggtagaattacaaggaggaaaaattgaagtcgaaagcgaagttgatcaagggactacttttcgctttaatttagccattggttga

SEQ ID NO: 77395 - protein, 374 aa, Crocosphaera watsonii WH 8501
MLNQSKLSKKMSRLSLGTRLFLSHLLVMFVGLGSFISIAKVSSPRMFVVRLEKLEQQGFFTVRSARTYLVRGFETAWNNSAFWSVIFGVSAAGGVSYIVSRRTMKPLNQMKEITQKLGQGYLEERMPDSDIPEWNQLGKSFNIMASSLQDVETRRRELISDMTHELRTPLTIMRGYLEELANGSIEGSPELYLNLVKETRRLERLIHDLQELSKAEAGYLSISLYPINILPLLTSLVERFADQIMDYGPTIKLECIQELPPVLADSDRTEQILVNLIGNAIRYTEKGTITIKAWSENKQVWVEIIDTGIGIKPEDLPYVFERFWRADKSRSRYSGGTGIGLAITRRLVELQGGKIEVESEVDQGTTFRFNLAIG

SEQ ID NO: 77396 - DNA, 1473 bp, Anabaena variabilis ATCC 29413
  CDS (1)..(1473)
atgaaactcccttcctttcggctgcgaattgctctgttatctgccgctttggctggcactacactagtaggatttagtgcagtctcttggttgcaaatttacgatgctaaactcagtcgcctggatgcagaactgttaaatcaactgatgcgggcagcaccaaacttacttccacccagagaaccccctacatttttcactagggaaaattttcgtccacctatgccagagccttggcagcgttacgaagaattattatcttccgcctttggtggaaatgcaaaaacacctattgtactgttggtactggatgcagaaggcaaccaactttatgaatccccacaaacttctcctgactctgacttacgtcgcctgttgcttcagaatctccagttagcgcctcaaccacaacccccccggcctttacccaatcttcccttgcgccccccacgtccaccgcaatttgtcacccaaaagacaacaagcggcagttggcgaattggtgcaactaaatttccccgttctcaggttgcgatcgctgtcagtctgcaaaccgtcaatcaagagatggcagccattcgcaatatatatcttgtttccattcccatcgccttgctactagttacctctggagcttggttagtttctggtagtgcattgcgtccgattcggcaattaacggctgtaattcaacaggtgagcgccaaaggtttagatcagcgcattcccatcggtacgacggatgttgaatttgtagaactaattcaggtgtttaatcaaatgttggaacgcctggaaagcagttttacccaagcctctcgcttcagtgcagatgcagcccacgaactgaaaacccccctaacaattctccaaggtgaactggaacgcaccctgcaacaggtggaaccaggctcggaagtacaacagcgtttaagcaatttattagatgaagtgcgccgcttgagtggaattatgcgtaaactcttgctgttgtccttagccgatgcaggacaaatgagtttgtatctagtggaagtagatatgtctgagttattaatggagatggttgaggatgtggaattactcgcgccccatttgagtgtacacatcgaaattcctgagaaattgcgggttaaaggcgatcgcgatctcctcatccaagtgttgcaaaacctgttgagtaatgccatcaaatacaatctcccccaaggttggatcaaaattcacgctcatcaaaccccaaccactatccacatcactattagcaactcatccccagacattcccccaagcgatcgcgatcgcttatttgagcgtttctatcgtggtgatcccgcccgcacacgcaaagtagaaggcatcgggctaggactcagcctgtcccgtgaaattgcccgcgcccatcgtggtaacttaaccttagatgcggaaaattctggtcaaacaaggttgactctgactttactccggtga

SEQ ID NO: 77397 - protein, 490 aa, Anabaena variabilis ATCC 29413
MKLPSFRLRIALLSAALAGTTLVGFSAVSWLQIYDAKLSRLDAELLNQLMRAAPNLLPPREPPTFFTRENFRPPMPEPWQRYEELLSSAFGGNAKTPIVLLVLDAEGNQLYESPQTSPDSDLRRLLLQNLQLAPQPQPPRPLPNLPLRPPRPPQFVTQKTTSGSWRIGATKFPRSQVAIAVSLQTVNQEMAAIRNIYLVSIPIALLLVTSGAWLVSGSALRPIRQLTAVIQQVSAKGLDQRIPIGTTDVEFVELIQVFNQMLERLESSFTQASRFSADAAHELKTPLTILQGELERTLQQVEPGSEVQQRLSNLLDEVRRLSGIMRKLLLLSLADAGQMSLYLVEVDMSELLMEMVEDVELLAPHLSVHIEIPEKLRVKGDRDLLIQVLQNLLSNAIKYNLPQGWIKIHAHQTPTTIHITISNSSPDIPPSDRDRLFERFYRGDPARTRKVEGIGLGLSLSREIARAHRGNLTLDAENSGQTRLTLTLLR

SEQ ID NO: 77398 - DNA, 1035 bp, Bifidobacterium longum DJO10A
  CDS (1)..(1035)
atgaaacctcgcgtcaagccggttgatttgttctcatctctgaagctggaactcagcgcactgatcgttatcgccactgccatcgcgtttgccatgtgctggttcctcctgaaattcggctggtccggttggatcgccatgccgctgactttggtggtggccttgggcatcacctatttcttctctcgcggcatcaccgctcccctacgccagatgcgcgatgtggccgaagccatggcggatggcgattacacggtccgcgtggatatcgatcaggatcgtcatgacgaggtcggcaagctggctcgctcgttcaacgagatggccggcgaactcgagcatgccgataaaatgcgccgcgacatgatcgccaatgtgagccatgagctgcgcacgcccgtttccgctttgcaggcgatggtcgagaacatggccgacggcgtcaccgagcccactcccaccaatctggagagcatcctcacccaaacgcagcgtctctccgatctcatcgccttcctactggacctgagccgtatggaggccggtgcggcgagtctgaatatcgaaaagttcaacttcgccgactttcttgacgagaccatcgagccgttggaaatcgccgatggtggccacgcccacgacatccgcgtcaccgtgccggccgacatcacgatggaaggcgatcaggaccgcctgcgccagctattcaccaacatcatcgccaacgcgctgaaacattcggccgacggcaccaccgtgctggtcgacgcccacgaggacgaaaaccaaggcaccatcgtgaccaatgtggtgaatttcggctcccagattgcgccttccgaccgtttggacatcttccggcgctttgtcaaaggcaagacgggtcccggcaccgagtcgggcggcaccggtcttggcctgtccatcgcgcgctgggcggcccaattgcacggtggcaccgtcaaagtggtcgacgacacgcgaggtgccgatttcgaaatcatcctgcctaaatatcacatcgccgaacgctga

SEQ ID NO: 77399 - protein, 344 aa, Bifidobacterium longum DJO10A
MKPRVKPVDLFSSLKLELSALIVIATAIAFAMCWFLLKFGWSGWIAMPLTLVVALGITYFFSRGITAPLRQMRDVAEAMADGDYTVRVDIDQDRHDEVGKLARSFNEMAGELEHADKMRRDMIANVSHELRTPVSALQAMVENMADGVTEPTPTNLESILTQTQRLSDLIAFLLDLSRMEAGAASLNIEKFNFADFLDETIEPLEIADGGHAHDIRVTVPADITMEGDQDRLRQLFTNIIANALKHSADGTTVLVDAHEDENQGTIVTNVVNFGSQIAPSDRLDIFRRFVKGKTGPGTESGGTGLGLSIARWAAQLHGGTVKVVDDTRGADFEIILPKYHIAER

SEQ ID NO: 77400 - DNA, 1617 bp, Magnetospirillum magnetotacticum MS-1
  CDS (1)..(1617)
atgacgagtgaggccgccaccccgtcgcgacggcgcctgccccgctggcggctgctggcttcgccgctgacccggcgcatcctggcggtcaatctgctggcccccgtcgtgctggtggctggcgtgatgtatctcgaccgctacaaacagggcctgatccgcgccgaactggacgggctgggcacccaggccgagatggtggcgggcgccatcggcgaaggcgccgtcttcgaagaggatgcgggcttcttcgagatcaacccggccatggcccagcagatggtccgccgcctgtccgagcccgccaagttccgcgcccgcctgttcggtacggtgggcgaactggccgccgattcccgcgtggtaggcggcgccaaaggctccatctatatcgaggaactgccaccacccacgccgccgcaatggaccgaccgtctggcgcgtcaatgggaccgctgggcccgctggatgccccgcgacaagtccctgccgctctaccgcgaacaccccaatgcgcgggccgatgatttcgaggaagtgatgagcgccatggcaggaagaaccgcctgggcggtgcgctcgcgcctgaacggcaccttgatgctctccgtggccgtgccggtccagcgctacaagcaggtggtgggcgccctgttgatcaccgccgacggcgccaatatcgcccgctcgctgttccaggtgcgcgtcgccatcctggaagccttcgccatttccctggcgctgaccatcggcgtgtcgctctacatggcgggcaccatcgcccggcccatccgccgcctggccctggccgccgagcgggtgcgtcacggccagggccgcgtccacgccattcccgacctgtcatcgcgcaaggacgagatcggcgaattgtccctggccttgaaggaaatgaccgaggccctgtggcggcgcatggacgccatcgaggccttcgccgccgatgtggcccatgagatcaagaacccgctgacctcgctgcgttccgccgtcgagaccgcggcgcgtatcgaggacccggaaaagcgcgcccgcctgatggccatcgtcctcgacgatgtggggcgcttggaccggctgatcagcgacatttccgatgcctcgcgcatcgatgccgagatgagccgggcagaaaccggacccgtcgccctggccgccatgctcgacaccctggccgagatctatcgcggcacctgcgcggcccaaggtctggccttcgcggtcgagcggcccgaaggcgacaccctgaccatccagggtatcgaatcccgtctggtccaggttctgcgcaatctgatcgccaatgccgcgtctttcagccctcagggcgggctcatccgtcttgccgcccggcgcgaggccgcccgcatcactctggttgtcgaggatcaggggccgggcatcccgcccaacaagctggacgccatcttcgagcgcttctattccgagcggcccgagggagagaagttcggaacccattccggcctgggcctgtccatctcgcgacagatcatcgaggcccatggcggcaccatccgcgccgaaaaccgagacgagggcggagcgcgcttcatcatcgatctgcccgccgccccatga

SEQ ID NO: 77401 - protein, 538 aa, Magnetospirillum magnetotacticum MS-1
MTSEAATPSRRRLPRWRLLASPLTRRILAVNLLAPVVLVAGVMYLDRYKQGLIRAELDGLGTQAEMVAGAIGEGAVFEEDAGFFEINPAMAQQMVRRLSEPAKFRARLFGTVGELAADSRVVGGAKGSIYIEELPPPTPPQWTDRLARQWDRWARWMPRDKSLPLYREHPNARADDFEEVMSAMAGRTAWAVRSRLNGTLMLSVAVPVQRYKQVVGALLITADGANIARSLFQVRVAILEAFAISLALTIGVSLYMAGTIARPIRRLALAAERVRHGQGRVHAIPDLSSRKDEIGELSLALKEMTEALWRRMDAIEAFAADVAHEIKNPLTSLRSAVETAARIEDPEKRARLMAIVLDDVGRLDRLISDISDASRIDAEMSRAETGPVALAAMLDTLAEIYRGTCAAQGLAFAVERPEGDTLTIQGIESRLVQVLRNLIANAASFSPQGGLIRLAARREAARITLVVEDQGPGIPPNKLDAIFERFYSERPEGEKFGTHSGLGLSISRQIIEAHGGTIRAENRDEGGARFIIDLPAAP

SEQ ID NO: 77402 - DNA, 1140 bp, Burkholderia cepacia R18194
  CDS (1)..(1140)
atgaaactcagtgggctgggccgcaagattgcggtgtcgatggccgagctggcgctcggcatcatgttggtcgtcgtactgatggtctacgggttttactacgtgatgttccggcactggagcgaggtgtgttaccagtccagctggtttccgtcgaactccgagtggctatggctgggcaccacgatcctgatcggcctggtcatcgcgatcatcgtgtcgacccggctcgcgcatcgcattctggtgccgctcaactcggtcgcggacagcatccgtcgcgtcgccaagggcgacctgaccgcgcgcgccgtcgccggcgatcgatcgattcgtgaagccgcgctgatcgcggacgacttcaatgcactcgcggcccagctgcagcgcatgacggacgagcaggcattctggaatgccgcgatcgcgcacgagctgcgtacgccggtcacggtcctgcgcgggcggttgcaggggctggcggaaggcgtgttccagccgggcgaggcgctgttccggagcctgttgacccaggcggaaggactgacgcgcctgatcgaggatctccgcgtgatcagcctcgccgaaagcgggcacctgagcgtcagcctccaggcgaccgatctgacgacgcacgtcaaggcggtcgtcgagatgttcgaggattcgctggccgcggccggtcaacacatggtgctcgatctcgatatgcgggccgtccactgcgacccgttccggatgcgccaggcgctgctcgcactgctggagaatgcacggcgctatgcggtgcccggcgcgatccgcattcacacgcgcgtcgaaaacggtgcatgccacttgcaggtcgaagacgaagggccgggcattccggccgattacgccgcgcagattttcgatgcgttcaggcgcgtggacgatgcggattccagccagaagggcggcagcggcctggggctggccgtggtcgcggccattgcgcaggctcacggcggagcggcatcgtgccgtccgaccgtgcgcggcggcacggtgttcgagttgcgctggcccgacagccccgcttcgccgcggatcgcaccatcgaaccggaaggatgcaccgtccgccacacagcgcgccgtcgataccgatccacggtaa

SEQ ID NO: 77403 - protein, 379 aa, Burkholderia cepacia R18194
MKLSGLGRKIAVSMAELALGIMLVVVLMVYGFYYVMFRHWSEVCYQSSWFPSNSEWLWLGTTILIGLVIAIIVSTRLAHRILVPLNSVADSIRRVAKGDLTARAVAGDRSIREAALIADDFNALAAQLQRMTDEQAFWNAAIAHELRTPVTVLRGRLQGLAEGVFQPGEALFRSLLTQAEGLTRLIEDLRVISLAESGHLSVSLQATDLTTHVKAVVEMFEDSLAAAGQHMVLDLDMRAVHCDPFRMRQALLALLENARRYAVPGAIRIHTRVENGACHLQVEDEGPGIPADYAAQIFDAFRRVDDADSSQKGGSGLGLAVVAAIAQAHGGAASCRPTVRGGTVFELRWPDSPASPRIAPSNRKDAPSATQRAVDTDPR

SEQ ID NO: 77404 - DNA, 1326 bp, Burkholderia cepacia R18194
  CDS (1)..(1326)
ttgctgatctggctgctcgcgatcgtcgtcgcgggcgtgggcatcgcgggctggctcatctaccggcaggcgctcgccgaagcgaacgaactgttcgactaccagttgcaggaaatcgccgcggccttgccgtcggagccgttctcgcaggtgttcggctcgcgcaccaacggcgacgaaggcatcgtgatccagatctggaaccgcaacggcgtgctgatgtacttctcgcatccgcgtgcgccgatcgcgccgcgcgcggagctcggcttctcgaccgagcgcaccgatcgcggcgaatggcgcgtgtacggcgcgatcgtcggcgacaacgtcgtgcagctcgcgcagccgctgtcggtgcgcaaccggctcgcggcgaacgtcgcgctgcgcacgctgtggccgctgatcgtgctgctgccgttcctcggcgcggccgtgtgggtgatcgtcgggcgcgggctcgcgccgctcggccgcgtgacgcgcgcggtcgaggcgcgccggccggaagcgctcgatccgctgcccgatgcgcgcctgccgctcgaggtgcagccgctcgtacgggcgctgaacgggctgctcgcgcggctggcggccgcgctcgacacgcaaaaggccttcgtggccgacgccgcgcacgaactgcgtacgccgctcgcggccgtgcagatccaggcgcagctcgtcgcccgcgcgaaggacgacgcatcgcgccgcgaggcggtcgcggatctccaggatggcgtgtcgcgagcgacgcgtctcacggagcagctgctcgcgctcgcacgcgccgaaccggatggcgcgacgatgcgcgagccggtcgacctgcaggcattgcttgccgaatgcgtggccgcgcttgcgccgctcgcgcaacggcacgacatcgatctcggcttcgaggagacgcgtgcggcgagcgtcgtcgcggacgtcggcgcgttgcgcgtgatgttcggcaacctgctcgacaacgcggtgaagtacacgccggacggcggccgcatcgacgtgtcgctgacccgcgacgcggccggtcgcgcatgcgtgcagatcggcgacagcgggcccggcattccggccgacgagcgcgagcgcgtgttcgaccgcttctaccgcgacagctccgcgcgggcgcgcaccgacgtgtcgggcagcgggctcgggctcgcgatcgtcaagcgcgtggccgcgcagcagggtgcaacggtgtcgctcggcgacgcggctgcaggcgggctgctcgtcagcgtcgtgttccgcgatgccgagatgccggccgaggcgccgcagccgtccgaatccgtgtga

SEQ ID NO: 77405 - protein, 441 aa, Burkholderia cepacia R18194
MLIWLLAIVVAGVGIAGWLIYRQALAEANELFDYQLQEIAAALPSEPFSQVFGSRTNGDEGIVIQIWNRNGVLMYFSHPRAPIAPRAELGFSTERTDRGEWRVYGAIVGDNVVQLAQPLSVRNRLAANVALRTLWPLIVLLPFLGAAVWVIVGRGLAPLGRVTRAVEARRPEALDPLPDARLPLEVQPLVRALNGLLARLAAALDTQKAFVADAAHELRTPLAAVQIQAQLVARAKDDASRREAVADLQDGVSRATRLTEQLLALARAEPDGATMREPVDLQALLAECVAALAPLAQRHDIDLGFEETRAASVVADVGALRVMFGNLLDNAVKYTPDGGRIDVSLTRDAAGRACVQIGDSGPGIPADERERVFDRFYRDSSARARTDVSGSGLGLAIVKRVAAQQGATVSLGDAAAGGLLVSVVFRDAEMPAEAPQPSESV

SEQ ID NO: 77406 - DNA, 1320 bp, Burkholderia cepacia R1808
  CDS (1)..(1320)
ttgctgatctggctgctcgcgatcgtcgtcgcgggcgtgggcagtgccggctggctgatctaccggcaggcgctcgccgaagcgaacgagctgttcgactaccagctgcaggaaatcgcggcggcgctgccgtccgaaccgttctcgcaggtgttcggctcgcgcaccaacggcgacgaaggcatcgtgatccagatctggaatcgcaacggcgtgctgatgtacttctcgcatccgcgcgcgccgatcgcgccgcgcgcggagctcggcttctcgaccgagcgcaccgatcgcggcgaatggcgcgtgtacggcgcgatcgtcggcgacaacgtcgtgcagctcgcgcagccgctgtcggtgcgcaaccggctcgccgcgaacgtcgcgctgcgcacgctgtggccgctgatcgtgctgttgccgttcctcggtgcggcggtctggatgatcgtcgggcgtggcctcgcgccgctcggccgcgtgacgcgcgcggtggaggcgcgccgcccggaagcgctcgatccgctgcccgacgcggggctgccgctcgaggtgcagccgctggtgcgcgcgctgaacgggctgctcgcgcggctgtcggccgcgctcgacacgcagaaggcgttcgtcgccgatgccgcgcacgagctgcgcacaccgctcgccgccgtgcagatccaggcgcagctcgtcgcgcgcgcgaaggacgacgcggcgcgccgcgaggcggtcgccgatctgcaggacggcgtcacgcgcgcgacgcgcctgaccgaacagctgctcgcgctcgcccgcgccgagcccgacggcgcgtcggtgcgcgagccgatcgacctgcacgcgctgctggccgaatgcgtggccgcgcacgcgccgctcgcgcagcggcgcggcatcgacctcggcttcgaggaggcatgcgcggcgaccgtcgtcgcggacgtcggcgcattgcgcgtgatgttcggcaacctgctcgacaacgcggtgaagtacacgcccgacggcgggcgcatcgacgtgtcgctgacgcaggacgcggccggccgcgcatgcgtgcagatcgccgacagcggccccggcatcccggccgacgagcgcgagcgcgtgttcgaccgcttctatcgcgacagctcggcgcgcgcgcgggcggacgtgtcgggcagcgggctcgggctcgcgatcgtcaagcgcgtcgcggcgcagcagcgcgcgacggtgtcgctcggcgatgcggccgccggcggcctgctcgtgagcgtcgtgttccgcgaggccgacacgggggcgcaggcacggtcggcatctgcgtaa

SEQ ID NO: 77407 - protein, 439 aa, Burkholderia cepacia R1808
MLIWLLAIVVAGVGSAGWLIYRQALAEANELFDYQLQEIAAALPSEPFSQVFGSRTNGDEGIVIQIWNRNGVLMYFSHPRAPIAPRAELGFSTERTDRGEWRVYGAIVGDNVVQLAQPLSVRNRLAANVALRTLWPLIVLLPFLGAAVWMIVGRGLAPLGRVTRAVEARRPEALDPLPDAGLPLEVQPLVRALNGLLARLSAALDTQKAFVADAAHELRTPLAAVQIQAQLVARAKDDAARREAVADLQDGVTRATRLTEQLLALARAEPDGASVREPIDLHALLAECVAAHAPLAQRRGIDLGFEEACAATVVADVGALRVMFGNLLDNAVKYTPDGGRIDVSLTQDAAGRACVQIADSGPGIPADERERVFDRFYRDSSARARADVSGSGLGLAIVKRVAAQQRATVSLGDAAAGGLLVSVVFREADTGAQARSASA

SEQ ID NO: 77408 - DNA, 1431 bp, Listeria monocytogenes str. 4b H7858
  CDS (1)..(1431): transl_table=11
atgaaatttaaatatgcttaccaattatttttcacacaatttatcattttgcttattgcttgtatcatgattggggtgcttgtctctcactccttaaaagattatttttaccaaagccaagtagatgacttaacaagttatgggcaaacgatttctagggatattcgctattcgccacaagatgcaacgatgcaagttttgaatacgtatcagcgaattttagatgtgaaaaaaattcattatacaatcaaaaacgccaacgatgaaaccatttatccaacacagatgaatcagccgttaccaaaggatttctctatttcttcggatgataagaaaaagcttgaaagtggcgaaacagttagtaagaaaatagataatcgctttaataaagaaatgacaattgtgtacgtcccaataatgaatggcgacaaatttgtcggttctatcgtgctcaattcacctattagcggtacggagcaagtaattggtacgattaaccgctatatgttctacactattttactttctataacggtagcacttattcttagcgcaatcttgtccaaactacaagtaaatcgaatcaacaaactacgagcagcgacaaaagacgttattcaaggcaattacaaagctcgattgaaggaaaataattttgatgaaattggtgcacttgccattgatttcaataaaatgacacaaacccttgaaacatctcaagaagaaatagaacgacaagagaagcggagacgccagtttattgctgatgtttctcatgaaatgcgtaccccgctcacaacgattagtggcctcacggaaggtttagtaaatgatattattccaaaaagtgaaacagatcgttgcatagcactcattgatacagaagctagacgtttaacgaaactagtcaatgaaaatttagattatgaaaaaatccgcagtaacaaaattatacttcaaaaaacacgttttaatggtaaggaattccttgagttaatcaaagaacaacttgattatgtatcaagcgaaaaaggtaacactattactgtttctatcgataaagacatggcgatttacgcagattacgatcgtttaacacaagtatttatcaatatcgtcaaaaatagtgtccaatttactgaaaatggtcagattactctaactggcacacaagattataaagaatctgttttaacgataacagatactgggattggtatgaatacagaggaattagaacaaatttgggaaaggttttataaagcagatatgtctcgaacaaataccgcttttggcgaatctggtattggcttatccattgtgaagcagttaattgaatatcacgatggatcaattacagtgactagtgaaccaaataaaggtacttcatttactattcgccttccttttttccaagataacgaacaataa

SEQ ID NO: 77409 - protein, 476 aa, Listeria monocytogenes str. 4b H7858
MKFKYAYQLFFTQFIILLIACIMIGVLVSHSLKDYFYQSQVDDLTSYGQTISRDIRYSPQDATMQVLNTYQRILDVKKIHYTIKNANDETIYPTQMNQPLPKDFSISSDDKKKLESGETVSKKIDNRFNKEMTIVYVPIMNGDKFVGSIVLNSPISGTEQVIGTINRYMFYTILLSITVALILSAILSKLQVNRINKLRAATKDVIQGNYKARLKENNFDEIGALAIDFNKMTQTLETSQEEIERQEKRRRQFIADVSHEMRTPLTTISGLTEGLVNDIIPKSETDRCIALIDTEARRLTKLVNENLDYEKIRSNKIILQKTRFNGKEFLELIKEQLDYVSSEKGNTITVSIDKDMAIYADYDRLTQVFINIVKNSVQFTENGQITLTGTQDYKESVLTITDTGIGMNTEELEQIWERFYKADMSRTNTAFGESGIGLSIVKQLIEYHDGSITVTSEPNKGTSFTIRLPFFQDNEQ

SEQ ID NO: 77410 - DNA, 1380 bp, Listeria monocytogenes str. 1/2a F6854
  CDS (1)..(1380): transl_table=11
atgaaatcgttatacagtcgaatagttgtcacgatgcttgtcgtcatcctttccagtagtttgctcggctttttctttgcaaacatttattaccaaataaaattaaaaccttttaacgacgaaaaaacagccaaaatagcgaaggaagtccaacaattttacgagtcaaatgctacgatttctttaaatgagtacttggaaaatgtgggcgaactgggatatgaattatatttgacagatggcgcggaaaaatccacttattttggtggtgcttttcgaaaaaaagatttaccagataagacaatcaagcaagtactagacggagatacttatcatggaattgactcattcgatacaggcattttcatcacaggcttttttgataatgatgtgcgaaataccattggtgtcccggtgcaagtagatggtaaacaactagcgctattcatacgtcaagacccggaacaacaatttggggaactccgaatatttttcgcgatgatacttatttttacatccatcattagtatcctatttgtccttattagtggcagatatattgttaatccggtcgtgaagttgacgaatgcgacgaaaaaaatccgtaaaggtaattatgatgtagcatttgaagttcggcgtaaggatgaaattggacagttggcagactcgtttacgaaaatggctagtgaactcgaaaaatctgaagctgcccgccaagaatttgtcgccaatgtttctcatgaactacaatctccgctcacatccatgcaaggtttcgcgagacttttaggttcaggaacattaacagaaaaagaacaagcggaatatttaaccgttttatcagaggagaccacgcgtctatcttccttaaccaaacaactactcacactcgcttcacttgatcaagaatcagagctacggaaaaaagaaccagttcacttagccaagcagtggcgtcaattaatccaaatgaccgagtggagttggcgcgaaaaagaactaacgataaacttagatttagcagatgtaaactatactggcgatgccgaattgctttatcaagtgtggtccaatttgttaactaatgcgattaaattcacaccacagggcgggaatattcaagtccgcctttatgaagatacgacgaatgtttttgtagaagttcaagatagcggtgtcggcataagtaaggtggatatgaccaagatttttgaccgtttttataaagctaacgaaagccgaaccagagaagaaggctcgagtggcctaggattatccatttgccagaaaattatcacgctccatcacggcgaagtaaccgtgcaaagtagccttgaaaaaggaacaacattcacagtcaaactaccaaaaaactaa

SEQ ID NO: 77411 - protein, 459 aa, Listeria monocytogenes str. 1/2a F6854
MKSLYSRIVVTMLVVILSSSLLGFFFANIYYQIKLKPFNDEKTAKIAKEVQQFYESNATISLNEYLENVGELGYELYLTDGAEKSTYFGGAFRKKDLPDKTIKQVLDGDTYHGIDSFDTGIFITGFFDNDVRNTIGVPVQVDGKQLALFIRQDPEQQFGELRIFFAMILIFTSIISILFVLISGRYIVNPVVKLTNATKKIRKGNYDVAFEVRRKDEIGQLADSFTKMASELEKSEAARQEFVANVSHELQSPLTSMQGFARLLGSGTLTEKEQAEYLTVLSEETTRLSSLTKQLLTLASLDQESELRKKEPVHLAKQWRQLIQMTEWSWREKELTINLDLADVNYTGDAELLYQVWSNLLTNAIKFTPQGGNIQVRLYEDTTNVFVEVQDSGVGISKVDMTKIFDRFYKANESRTREEGSSGLGLSICQKIITLHHGEVTVQSSLEKGTTFTVKLPKN

SEQ ID NO: 77412 - DNA, 1053 bp, Bacillus cereus G9241
  CDS (1)..(1053): transl_table=11
atgaatctattaagcaccggtattatgataattgctatatggtatagtgagacgaaaatgttacttgaacaggaacaaacgcggttattaaccataattgcatttgtggcatttattatttcgacgtttatttattggttaatgacacgtcctatcatgagatctatacaaaatttaataaaattgacgaaacaatttagtgatagacactttgaaacgatgtatataattgggcaagaaccacgggagtttaaagaattagcaacagcttttcaacagatggcaaaaaaattagaagaagggtttactaagttagaggaacaggaaaaatcccgtaaggagctaattaccaatatctcacatgacttacgaacacctatggctagcatgcaattgatgatagaagcattacaagataacctgattgaagatcctgaagtgaaaaagcaatacttagcgacgattttaaaaggaatagaaagattaagtggattaattaacgacttatttgatctttcaaagttagagtttgagcaagtagattttcacccaagtttcacacatttagataaagtcctattagatgtattagagtcacattctatcttattaggagacaaacaaatccatatgcaattggatgttcctgatacattacctcgacttttgattatgccttgtaaaatagaaagggtcataggtaatttattacataatgcaattcgatattctcctatctccggaacaattgaattgactgtagaggaaaataaacaaactcaacaggtccagttcactttgcgggatgaagggataggaatttctcctaataatcaattacgcgtattcgaacgtttttttagaacagatcgatcaagaagttcacaatctggaggatccggactaggattagctattgcaaaatcattgattgaaatgcacaaaggggaaattggtgtgaggaatcgtgaagatggtaagcagggaagtgaattttggttcactcttcccataacatcagaaaaaaataagacggccgaaagacttttgtaa

SEQ ID NO: 77413 - protein, 350 aa, Bacillus cereus G9241
MNLLSTGIMIIAIWYSETKMLLEQEQTRLLTIIAFVAFIISTFIYWLMTRPIMRSIQNLIKLTKQFSDRHFETMYIIGQEPREFKELATAFQQMAKKLEEGFTKLEEQEKSRKELITNISHDLRTPMASMQLMIEALQDNLIEDPEVKKQYLATILKGIERLSGLINDLFDLSKLEFEQVDFHPSFTHLDKVLLDVLESHSILLGDKQIHMQLDVPDTLPRLLIMPCKIERVIGNLLHNAIRYSPISGTIELTVEENKQTQQVQFTLRDEGIGISPNNQLRVFERFFRTDRSRSSQSGGSGLGLAIAKSLIEMHKGEIGVRNREDGKQGSEFWFTLPITSEKNKTAERLL

SEQ ID NO: 77414 - DNA, 1341 bp, Pseudomonas fluorescens PfO-1
  CDS (1)..(1341)
atgcgccgactgtccttgagcggccgattggtgctgttgttcgccggctgcaccgcagtggtttcgctggtcgccggggtggtgttcaatcgggccagcgaaggccacttcatcgaactcgaccagcaattgctcgaaggaaaactgctcagcgtgcgtcagacgctgcgcagcggtagcgacgccgcgcacatcaccgatgaattgagccaacagggcgatgtttcgttgcgtatcagcagctctgaggggcagcgctggttcggtcgctcgttgcataccccggcgaatctgccgcaacagcccggcctggccaccatcaacgacaacggcaccgactatcgcctgctcaacgccgcgcttgaaccgggaaaacccgattccccgcaattgaccttgctgctggacatcacccaccaccagcacttcctgcaacgcatgcagcatctgatctggctgaccgtcggcctgtcggcgctggccactgcgctgctcggcgcctgggctgcccgcagcggtcttcgcccgttacgccgcatgagtgcggtcgcccgggggatttcggcgcaatcgctgaatgcccgactgccggacgcacggatgcctgcagaactcgcggaattggcccacagcttcaacgccatgctcggacgcctcgatgactcctttcagcggctgtcagcgttttccgccgacatcgcccatgaactgcgcaccccattgtcaaacctgctgactcaaactcaggtcaccctgacccgccctcgccccctcgaagactatcgcgaggcactgcacagcaacctcgaagagctgcaatggatggcgcagttggtgaacgacatgctttatctggccaaggctgaccacggcttgctggtgcccaagcgtgaaccgctggagctggcggaagaagccgatgcgttgctggagttttttgcgccgctggccgaagacgctcaggtcagcctcagccgtgacggtgcggggcggttcgagggtgatcgcgcgatgttgcgtcgggcgctgtcgaatctgctggataacgcgttgcgctttaccccggccgccggcgaagtgcgtgtaaaggtggtcgagcaggcgaaattcttgagcgtgactgtggagaacagtggtgaggggatttctgtcgagttgttgccgcgcttgttcgaccgcttctaccgggcggatccggcgcgccaggaaggcagcagcgagcatgcgggattggggctggcgatcactcagtcgatcatccgggcccatggcgggcagattcattgcgaatcggctcagggctggacgcggtttgtgattgagttgccgaaaaacgattga

SEQ ID NO: 77415 - protein, 446 aa, Pseudomonas fluorescens PfO-1
MRRLSLSGRLVLLFAGCTAVVSLVAGVVFNRASEGHFIELDQQLLEGKLLSVRQTLRSGSDAAHITDELSQQGDVSLRISSSEGQRWFGRSLHTPANLPQQPGLATINDNGTDYRLLNAALEPGKPDSPQLTLLLDITHHQHFLQRMQHLIWLTVGLSALATALLGAWAARSGLRPLRRMSAVARGISAQSLNARLPDARMPAELAELAHSFNAMLGRLDDSFQRLSAFSADIAHELRTPLSNLLTQTQVTLTRPRPLEDYREALHSNLEELQWMAQLVNDMLYLAKADHGLLVPKREPLELAEEADALLEFFAPLAEDAQVSLSRDGAGRFEGDRAMLRRALSNLLDNALRFTPAAGEVRVKVVEQAKFLSVTVENSGEGISVELLPRLFDRFYRADPARQEGSSEHAGLGLAITQSIIRAHGGQIHCESAQGWTRFVIELPKND

SEQ ID NO: 77416 - DNA, 1902 bp, Pseudomonas fluorescens PfO-1
  CDS (1)..(1902)
atgattttccgccgttgggacatcaacacccgcacccagttgatcagcctgggccctgcgctgttgctgaccttgctgctgatcagctttttcacctttgtgcgcattcaggatttgcgtcaggagctgaaccacaccggccaactgatcgccaaccagctcgcaccggccaccgagtacggggtgatttccggcaacaacgaagtgctggaaagcctgctcaaggccacgctggccacgccgaacgtgcggtttctggaagtgcaggacagcgccaatcggattctctcttacgtcgaacagccggcggatgcgcacaatcgtccgcatcaggtcgaagtgttccaggcgccggtgcggctgcaacgcatcgccttgcacaacgatttctttcaggacggcaagagcagccccggcgtggccagcgaggactatctgggacgggtgatcgtcggtctgtcgaatgacgcgttcagtcagcgccaacaggaaattttgctcaaggccgggattctcgcgttgttcgccctgctcttcacgttcgtcctggcgcggcggctggccggcagtctgtcgcagccgattcgcgacatcggcaatgcggtcaaggcgattcaggacggcgattacaagaccccactgccgattgtagacgacaccgaactgggcgccctgtcccagcacatcaacaacctggcccaggcgctggaacaggccagccgcgagcagcatcaggcgatggcgcaactgatccagacccgcgaagaggccgagaaagccaacaacgcgaaatcggatttcctggcgatgatgagccatgaactgcgcaccccgatgaacggtgtgctgggcatgctgcaattgctcgaaaccaccgacatgactgaggagcaggtcgagtacgcggcgctggcttccgagtccaccgagcatttgctcaaggtgatcaacgacattctggatttctcgcgcatcgagcgttcggaactggagctggagcacattccgttcaacctcgccgaagtgatcggcgcctgcgcccagtcgttccagcacagcgcggcgcaacgcgggttggccctgcagctgcgaatccccgaagacttgcgcgacttgcaggtccagggcgatccgacgcggatccggcagattctggtcaacctggtcggcaatgccttgaagttcaccgaacagggacgcgtcagcatcgaggcgcagtggcagtcgctggatcacgagttgctgtggttcacctgtgcggtgcgtgacagtggcatcggtatttcgccggagagcctggagctgatgttcaacgcgttccagcaggctgacagttcgatttcccgtcgttatggcggcaccggcctgggcctgccgattgcccgcacgctcgccgaacggatgggcggcaccttgcgcgcccagagtgaagaaggtcgcggctcggtgttcaccctggaaataccactggccctatataagcaggcgctgcccgcgcttgccgcaccgcgcacattgaacggtgcaagtcacggcgaaggccgaaatgtgctgctggtcgaggacaacccggtcaaccagacggtgatcgaagcgatgctgcgcagcctgggctttaccgtcagcgtcgccaccgatggcgtgcaggcggtgcgcagtgccggggacaaccgtttcgaagcgattctgatggattgccgcttgccgctgatcgacggttacgaagcgacccggcggatccggcagctgcccggctgcggccaggtgccgatcatcgccctgaccgccaatgctttacagggcgaccgggaaaactgcctcgcggcgggcatgaacgattacctggccaagccattcaaacacaatgatctgcagcagattctgcagcgatgggtgcagtaa

SEQ ID NO: 77417 - protein, 633 aa, Pseudomonas fluorescens PfO-1
MIFRRWDINTRTQLISLGPALLLTLLLISFFTFVRIQDLRQELNHTGQLIANQLAPATEYGVISGNNEVLESLLKATLATPNVRFLEVQDSANRILSYVEQPADAHNRPHQVEVFQAPVRLQRIALHNDFFQDGKSSPGVASEDYLGRVIVGLSNDAFSQRQQEILLKAGILALFALLFTFVLARRLAGSLSQPIRDIGNAVKAIQDGDYKTPLPIVDDTELGALSQHINNLAQALEQASREQHQAMAQLIQTREEAEKANNAKSDFLAMMSHELRTPMNGVLGMLQLLETTDMTEEQVEYAALASESTEHLLKVINDILDFSRIERSELELEHIPFNLAEVIGACAQSFQHSAAQRGLALQLRIPEDLRDLQVQGDPTRIRQILVNLVGNALKFTEQGRVSIEAQWQSLDHELLWFTCAVRDSGIGISPESLELMFNAFQQADSSISRRYGGTGLGLPIARTLAERMGGTLRAQSEEGRGSVFTLEIPLALYKQALPALAAPRTLNGASHGEGRNVLLVEDNPVNQTVIEAMLRSLGFTVSVATDGVQAVRSAGDNRFEAILMDCRLPLIDGYEATRRIRQLPGCGQVPIIALTANALQGDRENCLAAGMNDYLAKPFKHNDLQQILQRWVQ

SEQ ID NO: 77418 - DNA, 1611 bp, Pseudomonas fluorescens PfO-1
  CDS (1)..(1611)
atgaactcgatcttcctgcgcatctatggcggcatgtgcgcggcgctgattctggtggcggtgctcggtgtgctggcgctgcacctgctcaaccaggtgcgcagcgagcaataccgtgagcgtctggcccacggcacgttttcgctgatggccgacaacctgcaaccgatgaacgaaaccgagcgccatcgcgccttgctggtgtgggagcggctgctcgggattccgctggcgctgaagaccttcacccagaccgatctcgacctgacccagcgcactcgcgtgcagcgcggccaggccctggtggagcagaccggcccgcacgcggccaaggtctatcggctggtcagcgacaaggatcaactggtgctggtgggcgaggtgcagcagatcagcgagcaactggcccgggcgaccatctacctgttggccgatgagctggtgcgggtgcccgtgggcgaacagcccaaacgactggcgcagttgaaagaagacaaaggcttcggtttcgatttgcgactggttacggtcagcgatgccgacatggacgaagaccagagccgtcgggtgtccgagggcgatacggtgatggcgctgggcaagggcggcgattcgatccgggtgttcgccggcatggtcggcacgccgtgggtgctggaaatcgggccgctgtatcagatgaacccgtacccgccggaatggctggtgctgatcgcagccctcggcctgaccctgatcggcctgattgtctatctattggtccgccagctcgaacggcgtttgcgtggactcgaagctgccgccacgcgcatcgccaaaggcagcctggaaacccgggtgccggcccgtggtgccgactcggtgggcaagctggcagcggcgttcaacggcatggccgagcacttgcagcagttgctcgccattcagcgtgaactggtgcgcgcggtgtcccacgaactgcgcacgccggtggcgcgtctgcgtttcgggctggagatgatcggctcggccaccaccccgcaggcgctggaaaaataccgcgagggcatggaccacgacatcgaggacctcgacaagctggtcgacgaaatgctcacgtacgccagactggaacagggctcgccggcgctgaccttccagcgcatcgacctggatgcgctggtcaatcaggtgatcgaagagctggcgcctctgcgcgccgaggtcacggtgcagcgcggtctgtgcctgtcggcggcggattgcgatgatgcctgggtcgaggccgagccgcgttacctgcaccgcgccttgcagaatctggtgagcaacgccatgcgtcatgcgcgttcgaaggtcacggtcagttatcaggtcgggcagatgcgttgccgggtggatgtcgaggacgacggccccggcgtgccggaaaccgcctgggagaaaatcttcacgccgttcctgcgtctggacgacagccgcacccgggcgtccggcggacacgggctgggcctgtcgatcgtgcggcggatcatccactggcacgacggccgggcgctgattggcaagagcaagagcctgggcggggcgtgtttcagtctgagctggccgaggaatcaggagcggcgctga

SEQ ID NO: 77419 - protein, 536 aa, Pseudomonas fluorescens PfO-1
MNSIFLRIYGGMCAALILVAVLGVLALHLLNQVRSEQYRERLAHGTFSLMADNLQPMNETERHRALLVWERLLGIPLALKTFTQTDLDLTQRTRVQRGQALVEQTGPHAAKVYRLVSDKDQLVLVGEVQQISEQLARATIYLLADELVRVPVGEQPKRLAQLKEDKGFGFDLRLVTVSDADMDEDQSRRVSEGDTVMALGKGGDSIRVFAGMVGTPWVLEIGPLYQMNPYPPEWLVLIAALGLTLIGLIVYLLVRQLERRLRGLEAAATRIAKGSLETRVPARGADSVGKLAAAFNGMAEHLQQLLAIQRELVRAVSHELRTPVARLRFGLEMIGSATTPQALEKYREGMDHDIEDLDKLVDEMLTYARLEQGSPALTFQRIDLDALVNQVIEELAPLRAEVTVQRGLCLSAADCDDAWVEAEPRYLHRALQNLVSNAMRHARSKVTVSYQVGQMRCRVDVEDDGPGVPETAWEKIFTPFLRLDDSRTRASGGHGLGLSIVRRIIHWHDGRALIGKSKSLGGACFSLSWPRNQERR

SEQ ID NO: 77420 - DNA, 1602 bp, Rhodospirillum rubrum
  CDS (1)..(1602)
atggctcttaagcttccccgccggctgctgccgcgcagcaccaccttacgcatcgcgcttagtttcctcgtgttgtttggcggagcctcgggcctgctgatggccggggtctattggacgacctcgcgcttcctgatgtttcaggtcgatggggtgatcggcgacgatatcgccctgctgaccaatgccgcccgcgaacgtggccaccgcttgctggccgccatgctggtcacccgcgcccgtcaggccggcgaggcccaggcggtttacctgcttgccgatcaggacggcgaaccgctggcgggcaatctggccacttggcccgaggggctagaggcgaccggctggaccatcctgcccgccaccgcgctcaccgtcgttcccgtcaccgataccctgccgccgccgccaaggcgccccgaccgccccgaggactccgagcgccgccagcgtcaccgcgaggcctgggacgattggcgcccgcccttgcccgacagcctgccgccccccccgccccgcctgttcgccgatcgcggcggccgtgatcccgccgatcccgatgtccggccgcgaccctggcggcggggcgatgtgcgggtggccgccctgaccctgcccagcggcatgcgcctgttgattggccgcgatcttgggccgatccaggccctgcgccaccgcatggccggggccatgcgcctggggctgggcggcatggtggtgctgggtctggccggcggtctggtgatgagccggcgcttcagccgacggctggaggcggtcaaccgcaccagccgcgagatcatcggcggcgatctgtcgcggcgggttccgcaaggccggggcctggacggcgacgacttcgaccaattggcggtcaatctcaacgccatgctcgggcgcatcgaaaccctgatggagggggtgcgccatgtctccgacaccatcgcccatgatctgcgtaccccgctgtcgcggctgcgcaaccggctggagcgcctgcaggccgatgcccaatgcaccgaccgcgacgaattggccgccgccctggccgaggtcgatagcctgctcgccaccttccacgccctgttgcgcatcgcccaggtggaaacaggcggccggcgcatggccttttcgcccgtcgatctgctggccctgctcatcgatgtcgccgaactttacgacgcggtggccgacgaaagaaccgtaacccttgatctcgacctcgccttggcgccgggcgcgcgtttgctggtcgatggcgaccgcgacctgctgttccaggccttcgccaatctgctcgacaacgccgtcaaatactcacccgagggcggccgggtcagcctcgccctgatccgcggcgagacccgggtgacgatcagcctgcgcgatcagggaccagggatccccgcagccgaccgccagcgcgttttcgaacgcttcgcccgccttgataccgcccgcaccaccccgggcaacggcctgggtctgaccatggtcggcgcggtgatcgaagcccatgacggcaccatcgccctggaagacgcgccgggcggcggattgctggtccgcgtcgtcttgccgctgcgccggggtccgggctga

SEQ ID NO: 77421 - protein, 533 aa, Rhodospirillum rubrum
MALKLPRRLLPRSTTLRIALSFLVLFGGASGLLMAGVYWTTSRFLMFQVDGVIGDDIALLTNAARERGHRLLAAMLVTRARQAGEAQAVYLLADQDGEPLAGNLATWPEGLEATGWTILPATALTVVPVTDTLPPPPRRPDRPEDSERRQRHREAWDDWRPPLPDSLPPPPPRLFADRGGRDPADPDVRPRPWRRGDVRVAALTLPSGMRLLIGRDLGPIQALRHRMAGAMRLGLGGMVVLGLAGGLVMSRRFSRRLEAVNRTSREIIGGDLSRRVPQGRGLDGDDFDQLAVNLNAMLGRIETLMEGVRHVSDTIAHDLRTPLSRLRNRLERLQADAQCTDRDELAAALAEVDSLLATFHALLRIAQVETGGRRMAFSPVDLLALLIDVAELYDAVADERTVTLDLDLALAPGARLLVDGDRDLLFQAFANLLDNAVKYSPEGGRVSLALIRGETRVTISLRDQGPGIPAADRQRVFERFARLDTARTTPGNGLGLTMVGAVIEAHDGTIALEDAPGGGLLVRVVLPLRRGPG

SEQ ID NO: 77422 - DNA, 1008 bp, Rhodospirillum rubrum
  CDS (1)..(1008)
atgacggtcatggccttcagtgtcgtcctgctgtcgatatgcggatcctatgtgttctatgcggtcttcctgacctattccccgtccagcatctccgatgacctgctgcccgctccggcggaggtcgcctggatgaccgtcacgatgctggcggccctgcttctcgccgccgtgatcgccatccgattggcgcggcggatcctgacgccgctcaactccgtcgccgacagcctgcatcggatggcggagggcgacctttcggcccgggcggtcgccgacgatctgtcgatgggcgaagccacgcgtctggtggccgatttcaacaacatggccgagcgcctggatggcatggcgcgggaacgcgccttctggaacgccgcgatcgcccacgaattgcgaacgcccgtgacggttcttcgcggtcgccttcaaggtttggcggagggggtgttcgaacccacccccgccatgttctcggggctgctgatccatatggaggggttgagccggctggtcgaggatttgcgcgtgctgggcctggacgaaagcgggcggctggagttgcggctggagcaatgcgacctcgccgccgaaatcgcggcgctgatcaacgccttcgagcccaatctgcgcgccgccggtttcgttctcgcccaggatctggacggaggcgaggtcgtctgcgacccgatgcggattcggcaggcgctctcggcgctgctcgacaacgccatccatcacgccgaacccggagcccttcaggttcgcctccgcctggaggacgagcggatccgccttcaggtcgaagacaaggggccgggcatcccgaccgacctcatggagtgcgtgttcgatgcgttccgccgtggcgcgaagccgcgcctgggcggaggtagtggtttgggattggccgtcgtaagggccatcgcccgcgcccatggcggagaagccgcctgccgggcctccgatagccagggaacgatcttcgaactgacgtggcccgcctga

SEQ ID NO: 77423 - protein, 335 aa, Rhodospirillum rubrum
MTVMAFSVVLLSICGSYVFYAVFLTYSPSSISDDLLPAPAEVAWMTVTMLAALLLAAVIAIRLARRILTPLNSVADSLHRMAEGDLSARAVADDLSMGEATRLVADFNNMAERLDGMARERAFWNAAIAHELRTPVTVLRGRLQGLAEGVFEPTPAMFSGLLIHMEGLSRLVEDLRVLGLDESGRLELRLEQCDLAAEIAALINAFEPNLRAAGFVLAQDLDGGEVVCDPMRIRQALSALLDNAIHHAEPGALQVRLRLEDERIRLQVEDKGPGIPTDLMECVFDAFRRGAKPRLGGGSGLGLAVVRAIARAHGGEAACRASDSQGTIFELTWPA

SEQ ID NO: 77424 - DNA, 1302 bp, Burkholderia fungorum LB400
  CDS (1)..(1302)
atgcgttcgatccgccgtcaattgctggtgtggctgctggcgctggtgctgctcggcgtcggcatcgcgggttggctgatctaccggcaggcgcttgccgaagccaacgaacttttcgattaccagttggagcagatcgccgcggcactgccgtcggaaccgttttcccaggtgctgggttcgcgcgataccggcgacgaaggcatcgtgctgcaaatctggaatcgcgatggcgtgctgatgtactactcgcgtccgcgtgcaccgctcgctccacgcgccgaactcggtttttcgaccgagcacacggatcgcggcgagtggcgcgtgtatggcgcgatcgtcggcgataacgtggtgcaactggcgcagccggtgtccgtgcgtaaccggctcgccgcgaacgtcgcgctgcgcacgctgtggccgctgatcgtgctgctgccgttgctggggctcgcggtgtgggtgatcgtcgggcgcggactcaggccgttgcggcgcgtgaccagcgcgctcgacgcacgtcgccccgaggcgctcgatccattgccggaccagcgtctgccgctcgaagtgcaaccgctcgtgcgtgcgctgaatggtctgctggagcggctcgccaccgcgctcgatatccagaaagccttcgtcgccgacgctgcgcacgaattgcgcacgccgctggccgccgtgcagatccaggcgcaactggtggcgcgcgcaaaagacgaagccggccgcggcgaggcgctcgccgatctgcaggcgggcgtgacccgcgccacgcgtcttgccgaacagttgctggcgctcgcgcgttccgaaccggacggcctcgccgccaccgacgcgatcgatctgcgcgcgctgcttcaggagtgcgtggcggcttacgcgccgcttgcacagaatcgcggcatcgatctcggcatcgaggcgacggagtccgccaccgtgatcggcgacgccgacgcgctgcgcgtgatgttcaacaatctcgtggacaacgcaaccaaatacacgccgcgcggcggccatgtggatgtcaatctgcgcgtggaagaagggcacccggtcgtgcggatcgccgacagcgggccggggatcgaaccggccgaacgcgatcgcgtattcgatcgtttctatcgcgcgggcgccggcgcgaatcgcgcgcgtaccgacgtgacgggcagcggtctgggactcgcgatcgtgcgccgcatcgccgtgcagcatcacgccgccgtgtcgctcgacgaatcgccggcgggcgggttgcaggtcaacgtgcgcttttga

SEQ ID NO: 77425 - protein, 433 aa, Burkholderia fungorum LB400
MRSIRRQLLVWLLALVLLGVGIAGWLIYRQALAEANELFDYQLEQIAAALPSEPFSQVLGSRDTGDEGIVLQIWNRDGVLMYYSRPRAPLAPRAELGFSTEHTDRGEWRVYGAIVGDNVVQLAQPVSVRNRLAANVALRTLWPLIVLLPLLGLAVWVIVGRGLRPLRRVTSALDARRPEALDPLPDQRLPLEVQPLVRALNGLLERLATALDIQKAFVADAAHELRTPLAAVQIQAQLVARAKDEAGRGEALADLQAGVTRATRLAEQLLALARSEPDGLAATDAIDLRALLQECVAAYAPLAQNRGIDLGIEATESATVIGDADALRVMFNNLVDNATKYTPRGGHVDVNLRVEEGHPVVRIADSGPGIEPAERDRVFDRFYRAGAGANRARTDVTGSGLGLAIVRRIAVQHHAAVSLDESPAGGLQVNVRF

SEQ ID NO: 77426 - DNA, 1836 bp, Enterococcus faecium
  CDS (1)..(1836)
atgaaaagaaaagtccgcttttttcgatcagtcaattttaagatcgctattacctttattctgattttattgatctcgatcgaaattattggtgcctactttatacgtggtttagaacgttccacgatcaatacatttattaaagatatgaatcaaacggtggaatcattagcaacaacaatcagcccggaattgaatcgaaaagataatgcagatgatgaagaggtaaatgcgaatatcaaaagatttattgaaaacagtgcgactagcgatatcatcgaaatacgggtcgttgacgaaaaagggatcatccgaggaacaaccgatgtcaatgaacaaagcgctgtgggaaagaaaaatgattatgttgatatcaatgatttcacgactaaacgttatgttgctttagataacgacgataaacgggtgaatatcaatgttcaaccgatcctgtccccgaccggcgatgccgttatcggggctctttacgtcaaaagtaatatcgaacaaaaatattcggaaatcaataacacagcagtcattttctttactgcctcactaattgcggcatttatttcaatgatcgtatctgttttagttgctcgttcgattacacagccgatcggtgaaatgagagaacaagccattcgaatcgctagaggagactacagtcggaaagtcaaagtgcatggacaagatgaacttggacagctggctgataccttcaatcagttagctgaacgtattgaagaagctcaagatacaatggaagctgaacgcaatcgtttggatagcgtgctatcccatatgacagacggcgtcattgcgacagatcgcaggggtaaagtcattacgatcaatgatatggctgtttccttgctagatatcaaaaacgaggaagcaatcggacaatcgattttgacacttttagatatcgaagaagaatatacgttgcggaaattattagaagatccaaacgaaatggtacttgaccgttcaaccagtacattggaaagtgatcagatgatcttgcgagtagacttttctatgatccgtcgcgaatcaggttttatcagcggattagtagctgtcttgcatgatgtgacagaacaagaaaaaacagaacgggaacgtcgtgaattcgtctctaatgtttcccatgaacttcgtacaccgttgacaagtatgcgtagttatatcgaagcattgagcgaaggtgcgtggaaagacgaggaagtagcaccaaattttttgaaggtaacgctagatgaaacagaccgaatgattcgaatgatcaatgacctcttaaatctatctcgcatggatacaggtaatacccagcttcaattagaatatgtcaatttcaacgagttagtgaattttgttcttgaccggtttgatatgatggtgggaaatcaggaaaaaaattataagatccgtcgtgaatttacgcaaagagatctttgggtcgaagtagatacagataaaatcatccaagtagtcgataatatcatgaataacgcgatcaagtattcaccagatgggggaacgattacttgtcgcttattagaaacgcataataacgtggttttaagtatcaccgatcaaggattggggattcctaaaaaagatctgaaccgagtgttcgagcggttctatcgagtagataaagcacgtgcaagagcacaaggtgggacaggacttggattagctatttctagagaagtgattaaggcgcatcgaggcgctatttgggcagagagcaaggaaggaaaagggtcgactttttatatctcgctgccatatgaaccttatgaggaggaatggtgggaatga

SEQ ID NO: 77427 - protein, 611 aa, Enterococcus faecium
MKRKVRFFRSVNFKIAITFILILLISIEIIGAYFIRGLERSTINTFIKDMNQTVESLATTISPELNRKDNADDEEVNANIKRFIENSATSDIIEIRVVDEKGIIRGTTDVNEQSAVGKKNDYVDINDFTTKRYVALDNDDKRVNINVQPILSPTGDAVIGALYVKSNIEQKYSEINNTAVIFFTASLIAAFISMIVSVLVARSITQPIGEMREQAIRIARGDYSRKVKVHGQDELGQLADTFNQLAERIEEAQDTMEAERNRLDSVLSHMTDGVIATDRRGKVITINDMAVSLLDIKNEEAIGQSILTLLDIEEEYTLRKLLEDPNEMVLDRSTSTLESDQMILRVDFSMIRRESGFISGLVAVLHDVTEQEKTERERREFVSNVSHELRTPLTSMRSYIEALSEGAWKDEEVAPNFLKVTLDETDRMIRMINDLLNLSRMDTGNTQLQLEYVNFNELVNFVLDRFDMMVGNQEKNYKIRREFTQRDLWVEVDTDKIIQVVDNIMNNAIKYSPDGGTITCRLLETHNNVVLSITDQGLGIPKKDLNRVFERFYRVDKARARAQGGTGLGLAISREVIKAHRGAIWAESKEGKGSTFYISLPYEPYEEEWWE

SEQ ID NO: 77428 - DNA, 1410 bp, Magnetococcus sp. MC-1
  CDS (1)..(1410)
atgcgtatttttctcaaactctttatcggcttttggttaaccctgctggtcatgggcagcctgacggcgtgggccgcatttcatctacgcggggatttggaggatcgttttcataaccaaatgaatgacctcgccaaagagcgcatgtccctgggccatgccctggccttttatggggagcaagccctgcgagacgccctgcgcaaccacccagacaacccctggatctacgtggtcaaagaggaacgacaagatctgctgcaacgccccttgcccggccatgcacaacattttcttcgccaccgctgggcaccagaggccagcctgcacatctacagcgcccaggtagccacccaagccacccccgagcaggagcttgcccatctacgcgaccaccccatccccccaccggtgctgtggtatgtgcgcgggccagacaacaccctatatggccttatgctaacccctaagaggcccccctttatggggctaatccttgagaaccgctgggccttggcgggtatcgtgctctacagcttgctgggggtgctgctgcttaccctgcactttaccaaccccattcgacggctcaccaaagcgtcgcagcagctctcgtttggcgcgctcagcacccgctgcgcaccgttgcgcttgcgtatccccgacgagctcagcaccctggtgcatagctttaaccatatggcccaacgcttggaggaaattttttctgcgcaaaaacgtctgatgcgggatgtctcccacgaactccgctcgcccttggcccgcatgcgggtggcactggagctggctacacggacgcatccaacggaatctcaagcgcatctcgccatggttgaacgggagatccatcgcctagaccgcttgatccatgagatcctcaccttggcccatcccgatgcagggcagcctgtggtattggaaggcatggtggatctgcaaggcatgctcaccagcattgccgccgatgtcaccctggaaggccgccccagcggacgtcacgttatcctggccgccagtgaagagcggctggtcaaagccaatccagaagcgctacactcagccctggaaaatgtggtgcgcaacgcgctacgctacaccccaccccatagcacggtggatgtcaccctgactgagcaggcccaacagctgcacatccaggtgcgcgatcacggccctggtgtggccgaagctgacttgctgcgcatttttaaacccttttaccgcaccagtgctgcacgggagcgggagagcggcggctatggcttagggttggctattgcgcagcgggtgattagcgaacaccatggcactctctgggcggccaatcatagcgagggcggtttagtggtccatatcaccctacccatcgcggcacctgaaccggaataa

SEQ ID NO: 77429 - protein, 469 aa, Magnetococcus sp. MC-1
MRIFLKLFIGFWLTLLVMGSLTAWAAFHLRGDLEDRFHNQMNDLAKERMSLGHALAFYGEQALRDALRNHPDNPWIYVVKEERQDLLQRPLPGHAQHFLRHRWAPEASLHIYSAQVATQATPEQELAHLRDHPIPPPVLWYVRGPDNTLYGLMLTPKRPPFMGLILENRWALAGIVLYSLLGVLLLTLHFTNPIRRLTKASQQLSFGALSTRCAPLRLRIPDELSTLVHSFNHMAQRLEEIFSAQKRLMRDVSHELRSPLARMRVALELATRTHPTESQAHLAMVEREIHRLDRLIHEILTLAHPDAGQPVVLEGMVDLQGMLTSIAADVTLEGRPSGRHVILAASEERLVKANPEALHSALENVVRNALRYTPPHSTVDVTLTEQAQQLHIQVRDHGPGVAEADLLRIFKPFYRTSAARERESGGYGLGLAIAQRVISEHHGTLWAANHSEGGLVVHITLPIAAPEPE

SEQ ID NO: 77430 - DNA, 1740 bp, Thermobifida fusca
  CDS (1)..(1740)
atgacggacagcgtccaagccccgagtccgaacgcggccgcccctgccctggaaggggaggccgcgttcacacggtggcagcggatgggcaacgcactgcgcgccggatatgtggtgacccagcggctggcccgcggtctcgtcaccgccgtgcactcgcggtggcggcgctccctgcagctccgggtggtcaccaccaccttgatggcctcggtcctggtcaccgcgattctggggttcttcatggtgcagcaggtccgctcggacctgctcaaggccaaggagcaggccgcgttcagcgaccaccacatggggctgaccgctgccctgggcatcctccaggacagcggacagcaggacccggaacgccagctcgacgagatcgtcgaagagctcagtgcacgcagcggtgccaccgggttgtacgacgtggtgatcctgccctcggtgggcggcatgacgggccgggcgagcggcggcgtcggcgaagcgagcattcccgcacagctccgcgaggaagtgcagaacagtaacggcgacacccagcacggccgctacaccgagatcatccgcggccccaaccgggaacccgggttggccgtgggcgcccagttgtccagcgcctacgagctgtactacctgttcccgctcgaccacgagcagcagatgctcgacctggtgcagcggaccttggcgctcgtcgcttccgtcatggtcctgctgttggccgccatcgcctacgtggtgacccgccaagtggtcacgccggtccggcaggccgccagctccgccgagaagctgtcctccggtgacctgtctgagcggatggaagtccgcggggaggacgacttggcgcgcctggcggtgtcgttcaacgacatggcgggcagcctccaggagaagatccaggagctggaggagctgtccaaggtccagcgccagttcgtctcggacgtctcccacgagctccgcaccccgctgaccacgatccgcatggcgggggacctgctgtttgaagagcgcgacagcttcgacccgacggtgcggcgctccgtggagctcctgcaaagccagttggagcgcttcgaagaactgctcaacgacctgctggagatcagccggcacgacgccggcgccgccacgctggctttggaacgcgccgacatccgcgactccgtgctccaagcggtccgggaagccgaacagatcgcggagaagcgcgggatcaaggtgatcctgcgcctgcctaccgagccgtgcaccgccgagttcgactcccgccggatcaaccgcatcctgcgcaacctcatcgtcaacgccatcgagcacagcgaaggcaaggacgtcatcgtgaccgcggccgcagaccgggacgccgtggcggtagcggtccgcgacttcggggtcggcctcaaggaaggcgaagagcacttgtgcttcgaccggttctggcgcgccgatcccgctcgggcccgcactacggggggaaccgggctcggcctggcgatcgccaaggaggacgcgcaactgcacggcggctggctccaagcatggggacggccggggaagggcgcccagttccggctgtcgcttccccgggtggccggcactgagctgcgcggctccccgttgccgctggtcccgccggagatggcgttagggggaaacctttcggtgttgagcggccagcaggtcgacttggagaccgggcgaggaacaagcgcgggggaggaagcgtga

SEQ ID NO: 77431 - protein, 579 aa, Thermobifida fusca
MTDSVQAPSPNAAAPALEGEAAFTRWQRMGNALRAGYVVTQRLARGLVTAVHSRWRRSLQLRVVTTTLMASVLVTAILGFFMVQQVRSDLLKAKEQAAFSDHHMGLTAALGILQDSGQQDPERQLDEIVEELSARSGATGLYDVVILPSVGGMTGRASGGVGEASIPAQLREEVQNSNGDTQHGRYTEIIRGPNREPGLAVGAQLSSAYELYYLFPLDHEQQMLDLVQRTLALVASVMVLLLAAIAYVVTRQVVTPVRQAASSAEKLSSGDLSERMEVRGEDDLARLAVSFNDMAGSLQEKIQELEELSKVQRQFVSDVSHELRTPLTTIRMAGDLLFEERDSFDPTVRRSVELLQSQLERFEELLNDLLEISRHDAGAATLALERADIRDSVLQAVREAEQIAEKRGIKVILRLPTEPCTAEFDSRRINRILRNLIVNAIEHSEGKDVIVTAAADRDAVAVAVRDFGVGLKEGEEHLCFDRFWRADPARARTTGGTGLGLAIAKEDAQLHGGWLQAWGRPGKGAQFRLSLPRVAGTELRGSPLPLVPPEMALGGNLSVLSGQQVDLETGRGTSAGEEA

SEQ ID NO: 77432 - DNA, 1452 bp, Novosphingobium aromaticivorans DSM 12444
  CDS (1)..(1452)
atgcgggttcgaatcggaaccatcgtctttgcgggatcggccctgtctgcgctgctcggggcggtcgcgatggggctcgccatgtggattgcccagcgcgaaggcttttcgcactatctcgcaacccgcgatgccgagcggctcgaccagctggttcggcggttcgacgaggaggctgtcgcgcgaggcggaattgctgccttcagggcggggcgcttcacgcttggcgaggctttcggcgcgctcgggcctccgccgataacgggccacgtgtcgcctgagggcgaccgctcaccgcccagaggccgtccaccaccgtcggaagacatcggcgggcgcctggtgctgttcgatgcctcgggcgagcgcctttccggccctgagcgtccgcctgtgctgccaggcatggacggcaggcctccgccgccgcgcatcgagcaccgcacgcttacggtcgaaggcgtgcaggtcggcacgatagcgatgctgccccgcgttccggcaaacggcgacgtcgaggccaggttcctgcaaagccaggttcgctatggcctgttggccttgctcgtggtcgttctgttgtgcctctatccgtcatggctggtagggcgagccggtgcccgcgctgccggccggttcgcacgccgcaccgcagccatcgcggcgggcgactattatcgctacgaccgcaagcccagcttcgtcgtggaacttgacgccgtggggctggacttgtcgcgcatggcaggcagcctgcagcggatggaaagcgcgcgcaggcgctggcttgccgagatcgcgcacgaattgcgaacgccactggcggtgctgcgcggggagatcgaagccctgcgcgacggtatccggcagcccggacgcgccgagatcgattccctcctggccgaggccggatcgctcggcagactggtcgacgacctgcatttcctgtcggtttccgagctggagggcatggcttgccacttcgagcaggtcgatcctgccgaaatctgcgggctggccctgcgccgggcacagatcctgtcgaaggccgaggggctgtcgttcgctctttccgttagcggcaatggcgttggcacggcttggtgggaccgcgaccggatcgaccagttgctcgccaacctgctcgccaacgcgtgccgctacaccgaccgcccaggcaagatcgagatgctgcttcacgcggagcacgacgggctgcggatcgtcatcgacgacacgccgccaggcgttgatcccgcccatttgccacacctgttcgagcccctctatcgcgcggacccttcgcgctcgagggcgagcggaggcagcggactggggctttcggtctgcgccacgatcgttgaggcgcatggcggagcgattgccgccgggtcgtctccgttgggcgggcttcgcgtgacagtggaccttccgcgccggagcgccgcatga

SEQ ID NO: 77433 - protein, 483 aa, Novosphingobium aromaticivorans DSM 12444
MRVRIGTIVFAGSALSALLGAVAMGLAMWIAQREGFSHYLATRDAERLDQLVRRFDEEAVARGGIAAFRAGRFTLGEAFGALGPPPITGHVSPEGDRSPPRGRPPPSEDIGGRLVLFDASGERLSGPERPPVLPGMDGRPPPPRIEHRTLTVEGVQVGTIAMLPRVPANGDVEARFLQSQVRYGLLALLVVVLLCLYPSWLVGRAGARAAGRFARRTAAIAAGDYYRYDRKPSFVVELDAVGLDLSRMAGSLQRMESARRRWLAEIAHELRTPLAVLRGEIEALRDGIRQPGRAEIDSLLAEAGSLGRLVDDLHFLSVSELEGMACHFEQVDPAEICGLALRRAQILSKAEGLSFALSVSGNGVGTAWWDRDRIDQLLANLLANACRYTDRPGKIEMLLHAEHDGLRIVIDDTPPGVDPAHLPHLFEPLYRADPSRSRASGGSGLGLSVCATIVEAHGGAIAAGSSPLGGLRVTVDLPRRSAA

SEQ ID NO: 77434 - DNA, 1392 bp, Clostridium thermocellum ATCC 27405
  CDS (1)..(1392)
atgaaatttagtttaaggataaagttgtccgtatcttatcttctggttgccgtgacaagcgtagttctggcaatgatgctgaccaatatgtttcttgacagccactttagaaaatatgtcaaccaaaaccaggagaaaagaaaccgcgaagttgtcacagcggtaagccagcagtatctgggagacggaaaatggaacacggaaatggtggaagccataggtgtcagcgcgcttgaaaacggtctgataataaaggtaaaggatatcagcggcagagtaatctgggatgcgacggcccataacaacggaatgtgccaaagaattattgaacatatggcaagaaacgtaagcagacgttatcctgatgccggaggatcttacacagagataccttatgaggtaacttacaaccagaagagtgtcggtctggtggagattggctcctatgggccgtattatttgagtgacaatgaccttgcatttataaacactttgaacaaaattttgattgcagtaggtgttttttcagtaattttctcgctggttttgggaagtataatggcaaaaaagctgagccagcccatagccagggttataagtagcgcgcagtcgatagcccggggatatttttccgacagaataacggaaaaatccactacggaggaaatatgccagttgacttcaacaatcaataatcttgcccaaaccctggaaaatcaggaggctctgcgcaaaaaaatgagtgccgacatggcccacgaacttcggactccccttgcaacactgcaaagccacatggaggccatgatagacggtatatgggaaacggacgcggacaggctcaagagctgttatgaggaaataatcaggataaacaagatggtgggagaccttgaaaagctggcaaaatacgaaagtgaaggttttgtattggacaaaaccgtatttgacatgtcggcactgatacgcagaatcatatgcaattttgagcccgaatttaaaaataacggaattgaaattgcctttgaaggtgggactgaggaaatttttgccgataaggataaaatgagtcaggtaattataaaccttctgtccaatgccttaaaatacacgcaagaaggaggcaaggttgaaataagtgccaaaagcaagggagatgtgcttgagatcagggtgaaggataacgggcagggcatacctgaggaggacttgcctttcgtgtttgaaagactttacagggcggacaagtcgcgtaacaggaagacaggaggcgcaggaataggacttactattgcaaaaacaattgttgaggctcataatggacatatagaggtttacagtaaaataaatgagggaacggaatttcttataacattgccaaaaggtatttaa

SEQ ID NO: 77435 - protein, 463 aa, Clostridium thermocellum ATCC 27405
MKFSLRIKLSVSYLLVAVTSVVLAMMLTNMFLDSHFRKYVNQNQEKRNREVVTAVSQQYLGDGKWNTEMVEAIGVSALENGLIIKVKDISGRVIWDATAHNNGMCQRIIEHMARNVSRRYPDAGGSYTEIPYEVTYNQKSVGLVEIGSYGPYYLSDNDLAFINTLNKILIAVGVFSVIFSLVLGSIMAKKLSQPIARVISSAQSIARGYFSDRITEKSTTEEICQLTSTINNLAQTLENQEALRKKMSADMAHELRTPLATLQSHMEAMIDGIWETDADRLKSCYEEIIRINKMVGDLEKLAKYESEGFVLDKTVFDMSALIRRIICNFEPEFKNNGIEIAFEGGTEEIFADKDKMSQVIINLLSNALKYTQEGGKVEISAKSKGDVLEIRVKDNGQGIPEEDLPFVFERLYRADKSRNRKTGGAGIGLTIAKTIVEAHNGHIEVYSKINEGTEFLITLPKGI

SEQ ID NO: 77436 - DNA, 1488 bp, Clostridium thermocellum ATCC 27405
  CDS (1)..(1488)
atgaagaaggatgattttatgaagaaaaatacaattaaatggagaattttcaaatacaacattattgcaatttcggttttattggcattgacaactatcgtgttcaatattaccatccagtcctatatcaaaaacgacattaaggagcagctaagtacaattgctcaacgcgttgaagacactgctttgtacaggggacccgactttttccctccccaggaaccgcaaaggccccgtcctttgccgggcaggcaaaacggtatgtttcgggaaaataacgatttattcaggttttatttctttttggaccgttccttaagagaacctctttcgattttaaacgccgattttatacttcttgacaacaacatggacataatcacgccgccggaaggagactttttcaaaccttccggtgaaatagcaaatgaaataataagtaaaataaaaaaattggatggttccaaggtccaggagtatgtttactttaatgtaaacaataccgattatatttccattgtcaaacccgtttccgataaaaactcctttggattgggctggttgattatttactcgagccttcaaaaagtcaatcagctaaagctgggtataaatatgatacttattgtcattgtgcttttatcggcgctgatttttgccatattttcttctcttgcggcaaaaaaaatatcagccccgttttcctctttaaatcagcatatcagggccattgccgaaagaaatttcggcgtgaaaatcgaaatgccggtggatgcggaacttcaagagctggtaaacagcataaatattatgtccgaaaaactggagtcctatgataaagcccagaagacctttttccaaaatgcctcccatgagttcagaaccccccttatgtccatccaaagctatgcagaaggtataaaatacgacgtggtggacaaaaataccgccgcagatattataattgacgaaacaaaacggatgacccaccttgtggaagatttgctgtacctttcgcgccttgatacaattgaggaaaattatcgttttgccgaccttgacttcaaggattttataaatgcctgccaggaacgtatgtatggcatagcgtcaaaaagcggcatcaatcttgaggttgaaaacataaatgaacccgttgtggtatatgccgacgaggaaaagctttttcgtgcttttgcaaatatcattggcaactgcatccgatatgccaacaataccgtaagcattgttccaaaaattattgaccgctccaaaattgaaattgtcatccgggatgacggccccggaatagattccaatgaacttcccaatatttttgaaaggttttacaagggcaaaaaaggtaatgtgggactgggtcttgccatcagcaaaaacataattgaaaggcataacggaaaaatcacggcccgaaactcagaatccggtgcagtatttaccattgtgcttcctgtcaaacaatcctaa

SEQ ID NO: 77437 - protein, 495 aa, Clostridium thermocellum ATCC 27405
MKKDDFMKKNTIKWRIFKYNIIAISVLLALTTIVFNITIQSYIKNDIKEQLSTIAQRVEDTALYRGPDFFPPQEPQRPRPLPGRQNGMFRENNDLFRFYFFLDRSLREPLSILNADFILLDNNMDIITPPEGDFFKPSGEIANEIISKIKKLDGSKVQEYVYFNVNNTDYISIVKPVSDKNSFGLGWLIIYSSLQKVNQLKLGINMILIVIVLLSALIFAIFSSLAAKKISAPFSSLNQHIRAIAERNFGVKIEMPVDAELQELVNSINIMSEKLESYDKAQKTFFQNASHEFRTPLMSIQSYAEGIKYDVVDKNTAADIIIDETKRMTHLVEDLLYLSRLDTIEENYRFADLDFKDFINACQERMYGIASKSGINLEVENINEPVVVYADEEKLFRAFANIIGNCIRYANNTVSIVPKIIDRSKIEIVIRDDGPGIDSNELPNIFERFYKGKKGNVGLGLAISKNIIERHNGKITARNSESGAVFTIVLPVKQS

SEQ ID NO: 77438 - DNA, 1515 bp, Clostridium thermocellum ATCC 27405
  CDS (1)..(1515)
atgctaaaaactctgtttagcaagattgttgtcctgtttattgccattttgcttgtaagcacatccataaccggggtgatgctttatatttttcttggaaattttgcctcggaggaaaaggaaaaattattaagtgacactgcggacagtataaacagtatgctgaacgattatttgactgcttattacaataactataacaatcccatgtttgcattctgggaggaaatataccgcagaatgctggataacgcccttgagagggaaagtcaaagtacaggcactgtcatatggattgtgtccacagaaggagaaatcggtattatcaagggtaatcaggcggtggtaagggaaatagtccaaaagcttaccgacgacaccggcaagattaaactgcaaaacccggcacaatataaagacgttatgagcggtagtgtgcccatggtcaaagaaataggagatttttacggactgtttaaggacacgaatgtatcgtggctgactattggaaagccgtttacatataacggcaaaattctcggggctgtttaccttcatacgccggttcctgaggtacagagggcaagaagcagtgtttttaagttctttatttttgccgttgtcatttccataataatatcaatagtactgatttatattttttcacttaagctttcaaggcctttgaaaaagattaacagtgctgcaaagaaaattgcaagcggaaaatttgacgaaaggcttgatatttcatcggaagatgagataggtgagcttgcaagaagttttaacaacatggcgggagagcttcagaatctggaaaacatgcgaagaggttttatcgccaatgtgtcccatgagcttagaaccccgatgacttcaatacatgggtttatagaaggaattctggatggaaccattcctccggaaaaggaaaaggattaccttttaattgtccgggatgaaatacgaaggctcaacaggctgaccacggatcttcttgaccttgcaaaaatggaggccggtgaaatcactataaatccggttaactttaatatcaatgaacttatcagacgatgcattataaagcttgaaaactttataacacaaaaggacattgaggttgaggcaaattttgaagaagaggatatgtatgtaaaagcggatattgactccattgagagagtgcttataaatcttatgcacaacgctgtcaaatttgttcagcagaacggaaaaatcaaagtatccacctcaagttacaaaaacaaggtacttgtttgtgttgaggataacggcataggaattgacaggaatgaaattgaccttatctgggaaagattttacaagtcggacaaatccagaagcaaagaaaaaggcggtgccggccttggacttgccatagtcagaaacataataaacgaccacaagcaggaaatctgggttgagagtgaggtcggaaaaggaaccaagttttattttactttggacaaaggaagcaatgaaaaagcataa

SEQ ID NO: 77439 - protein, 504 aa, Clostridium thermocellum ATCC 27405
MLKTLFSKIVVLFIAILLVSTSITGVMLYIFLGNFASEEKEKLLSDTADSINSMLNDYLTAYYNNYNNPMFAFWEEIYRRMLDNALERESQSTGTVIWIVSTEGEIGIIKGNQAVVREIVQKLTDDTGKIKLQNPAQYKDVMSGSVPMVKEIGDFYGLFKDTNVSWLTIGKPFTYNGKILGAVYLHTPVPEVQRARSSVFKFFIFAVVISIIISIVLIYIFSLKLSRPLKKINSAAKKIASGKFDERLDISSEDEIGELARSFNNMAGELQNLENMRRGFIANVSHELRTPMTSIHGFIEGILDGTIPPEKEKDYLLIVRDEIRRLNRLTTDLLDLAKMEAGEITINPVNFNINELIRRCIIKLENFITQKDIEVEANFEEEDMYVKADIDSIERVLINLMHNAVKFVQQNGKIKVSTSSYKNKVLVCVEDNGIGIDRNEIDLIWERFYKSDKSRSKEKGGAGLGLAIVRNIINDHKQEIWVESEVGKGTKFYFTLDKGSNEKA

SEQ ID NO: 77440 - DNA, 1449 bp, Microbulbifer degradans 2-40
  CDS (1)..(1449)
atgaaaagcattaaatttaaaatctggctcgccttttttattacccttaccgtatgtatggctaccatgcttgtggtaacgcataccacaatgaaaaaagggtttttgcgatacgtaaatatcgaaaccatcaacaagctagatctgctcaaaaatgaaatagctgaaatttacacccgcactgggtcgctagagctatttaccaccaagccgcacctttgggacaaactaaaatacaaagcctatagcccctacttaaaaattcgcgcagaccaacgacgtaacgacggcccaccagcgccccccaaaagtaaagagttgccccccaaagacaaacacggtgtgggccgccatcaacgcgagtttatggaaaggttaattttgaccgatgagaacaaaaatgtaatttctggtcgctaccgcaaaaactctgattacagctggtcggcaataaaagcagaagacaaaatcatcgcctacgtgggttatgtggccccctcagaatttttgcgcgatgtagataaacacttcttgtataaccaacttcgcgcgctctctaaaattagtattttcttggtgatcatctcattcataacggtgctaatcatctcccacaagctggttaagccattagttgccctatcgcgcagtgcaaagcagctagctgccggcgagtacaacgtgcgcatacaacctcaaacctccgacgaggttggcgagctgtgccacaacttcaacgagcttgcccacaccctagaggctaacgaacaatctcggcgccaatgggtagccgatattagccacgaaatgcgcacaccattagctgtaatcaaagcgcagattgaatcaatgcaagatggtatccgccagccctcccaggccaacttagcccttttaaaagacaaaacagattcgctaaatgcgctggttaacgacctctacgagctttcgctttcagatttgggcgcgcttacctatagcaaagaggtatttagttttaaccaactgtttgagcacacgcaagacgaagtggaagtgcgcaccaatggcaaagaactaacgcttaccatcgaaaacaacttaaacgagcagcataaaatttacggcgacagcagccgcttagcgcagctaattaacaacttgattgagaacagcctgcgctacacagatacccctggccaaataaaaatatggtctgctgaaacgcagggcaatcttgagttccacattgaagacagcgcgccaggcgttaacccagatcagctagataaaatttttgacaggctttaccgcttagattcttcgcgcaaccgcgctacaggcggcgccggcctaggcttatctatatgtaaaaacatcgtagaggcccacaacggcactattcgagcactgcaatcgaagctcggaggcattcatataatcatttcactgccacgttggacgaggtaa

SEQ ID NO: 77441 - protein, 482 aa, Microbulbifer degradans 2-40
MKSIKFKIWLAFFITLTVCMATMLVVTHTTMKKGFLRYVNIETINKLDLLKNEIAEIYTRTGSLELFTTKPHLWDKLKYKAYSPYLKIRADQRRNDGPPAPPKSKELPPKDKHGVGRHQREFMERLILTDENKNVISGRYRKNSDYSWSAIKAEDKIIAYVGYVAPSEFLRDVDKHFLYNQLRALSKISIFLVIISFITVLIISHKLVKPLVALSRSAKQLAAGEYNVRIQPQTSDEVGELCHNFNELAHTLEANEQSRRQWVADISHEMRTPLAVIKAQIESMQDGIRQPSQANLALLKDKTDSLNALVNDLYELSLSDLGALTYSKEVFSFNQLFEHTQDEVEVRTNGKELTLTIENNLNEQHKIYGDSSRLAQLINNLIENSLRYTDTPGQIKIWSAETQGNLEFHIEDSAPGVNPDQLDKIFDRLYRLDSSRNRATGGAGLGLSICKNIVEAHNGTIRALQSKLGGIHIIISLPRWTR

SEQ ID NO: 77442 - DNA, 1413 bp, Microbulbifer degradans 2-40
  CDS (1)..(1413)
atggcgtttggatttcgcctggcgcgacctttatcactcaacaatcgtgtgatgctgtttgtcgcacttgccattagtctcagccttgttgtaatcggccatctcgttcagaagtcagtcgaacagcattttgcagaacaagacgctgacgaattggttgtcatcagccgtgccgtggcagaagcactaaaaaagacaacacgttcaggtcgttcggccgacgaaacacttcctcatgctgtttccggtcatcacggtgtgtattatcaggtttgggacgaatctggtgcgctggtttacggcccacatgaagtagtttttcctccccgagctagattcaatgccccggtgtacactatccgcgccgacaatcttgtgagttggcatattgatgataaatcctatcgaggcgcgatgacacaagtgcaaattgacggccgaaactatctcgtcactgcggccatcaatatggacttccatatgcgctttctcgaacatttcagccgcaatttatggttgatcatggcgctggctggtgggcttactttactcgcagcctggtacggtgtgcatcaagggcatgcgccactacgggcactcagtgaatccatacgatctgttcaagccgaccaattggatatgcgactgaatgaaaaagctgttcccatggaattgcaacctctggtggagtcctttaaccagatgatcagtcgccttgacgacagcttcacgcgcctgtcccacttttctgcggacatcgcccatgagttgcgaacacctcttacgaacctcgcaacgcaaacccaggtcggtttggggcaagcgagaacacttgaagagtatcgggaattgctctactccaatttggaagagcaagaaagattgaccaaaatggtaaatgacatgctgtggctcgcgcagagtgagaacggcctacttaaacccaattgggaattactggatttgaggcaagaagttgaagccaccttcgaatttttcgaagccttggcggaggataaaaaaattacattggctgtagggggagatcgcgtcaacgcgatggccgatcgttcgatgctgcgccgagtgatttctaaccttttgtctaatgcgcttcgttatacaccagagaacgaaacaatcaatgtcactgttgagggggttggcaatcaggcccaaataacaattgaaaacccggggcaggggatttctgcagtgcatctaccgaaactctttgatcgcttctatcgggttgatccatcgaggcagcgtcagagcgagggggcaggcttgggtttggcgatcgtgaagtcaatcattgaggcacatgacggaaatgtggaggtgtcctccgaaatgggtactacccggttcgttatctcgctgccagctcatgataaaaaagcaggttag

SEQ ID NO: 77443 - protein, 470 aa, Microbulbifer degradans 2-40
MAFGFRLARPLSLNNRVMLFVALAISLSLVVIGHLVQKSVEQHFAEQDADELVVISRAVAEALKKTTRSGRSADETLPHAVSGHHGVYYQVWDESGALVYGPHEVVFPPRARFNAPVYTIRADNLVSWHIDDKSYRGAMTQVQIDGRNYLVTAAINMDFHMRFLEHFSRNLWLIMALAGGLTLLAAWYGVHQGHAPLRALSESIRSVQADQLDMRLNEKAVPMELQPLVESFNQMISRLDDSFTRLSHFSADIAHELRTPLTNLATQTQVGLGQARTLEEYRELLYSNLEEQERLTKMVNDMLWLAQSENGLLKPNWELLDLRQEVEATFEFFEALAEDKKITLAVGGDRVNAMADRSMLRRVISNLLSNALRYTPENETINVTVEGVGNQAQITIENPGQGISAVHLPKLFDRFYRVDPSRQRQSEGAGLGLAIVKSIIEAHDGNVEVSSEMGTTRFVISLPAHDKKAG

SEQ ID NO: 77444 - DNA, 1452 bp, Pediococcus pentosaceus ATCC 25745
  CDS (1)..(1452)
atgtcgctaaaatggaaatgggctatcggtactggtgttggagtcctattaatttttgcacttttctctttttttgtttttaaaattgtaacagattcattatatgctgaagaacatcgagatgtggaatcaacagtaacccaagtaagaagtcgtcttcaaaatgcgaatgagattaattataaaactacggatatattcagacctgatttaaaccaaaaatcggcggttaataataaccaaggtggttttaatgattcattgttagcgagtttaaccaggcgagatttagtagtttcagtttataacttagaaaaagaatcagttttttcgaatcaaagaattagtatgaagactactctctccgagcgaaagtcaattaaacggagtaaatttcatcataaagatattattgtgggacaagcaccgattattaataaagataatcaagtaatcgggtatgtacgagttgttgatttactggtgaaatataataacagatatcagcgcttgatctggctatttaccttaacgtcgcttttaatttttatggtaatctccattttcggttatggattaacggcatacttattaaaaccaatgaatttaattaatcagtcgatgcgtaatttagaggaagatcctcaaaccgatttaagagttcctgaaattgatacaaatgacgagttatcggacttggctcatgaatttaatgatatgattgatcgaatgcaacgctatattgatcaacagagacagttcgttgaagatgtatcacatgaattgcgaacgccagtggcagttgtggaaggtcacctaaagatgcttgaccgttggggaaaggatgatccacaagttttggatgaatcaattaaagcgtccttagaagaaacgcaacgaatgaaaagtttagttagtgaaatgctagatctaacacgagctgatcaaattgagattaattatgccgatgaaaaaacgaacgtcgttcaattagtaaatcaagtattcaatgattttaagatgattcatccagaatttaatttcgtaatggatgacgatattactggtgaacccattgttcctatatatcggaatcatttagaacaaattctcgtaatcctgcttgataatgccatcaagtactcaaaagatcgcaaagaaattcatatttcaactgctaataccaaaaagaccgttgaaattgctgtacaagattttggtgaggggattgctgaagaaaatctgaaacaggtatttaatcgtttctatcgaatcgacaaagctcgcagtcgagatcaaggtgggaacggtttaggtttatccattgctaagaaattaactgaagaatatcatggaaatatttcgctagaaagttcagttggttcaggttcaatatttagaattaaattaccgattattgaagatcaacagatagaaattagtgaaaaataa

SEQ ID NO: 77445 - protein, 483 aa, Pediococcus pentosaceus ATCC 25745
MSLKWKWAIGTGVGVLLIFALFSFFVFKIVTDSLYAEEHRDVESTVTQVRSRLQNANEINYKTTDIFRPDLNQKSAVNNNQGGFNDSLLASLTRRDLVVSVYNLEKESVFSNQRISMKTTLSERKSIKRSKFHHKDIIVGQAPIINKDNQVIGYVRVVDLLVKYNNRYQRLIWLFTLTSLLIFMVISIFGYGLTAYLLKPMNLINQSMRNLEEDPQTDLRVPEIDTNDELSDLAHEFNDMIDRMQRYIDQQRQFVEDVSHELRTPVAVVEGHLKMLDRWGKDDPQVLDESIKASLEETQRMKSLVSEMLDLTRADQIEINYADEKTNVVQLVNQVFNDFKMIHPEFNFVMDDDITGEPIVPIYRNHLEQILVILLDNAIKYSKDRKEIHISTANTKKTVEIAVQDFGEGIAEENLKQVFNRFYRIDKARSRDQGGNGLGLSIAKKLTEEYHGNISLESSVGSGSIFRIKLPIIEDQQIEISEK

SEQ ID NO: 77446 - DNA, 3360 bp, Trichodesmium erythraeum IMS101
  CDS (1)..(3360)
atggctttaaaatacctgagtagattatttgctcaaatttctggaaaagttcccctccgtacaactttaatactaccatttatagtgcaagtatttggggtagtaggtttaatagggtatatttctatagaaaattctcaaagagctattaatgatgtagttaatcaacttttgaatgaacaggttgctagagttgaacaaaatttagaagcttaccttcgtgttccccatcaggttaatcaaattaatgctactactattcgtaatggtcaattagatttagaaaatacttctcaattagaaaattacttttggcaacaactacaaatatttgatgttcttggttttacaggattaggattagaaaataaagttaatttgggggccgaaagacttactcaggatactctacatctgagaatttcaacccaagaaagcaattatatttttgaaacttattccacaaatcaatttggtgagcgagtccaactattaaatagtattaaattcgacccacgcactcgaccttggtacaaagctgctgtagctagtggtcaacctacttggagtgaaatttatcctaatactgctggtctcactgcttatcttggcgcatctaaggctttttataatgaccagggaaaattgcagggtgtactattaacaaatattaatctatcacaaattggtgactttttagggagtctagaaattggtaaaactggacaaatttttattcttgagcgttcgggaatgttagtggcaacttctacaggagaaaagccttttcgtacgataaataaagcatacggagctgagagagttcaagccattgaaagttataatgatttgactcaagctacagccaaatatttaagcacagaatttgacttaaataaattaattaatgatggaaaatatctgcaatttaagattaataatcaacgacaatttcttaatataaaacctttccaagatcagtatggtttagactggttaatagtaatagtaattccagaaatagactttctagataatatttataaacaaactaaaatcacgattatactttgtctattggcattagttttagcaacagtaattggtatcttaacatctcgttgggttgtgcaacctattttaaaactaaaagatgtagctactgccttatctgaaggagaatttaatcagaaaattgaacttaatcgtgatgatgaagtaggggaacttgctaaagcttttaattctatggcttttcaattacaaaattcctttaatttactgacaattaagaataaacaattagaaaatttagataaattaaaagacgaatttttagctaatacatctcacgaacttcgtactcctttgaatggaattattgggattacagaatcattaatagatggggtagcaggagaattatcttctgaggttaaaaataatctttatctagtgattttttctggcaaaagattatcaaatttaattaacgatattcttgatttttataaacttaaacatcgcaatatcgaattaaaattaaaaccagtaggggtgagagaagtagcagagatagtaattaatctttctagttccatgattggtacaaagcctttacaaataattaattctattagttatgatataccttttgttgatgctgatgaaaatcgacttcagcaaatcttttataatttagttggtaatgcagttaagtttactgactcaggtaaaatagaggtctcggctaaagtcttagaaaatcaactagaaaactctagtaataacgtttctttattagagattactgttagtgatacaggtattggcattccatcagataaattagatcaaatttttgaatcatttgaacaagcaaatggctctacttctagagaatatggtggtactggtttgggtttagctattactaaaaagttagtagaattacacaaaggttctctctgcgttttatcagaagtaggtgtgggttctcagtttaaatttactattccaatctctaaaactcaagtagttaattttccacaagttacattatctccatcaataccattagttacagattttgaaccaaaaagtaaggacgttaaactacaatatttagaagcagaaatgggagattttacagttttaattgtagatgatgaaccagttaatttacaagttattagaaataatttggctttacaaaattatgctattactgaagctaataatggaattgaagcattagaaatgattgaaaaaggcctgatgccagatttaattttacttgatgtaatgatgcctcacatgactggttatgaagtggcaaaaaaactgcgggaaaaatatttacatattgaattacccattattatgttaacagcaaaaccattagtttctgatttggtggaaggttttgtttctggagcgaatgattacttaatcaaacctttttctaaacaagaattacttgccagaataaaaattcatattcgtcttagtaaaataagttctgcttataatcgttttgttccccataattttgtgcaattattgaattctgagagtattgtagatgtaaagttgggagatagtattaagcaaaaaatgtctattttgttctctgatattcgttcttttacaactttaagtgaaagtatgactccagaagaaaactttaagtttattaatgcttatttatcccgaatggaacctgccattttagataatgaagggtttatcgataaatatattggtgatgccattatggctatttttatcagaaaggcagatgatgcagttcaggcagcaattaatatgttgaaaaacttggctgattttaatcaggaacgtcaaaaattatcacaggaaatgattaaaattggtattggtattaatacaggagatttgatgttgggaattgtgggaggagagagaagaattgatggtacagtgattagtgatgctgttaatttaggctctcgcttagaaagtttaactaagttatatggagtgaatattttaattagtgaaaatactttattgaatctggaagaagcatataaatataattatcgtttccttgataaagtaaaagtgaagggaaaaaaacaagccgttggactttttgaaatttttgatggagatcctgaagaacaaaaagaattaaaaaaacaaactaaaactaaatttgaacaagcagtttttctttattttcaacaaaagtttgctacagctaaacaaataatgattgaaattttacaaatcaacccagaagacaaagttgcacaattttatattcggcgttttgatgaatctaagttgatagaagaattgaaagatggggaataa

SEQ ID NO: 77447 - protein, 1119 aa, Trichodesmium erythraeum IMS101
MALKYLSRLFAQISGKVPLRTTLILPFIVQVFGVVGLIGYISIENSQRAINDVVNQLLNEQVARVEQNLEAYLRVPHQVNQINATTIRNGQLDLENTSQLENYFWQQLQIFDVLGFTGLGLENKVNLGAERLTQDTLHLRISTQESNYIFETYSTNQFGERVQLLNSIKFDPRTRPWYKAAVASGQPTWSEIYPNTAGLTAYLGASKAFYNDQGKLQGVLLTNINLSQIGDFLGSLEIGKTGQIFILERSGMLVATSTGEKPFRTINKAYGAERVQAIESYNDLTQATAKYLSTEFDLNKLINDGKYLQFKINNQRQFLNIKPFQDQYGLDWLIVIVIPEIDFLDNIYKQTKITIILCLLALVLATVIGILTSRWVVQPILKLKDVATALSEGEFNQKIELNRDDEVGELAKAFNSMAFQLQNSFNLLTIKNKQLENLDKLKDEFLANTSHELRTPLNGIIGITESLIDGVAGELSSEVKNNLYLVIFSGKRLSNLINDILDFYKLKHRNIELKLKPVGVREVAEIVINLSSSMIGTKPLQIINSISYDIPFVDADENRLQQIFYNLVGNAVKFTDSGKIEVSAKVLENQLENSSNNVSLLEITVSDTGIGIPSDKLDQIFESFEQANGSTSREYGGTGLGLAITKKLVELHKGSLCVLSEVGVGSQFKFTIPISKTQVVNFPQVTLSPSIPLVTDFEPKSKDVKLQYLEAEMGDFTVLIVDDEPVNLQVIRNNLALQNYAITEANNGIEALEMIEKGLMPDLILLDVMMPHMTGYEVAKKLREKYLHIELPIIMLTAKPLVSDLVEGFVSGANDYLIKPFSKQELLARIKIHIRLSKISSAYNRFVPHNFVQLLNSESIVDVKLGDSIKQKMSILFSDIRSFTTLSESMTPEENFKFINAYLSRMEPAILDNEGFIDKYIGDAIMAIFIRKADDAVQAAINMLKNLADFNQERQKLSQEMIKIGIGINTGDLMLGIVGGERRIDGTVISDAVNLGSRLESLTKLYGVNILISENTLLNLEEAYKYNYRFLDKVKVKGKKQAVGLFEIFDGDPEEQKELKKQTKTKFEQAVFLYFQQKFATAKQIMIEILQINPEDKVAQFYIRRFDESKLIEELKDGE

SEQ ID NO: 77448 - DNA, 3402 bp, Trichodesmium erythraeum IMS101
  CDS (1)..(3402)
atggcatttaaatctttgtccctaaacctgggtagaatatttagtaagctttctttaaaaactattttaatagtaccctatgttatccaaattcttggtgcttttggagcattaggatatatagcttttctgaatgggcaacaaaccgttgatgatttgggcaaaaagctaactaacaaaattagcgatcgcattcaacagcacgttttgggatatttaaatcaatctcatcaagttctgaggatcactaatgatgctatagaaagtgcaaacttagacatctataattttgtcgcactcaggcgatacttttgggaagtcgtaaaagaaaaagatttacaggattatttattctttggcaacgaagaaggagaatttattggcgtcgaacatttcgcagaaggagaaatttacctaaaaagttgtaaaatccctacccaaagcctttgcgaaacttatctgcttaataatcaaggtaacattagccaatatttaaacagcaaagagtacgacccccgggatactccctggtatttagtagcaaaaaaattaggcgagcccacctggagtccaattttgtcctcattttctggtcaaaatagctccctcgacatcttcgcagttcaacctatttttgactcaacagagaatttattaggagttctctcaaacaaaaccaccctggtcaaactcacaaatttcctcaaaaacttatacattagtcccaacggtcaaagtttcattatcgaacgatcgggaaacttaattgcttcttccgaggttatggagccttttgtaattaaaggaactcaggaaaatcgaaaaatagaacgcctacccgccactgctagtgagaataagatagtaagcatgacgacaaaacatctacaacaaaagtttagtagttttgccgaaattactcacactcacgaaatgaattttcctattgaagaagaatggtactatgctagtgttataccagtaatagacggacgaggtattaattggctagcagtagtagttattcctgaagatgacttcatggaaaaagtcaatatgaacattcgtactactattctattaagttttgctgccttgacaataaccgtattattaggaatagtcaccactaactggataaccaagcctatcttacaacttaattctgctgccaaagaaatttctcaaggaaaatgggaaacccaactcaaaatttatcgcgaagatgaattaggggaactggccaactcctttgatcagatggcaagccagctcaagaaatcctttgaaaccctagaagcccaaaataaacaactcacagaactagatcgccttaaagatgaatttcttgccaatacctcccacgaactccgcaccccactaaatggtattatcggtattggagaatttctactagaagaaaacactaaaaatttaaactctataactacctctaacttagccataatagtttctagtgctcgtcgtctctccaacctcgtcaacgatattctcgacttttctaaaattagataccacaaattagaattacaagtcagagccattgatgttaggatagtcgttgaatcagttatcaccctaaatagagtattagttggcaaaaacaaaaatctgcaattaacaaatgctataccgacagacttaccccccgttttagctgatgaaaaccgtctacaacagatactctataatttaattgccaatgctatcaaattcactgaatctgggaaagtcgaaatctctgcttccctctactcccctaaagaagatcaagatgaagccactgaaattattatcatggtatctgatactggtatcggtattccccctgatcaactagatcgtatctttgaatcttttgaacaaggagaaggttcaattataagaaaatacggcggtacaggtttaggtttggctgtcaccaaagaattagtagaactccaaggcggtcgtatttgggttgagtctgaagttggtgtaggttcccggtttaacgtgaccttacccatatctaatcaactcgtacctaattcctctttaaattttcctagtcctactgttaataatattcactatctgatcaagaacatagaaacaactatcaggagtaaacccctaggaagtaaaatacctaatggtgatttccacgttttagttgttgatgatgaaccgataaatattcaagttttaaacaattacctcaaagccaataattatcaagttacccaggcattaagtggaaaagaagctttggcggctttggagaataatcataattttgacttaattttgctagatgtaatgatgccaaatatgtctggttatgaggtatgctctcaaattagagaaaaatatccggcccaaagtttacctgtgttaatgttaacagctaaaaatcaaattgctgatttagttatgggtttccaatttggtgctaatgattatttaactaaaccttttgctaaagatgagttattaacccggattcaaactcatattaaattatcaaaaatcactaaagcttacgagcgttttgttccccacgaatatgttgagttactctcaaaagaaagcattattaatgttaaactaggggatcgagttagtactaaaatggcaattttcttttctgatattcgctcttttacgactatatctgagcagatgacttctcaagaaacttttgcttttgtgaatggttatttaaaggaggtttgtccagaaattcgcgatcgcaacggtttgattattaaatttctgggagatggtattatggcagtatttccagatggagctgatgatgcattggaggcagctattgctcaactcaaaagattacaggaatataatcaggttctattatctacaggttggatgcctataaaaattggaattggtattcattggggtcacattatggtaggcatagttggagaaaagggtcggatgtcaggagatgcattttctaataatgtgaatttgacatctcgtttggaaggtttgactaagttttatggtgtttctttattaatttctgagtcagcttttaactatttaaaaaatccgcagaaatatcaaattaggtttttagaccgggcatctgttaagggtatagatgaaccgattaatgtttatgaagttcttgatggtgaagttgatgagatacgagagttaaaattacaaactcaggtagattttgcattaggtttggagtcttatcgtgtaggagagttagttgatgctaaagattattttgagaaagtattagccgttaattattcagataaaacagctcaactttatctggaaagaattgatgatttgatggtaactggtgtgcccaaaaattggaatggggtttgggcatttactcagaagtaa

SEQ ID NO: 77449 - protein, 1133 aa, Trichodesmium erythraeum IMS101
MAFKSLSLNLGRIFSKLSLKTILIVPYVIQILGAFGALGYIAFLNGQQTVDDLGKKLTNKISDRIQQHVLGYLNQSHQVLRITNDAIESANLDIYNFVALRRYFWEVVKEKDLQDYLFFGNEEGEFIGVEHFAEGEIYLKSCKIPTQSLCETYLLNNQGNISQYLNSKEYDPRDTPWYLVAKKLGEPTWSPILSSFSGQNSSLDIFAVQPIFDSTENLLGVLSNKTTLVKLTNFLKNLYISPNGQSFIIERSGNLIASSEVMEPFVIKGTQENRKIERLPATASENKIVSMTTKHLQQKFSSFAEITHTHEMNFPIEEEWYYASVIPVIDGRGINWLAVVVIPEDDFMEKVNMNIRTTILLSFAALTITVLLGIVTTNWITKPILQLNSAAKEISQGKWETQLKIYREDELGELANSFDQMASQLKKSFETLEAQNKQLTELDRLKDEFLANTSHELRTPLNGIIGIGEFLLEENTKNLNSITTSNLAIIVSSARRLSNLVNDILDFSKIRYHKLELQVRAIDVRIVVESVITLNRVLVGKNKNLQLTNAIPTDLPPVLADENRLQQILYNLIANAIKFTESGKVEISASLYSPKEDQDEATEIIIMVSDTGIGIPPDQLDRIFESFEQGEGSIIRKYGGTGLGLAVTKELVELQGGRIWVESEVGVGSRFNVTLPISNQLVPNSSLNFPSPTVNNIHYLIKNIETTIRSKPLGSKIPNGDFHVLVVDDEPINIQVLNNYLKANNYQVTQALSGKEALAALENNHNFDLILLDVMMPNMSGYEVCSQIREKYPAQSLPVLMLTAKNQIADLVMGFQFGANDYLTKPFAKDELLTRIQTHIKLSKITKAYERFVPHEYVELLSKESIINVKLGDRVSTKMAIFFSDIRSFTTISEQMTSQETFAFVNGYLKEVCPEIRDRNGLIIKFLGDGIMAVFPDGADDALEAAIAQLKRLQEYNQVLLSTGWMPIKIGIGIHWGHIMVGIVGEKGRMSGDAFSNNVNLTSRLEGLTKFYGVSLLISESAFNYLKNPQKYQIRFLDRASVKGIDEPINVYEVLDGEVDEIRELKLQTQVDFALGLESYRVGELVDAKDYFEKVLAVNYSDKTAQLYLERIDDLMVTGVPKNWNGVWAFTQK

SEQ ID NO: 77450 - DNA, 1410 bp, Moorella thermoacetica ATCC 39073
  CDS (1)..(1410)
atgaccctgcgtctacgcctcaccctgctggttaccattacccttggtttaaccttcattgtcctgggtggactggtctatttcctgatgggacattacctgaccaatgaaattgatcgttccctggtcgcccgggcccaggaggttgtccgttcttttcgagtagagggaaacttgcgcttgcagcgcattacgctgcccaatgtgaatgttttctcggctccggatacctttatccagatagttgatataaatggtttcgtagtcacccgttctgataatctgggtcaacaatctttaccccttggaccgcaaaccctcattcaagccggggaaggcatcgccttttttgaaaccgagatagtcggtaaccatcccctgcgactttataatgtaccccttttattgcaaaaccagccggtagggcttctccaggtagcccgccttctcagtcccgtccagcagaccctgggcaacctgcgccgggtactgctcttcctggggcttttattaatcttcctggctgccacccttggttatatcttagcccgtactgccctgcggcccattgatcgtctaacccaggtggctgaacaaataggggagggcaaggatctggatcagcgggttccctaccagggccctatggatgaagtcggccggctggctgctacctttaatgctatgctggcccggcttcagcgagcctacacccgcctggaggaagcctatagcgcccagcggcgcttcgtagccgacgcttcccatgaactgcgcacccccctgactaccatccgcggtaatgtcgacctattacggaaagtacagggtcaaggggaagcatggcaggatgaagccctggccgatattgccagtgaggccgagcgaatgagccggctggtcaatgacctcttgacccttgcccgggctgacgccggtcaggagataaaacgtgaaccactggaaatacttcctctcttacaggaggtggcccgccaagcacctttattgggaacggccaccttcacagccatcggattggaaaacctggccggagtccacatcatgggaaaccgggattacctcaaacagctattctttatccttctggataacgcctttaaatataccccttccgaaggtaaaatcgatttaatagttaacgttgaaccccagcagcggttgatcattaaagtcagggataccggcccgggtatccctccccgggatctggagcatatttttgaacggttctatcgcgccgatgctacccgcagcagtgaaggaaccggactgggcctggccatagctcggtggatagttgaacagcaccagggtcatatcggggttgaaagtacggtggggaagggcaccaccttcaccattaccatccccctgttgaaaggttga

SEQ ID NO: 77451 - protein, 469 aa, Moorella thermoacetica ATCC 39073
MTLRLRLTLLVTITLGLTFIVLGGLVYFLMGHYLTNEIDRSLVARAQEVVRSFRVEGNLRLQRITLPNVNVFSAPDTFIQIVDINGFVVTRSDNLGQQSLPLGPQTLIQAGEGIAFFETEIVGNHPLRLYNVPLLLQNQPVGLLQVARLLSPVQQTLGNLRRVLLFLGLLLIFLAATLGYILARTALRPIDRLTQVAEQIGEGKDLDQRVPYQGPMDEVGRLAATFNAMLARLQRAYTRLEEAYSAQRRFVADASHELRTPLTTIRGNVDLLRKVQGQGEAWQDEALADIASEAERMSRLVNDLLTLARADAGQEIKREPLEILPLLQEVARQAPLLGTATFTAIGLENLAGVHIMGNRDYLKQLFFILLDNAFKYTPSEGKIDLIVNVEPQQRLIIKVRDTGPGIPPRDLEHIFERFYRADATRSSEGTGLGLAIARWIVEQHQGHIGVESTVGKGTTFTITIPLLKG

SEQ ID NO: 77452 - DNA, 1395 bp, Moorella thermoacetica ATCC 39073
  CDS (1)..(1395)
atgggaggctttaacttgcggcagaaattttccacctggctccgcggtattcccctgcggtggcggctgacggcctggtatgttttcttgctggccttgatcctggccggcttcagcgcttttatttactttaacatgtcccggagcctgaaacagggcctggattctttattattctcccagggggaacaggttttaagcagcctggacaacgagaacggcctgccacgcctggaccccaatttgcccctcctgcccggtacttactttggcctttacgacaccggaggtaaagtcctggatacaaacatgccggcggacctggctaccggcttccaggtgaagggcttaacggccagccggcccgcaacagtggagattaagggggccgaatggcgggtgctcctggtcccggtaagggaaaaaggccagcaaccttactgggtcctggttgtacgctcggtcgaagagaccgaaaagcccctggaccgcctgctgttatttatccttattgccatccccatgaccctgctggtggcggcgggagggggtattttcctggcccggcgggcgttgcagcctattgatagaattgccgccaaagcccgccagatcagcgctactgacctgagccggcgcctggacctgccccacggtaacgacgaggtggggcacctggtggccaccctggacgagatgctggatcgcctggaccgggcctttcagcgccagcggcagtttactgccgacgcctcccacgaatttcgcacccccctggccgtcatccgcagccaggccgaagcggccctacagcggcagcactcgccggcagagtaccgccaggccctggaaataatccgtgatcaggcggagtggatgggtaacctggtcgccaagttattgcttttggcccggagcgacgacaggatggaacagatggagatggaacccctggatttgggcgaactggtggaaggcgtcacggccgaattccaggggatggcggcggaaaagggcctgaggctggtaaaaaaaattaaggaaaaagtggtcgttcgcggggatcagacacgcttgacccagctcctggccaatctggtggataatgccatcaaatatacgccggaaggggaggtggtcgtcagcctggaacggcgcggccggcaggccctgctgcaggtgcaggatacgggagtaggtatcccggaggaacatctggcccatatctttgagcgattctaccgggtcgataaagcccgttcccgggcggaagggggctttggcctgggactggctatctgcgactggatcgtccgcgcccataacggcaaaattgaggtagaaagtgcggtggggcggggaacaacctttaaagtatggttgccggttgaatga

SEQ ID NO: 77453 - protein, 464 aa, Moorella thermoacetica ATCC 39073
MGGFNLRQKFSTWLRGIPLRWRLTAWYVFLLALILAGFSAFIYFNMSRSLKQGLDSLLFSQGEQVLSSLDNENGLPRLDPNLPLLPGTYFGLYDTGGKVLDTNMPADLATGFQVKGLTASRPATVEIKGAEWRVLLVPVREKGQQPYWVLVVRSVEETEKPLDRLLLFILIAIPMTLLVAAGGGIFLARRALQPIDRIAAKARQISATDLSRRLDLPHGNDEVGHLVATLDEMLDRLDRAFQRQRQFTADASHEFRTPLAVIRSQAEAALQRQHSPAEYRQALEIIRDQAEWMGNLVAKLLLLARSDDRMEQMEMEPLDLGELVEGVTAEFQGMAAEKGLRLVKKIKEKVVVRGDQTRLTQLLANLVDNAIKYTPEGEVVVSLERRGRQALLQVQDTGVGIPEEHLAHIFERFYRVDKARSRAEGGFGLGLAICDWIVRAHNGKIEVESAVGRGTTFKVWLPVE

SEQ ID NO: 77454 - DNA, 1287 bp, Thiobacillus denitrificans ATCC 25259
  CDS (1)..(1287)
atggtacgcatcgccagttcgctctacgcgcgcacggcgctgacgctggccatcgctttcgtcctctttcaggccgccgccttcgcggtcgtataccgcaccctgatcatcccgctggccgagcgctcggccgacgacctcgcgggcctgatcgtgctgtcggctcagacctgggtcgaactgccgccgcaaacccgcgccgcgttcgagcgggaactggcggaccggcacggtctgcgtctcacggccggcgatcccggcgcggtcgccgacgcgccgcagttcgcgttccgtgcgcagatcgagaccgccctcagccgccgcgtgggcgagccggtcaagcttcggggggtgcccgggacacgcgcggcctggctcgacatcccgaccggcggccatgccctgcaggtcggcttctacccggcgcgctacgcggtgaagccgccgctggcggcgatcgctgtgatcgcgctcggcgccctgctcagtctggtgaccgcgctgctgctcgtgcgccgcatcacgcttccgctcgcgcgggcggcgcgggccgcacggcaggtcggcgcgggccagctccccgagccgctgccggagaccggcccggccgaggtcgccgaactcgcgcgtcgcttcaacaccatggcgaccgaggtccgcgagctgctcgacaaccgcacgaccctgctcgccggaatctcgcacgacctgcgcacgccgatgacccggctccagctccatctcgaaatgctgcgcgacgcgccgagcccggcacgaatcgatcgcgccgtcgccgacctcgccgacatgaacaagctcatcacaggctatctcgaactcgcgcgcacgacccaggccgaggcgaagacgcgcttcgacctcgcggtcctgctcgaggaagtcgcgaccgacgcgggcctggcgggattttccgcggcgccgtgcacggtcgaggcgggccgcctggcactgcgccagatcgtgtcgaacctgatccagaatgcgcagcgctacggggacgcagcgacggtcgaactcgaactcgaatgctcggagctgggggcgcgggtgaccgtgcgcgatgcgggaccggggattccggaagatcagctggagaaggtgttccggccgttctaccggctcgaggcatcgcgctcggaagcgaccggcggaagcggtctcgggcttgcgatcgtccggcagttggcggcgacccacggttggaaagtctcgctggccaaccgcaagaccggcgggctcgaggcggtgctcgaaatccgccgctag

SEQ ID NO: 77455 - protein, 428 aa, Thiobacillus denitrificans ATCC 25259
MVRIASSLYARTALTLAIAFVLFQAAAFAVVYRTLIIPLAERSADDLAGLIVLSAQTWVELPPQTRAAFERELADRHGLRLTAGDPGAVADAPQFAFRAQIETALSRRVGEPVKLRGVPGTRAAWLDIPTGGHALQVGFYPARYAVKPPLAAIAVIALGALLSLVTALLLVRRITLPLARAARAARQVGAGQLPEPLPETGPAEVAELARRFNTMATEVRELLDNRTTLLAGISHDLRTPMTRLQLHLEMLRDAPSPARIDRAVADLADMNKLITGYLELARTTQAEAKTRFDLAVLLEEVATDAGLAGFSAAPCTVEAGRLALRQIVSNLIQNAQRYGDAATVELELECSELGARVTVRDAGPGIPEDQLEKVFRPFYRLEASRSEATGGSGLGLAIVRQLAATHGWKVSLANRKTGGLEAVLEIRR

SEQ ID NO: 77456 - DNA, 1398 bp, Azotobacter vinelandii
  CDS (1)..(1398)
atgaaaatcagcctctccaccaaggtattcctcgccgtccaggcgctctgcaccttcgccgtgctgggcatggcgctggccgcctacctgagcttcgcccgcggctttctcggctacctcaacgagcaggccatcgagcgcctggagcgcatcctgccgaacttccagcgcgcctacaccgagcacggcgactggcgcttcctcgacggcaacccggacgaatggttcctcctcacccgtcccgacgaccgccccaagggcgccggcagcgacctgccgccgccgccgatctccgatctgaccggcgccttcctgcgcctgagcctgctggatgccgggcaaggctacgtggccggctacagccagtacgccagccagccggtgctgcgcgccatccgggtggacggcgagacggtcggctggctggccatgacccccttcgagacagtcagcgccgccggcgaccagcgtttccaggccgggcagatacgctcgagcatcctcatcgcgctgatctgcctgctggtctcggcggtgatcggctggtggatcgcccgttcgctgctgcgcccgatccgccgggtggcccgcgccacccggcaactggccgccggcgactattcgatcgaactaccggtggcctccaacgacgaggccggccagttggccggcgacttcaaccgcatggcccgcaccctggccgccaacgaacgcctgcgtcgcgcgttcatggccgacatttcccacgagctgcgcaccccgctggcggtgatgcgcggcgagctggaagccatggaggacggcatccggccgaccgacccggcggcgctgcgctcgctacaggccgaagtcgccgcgctgagcaagctggtggacgacctcttcgaactgtccctggccgacgtcggcggccccacctatcgccacgagccgctggacctgcgcctgctgctggaaagcctggccgacagctaccgaacccgcttcaccgaacggcggctggccctggaactgcaactgccggacgatccgttgtcggtggtgggagacgagatgcgcctgaaccagttgttccacaatctcctggaaaacagcctgcgctacaccgagcccggcggccgggcccggctgggcgggcagcggcaaggcgacgcgatcctgatccactgcgaggactccgcgcccggcgtgccggaagcccagcgggcgcggctgttcgagcgcttctaccgggtcgagggctcgcgcaaccgcgccagcggcggcgccggcctgggattggcgatctgccgcggcatcgccgaggcccacggcggcagcctctcggccagagcctcgacgctcggcggcctgtggctgaccgtgcacctgccgatccgcgcggagcaacggccatga

SEQ ID NO: 77457 - protein, 465 aa, Azotobacter vinelandii
MKISLSTKVFLAVQALCTFAVLGMALAAYLSFARGFLGYLNEQAIERLERILPNFQRAYTEHGDWRFLDGNPDEWFLLTRPDDRPKGAGSDLPPPPISDLTGAFLRLSLLDAGQGYVAGYSQYASQPVLRAIRVDGETVGWLAMTPFETVSAAGDQRFQAGQIRSSILIALICLLVSAVIGWWIARSLLRPIRRVARATRQLAAGDYSIELPVASNDEAGQLAGDFNRMARTLAANERLRRAFMADISHELRTPLAVMRGELEAMEDGIRPTDPAALRSLQAEVAALSKLVDDLFELSLADVGGPTYRHEPLDLRLLLESLADSYRTRFTERRLALELQLPDDPLSVVGDEMRLNQLFHNLLENSLRYTEPGGRARLGGQRQGDAILIHCEDSAPGVPEAQRARLFERFYRVEGSRNRASGGAGLGLAICRGIAEAHGGSLSARASTLGGLWLTVHLPIRAEQRP

SEQ ID NO: 77458 - DNA, 1395 bp, Desulfitobacterium hafniense DCB-2
  CDS (1)..(1395)
atgaaagggatccgcggcagattgacggctaattttatgatcgtgattctggtttcggtagccattttggaagtgctgctgatttatactgtccagcagaattattacggcagcctgaggggcaacctgaccaatcaggtgaaaatcagtgctgatatgtattccaaatactattccgatacctctttggaagataacatcctctataatgtggatgccttttggaatcaaagcaacgctcaagtggaaattgtcgatagagacgggaagatcgtcatggactctctgggagcgatttcggaacaagaggggcccacagaggatattcaggatgccctcaatgatcagatgggggaatggataggaaaattaaatggccagaaggtcatggccgtagcctatcccttaaaatccgaaggggagattgtcggagccctgcggtttattgcttctacacatgaaatcgaccaggatattcaggacacggccaaaatttttatcgctatcggtctttttgtggccatggtggtgggtttcctcagcattttcttggccaataccattcttattcccttgaaggaagtgacagccattgccgaaagcatggctgccggcaattttcaaatcaagagcaggaaaaagcgggatgacgagatcggcaagcttgccgataccttgaattatatggctgaagaaataaccaaaaaagaaaagctgaaaaatgattttatctcttcggtctcccatgaattgcgcactcccctgacctccattatgggctgggccataaccctgcaaagcgaaaaattccagcagaaagaaatgctcaacgacggtcttggcatcattgccaaagaatccgaacggctcacccggatggtggaagagctcctggacttttccaaatttgtttccggcaggattaagctgagttatgaagaggtcaatatggccgaactgatggagcatatccgcaaacaactgaccccccgggccaccagggaaactatccagtttacagtggattatccggaaaacctccccgacctgttgacagatcctaatcggttaaaacaagtcttgatcaatattctggataacgccttgaattttacggctgccgaggggagtgtccgttttcaggccgaggtaggggagaaggactacacctttacgatctccgacaacggatgcggcattgctgccggtgaactgcccatggtgaaagaaaagttttacaaaggcaagagctctcgttcccgcaacgggattggtttatccatctgtgaagagatcattaccctgatgaaaggccggctggaaatccacagtgaagtcaatgtcgggacaacggtggtcattactctgcccagagaggtgtgtgcccatggttaa

SEQ ID NO: 77459 - protein, 464 aa, Desulfitobacterium hafniense DCB-2
MKGIRGRLTANFMIVILVSVAILEVLLIYTVQQNYYGSLRGNLTNQVKISADMYSKYYSDTSLEDNILYNVDAFWNQSNAQVEIVDRDGKIVMDSLGAISEQEGPTEDIQDALNDQMGEWIGKLNGQKVMAVAYPLKSEGEIVGALRFIASTHEIDQDIQDTAKIFIAIGLFVAMVVGFLSIFLANTILIPLKEVTAIAESMAAGNFQIKSRKKRDDEIGKLADTLNYMAEEITKKEKLKNDFISSVSHELRTPLTSIMGWAITLQSEKFQQKEMLNDGLGIIAKESERLTRMVEELLDFSKFVSGRIKLSYEEVNMAELMEHIRKQLTPRATRETIQFTVDYPENLPDLLTDPNRLKQVLINILDNALNFTAAEGSVRFQAEVGEKDYTFTISDNGCGIAAGELPMVKEKFYKGKSSRSRNGIGLSICEEIITLMKGRLEIHSEVNVGTTVVITLPREVCAHG

SEQ ID NO: 77460 - DNA, 1368 bp, Dechloromonas aromatica RCB
  CDS (1)..(1368)
atgccgggctggcggtattcgatcacgctgcgcctgtcgctggccttcgcgctgctggcgacgctcgtgttcgcagcgctcggtctgtatttcagccgcgctgccgatgaccacatggccgaactggatgcccacgatctgttcggcaagctggcgctgattggccatgttggcgcgcaagaggaaacggcggaagccttcgcagcccggctcggcgatgccctgattggccagaatggggtaattgcgacagtcgatgcccaaaaaagggctgttttcagatggccgtcagccgaacttgccgatccgctggcggcagccggtgtggccttgagccagaggccgatccggcaaaccctgggcggcgccgagtacagggtcattgccgccgatatggaaaccccttggggtggcacggcacacgtcgtggtcggccgcgacattcgccaccacaccgattttctcgatcaactgcagcaggatttctggctggccatcgtggctgcggccttgctgacggccgttgttggcgccctgatcgttcgtcgtggcatgcacccggtgcgcgatattgccagtgctgcaggccgcatctccgccgggcaactggccgagcggattcctgaacaggatgtgccgacggaattagctgaactggtccattccttcaacgccatgctgggccgtctggaggagtcattcaagcgcttgtctgatttttcggccgatctcgcccatgagttgcggacgccgattcacagcttgcgcatgcagaccgaggtatcgctaggcaaggcgcgtagcgtcaatgaataccatgatctgctggcgtcgaatctggaagaatacgaacgcctgtcgcggatgattgccgacatgctgttcctggccaaagccgagcatggcctgcttgtgccgcagaaggcggcggtgccattgctcgatctgtgtcgccggctcgttgattactatggcattctggccgacgatattgccatcgaagtgcttggcgaaaacctggtggttcaaggcgacagcctgatgctggagcgggccatcggcaatttgctgagcaatgccatcctccatacaccggcgggcggcatggtcggattgtcggtgcgccagcgagacggcgaggtggtgctatcgattgctaatacggggcagccgatcccggctgaggccttgcatggcatcttcgaccgcttcgtcaggctcaatcccggtggtgaggggagtggccttgggctggcgattgtcaaatcgatcgtgctggcccacggtggcgttgtttcggcgacttctggcgactcgatgaccgagttcgtcattgagtttctcgataagggcgatcagccggcctga

SEQ ID NO: 77461 - protein, 455 aa, Dechloromonas aromatica RCB
MPGWRYSITLRLSLAFALLATLVFAALGLYFSRAADDHMAELDAHDLFGKLALIGHVGAQEETAEAFAARLGDALIGQNGVIATVDAQKRAVFRWPSAELADPLAAAGVALSQRPIRQTLGGAEYRVIAADMETPWGGTAHVVVGRDIRHHTDFLDQLQQDFWLAIVAAALLTAVVGALIVRRGMHPVRDIASAAGRISAGQLAERIPEQDVPTELAELVHSFNAMLGRLEESFKRLSDFSADLAHELRTPIHSLRMQTEVSLGKARSVNEYHDLLASNLEEYERLSRMIADMLFLAKAEHGLLVPQKAAVPLLDLCRRLVDYYGILADDIAIEVLGENLVVQGDSLMLERAIGNLLSNAILHTPAGGMVGLSVRQRDGEVVLSIANTGQPIPAEALHGIFDRFVRLNPGGEGSGLGLAIVKSIVLAHGGVVSATSGDSMTEFVIEFLDKGDQPA

SEQ ID NO: 77462 - DNA, 1455 bp, Kineococcus radiotolerans SRS30216
  CDS (1)..(1455)
atgcgggtccggtcgacggtggcggcgacggccctgctggcggtgctggtggcggccggggcggtgacggggctgctggtgctgcgctcggcgctctacggcggggctgcggagaccggctccgtgcaggcgcggctggtgcggctgtcggtgaccgaggaggtcctggcgcagggcccggcgggcgcggaggggacgggggacccgctcccggcgcgggaggcgctggacgccgcggtgggggcgcgggtggaccggggctcgcacgtccaggtgctcgacgcctcgggggcggtggtggcgcgcagcgcgcggctggcggggctggcggcgctgtccccggcgcggccgccctcggcgggccaggtccaggaggtggtggccctgccgcagctgggcggccggtcccggtgggtggtgacggtggtgggcgcggaggtcggggaccggcccttctacgtggtggtggccgagagcaccgaggacgccgaccgggtgctgctggtggcggccgggttgctggccgtgggctcccccctgctgctggcggcgatcgcggtggcgacgtggacgttcgtggggcgctcgctgcggccggtggaggcgatccggcgcacggtggagggcatcaccgcgcggggcctggacgggcgggtgcccgtccccgtcgccgaggacgaggtgagccgcctggcgcggacgatcaacgaggtgctggcccgcctggagctggcccagcgggggcagcggcggttcgtggccgacgccagccacgagctgcgcagcccggtggcgacgttgcgcgcggcggcggaggtgtgggcgggggcgggtgtcccggcgccgttcacggccctggtgcaggcggagagcgcgcggctggaggcgctggtctcggacctgctggcgctggcccgcgccgacgaggggcgcgcggtgcggcagtggcaggaggtggacctcgacgaggtggtcgagtccgaggcggcgcggctgcgggcggtcgccgggtgcgccgtggtggtcaccaccacccccgcgcgggtgcgcggcgacgcggtggcgctggcgcgggcggtgcgcaacctcagcgacaacgcggtccgccacgccgactccgcggtccgcctggagctgtcggtgcgggacggggaggcgctgctgcgggtctgcgacgacggtcccggcatcccggtcggtgagcgcgagcgggtcttcgagcgcttcgtgcgcctggacgagagccgtcagcgcgggtccggggggacgggtctgggcctgcccatcgtgcgcgagacggtggccgcgcacgggggcacggtgcaggtggaggactcccccggccgcggcgcggtcctggccctgcgggtgccgctggccccgccggacgccccgccggacgccccacccgcggaccgggccgggggtcagccgccgtcggcggcgagccggtag

SEQ ID NO: 77463 - protein, 484 aa, Kineococcus radiotolerans SRS30216
MRVRSTVAATALLAVLVAAGAVTGLLVLRSALYGGAAETGSVQARLVRLSVTEEVLAQGPAGAEGTGDPLPAREALDAAVGARVDRGSHVQVLDASGAVVARSARLAGLAALSPARPPSAGQVQEVVALPQLGGRSRWVVTVVGAEVGDRPFYVVVAESTEDADRVLLVAAGLLAVGSPLLLAAIAVATWTFVGRSLRPVEAIRRTVEGITARGLDGRVPVPVAEDEVSRLARTINEVLARLELAQRGQRRFVADASHELRSPVATLRAAAEVWAGAGVPAPFTALVQAESARLEALVSDLLALARADEGRAVRQWQEVDLDEVVESEAARLRAVAGCAVVVTTTPARVRGDAVALARAVRNLSDNAVRHADSAVRLELSVRDGEALLRVCDDGPGIPVGERERVFERFVRLDESRQRGSGGTGLGLPIVRETVAAHGGTVQVEDSPGRGAVLALRVPLAPPDAPPDAPPADRAGGQPPSAASR

SEQ ID NO: 77464 - DNA, 1425 bp, Chloroflexus aurantiacus
  CDS (1)..(1425)
ttgcggcaacgactggcgttgttgtacagcggcctgctggccctgcttttatgtctacttggcttcggcttctacctcgatatgcgccagtttctctttgagagcaccggtctgcggattcgagcgcaagccaaaccagtgatcgaacaatacctgtttgagcaccctgacccggctacacagttgccgttaattgccgaacagttgagccgtgatctgacctcgcgcgataccaccgctctgatcttcgatcaggcaggggcgttgttagccagtggtcgccgattaccagaagagccgccggctcaaccggtcgaagcttcgtatgtcaatatggcactggccggccacaataacgtgaacgttattcaggatgatggcgatcagcggatgctgagcctgctgatcccactacgaccggcaccaggagcaccccaagtgtttggcgtggtgcaaatgagcactcccttaagcccaattgagacgactctgcaacgccaaagcatcattattgtgtcaagtatcgtcatcgttctcctcgcaggcagcctcatcggctactggttaaccagctcgacgctgcggccattaagcgacttaatcgttgcctgtcagaagattgcccagggcaatctccgccagcgcgtaccggtgatttcgccgcacgacgagattggcaagctgacgcaggcttttgacgagatggttgagcgcctggaacaaaattttcaggctcaacgacgctttatcgccgacgctgctcacgaaatgcgcacaccgctaaccgcattacgcagcgggctagaggtgctgttacgcggtgcccaggatgacccgcaaacggccttccgcctgatccaaagtatgcatcgtgacgttgtccgcctgtgcaatgtcagtgaacagttactcgacaaagcccgctacgagtcgggtcgttcattgaacatacaaccggtgacaatgaccgattttctcgtcgaatttaccgcccaggcccggctcttagccggcgaacgacgggtaatcctcgaaagcgggccacccattcaggcctggatcgatggcgacagcgtcaaacaagcgctttttcacctggttgataatgcgattcaacatacggcggcgaacggtaccattcgcttaggctggaaggttgatcaacaacggttgtgctgttgggtgagtgataatggcgaaggaattgccgaggccgatctgccccatgtctttaccccattttatcgaggtgaccgctcccgttcgcgccgaaccggtggtactggcctgggactcacgctggtgcagagcgttgcccacgctcacggtggtgaggttgcgatttcgagccggcaaggcgaggggacaacagtgacgatcattctgcctctcacaccaccacagacaaatcacagtagaacttag

SEQ ID NO: 77465 - protein, 474 aa, Chloroflexus aurantiacus
MRQRLALLYSGLLALLLCLLGFGFYLDMRQFLFESTGLRIRAQAKPVIEQYLFEHPDPATQLPLIAEQLSRDLTSRDTTALIFDQAGALLASGRRLPEEPPAQPVEASYVNMALAGHNNVNVIQDDGDQRMLSLLIPLRPAPGAPQVFGVVQMSTPLSPIETTLQRQSIIIVSSIVIVLLAGSLIGYWLTSSTLRPLSDLIVACQKIAQGNLRQRVPVISPHDEIGKLTQAFDEMVERLEQNFQAQRRFIADAAHEMRTPLTALRSGLEVLLRGAQDDPQTAFRLIQSMHRDVVRLCNVSEQLLDKARYESGRSLNIQPVTMTDFLVEFTAQARLLAGERRVILESGPPIQAWIDGDSVKQALFHLVDNAIQHTAANGTIRLGWKVDQQRLCCWVSDNGEGIAEADLPHVFTPFYRGDRSRSRRTGGTGLGLTLVQSVAHAHGGEVAISSRQGEGTTVTIILPLTPPQTNHSRT

SEQ ID NO: 77466 - DNA, 1395 bp, Lactococcus lactis
  CDS (1)..(1395): transl_table=11
atggcaaaaataaaaagactcaaaaaaaagatttctgttaaaattggaggctctttttttacagtaatagtcgccattgagttaggtctcttcatcagtctctatcttctcattgttaatacatgggtacgagaagaagtaaattcggttgttgcacaaggaaataatcatgcattagttctatcaggagattttcgtacccaaacgatagaacatgtagttttgatggaagaaggtagtagtcaaacagctattgtaatccaaaattcttctggtaaaacattaagatcatctcaaacaataaatagtcaaatgaagaaacatatttctgcgcttcaaaatgaaaaaaagaacaagaaagaatctctccactttcattggttaggagataaatacattgtctcaaaatcgcgcattcaaagtaatggaaagatcgtaggatctgtttatatgtttttatcaacgagaccgattcagaagatggttttcaatttcacaggaatttttgcagttttagcggtgattactttaattgtaacagcattttccatcttctatattactcgtacagtgacacgacctcttctaaaaattaaactagggacagataaaattgcacagggagatctatcaattcaattaaatgtaaacacagaggatgagttaggagaactagcaaaatcgattgaagatttagcagaaaaacttgattttatgaagcgagagcgtaatgagtttctttcctctgtggcccatgaactgagaacaccattaacctttattaaaggttatgcggatattgctaatcgctctacaacaagtctagaggataaaactcaatatctacgcatcatccgagaagaaagccgacatcttacgcaactcatggaagatttaatgaatcttgcacaattggaggaaaatggatttaaagttgaaaaacatcaggttttaattcaagagcttattaatgaggtggtcagtaaagtttcaggagtatttagtgaaaagagaattaactttttaatctctggagaaggaaacttttatgcaaatattgatttcatgcgtatagaacaagtattggtcaatcttttgatgaatgcttacaaatattctgctgatgaatcagatattaaacttgcttttattccagaaaaagaaaattttaaaatcgttatttcggataaaggagagggaattcctgagcaagatcttccatacatttttgaacgattttatcgtgtagataagtcgagaactcggacaactggcggagttggattaggtttagcaattgttcaggacattgtcaagaaacataatggaaaaataattgtagagagtatccaaaatcaagggactacattcattattgaactcccatatagttaa

SEQ ID NO: 77467 - protein, 464 aa, Lactococcus lactis
MAKIKRLKKKISVKIGGSFFTVIVAIELGLFISLYLLIVNTWVREEVNSVVAQGNNHALVLSGDFRTQTIEHVVLMEEGSSQTAIVIQNSSGKTLRSSQTINSQMKKHISALQNEKKNKKESLHFHWLGDKYIVSKSRIQSNGKIVGSVYMFLSTRPIQKMVFNFTGIFAVLAVITLIVTAFSIFYITRTVTRPLLKIKLGTDKIAQGDLSIQLNVNTEDELGELAKSIEDLAEKLDFMKRERNEFLSSVAHELRTPLTFIKGYADIANRSTTSLEDKTQYLRIIREESRHLTQLMEDLMNLAQLEENGFKVEKHQVLIQELINEVVSKVSGVFSEKRINFLISGEGNFYANIDFMRIEQVLVNLLMNAYKYSADESDIKLAFIPEKENFKIVISDKGEGIPEQDLPYIFERFYRVDKSRTRTTGGVGLGLAIVQDIVKKHNGKIIVESIQNQGTTFIIELPYS

SEQ ID NO: 77468 - DNA, 1455 bp, Xanthomonas campestris
  CDS (1)..(1455): transl_table=11
atgtgcgaccggctcagctggcgcttgctttcagcgccgcatgcgccgctaatggcctccgcgatggtgaagattcgactcaaattcggcctgaccgcgaagaccttcctcgcgatcttcaccgcctgcctgctggtgctggcagtgaacggcattgccagtcgcgttgcgttccagaccggcttcctggactacctcaacgaccagggcgacctgcgcatgcagcgcctgatgccccacctgcagcgcgagtacagcgcgcacggcggctgggagcatctgcgcggtgacagtgaccgctgggcgcggctgctgcgtccggatctggcccatggacacgagggaccggtgccgccgctgtccgaccagaccggcgtaccgtcgcggctgggcctgttcgatgcgcgccaccggttcgtggccggcaaccccgatgccaccagtgatgacgagccgcatcctgtgcagctggacgggcacaccgtcggctggctgggcatggtgccgttccagacggtcatcgccaccaacgatctgaacttctacaacacccaggtgcgcgcctggtgggtgatcggcgtcgccctgctgctggtgacggtgctgctggcctggctggtgtcgcgtgcgctgcgccagcgcctggccaagctggccgcggccacgcaccggctcgccgccggtgactacgccacacgcatcgaacgcaccagcgacgacgaactggacgcgctggtcaacgacttcaaccggatggcacaggcgctggacgataccgagcgcaaccgccgcgcgttcatcgccgacatctcgcacgagctgcgcacgccgctggcggtggtgcgcgccgagctggaagcgatcgaggacggcatccgtccattggaccgcgccaacctcggtggcctgcaaagcgagatccgccagctgggcaagctggtcgacgacctgcacgatctgtcgatgacccagtccggcggcctcgcctaccgcttcgcgccgctggacctggtggcgctgctgcgcagcgaactcaatggcatgcgcgtgcgcttctccgcggcggggctggccctggaagaagcgctgcccgccacgccactgcaggtatccggcgacgaacggcgcctgcagcaggtcctggccaacctgttggaaaatgcgctgcgctatacccataccggcggccgcgtacgtgtgcaggcggctcgcgtacctgccggcgtgcagctgatcgtggaagacaccgcaccgggcgtgccggccgacaagtgcgcgctgctgttcgagcgcttctaccgggtggagagttcgcgcaaccgtgccagcggcggcggcgggttgggcctggccatcagccacaacatcatcctcgcccaccacggccacatccacgccgagccctcaccactgggcgggctgcgcgtggtcatcaccctaccggagcctgcatga

SEQ ID NO: 77469 - protein, 484 aa, Xanthomonas campestris
MCDRLSWRLLSAPHAPLMASAMVKIRLKFGLTAKTFLAIFTACLLVLAVNGIASRVAFQTGFLDYLNDQGDLRMQRLMPHLQREYSAHGGWEHLRGDSDRWARLLRPDLAHGHEGPVPPLSDQTGVPSRLGLFDARHRFVAGNPDATSDDEPHPVQLDGHTVGWLGMVPFQTVIATNDLNFYNTQVRAWWVIGVALLLVTVLLAWLVSRALRQRLAKLAAATHRLAAGDYATRIERTSDDELDALVNDFNRMAQALDDTERNRRAFIADISHELRTPLAVVRAELEAIEDGIRPLDRANLGGLQSEIRQLGKLVDDLHDLSMTQSGGLAYRFAPLDLVALLRSELNGMRVRFSAAGLALEEALPATPLQVSGDERRLQQVLANLLENALRYTHTGGRVRVQAARVPAGVQLIVEDTAPGVPADKCALLFERFYRVESSRNRASGGGGLGLAISHNIILAHHGHIHAEPSPLGGLRVVITLPEPA

SEQ ID NO: 77470 - DNA, 1395 bp, Corynebacterium equii
  CDS (1)..(1395): transl_table=11
atgagtcgtctgcgcgcattgccgttgcgggtcaccctggtcgtggcgctgctgctgctggcggcggccgggctgctggcgtccggtgtcgccgtgacgtcggcgatgcagtcctcgctgatcgaacgcaccgaccggcaactgttcgacgccgcgcacgggtgggcgaagccgcgtgatccgtggcctctgccgccggtgtccgcgccggggccgagccggccaccgagtgcgttctatgtccggaccaccgaacccgacggcaccgtgcggctcgaggtcaacgacgagagcaccaatgccacaccggaaatcagcgacgatgcaggtccggtgacggtgggatcggtgggtggcgaggacatccggtggcgcgagctgacggtggcgacgccttcgggtacgacgaccgtggcggtgaagctcaccgacatcgacgcgaccgtcgagcgcctggtggttctgcagatcgggatcggcgcggtggtgctcgtcgcgctcgggttcgccacgtacttcgtggtgcggcgcagcctgcgtccgctgcgggaggtggaagagatcgccgccgacatcgcggccggagatctgcatcgccgggttcccgagtgggatcagcgcaccgaggtgggacgtctgtcgtccgcgctcaacgggatgctcgcgcagatccagacggcgttcgccgcgaccgcggcatcggaggagtcggcgcgccggtccgaggagcgcatgcgccgcttcgtcgccgatgccagtcacgaactgcggactccgctcgccaccatccgcggattcgcggagctgtaccggcagggagcggcgccggaccccgagatggtgatgagccggatcgaggatcaagcgcagcggatgggactgctcgtcgaggacctgctgctgctggcgcgtatggatgcgcagcggccgttcgaacggcaccctgtggatctgctcgcggtcgcggcggacgcggtgcacgatgcgcgggcccgctccccgcagcggcgaatcatgttggaagtactgcccggttcggcgcccgccgaggtgctgggcgacgacgcccggctgcggcaggtggtcggcaacctggtggggaacgccctcgatcacaccccggcgggcgccgatgtcacggtgcgggtgggcaccgacggcgcggacgcggtcgtcgaggtggccgacacggggcccgggctggcggagggcgacgcggcccgggtgttcgagcggttctaccgcgccgacgcgtcgcgcacgcggaccagcggcggcagcggactcggactgtcgatcgtcgcggcgatcgtcgccgcacacggcgggacggtcgacgtcgacagcgcacccgggaacggggcgaccttccgggtgcgtctgccgagagggtga

SEQ ID NO: 77471 - protein, 464 aa, Corynebacterium equii
MSRLRALPLRVTLVVALLLLAAAGLLASGVAVTSAMQSSLIERTDRQLFDAAHGWAKPRDPWPLPPVSAPGPSRPPSAFYVRTTEPDGTVRLEVNDESTNATPEISDDAGPVTVGSVGGEDIRWRELTVATPSGTTTVAVKLTDIDATVERLVVLQIGIGAVVLVALGFATYFVVRRSLRPLREVEEIAADIAAGDLHRRVPEWDQRTEVGRLSSALNGMLAQIQTAFAATAASEESARRSEERMRRFVADASHELRTPLATIRGFAELYRQGAAPDPEMVMSRIEDQAQRMGLLVEDLLLLARMDAQRPFERHPVDLLAVAADAVHDARARSPQRRIMLEVLPGSAPAEVLGDDARLRQVVGNLVGNALDHTPAGADVTVRVGTDGADAVVEVADTGPGLAEGDAARVFERFYRADASRTRTSGGSGLGLSIVAAIVAAHGGTVDVDSAPGNGATFRVRLPRG

SEQ ID NO: 77472 - DNA, 1074 bp, Acinetobacter baumannii
  CDS (1)..(1074): transl_table=11
atgaaaagtaagttaggaattagtaagcaactttttattgccttaactattgtaaatttaagcgttacgctattttctgtagtactgggttatgtcatttataactatgcgattgaaaaaggctggattagtttaagctcatttcaacaagaagattggaccagttttcattttgtagactggatttggttagccactgttatcttttgcggctgtattatttcattagtgattggcatgcgcctcgcaaagcgttttattgtgccaattaacttcttagccgaagcagcaaaaaaaattagtcacggcgacctctctgctagagcttacgataatagaattcactccgccgaaatgtcggagcttttatataattttaatgatatggctcaaaagctagaggtttctgttaaaaatgcgcaggtttggaatgcagccatcgcacatgagttaagaacgcctataacgatattacaaggtcgtttacaaggcatcatcgacggtgtttttaaacctgatgaagtcctatttaaaagccttttaaatcaagttgaagttttatctcacttagtcgaagacttacggactttaagcttagtagagaaccagcaactccggttaaattatgaattgtttgactttaaggcggtagttgaaaaagttcttaaagcatttgaagatcgtttggatcaagctaagctagtaccagaacttgacctaacttccactcctgtatattgcgaccgccgtcgtattgagcaagttttaattgctttaattgataatgctatacgctattcacatgcaggcaaacttaaaatttcctcggaagtggtatcacaaaactggatattaaaaattgaggatgaaggccccggcattgcaaccgagttccaagacgatttatttaagcctttctttagattagaagaatcaaggaataaagaatttggcggcacaggtttaggtcttgctgttgtacatgcaattattgtggcactgaaaggcactattcaatatagcaatcaaggctcgaaaagtattttcaccataaaaatttctatgaataactaa

SEQ ID NO: 77473 - protein, 357 aa, Acinetobacter baumannii
MKSKLGISKQLFIALTIVNLSVTLFSVVLGYVIYNYAIEKGWISLSSFQQEDWTSFHFVDWIWLATVIFCGCIISLVIGMRLAKRFIVPINFLAEAAKKISHGDLSARAYDNRIHSAEMSELLYNFNDMAQKLEVSVKNAQVWNAAIAHELRTPITILQGRLQGIIDGVFKPDEVLFKSLLNQVEVLSHLVEDLRTLSLVENQQLRLNYELFDFKAVVEKVLKAFEDRLDQAKLVPELDLTSTPVYCDRRRIEQVLIALIDNAIRYSHAGKLKISSEVVSQNWILKIEDEGPGIATEFQDDLFKPFFRLEESRNKEFGGTGLGLAVVHAIIVALKGTIQYSNQGSKSIFTIKISMNN

SEQ ID NO: 77474 - DNA, 1431 bp, Amycolatopsis mediterranei
  CDS (1)..(1431): transl_table=11
gtgaggaccggccggccgcggccgcggacgagccggctccggccgcggggcctgcgcgcccggctgctcgtcgcgttcgtgctggtgaccgtgctcggcgccgccgcggcggcctggtcgagcgccggctcggcgagcaccgcgctggtcacctcgacgcaggagcggatcaccgagggcgtcgccggccggctcggcgcgatcaccccgcagctgacctacccgccggaccaggacgcgctcgaccggctgcgcacggccgccgcggggaacaccgtggtgacctaccgggacctgcggtcctcggcaggcaccgagctggtccccgacacgctgcgcgccgccgtgcgcggccggaaccggctcgtcacgcggcggatcacagccgggggccggccgtggctggtggtcggcacgcccatcacgatcaccgcgccggacggggcccgcaccccgtccggcatcgaggtgtactccgcgtacgacctgaccgacgtcgacgggcagatcgaccgcctcacccggtccgcgaccctcaccgccgcactcgcgctgccgctggcggtgctgctggcgctgctggccgcgggcagcgtgctgcgcccggtgcgcgagctccgcgacacggcccgccggctggccggcggcgacctcgacgcccggtcgccgccccagggcgccgacgagctggccgaactgaccgtcaccgtcaacgaaatggccgagtcggtgcagacgtcgatgctggccatggaacagatgcaggcggacgcccggcggttcgccgccgacgtctcgcacgagctgcgcaccccgctgagcacgctgacggccgtcgtggaggtcctggcgaccacggcggacgggatggaggccgacgcccgggaatccgcgcagctggcgatcgtcgagacgcaccggctggtccggctcgtcgaggacctgatggaggtggcccgcttggacgccggcaccgcgcagctgcgggtggaggaggtcgacgtggccggtgccgtgcgggactgccttcgcgcccgcggctgggcggaccgggtcgaggtggtggcgccggatggcctcttgctccggctggatcggcgccggctggacgtcatcgtggccaacctggtcggcaacgcgctgcggcacggggagccgccggtccgggtggtcgtttcggagtcccgcgaggacgtgcggatcgaagtcaccgaccgcgggccggggctgcccgcgcacgtggtgccgcacgtgttcgaccgcttctacaaggccgacgcggcgcgcacccgcaccccgggcagcgggctcgggctggcgatcgcgctggagaacgcgcgcttgcacggcggcgacctcaccgcgggcaacgccgacggcggcggcgcgcggttcgtgctgtccctgccgcggaaccgggaggactcgtga

SEQ ID NO: 77475 - protein, 476 aa, Amycolatopsis mediterranei
MRTGRPRPRTSRLRPRGLRARLLVAFVLVTVLGAAAAAWSSAGSASTALVTSTQERITEGVAGRLGAITPQLTYPPDQDALDRLRTAAAGNTVVTYRDLRSSAGTELVPDTLRAAVRGRNRLVTRRITAGGRPWLVVGTPITITAPDGARTPSGIEVYSAYDLTDVDGQIDRLTRSATLTAALALPLAVLLALLAAGSVLRPVRELRDTARRLAGGDLDARSPPQGADELAELTVTVNEMAESVQTSMLAMEQMQADARRFAADVSHELRTPLSTLTAVVEVLATTADGMEADARESAQLAIVETHRLVRLVEDLMEVARLDAGTAQLRVEEVDVAGAVRDCLRARGWADRVEVVAPDGLLLRLDRRRLDVIVANLVGNALRHGEPPVRVVVSESREDVRIEVTDRGPGLPAHVVPHVFDRFYKADAARTRTPGSGLGLAIALENARLHGGDLTAGNADGGGARFVLSLPRNREDS

SEQ ID NO: 77476 - DNA, 1461 bp, Myxococcus xanthus
  CDS (1)..(1461): transl_table=11
atgagcctgcgctcctggctcgccgccaccatgggggtgctgacgttggtgacgttggcggccgccaccctgctcatcgtcctgacgagcgtgctcgaccgttcggccgcgaccctgggggtcgccttcgggggcatccgggtgtccgaggagctggaggtgggtctgctggcgcacgaccggatggtccgggaaggccccgtcaaggtgccccgtggcccgggcgggctgtcgcggttcgagctggaggcctcgctgtaccggcagatgggtgagctgcggcgcatcgcctcgacggcggcggagcgtcagcggctcgacgctgtccgcgaggacgtggacgtctacttctccgcccagtgggacccggtgcgtgcggagcaggaggcgggcccggcgctggacgccgcgttgagtggcttggaacaggtcagctccatcaacgtggagcgcgcgcgcgtggcccgctcggaagcggagcggtggaacgacatggcggactccgtgggcgtggtgctctgcggcttgctgctcttgggcgtgctcgtcgtgagcgtgctgctgcggcgcgtggcgctccagccgctgcgggacatcagccagtccatgcgccgcttcggcgcgggctgcaggcgcgcccgggccccggaggccgggcccaccgagctgcgggacatggctcgcacgttcaacgagatggccaacagcctggcccaccagcaggagcagcagctcgcgttcctcgcgggcgtggcgcacgagctgcgcaatccgctgtccgccctcaagttgtccacagccctgtcggaccgcagccgcgcccagctcacgcccgagcgcatggaccgcaccctgtccctggtagggcggcaggtggagcggctggaccgcatggtgggcgacctgctcgatgccacccgcatcgaagctggcaggttggagttgcgcccggaggtgcgggacgcgcgtgagctggcccgcgaggtggtggagctctaccgctccggcgacaccggccatggcctccgtctcagcctgccggacgtgtccgtgccggttcgcgcggacccggcccggctggagcaggtgctccacaacctcatcagcaacgcgctgaagtactcgccggcgggcagcaccgtggaggtgtccgtgcgccgcgaaaaggacacggctgtcctttgcgtgacggaccagggcatcggcatttccgaggaggagatgcgcctgctcttcgcgcccttccagcgcgccggcaacgcccgtcagcgcgccccgggcgtgggcctgggcctgtcggtggcccggcgcatcgtcgaggggcatgggggcagcatcgacgtgacgagccagcccggccacggctccgtcttctgcgtgcggctggccgtggccaccgaggccgttcggcatgccgaagaagacgcggggctgacgtccctcgaggacaccctgcactga

SEQ ID NO: 77477 - protein, 486 aa, Myxococcus xanthus
MSLRSWLAATMGVLTLVTLAAATLLIVLTSVLDRSAATLGVAFGGIRVSEELEVGLLAHDRMVREGPVKVPRGPGGLSRFELEASLYRQMGELRRIASTAAERQRLDAVREDVDVYFSAQWDPVRAEQEAGPALDAALSGLEQVSSINVERARVARSEAERWNDMADSVGVVLCGLLLLGVLVVSVLLRRVALQPLRDISQSMRRFGAGCRRARAPEAGPTELRDMARTFNEMANSLAHQQEQQLAFLAGVAHELRNPLSALKLSTALSDRSRAQLTPERMDRTLSLVGRQVERLDRMVGDLLDATRIEAGRLELRPEVRDARELAREVVELYRSGDTGHGLRLSLPDVSVPVRADPARLEQVLHNLISNALKYSPAGSTVEVSVRREKDTAVLCVTDQGIGISEEEMRLLFAPFQRAGNARQRAPGVGLGLSVARRIVEGHGGSIDVTSQPGHGSVFCVRLAVATEAVRHAEEDAGLTSLEDTLH

SEQ ID NO: 77478 - DNA, 1209 bp, Listeria monocytogenes
  CDS (1)..(1209): transl_table=11
atgttaaaaaaattcattatacaatcaagaatgccaacgacgaaaccatttattccaacacagatgaatcagcctttacctaaggatttctctatttctgcggatgataagaaaaagcttgaaagtggtgaaacggttagtaagaaaatagataatcgctttaacaaagaaatgacaattgtgtacgtcccaataatgaatggcgataaatttgtcggttctatcgtgctgaattcacccattagcggtacggagcaagtaattggcacgattaaccgctatatgttctacactattttactttctataacggtagcacttattcttagcgcaatcttgtccaaactacaagtaaatcgaatcaacaaactacgagcagcgacaaaagacgttattcaaggcaattaccacgctcgcttgaaggaaaataattttgatgaaattggtgcactcgccattgatttcaataaaatgacacaaacccttgaacatctcaagaagaaattgaacgacaagagaaacggagacgcccagtttattgctgatgtttcccatgaaatgcgtaccccgctcacaacgattagtggcctcacggaaggtttagtaaatgatattatcccaaaaagtgaaaccgatcgttgcatagcactcattgatacagaagctagacgtttaacgaaactagtcaatgaaaatttagattatgaaaaaatacgcagtaacaaaatcaagcttcaaaaaacacgttttaacggtaaggaattccttgagttaatcaaagaacaagtcgattatgtagcaagcgaaaaaggtaacactattactgttgctattgataaagacatggcgatttacgcagattacgatcgtttaacacaagtatttatcaatatcgtcaaaaacagtgtccaatttactgaaaatggtcagattactctaactggcacacaagattataaagaatctgttttaacgataacagatactgggattggtatgaatactgaggaattagaacaaatttgggaaaggttttataaagcagatatgtctcgaacaaatacagcttttggcgaatctggtattggcttatccattgtgaagcagttaattgaatatcacgatggatcaattacggtgactagtgaaccaaataaaggtacttcatttactattcgccttccttttttccaagataacgaacaataa

SEQ ID NO: 77479 - protein, 402 aa, Listeria monocytogenes
MLKKFIIQSRMPTTKPFIPTQMNQPLPKDFSISADDKKKLESGETVSKKIDNRFNKEMTIVYVPIMNGDKFVGSIVLNSPISGTEQVIGTINRYMFYTILLSITVALILSAILSKLQVNRINKLRAATKDVIQGNYHARLKENNFDEIGALAIDFNKMTQTLEHLKKKLNDKRNGDAQFIADVSHEMRTPLTTISGLTEGLVNDIIPKSETDRCIALIDTEARRLTKLVNENLDYEKIRSNKIKLQKTRFNGKEFLELIKEQVDYVASEKGNTITVAIDKDMAIYADYDRLTQVFINIVKNSVQFTENGQITLTGTQDYKESVLTITDTGIGMNTEELEQIWERFYKADMSRTNTAFGESGIGLSIVKQLIEYHDGSITVTSEPNKGTSFTIRLPFFQDNEQ

SEQ ID NO: 77480 - DNA, 1410 bp, Amycolatopsis mediterranei
  CDS (1)..(1410): transl_table=11
gtgacggcaccgcgggtccggtcgtggctcgccgggctgcggccccggctggtggccgccttcgcggtgatcatgatcctcggcgtcaccaccgcggtgggcgtgagttacgtcttcgcgcgccgggccatcctggaaggcgtccaggaccagacgatgctgaagctgcgcgaccagatcgtcgcgtacctgcccaccgtgtcgctgccgccgtcgcaggccacgctcgacgccttcgcggccacgctcaagtccagcaacgcactcgtcgtctacgggaacctgcacgcgacttcgggcctgtcgatcgacgacgtgccgggcgacctgcgccacgccgtggccaccaccaccaacatccagttccagcgcgtcgacgtccagggcttcccgctgttcttcgtcggcgtgccggtgcagaccggcggcggcaagccgagcggcctcgaggtctacgcgatgacgcggctgatcgatcagcaggaagcgatcgacgagctggcccgcaacgcctggctgtactccgcgctcgcgctgccgctcgcggtcggggtcgcgctgctggcggcgcggcaggtgctgcggccggtgcgcgcgctgaacaccgcggcgagccagctcggccgcggccggctggacgtgcggctgcccgccaaggggtccgacgagctcgcgcagctggtcacgacgttcaaccacaccgccgcggagctggagcgcacggtgggcaccctgcgcgcgatggaggcggacgcgcggcggttcgtcgccgacgtctcccacgagctgcggaccccgctggcggcgatgaacgcggtcaccgacgtcctcgacgaggacgccgagcagctgccgccggacaccgcggtcgcggcgcggctggtgtcggccgagacgcggcggctgacccggctggtgcaggacctgatcgagatctcccggttcgacgccgggcgggcggagctgcgccgggaggagctggacgtcgccgcggcggtcaccgacagcctcgccgcgcggggctgggaagccggggccgacctggtcaccgacctgccggccgggatcaccgcccggctcgaccggcgacggctcgacatcgtcgtggcgaacctggtcggcaacgcgctgcggcacggcgcgccgcgggtcgaggtggtgctgcgcaaagagctcggcgacgtcgtgctgaccgtcaccgaccacgggccggggatccccgccgaagcgctgccgaaggtgttcgaccgcttcaccaaggccgactccgcccgcgcccggtccgggggcagcggcctcgggctgtccatcgcgcgggagaacgcgcggctgcacggcggcgacatcgtcgcggccaacacgggcaccggcgcccggttcgagctccgcctgcccggggaggcgtggtga

SEQ ID NO: 77481 - protein, 469 aa, Amycolatopsis mediterranei
MTAPRVRSWLAGLRPRLVAAFAVIMILGVTTAVGVSYVFARRAILEGVQDQTMLKLRDQIVAYLPTVSLPPSQATLDAFAATLKSSNALVVYGNLHATSGLSIDDVPGDLRHAVATTTNIQFQRVDVQGFPLFFVGVPVQTGGGKPSGLEVYAMTRLIDQQEAIDELARNAWLYSALALPLAVGVALLAARQVLRPVRALNTAASQLGRGRLDVRLPAKGSDELAQLVTTFNHTAAELERTVGTLRAMEADARRFVADVSHELRTPLAAMNAVTDVLDEDAEQLPPDTAVAARLVSAETRRLTRLVQDLIEISRFDAGRAELRREELDVAAAVTDSLAARGWEAGADLVTDLPAGITARLDRRRLDIVVANLVGNALRHGAPRVEVVLRKELGDVVLTVTDHGPGIPAEALPKVFDRFTKADSARARSGGSGLGLSIARENARLHGGDIVAANTGTGARFELRLPGEAW

SEQ ID NO: 77482 - DNA, 1419 bp, Amycolatopsis mediterranei
  CDS (1)..(1419): transl_table=11
gtgaggcttccggccgtcagcctgcggacgcggatcgtggcggcgatcgtcggggtgaccacggcggcgacggcggtgatggcgtactccgcctaccaggtgcaggcggacgaggcacagggccgcttcgcctggtcggccgtgcgcaacgtggcagccgaccgccggatcctccaggagttttcgaaggtgggcaccgcagggtggctcgacgacatccccaaccgcctcggccccatcccggactgggcgctggtgaccgagcgccccggcgggacggtcgaagtcgtccgggccgccaccgggtacatctcgctcatcccggtgccggacaagctcacggtgctgcggaccgtgcgggacgagctgttcatccagcggctgcccgagcagctcggaagcgcctacgcgagagtgccgcagaccggccggaaggtgctcgtggtcagcgcgaacctgtcggagccgggctaccacctcgtccagttcgtcgacttcagccggttcgacgacgacctgaccgcgttgcgctggaagctcgtccgcatcgcgctcggggtgagtgtgctcggcgccggtgtcgcgctcctgatcggccgccggatccgccgtccgatcaaggcgctgtccacggccgccgacgcactcggcgcgggcgcgctcgaaacacgtgtcccggtcaagggccgggatgaggtcgccgccctggccgtctccttcaacacgatggccgcgcggctcggcgagtccatcgaggagctgcacgccaaagaccgccagcaacggcggttcgtcgccgatgtcgcccacgacctgcggaccccgctcgcctcgatgatcgccaccgtcgacaccctcgaccacgccgagcccgccacccgcacccgcgccgccgccatcctcggcacccaggcccgccggctggccaagctcgtggaggacctcctcgaaatcgcccggttcgacgccggcaaggccgacctgagggtggcgcccgtcgacctcgccgacctggtggccgacgccgccgaggtcaccggcgtcgaggccgccgtgacggcgagcggggacgtcacggtcgtcgccgacccacggcgggtgcacaccgtggtggcgaacctgctgagcaacgccgccccgcacggggccatgccggtgacggtcaccctcgacgggaccggcgacgacgtcgtcgtgcgggtcgccgacgccggccccggcgtcccggaggacctgctgccggtcctgttcgaccggttcacccgcggcgaccacgcgcgccaggcgaccgagggcagcgggctcggcctggcgatcgcccgggagaacgtgctggcgcacggcggatcgctcgcggtgcacaacgacggcggtgccgtgttcaccgtgcggttgccccggggcgtcgagaacgcctga

SEQ ID NO: 77483 - protein, 472 aa, Amycolatopsis mediterranei
MRLPAVSLRTRIVAAIVGVTTAATAVMAYSAYQVQADEAQGRFAWSAVRNVAADRRILQEFSKVGTAGWLDDIPNRLGPIPDWALVTERPGGTVEVVRAATGYISLIPVPDKLTVLRTVRDELFIQRLPEQLGSAYARVPQTGRKVLVVSANLSEPGYHLVQFVDFSRFDDDLTALRWKLVRIALGVSVLGAGVALLIGRRIRRPIKALSTAADALGAGALETRVPVKGRDEVAALAVSFNTMAARLGESIEELHAKDRQQRRFVADVAHDLRTPLASMIATVDTLDHAEPATRTRAAAILGTQARRLAKLVEDLLEIARFDAGKADLRVAPVDLADLVADAAEVTGVEAAVTASGDVTVVADPRRVHTVVANLLSNAAPHGAMPVTVTLDGTGDDVVVRVADAGPGVPEDLLPVLFDRFTRGDHARQATEGSGLGLAIARENVLAHGGSLAVHNDGGAVFTVRLPRGVENA

SEQ ID NO: 77484 - DNA, 1404 bp, Xanthomonas maltophilia
  CDS (1)..(1404): transl_table=11
atggccttcgcgatggcgaagttccaactcaaattcggcctgaccgcgaagaccttcctcgcgatcttcaccgcctgcctgctggtgctggcagtgaacggtattgccagccgcgtggccttccagaccggcttcctggactacctcaacgaccagggcgacctgcgcatgcagcggctgatgccacacctgcagcgcgagtaccgcgagcacggtggctgggagcatctgcacggtgatggcgaccgctgggcgcggctgctgcgcccggacctggcccatgggcacgaaggaccggtgccgtcgctgtccgaccagaccggcgtgccgtcgcgcctgggcctgttcgacgcgcagcaccgtttcgtggccggcaaccccgacgccaccagcgatgacgagccgcatgcggtgcaggtggacgggcagaccgtcggttggctgggcatggtgccgttccagaccgtcatcgccaccaacgacctgaatttctacaacacccaggtgcgcgcctggtgggtgatcggcatcgcgctactgctggtgacggtactgctggcctggctggtatcgcgtgcgctgcgccagcgccttgccaagctggccgctgccacccaccggttggccgccggtgactacgccacccgcatcgagcgcaccagtgacgatgagctggacgcgctggtcaacgacttcaaccggatggcgcaggcgctggacgataccgaacgcaaccgccgcgccttcattgccgacatctcgcatgagctgcgcacgccattggccgtggtgcgggccgagctggaggcgatcgaagatggcatccgtccgctggaccgggccaacctggtgggcctgcagggcgagatccgccagctgggcaagctgatcgacgacctgcacgacctgtcgatgacccagtccggcggcctggcgtaccgcttcgcgccactggacctggtggcgctgctgcgcagcgaactcaatggcatgcgcgtgcgcttcgccaatgcaggcctggcgttggaagaagacctgcccgccacgccgttgcaggtgtccggtgacgagcggcgcctgcagcaggtgctggccaacctgctggaaaacgcactgcgctacacccatgccggtggccgcgtacgcgtgcaggcggcgcgcgtgcctgccggcgtgcagctggtcgtggaagacaccgcgccgggcgttccgcccgacaagtgtgcactggtgttcgaacgcttctaccgcgtggaaagttcgcgcaaccgcgccagtggcggcagcgggctgggcctggccatcagccacaacatcatcctcgcccaccacggcgtcatccacgccgcgccctcgccgctgggcgggctgcgcgtggtcatcaccctgccggagcctgcatga

SEQ ID NO: 77485 - protein, 467 aa, Xanthomonas maltophilia
MAFAMAKFQLKFGLTAKTFLAIFTACLLVLAVNGIASRVAFQTGFLDYLNDQGDLRMQRLMPHLQREYREHGGWEHLHGDGDRWARLLRPDLAHGHEGPVPSLSDQTGVPSRLGLFDAQHRFVAGNPDATSDDEPHAVQVDGQTVGWLGMVPFQTVIATNDLNFYNTQVRAWWVIGIALLLVTVLLAWLVSRALRQRLAKLAAATHRLAAGDYATRIERTSDDELDALVNDFNRMAQALDDTERNRRAFIADISHELRTPLAVVRAELEAIEDGIRPLDRANLVGLQGEIRQLGKLIDDLHDLSMTQSGGLAYRFAPLDLVALLRSELNGMRVRFANAGLALEEDLPATPLQVSGDERRLQQVLANLLENALRYTHAGGRVRVQAARVPAGVQLVVEDTAPGVPPDKCALVFERFYRVESSRNRASGGSGLGLAISHNIILAHHGVIHAAPSPLGGLRVVITLPEPA

SEQ ID NO: 77486 - DNA, 1437 bp, Lactobacillus sakei
  CDS (1)..(1437): n means a or g or c or t/u
atgaaactgatctatcagtggatgctagccttttttggggttattatgacaaccatcgtgatcgttggcattgcgtttacgcagtattcaacgaagacggcttataataatacgtgggatcagttggaaggttacgcctcagttattgaacgtgaagcattcaaacagggctcacaggcaacactatccaaccagtttattgatgatagccaagccatcctgtcgcaacaacgggttagttttaatttttttaatgcgcaaaatgaaatggtctacccggcgcctaactcgaatgtctccgttaagaaaaagtactggaaatacctgaagaaggggcaggtccaacgactcagtatgagcaaggactcccagcaatttaataatgatcaagatcaactggttgtttttaaaccggttttctataatgataagttgatttatgttattggggttggttcctccattaaaaacgttaagtcgggcttagtgacgatgcgcaagaatttattgattgccttcttactttcgacgattggtgggattttactcagttatgttctagcgcgctaccagatttatcggattagccgcttacgaaatgcaacgcatctggttgccgaaggggattttgatgtccatattgataaccccggtaaggatgaattggatgatttggcgaccgactttaacgaaatggtccactcgcttaatgaatctgaggccgaaattaagcggcaagaagatcgccgtcgtcaatttatggccgatgttgcacacgaaatgcggacgccattaacgacggtgaaagggctattggaaggcttagcctacgatgccatcccagaagaaatgcgagaaaagagtatttcattaatgcaaaatgaaaccaatcgcttaattcgcttggttaatgacaacttggattatgaaaaaattcgaacaaaccaaattaaattgaatcaacaaacatttaatgcggtaaaagcgttgcaaaacattcaagaacaacttcaaaaaaaagcggcggatgccggtgataccattgtgcttgaagcacaagaaaaagtggctatctatgccgactatgaccgctttgttcaggtcctgtttaatatcatgcaaaatgccatccaatttaccaataacggacagattacggttactgcaaaagctgggttccacaaaaccattctgacggttagtgatactgggattgggatgacgtctgagcaagttaagaatatttgggaacnatactataaggctgacccttcccggaagaacacaaaatacggtgaatctggtttgggcttagcaattgttcatcaactggtccaattacatcatgggaccatcgaggttcaaagtgaaccagatcaagggacaacctttatattaactttcccagacgaaaccgtcacaactgatgctaattaa

SEQ ID NO: 77487 - protein, 478 aa, Lactobacillus sakei
  misc_feature (418)..(418): Xaa can be Arg or Gln or Leu or Pro
MKLIYQWMLAFFGVIMTTIVIVGIAFTQYSTKTAYNNTWDQLEGYASVIEREAFKQGSQATLSNQFIDDSQAILSQQRVSFNFFNAQNEMVYPAPNSNVSVKKKYWKYLKKGQVQRLSMSKDSQQFNNDQDQLVVFKPVFYNDKLIYVIGVGSSIKNVKSGLVTMRKNLLIAFLLSTIGGILLSYVLARYQIYRISRLRNATHLVAEGDFDVHIDNPGKDELDDLATDFNEMVHSLNESEAEIKRQEDRRRQFMADVAHEMRTPLTTVKGLLEGLAYDAIPEEMREKSISLMQNETNRLIRLVNDNLDYEKIRTNQIKLNQQTFNAVKALQNIQEQLQKKAADAGDTIVLEAQEKVAIYADYDRFVQVLFNIMQNAIQFTNNGQITVTAKAGFHKTILTVSDTGIGMTSEQVKNIWEXYYKADPSRKNTKYGESGLGLAIVHQLVQLHHGTIEVQSEPDQGTTFILTFPDETVTTDAN

SEQ ID NO: 77488 - DNA, 1608 bp, Streptomyces coelicolor
  CDS (1)..(1608): transl_table=11
gtgacacgggaacaccaggggggtacccgcggcctggccgcggcgcgcaagggattctggtccgggctgcgcttcaccagcctgcgcctcagactggtcctcgtcttcggcctggtcgcgctgaccgccgccgtgtccgcgtccggcatcgcgtactggctgaaccgggaggcggtgctgacccgtacccaggacgccgtgctgcgggacttcgagcaggagatgcagaaccgggcgggcgcgctgccggagcaccccacccaggacgaggtgcagcacaccgcggggcagatggccaacagcagccagcggttctcggtgctgctggtcgccgagaacgccgacggcaccgccgtgtacggcagttccggcggcctgggcggcgtcgcgctgtccgacgtgcccgagtcgctgcgcacggccgtgaacaaggagcagaagctcacctcggccaacaagcacccgtaccacctgtactggcagcggatcaccgacgacggcaccccgtacctggtggccggcacgaaggtgatcggcggcgggccgaccggctacatgctcaagtcgctggaaccggaggccaaggacctgaactcgctcgcctggtcgctggggatcgccaccgcgctcgccctgctcggctccgcgctgctcgcgcaggccctggcgacgaccgtgctgaagcccgtgcaccggctcggggtcgcggcgcggcggctgggcgaggggaagctggacacccggctgcgggtgtccggcaccgacgaactggccgacctgtcgcggacgttcaacagtgccgccgagaacctggagaagcgggtcgcggacatggcggggcgggagcaggcctcgcggcgcttcgtcgcggacatgagccacgagctgcgtacgccgctgacggcgctcaccgcggtgacggaagtgctggaggaggagctggagtacgcgggcgagggcgagggggagggcgggagtttcgacccgatggtcgagcccgcggtgcggctggtggtgagcgagacgcgacggctgaacgacctggtggagaacctgatggaggtcacccgcttcgacgcgggcaccgcgcggctggtcctggacgacgtcgacgtcgccgaccagatcaccgcctgcatcgacgcccgggcctggctggacgccgtcgacctggacgccgagcgcggcgtccacgcccgcctcgacccgcgccggctggacgtcatcctcgccaacctgatcggcaacgcgctcaagcacggcgggtcgccggtcagggtgtccgtggcgcgggcggaccacgagatcgtcatccgggtgcgggacaacggtcccggcatccccgaggacgtcctgccgcacgtcttcgaccgcttctacaaggcgagcgcctcccggccgcgctccgagggcagcgggctcggtctgtccatcgccctggagaacgcgcacatccacggcggtgagatcaccgcggagaacgccccggagggcggtgcggtgttcaccctgcggctgccgcaggacccgtcgccgcccgccgacgaggacggcgggcccgacgaggagaccgaggaccggggcaaggacgcgaagggacaggtctga

SEQ ID NO: 77489 - protein, 535 aa, Streptomyces coelicolor
MTREHQGGTRGLAAARKGFWSGLRFTSLRLRLVLVFGLVALTAAVSASGIAYWLNREAVLTRTQDAVLRDFEQEMQNRAGALPEHPTQDEVQHTAGQMANSSQRFSVLLVAENADGTAVYGSSGGLGGVALSDVPESLRTAVNKEQKLTSANKHPYHLYWQRITDDGTPYLVAGTKVIGGGPTGYMLKSLEPEAKDLNSLAWSLGIATALALLGSALLAQALATTVLKPVHRLGVAARRLGEGKLDTRLRVSGTDELADLSRTFNSAAENLEKRVADMAGREQASRRFVADMSHELRTPLTALTAVTEVLEEELEYAGEGEGEGGSFDPMVEPAVRLVVSETRRLNDLVENLMEVTRFDAGTARLVLDDVDVADQITACIDARAWLDAVDLDAERGVHARLDPRRLDVILANLIGNALKHGGSPVRVSVARADHEIVIRVRDNGPGIPEDVLPHVFDRFYKASASRPRSEGSGLGLSIALENAHIHGGEITAENAPEGGAVFTLRLPQDPSPPADEDGGPDEETEDRGKDAKGQV

SEQ ID NO: 77490 - DNA, 1698 bp, Mycobacterium paratuberculosis
  CDS (1)..(1698): transl_table=11
atgatgtggggctcccggcgacgtacgcggagccgctgggggcgctccggtccgatgactcgcggcatgggcgcggtgagccgggcggtgggcacggcctggcggcgctcgctgcagctgcgggtggtggcgctgaccctgggactgtccctggcggtcatcctggcgctgggcttcgtgctgacgtcccaggtcaccaatcgcgtgctcgacgtcaaggtgaaggccgccatcgagcagatcgagcgggcccgcaccacggtcggcgggatcgtcaacggcgaagaggcgcgctcgctggacagcagcctgcagctggcccgcaacacgctgacgtctaagaccgattcagcctcgggggcggggacggccggcaccttcgacgccgtgctgatggtgcccggtgacggcccacgcgcggccaccacggccggccccgtcgatcaggtgcccgcttcgctgcggggcttcgtcaaggccgggcaggcgtcctaccagtacgccaccgtgcacaccgacgggttctccgggccggcgctgatcgtcggcagcccggcctcctcccaggtggccaacctggagctgtacctgatcttcccgctgaagaacgaacaggccaccatccagctggtgcgcggcaccatgatcaccggcggcgccgtgctgctggtgctgctggccgggatcgcgctgctggtgtcgcggcaggtggtggtgccggtgcgttcggcgtcgcgcatcgccgaacggttcgccgaggggcatctgtccgagcggatgccggtgcgcggcgaggacgacatggcccggctggcgatgtcgttcaacgacatggccgagagcctgtcgcggcagatcacccaactggaggagttcggaaacctgcagcgccgcttcacttccgacgtgagccacgagctgcgcaccccgctgaccacggtgcgcatggccgccgacctgatctacgaccacagcgccgacctcgatccgacgctggcgcgctccaccgagctgatggtcaacgagctggaccggttcgagtcgctgctcaacgacctgctggagatctcccggcacgacgccggggtcgccgagctgtccgtcgaggcggtcgacctgcgcagcacggtgcagagcgcgctgagcaacgtggggcatctggccgaggacgccggcatcgaactgcaggtggagctgccggccgaggaggtcatcgccgaggtcgacacccgccgggtggagcggatcttgcgcaacctgatcgccaacgccatcgaccacgccgagcacaagccggtcaagatccggatggccgccgacgaggacaccgtcgcggtcaccgtccgcgactacggggtggggttgcggcccggcgaggagaagctggtgttcagccggttctggcgggcggacccgtcgcgggtgcgccgctccggcggcaccggcctgggcctggcgatcagcatcgaggacgcccggctgcatcagggccggctggaggcgtggggcgaaccgggcgtcggctcgtgcttccggctcaccctgccgctggtccgcggccacaaggtgaccaccagcccgctgccgatgaagccgatcccgcagccgtccccgtccggtgggcagtccccgtcgaccggcccgcaacacgcgaaagaccgtgcgcgccaacgcgagcacgccgaaaggtcgctgtga

SEQ ID NO: 77491 - protein, 565 aa, Mycobacterium paratuberculosis
MMWGSRRRTRSRWGRSGPMTRGMGAVSRAVGTAWRRSLQLRVVALTLGLSLAVILALGFVLTSQVTNRVLDVKVKAAIEQIERARTTVGGIVNGEEARSLDSSLQLARNTLTSKTDSASGAGTAGTFDAVLMVPGDGPRAATTAGPVDQVPASLRGFVKAGQASYQYATVHTDGFSGPALIVGSPASSQVANLELYLIFPLKNEQATIQLVRGTMITGGAVLLVLLAGIALLVSRQVVVPVRSASRIAERFAEGHLSERMPVRGEDDMARLAMSFNDMAESLSRQITQLEEFGNLQRRFTSDVSHELRTPLTTVRMAADLIYDHSADLDPTLARSTELMVNELDRFESLLNDLLEISRHDAGVAELSVEAVDLRSTVQSALSNVGHLAEDAGIELQVELPAEEVIAEVDTRRVERILRNLIANAIDHAEHKPVKIRMAADEDTVAVTVRDYGVGLRPGEEKLVFSRFWRADPSRVRRSGGTGLGLAISIEDARLHQGRLEAWGEPGVGSCFRLTLPLVRGHKVTTSPLPMKPIPQPSPSGGQSPSTGPQHAKDRARQREHAERSL

SEQ ID NO: 77492 - DNA, 1422 bp, Bacillus subtilis
  CDS (1)..(1422): transl_table=11
ttgatgaagattaaatatttatatcagctgctgctaagccatatcagcattttgattttagcgtttgtcattatcatttctctgttttcccactttgtgaaggaatttgcctatcagaacaaagtagaggaattgacgtcatatgcggtgcagattgcaaatgaattccaatccggccaggtggacatgcgcaggctctatccttatcaggacattttaagcacaagaaagacgcaatttatcatctttaatgaagagcagcagccttattttcttcctgaaggctttcatcacccaccaagggaacagctgaagaaatcagaatggaataagctgaaaaaagggcagactgtcacgatcagggcagatggccgttttgatgatgaagtgtcccttgtggcgcagcctatatttgttcagaacgaatttaaaggcgccgttctgctgatttctccgatcagcggtgttgaacagatggtcaatcaggtcaacctctatatgttttacgctgtgatcagcacgcttgtgattacgattcttgtgagctggcttctgtccaaattccatgtcaagcggattcaaaagctgagagaagcgacagataaagtggcttccggcgattatgacatccatttggaaaacagctacggggacgaaatcggcgtactggcgtctgactttaatatcatggcgaaaaaactaaagcagtcaagggatgaaatcgagcgccttgagaagcggagaaggcagtttatcgctgacgtgtcacatgaattaaaaacaccgctgacgacgatcaacggtttggttgaagggttgaacagccatacgattcctgaggataaaaaggataaatgcttctcgctgatcagtgaggaaacgaagcgcatgctgcggctcgtaaaagaaaatctggattatgaaaaaatcagatcccagcaaattaccttgaacaagctagacgttcctctgatcgaggtgtttgaaatcgtgaaagagcacttgcagcagcaggcggaagaaaaacaaaacaagctgatgatccaagtagaggatcacgtcatcgtacatgccgattatgaccggttcattcaaattctcgtcaacattacgaaaaacagcatccaatttacgcaaaacggtgacatttggctgcgcggaatggaaggttataaagagacgattattgaaattgaagacacgggtatcggcattccaaaagaggatattgagcatatttgggagcgattctataaagcagatatttcaagaacgaacacagcatacggtgaatacggactcggtctctcgatcgtcaggcagctcgttgaaatgcaccagggcacagtagaaatcaagagtgaagaagggaaaggcacaaagttcatcatccgccttcctttaacggcaaaacagcaatag

SEQ ID NO: 77493 - protein, 473 aa, Bacillus subtilis
MMKIKYLYQLLLSHISILILAFVIIISLFSHFVKEFAYQNKVEELTSYAVQIANEFQSGQVDMRRLYPYQDILSTRKTQFIIFNEEQQPYFLPEGFHHPPREQLKKSEWNKLKKGQTVTIRADGRFDDEVSLVAQPIFVQNEFKGAVLLISPISGVEQMVNQVNLYMFYAVISTLVITILVSWLLSKFHVKRIQKLREATDKVASGDYDIHLENSYGDEIGVLASDFNIMAKKLKQSRDEIERLEKRRRQFIADVSHELKTPLTTINGLVEGLNSHTIPEDKKDKCFSLISEETKRMLRLVKENLDYEKIRSQQITLNKLDVPLIEVFEIVKEHLQQQAEEKQNKLMIQVEDHVIVHADYDRFIQILVNITKNSIQFTQNGDIWLRGMEGYKETIIEIEDTGIGIPKEDIEHIWERFYKADISRTNTAYGEYGLGLSIVRQLVEMHQGTVEIKSEEGKGTKFIIRLPLTAKQQ

SEQ ID NO: 77494 - DNA, 22 bp, Primer
atgaagttctggcgacccggta

SEQ ID NO: 77495 - DNA, 27 bp, Primer
ttatacttctctctgtaaatcccgttc

SEQ ID NO: 77496 - protein, 476 aa, consensus
  MISC_FEATURE (1)..(476): consensus for the disclosure of xaa see table XV
PXXXXXXXXXXXXXXXXXXXXXXXXXXXXXXXXXXXXXEXXXLXXXXNXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHELRTPXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXDXXXXXXXXXNXXXNAXXXXXXXXXXXXXXXXXXXXXXXXXXXXXXXXXXXXXXXXXXXXXXXXXXXXXXXXXXXXXXXXDXGXGXXXXXXXXXFXRFXXXXXXXXXXXXXXXGXGLGLXIXXXXXXXHXGXXXXXXXXXXXXGXXXXXXXP

SEQ ID NO: 77497 - protein, 150 aa, consensus
  MISC_FEATURE (1)..(150): consensus for the disclosure of xaa see table XV
XHXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNX

SEQ ID NO: 77498 - protein, 68 aa, consensus
  MISC_FEATURE (1)..(68): consensus for the disclosure of xaa see table XV
XXXXXXXXXXXXXXXXXXXXXXXXXXXXXXXXXXXXXXXGXGLXXXXXXXXXXXXXXXXXXXXXXXXX

SEQ ID NO: 77499 - DNA, 1118 bp, Escherichia coli
  CDS (31)..(1107)
tactgcaagaacgcaacggaggctaatggcatgaaattgacgctgaaaaaccttagcatggcgatcatgatgagcactatagtcatgggaagcagtgcaatggcggcggacagcaacgaaaaaatagtcatcgcccatcgcggtgccagtggatatttgccggagcatacgctgccagcaaaagcgatggcgtatgcgcagggagcggattatctggaacaggatttggtgatgaccaaagacgacaatctggttgttctgcatgaccattacctcgatcgtgttactgatgttgccgatcgtttcccggatcgggcgcgcaaagacggtcgttactacgcgatagatttcacgctggatgaaattaagtcgttgaaatttaccgaaggtttcgatattgaaaacggtaaaaaagtgcagacttatccggggcgtttcccaatgggtaagtccgacttccgggtgcacacctttgaagaagagattgaatttgttcaggggttaaatcactctaccgggaaaaatatcggtatttatccagaaatcaaagcgccgtggttccatcatcaggaagggaaggatattgcggcaaaaacgctggaagtgctgaagaaatatggttacaccggtaaagacgataaagtttatttgcaatgttttgatgctgatgagctgaagcgtattaagaatgagctggaacccaaaatgggcatggagctcaatctggtacagctgattgcctataccgactggaatgaaacgcagcagaaacagccggatggaagctgggttaattacaactacgactggatgtttaagccgggtgccatgaaacaggtggcggaatatgcagatggtattggtccggattaccatatgttgattgaggagacatcgcagccgggtaatatcaaactcactggcatggtgcaagatgctcagcagaataaactggtagtgcatccttataccgtgcggtcagataaactgcctgaatacactcctgatgtgaatcagttatatgatgctctgtataacaaagcgggtgtaaatgggctgtttactgatttccctgataaggcagtaaaatttcttaataaagagtaatgttactgcag

SEQ ID NO: 77500 - protein, 358 aa, Escherichia coli
MKLTLKNLSMAIMMSTIVMGSSAMAADSNEKIVIAHRGASGYLPEHTLPAKAMAYAQGADYLEQDLVMTKDDNLVVLHDHYLDRVTDVADRFPDRARKDGRYYAIDFTLDEIKSLKFTEGFDIENGKKVQTYPGRFPMGKSDFRVHTFEEEIEFVQGLNHSTGKNIGIYPEIKAPWFHHQEGKDIAAKTLEVLKKYGYTGKDDKVYLQCFDADELKRIKNELEPKMGMELNLVQLIAYTDWNETQQKQPDGSWVNYNYDWMFKPGAMKQVAEYADGIGPDYHMLIEETSQPGNIKLTGMVQDAQQNKLVVHPYTVRSDKLPEYTPDVNQLYDALYNKAGVNGLFTDFPDKAVKFLNKE

SEQ ID NO: 77501 - DNA, 2361 bp, Deinococcus radiodurans R1
  CDS (1)..(2361): transl_table=11
atgacggccggcgcacagcgggctgacaagcggcccacacagtgcaaagccgtgaaacccacattcctcggttggtcagtgaccctcaccctttccctttgctcggcctcagcgctgggcggcggcgcggcgcctgtgactgctgcccctgtgtctgcggcgcccagcactgcggctcctactgcgtccgttcctcgacccaccctggtcggctacgcggagctgaaagccgacacctttgctcagggaccggcgagcggggcctggaacggcggcctgcgtggggaagcgcggtttcagggccagccggtgcaggggttttccggcgtgcagcgtgacccccagggtcaggggttcattttcctgagcgacaacggcttcggagcgaaaaacaactctgcagattacctgttgcggctctatcgggtgagcctgacccccggtaccccggcggcgcggacaggcagcgtcaaggtgggcagctttattgggctccgtgaccctgacaagaaggtgccctggcaaatcgtgaacgaggcgagcggcgagcgattgctgaccggggccgactttgacgtggagggctttgcgttcgctcctgacggcaccctgtggattggtgacgaattcgggccattcttgctgcatttctcggcggacgggcggctgctcgaagcccccatagccacgcccaaccttcctggcttgcccaccctgcgtgggcaggcgcccatcgtcatcggccaccggggcagttcaggcacccggcccgaacacacgctggagtcctaccggacggccatcgaggcgggggccgactttatcgagcccgacctggtggtcaccaaagatggcgtgctcgtcgcccggcacgagccggtcatcgctgccgtggacgagacgggcaaggtactagaagccaccaccgatgtggcgacgcggcccgaattcagggaccggctgaccaccaagacgctcgacggcgtgaaggtgcacggctatttcgtggaagactttaccctcgccgagctgcggacgctgcgggcagtggagcggcttccacagctgcgcggcaaagcctacgacggccagttcacggtgcccacgctggaagaaatcatcgcactcgttcgtgatgtagaggccaaaaccgggcgcaaggtgggcatctatccagaaacgaagcaccctacctacatggccgaagtggcaaaggtcaacacctcgcaacttttgattgacaccctcaagcggctgaatttcaccgaccctgcccgcgtctttatccagtcgtttgaggtgggcaacctcaaagacctcaacaccagaatcatgccggcggcgggcgtcaagttgcccctggtgcagctgatttccagccccgacgaggcgccttacgactgggcagcggcgggggacgggcgcaagtacgacgcgctgacgaacgacgcgtcgctgcgcgagatcgccacctacgccaatggcgtgggagcgtacaagcgctggattattgacggcgagggtcacaccaccgatttcgtgacgcgcgcacacaccgccgggctcctcgtacattcctggactttccgcaacgagccgacctacctgctgccgacgtacaagaacgaccccgaagccgagatgcgccaagccctgcgagcgggcgtggacggcctgtttaccgatttcccggccaccggcgccaaagtggttgggcaatacacggcccccgaggtgcgcagcccacagcacccggcgtttgcccagggcctgagcagcgcggcagcgaatctgcccgcgagcggcggctttgagggctttgccatcgcgcccggcggcaaacttgcctacggcctgctggaaaagacggtggcgggcgacccggcggggcaactgcgcctgatgcgctacgacctcggcacgcggcactgggcgctggcgggccgctacgtgctggaacagggtggcgaggcgattggcgacctgacgcccgtgaacgactcgcagatgctggtgatcgagcgcgacaacggtcagggggaaacggccaagttcaagcggctgtatctgattgacctcgcggccaaaaatgccgacggcaccctgcgtaagaccctggtggccgacctgatggcgctcgccgatccgcgtggcctggcaccaagcacccggggcggcgtcttttccttcccctacttcaccatcgaaaacgtgctggtgctcggccccgacaccctgctcgtcgccaacgacaacaattacccggcaaccggtgggcgcggcgcagacgtcaaagaccaaaccgagttcctatggatcaagcttcccacggcgctcaagctggcgcccgcttatcactga

SEQ ID NO: 77502 - protein, 786 aa, Deinococcus radiodurans R1
MTAGAQRADKRPTQCKAVKPTFLGWSVTLTLSLCSASALGGGAAPVTAAPVSAAPSTAAPTASVPRPTLVGYAELKADTFAQGPASGAWNGGLRGEARFQGQPVQGFSGVQRDPQGQGFIFLSDNGFGAKNNSADYLLRLYRVSLTPGTPAARTGSVKVGSFIGLRDPDKKVPWQIVNEASGERLLTGADFDVEGFAFAPDGTLWIGDEFGPFLLHFSADGRLLEAPIATPNLPGLPTLRGQAPIVIGHRGSSGTRPEHTLESYRTAIEAGADFIEPDLVVTKDGVLVARHEPVIAAVDETGKVLEATTDVATRPEFRDRLTTKTLDGVKVHGYFVEDFTLAELRTLRAVERLPQLRGKAYDGQFTVPTLEEIIALVRDVEAKTGRKVGIYPETKHPTYMAEVAKVNTSQLLIDTLKRLNFTDPARVFIQSFEVGNLKDLNTRIMPAAGVKLPLVQLISSPDEAPYDWAAAGDGRKYDALTNDASLREIATYANGVGAYKRWIIDGEGHTTDFVTRAHTAGLLVHSWTFRNEPTYLLPTYKNDPEAEMRQALRAGVDGLFTDFPATGAKVVGQYTAPEVRSPQHPAFAQGLSSAAANLPASGGFEGFAIAPGGKLAYGLLEKTVAGDPAGQLRLMRYDLGTRHWALAGRYVLEQGGEAIGDLTPVNDSQMLVIERDNGQGETAKFKRLYLIDLAAKNADGTLRKTLVADLMALADPRGLAPSTRGGVFSFPYFTIENVLVLGPDTLLVANDNNYPATGGRGADVKDQTEFLWIKLPTALKLAPAYH

SEQ ID NO: 77503 - DNA, 1179 bp, Arabidopsis thaliana
  CDS (1)..(1179)
atgattcttacaagatgcttacccttgatatggctatctctacttactgtgtgtgctgctgggaggacattgcaccctctccctgttaaaggacccaaaactgtcaagcttcaacttcagacttcacgtccttataacatcgcacacagaggttccaatggagagatcccagaagaaactacagctgcatacttgaaagcaattgaagaaggcacagacttcatagaaacagatatcttatcatccaaagatggtgtgctcatatgtttccatgattgtattctcgacgaaacaaccaatgttgcgagccacaaggagtttgcagatcgtaaaaggacatatgatgtccaaggattcaacattactggctttttcacttttgattttacacttaaagaactaaagcaactacgtataaagcagcgatatgcttttcgggatcagcaatacaacggaatgtaccctatcattacatttgaggaatttcttaccattgctcgggatgctccaagagttgttggaatatatcctgagattaaaaatccagttttaatgaaccagcatgtcaaatggcctggtggtaagaaatttgaggataaagttgtggagacacttaagaagtatgggtatggaggctcgtatttgtccaagaagtggttgaaaaaaccactatttattcagtcatttgccccaacttcactcgtgtacatatcaaacttgacagactcgccgaaagtccttctaatagacgatgttaccatgccaacgcaagacactaaccagacatatgcagagatcacatcagatgcgtatttcgaatacatcaagcaatatgttgtgggtatcggaccatggaaggatacaattgttccggtaaacaacaactatgtgctagcccccacagatttggtcaaaagagctcacgcacacaatctgcaggtgcatccctatacgtacaggaatgaacacgaattcttacactataactttagccaagacccgtataaggagtacgactactggatcaatgagattggagttgatggactcttcactgatttcacaggcagcctccataactttcaagaatggacatctccattacctgatacctccaagtctccacgacagcttcttagtcaaattgcctcattggtcctcccttatgcaaaggcttga

SEQ ID NO: 77504 - protein, 392 aa, Arabidopsis thaliana
MILTRCLPLIWLSLLTVCAAGRTLHPLPVKGPKTVKLQLQTSRPYNIAHRGSNGEIPEETTAAYLKAIEEGTDFIETDILSSKDGVLICFHDCILDETTNVASHKEFADRKRTYDVQGFNITGFFTFDFTLKELKQLRIKQRYAFRDQQYNGMYPIITFEEFLTIARDAPRVVGIYPEIKNPVLMNQHVKWPGGKKFEDKVVETLKKYGYGGSYLSKKWLKKPLFIQSFAPTSLVYISNLTDSPKVLLIDDVTMPTQDTNQTYAEITSDAYFEYIKQYVVGIGPWKDTIVPVNNNYVLAPTDLVKRAHAHNLQVHPYTYRNEHEFLHYNFSQDPYKEYDYWINEIGVDGLFTDFTGSLHNFQEWTSPLPDTSKSPRQLLSQIASLVLPYAKA

SEQ ID NO: 77505 - DNA, 1119 bp, Arabidopsis thaliana
  CDS (1)..(1119)
atggccttcaagtatcttctaccattgcttttactgtcattgttggttgctaattgtgcctcaaggcctttgtatcgtctcccaagcgaagcaaaacatgcaaccaagaaaccacttcagacttcccgtccttacaaccttgcacacagaggatcaaacggagagctccctgaagaaactgctcctgcatatatgagggccatagaggagggtgcagattttatagaaaccgatattttgtcttccaaagacggtgttcttatatgtcaccacgatgttaatctcgatgatacaaccgatgttgcagaccataaggagtttgcagaccgtaagaggacttatgaagtccaaggaatgaacatgaccggcttcttcactgttgattttactctcaaagagctgaaaacacttggtgcaaagcagaggtatcctttcagggatcaacaatacaatggtaaattcccgattattaccttcgacgagtatatttcgatagcactggatgcacctagagtggttgggatatatccagagatcaagaatccggttttcatgaatcagcaagtgaagtgggcggatggtaaaaaatttgaagataaatttgtggaaactttgaagaaatatggatacaaaggctcatatctgtctgaagattggttaaaacagccaatatttattcagtcttttgcagcaacttcgctagtttacatttcaaacatgacagactcaccaaaattgtttttgatcgacgatgtcactattcttaccgaagacactaataagacttacgcagagatcacatcagacgcatatttggattacattaaaccatatgtaattgggattggtccatggaaagacacaattgttcctgtgaacaataaccgtctcatgacaccaacagatttagttgcgagagcacattcgcgtaatcttcaggtccatccatacacataccgtaatgagaaccagtttctgcatttagagtttaatcaggacccttacctagagtatgattattggctcaataagatcggtgttgatggtttgttcactgatttcactggaagtctacacaattaccaggaattgaagtctcctttgcctcagcaacagtga

SEQ ID NO: 77506 - protein, 372 aa, Arabidopsis thaliana
MAFKYLLPLLLLSLLVANCASRPLYRLPSEAKHATKKPLQTSRPYNLAHRGSNGELPEETAPAYMRAIEEGADFIETDILSSKDGVLICHHDVNLDDTTDVADHKEFADRKRTYEVQGMNMTGFFTVDFTLKELKTLGAKQRYPFRDQQYNGKFPIITFDEYISIALDAPRVVGIYPEIKNPVFMNQQVKWADGKKFEDKFVETLKKYGYKGSYLSEDWLKQPIFIQSFAATSLVYISNMTDSPKLFLIDDVTILTEDTNKTYAEITSDAYLDYIKPYVIGIGPWKDTIVPVNNNRLMTPTDLVARAHSRNLQVHPYTYRNENQFLHLEFNQDPYLEYDYWLNKIGVDGLFTDFTGSLHNYQELKSPLPQQQ

SEQ ID NO: 77507 - DNA, 1077 bp, Pasteurella multocida subsp. multocida str. Pm70
  CDS (1)..(1077): transl_table=11
atgaaactaaaaacccttgtggcaatattagccctatcgaccttaactgcctgttcaagttcaagcatgatgaaaaatgatgataaattgattattgcacaccgtggtgcaagtggttacttacccgaacatactctagaatccaaagccctcgcttttggtcaacaagctgattatttagaacaagatctcgcaatgacgaaagacaaccgcctgattgtaattcatgatcatttcttagacggcttaactgatgtagcaaaaaaattcccaaatcgagcgagaaaagatggacgctattatgttgtggatttcaccttaaaagaaatccaaagtttagagatgacagaaaacttcaaagttgaaaacggcaaacaagtacaagtttacccaaaccgtttccccctttggcaatcccatttccgtattcacacctttgaagatgaaattgaatttattcaaggtttagaaaaatccactggcaaaaaaattggtatctatcctgaaatcaaagccccttggttacaccataaagaaggaaaagacatcgcggcagaaaccttaaaagtgctgaaaaaatatggctatgacacaaaagacgcgcgggtttatttacaaaccttcgactttaatgagctaaaacggattaaaactgaattgttgccaaaaatgggcatggatatcaagttagttcagttagtcgcatacactgattggcatgaaaccgaagagaaaaatgcacaaggtaaatgggtcaactatgattatgactggatgttcaaaccgggtgcgatggcggaagtcgccaaatatgccgatggtgtaggaccgggctggtatatgctcatcgacaacgaaaaatcgaaagtgggcaatatcgtttataccccattagtcaaagagctcgccaactacaagctagaattacatccttataccgtccgtaaagatgcgttacctgccttcttcactgatgtggatcaaatgtacgatgccctgttaaataaagctggtgcaacaggcgtcttcacagacttcccagatacaggtgttgagttcttaaaaagaaacaaataa

SEQ ID NO: 77508 - protein, 358 aa, Pasteurella multocida subsp. multocida str. Pm70
MKLKTLVAILALSTLTACSSSSMMKNDDKLIIAHRGASGYLPEHTLESKALAFGQQADYLEQDLAMTKDNRLIVIHDHFLDGLTDVAKKFPNRARKDGRYYVVDFTLKEIQSLEMTENFKVENGKQVQVYPNRFPLWQSHFRIHTFEDEIEFIQGLEKSTGKKIGIYPEIKAPWLHHKEGKDIAAETLKVLKKYGYDTKDARVYLQTFDFNELKRIKTELLPKMGMDIKLVQLVAYTDWHETEEKNAQGKWVNYDYDWMFKPGAMAEVAKYADGVGPGWYMLIDNEKSKVGNIVYTPLVKELANYKLELHPYTVRKDALPAFFTDVDQMYDALLNKAGATGVFTDFPDTGVEFLKRNK

SEQ ID NO: 77509 - DNA, 1152 bp, Pseudomonas aeruginosa PAO1
  CDS (1)..(1152): transl_table=11
atgcaaccagccttcctgcgccgccacctcggcgccgcctgcctgatgctcgccgctggcctggccagcgccgcccacgccgacaccggcaacgtacaacgcgccatcgactgggcccagggccaggcctccgttcgccacccggccagcgacgaacgctcgccgctggtcatcgcccaccggggcgccagcggttacgtaccggaacacaccctgggcgcctacgccctggcggtgatgatgggcgccgactacgtcgagccggacctggtgatgacccgcgacggcaagctggtcgcccgccacgacaacgaactgggcctgaccaccgatgtcgcccagcacccggaattcgccgaccgcaagcgcacgcagaaagtcgacggagtggaactcaccggctggttcagcgaagacttcaccctcgccgaactgaagaccctgcgcgccatcgagcgcatccccacgatccgcccgggcaatgcgcgcctggacggcaccttcgagatccccaccctgcaggagatcatcgacctggtgaaaagcctgcagatcagccagcagcgcaccatcggcctgtaccccgagatcaagcacggcacccacttccagcgcctcggcctggccatggaacgcccgctggtgaagaccctgcaccgcaacggctacctcggtccgcgcgcgccggtattcatccagtccttcgaggtgaacaacctgaaggaactcaagcgcctcaccggcatccgcctggtgcagctctacggcagcggccagccctacgaccagcaggctgccggcggcagcctgacctacgccgagatggccaccgccaagggcctgcgccaggtggcgcgctacgcctacggggtcggtccggacaagagctacgtgattccccgcgatgccaacggcaacctcggccagccgacccgcttcgtcggcgacgcccacgccgccgggctgaaggtgcatccctacaccttccgcgcggaaaacagcttccttccggcggagttccgcagcgccgacggcaacccgcagtcgcgcggcgacctggccggcgagatcagggcctacctcgacgccggcatcgacggcctgttcagcgaccagccggacgtcgccgtgcgcctgcgcgagcagcgctga

SEQ ID NO: 77510 - protein, 383 aa, Pseudomonas aeruginosa PAO1
MQPAFLRRHLGAACLMLAAGLASAAHADTGNVQRAIDWAQGQASVRHPASDERSPLVIAHRGASGYVPEHTLGAYALAVMMGADYVEPDLVMTRDGKLVARHDNELGLTTDVAQHPEFADRKRTQKVDGVELTGWFSEDFTLAELKTLRAIERIPTIRPGNARLDGTFEIPTLQEIIDLVKSLQISQQRTIGLYPEIKHGTHFQRLGLAMERPLVKTLHRNGYLGPRAPVFIQSFEVNNLKELKRLTGIRLVQLYGSGQPYDQQAAGGSLTYAEMATAKGLRQVARYAYGVGPDKSYVIPRDANGNLGQPTRFVGDAHAAGLKVHPYTFRAENSFLPAEFRSADGNPQSRGDLAGEIRAYLDAGIDGLFSDQPDVAVRLREQR

SEQ ID NO: 77511 - DNA, 744 bp, Staphylococcus aureus subsp. aureus Mu50
  CDS (1)..(744): transl_table=11
atgactctgaataaactgaaagatgaattacaaattgtttcgcaccgtggattaccgagtgattttcctgaaaatacaatggtcggttatcgagaggtaatggggctcaatgttgctatgttagaaatagatgttcatttgaccaaagaccaacattttgttgtgatacatgatgaaacaattgatagaacatcggatggtaaggggcgtattgctgattacacattatcgcaattaaaatcatttgattttggtagttataaagatgttgcttttaagggagaacgaatacccacgttagatgaagtactttcattatgcttaaagtatgataaaaagctattgattgaattgaaaagtccgaatttatatccagaaatagaatgtaaattgctggcatttttggaagaaaagaaagtcgatgcgacacaagtagttatacaatcttttgatatcgaatgcatcgaaaagttaaacacattgggcagtatatatgaattaggtgtgctttctagtaaacgtaattattggtataaaaagccaaacttttcaagaattgctcaaattgctagttatgttaatcctaattatgcattagtggccagaaaatttgttgataaagcacatcatcatcaattacaggttatgccatacacagttaataaattgaaaactggagaaaaattaagacaaatgggtgtagatggattaattacagataatccgaaattatttattaagtga

SEQ ID NO: 77512 - protein, 247 aa, Staphylococcus aureus subsp. aureus Mu50
MTLNKLKDELQIVSHRGLPSDFPENTMVGYREVMGLNVAMLEIDVHLTKDQHFVVIHDETIDRTSDGKGRIADYTLSQLKSFDFGSYKDVAFKGERIPTLDEVLSLCLKYDKKLLIELKSPNLYPEIECKLLAFLEEKKVDATQVVIQSFDIECIEKLNTLGSIYELGVLSSKRNYWYKKPNFSRIAQIASYVNPNYALVARKFVDKAHHHQLQVMPYTVNKLKTGEKLRQMGVDGLITDNPKLFIK

SEQ ID NO: 77513 - DNA, 1116 bp, Yersinia pestis CO92
  CDS (1)..(1116)
atgcaaactcacgtcaaaacgctgttggcaagtctgattctggcggcctctatggcagccccggcctatgctgcgaaaccagcatctgcggataaatctgcatctgccatagataaagtcgtcatcgctcaccgcggtgccagcggctatttacctgagcactcactaccagccaaagccatggcctacgcccaaggcgctgattatctagagcaagatctggtgatgactaaagataatgaattggtggtgttgcacgaccattatctggatcgtgtgaccgatgttgccgaacgcttccctgatcgcgcacggaaagatggccgctattatgccattgattttacgttgccagaaatcaagtcgctgaaatttaccgaaggctttgatattgataagaacggtaagaaagtacagagctatccgaaccgtttcccaatgggcaaatctgatttccgggtgcacactttccaagaggaaattgaattcattcaggggctgaaccactcgaccggtaaaaatacgggtatttaccctgaaataaaagcgccgtggttccatcatcaagaaggcaaagacatctcaaccaaagtattggaagtcctgaaagaatacggctacaccaataaagacgataaagtgtatctgcaatcctttgatgtaaatgaattaaaacgtattaagaatgagttggaacctaagatggggatggatctgaaactgatccaactgatcgcatacactgactggaatgaaacctacgagcaattacctgatggcaaatgggttaattacaactatgactggatgttcaagccaggtgcgatgaaggaagtggcgcactatgctgatggcatcggccctgactatcacatgttagtggttaaaacatcgacagcaaaagacatcaagttgaccgatctggtcaaagaagcccatgccagcaatatgatggtccatccgttcacgatacgggctgataggctacctaaatacgccaccgatattaaccaactatttgatattatttacaatcaggcacaagttgatggtgtatttactgacttcccggaccaaggcatccagttcctgcaaaaacagcaacagcataaataa

SEQ ID NO: 77514 - protein, 371 aa, Yersinia pestis CO92
MQTHVKTLLASLILAASMAAPAYAAKPASADKSASAIDKVVIAHRGASGYLPEHSLPAKAMAYAQGADYLEQDLVMTKDNELVVLHDHYLDRVTDVAERFPDRARKDGRYYAIDFTLPEIKSLKFTEGFDIDKNGKKVQSYPNRFPMGKSDFRVHTFQEEIEFIQGLNHSTGKNTGIYPEIKAPWFHHQEGKDISTKVLEVLKEYGYTNKDDKVYLQSFDVNELKRIKNELEPKMGMDLKLIQLIAYTDWNETYEQLPDGKWVNYNYDWMFKPGAMKEVAHYADGIGPDYHMLVVKTSTAKDIKLTDLVKEAHASNMMVHPFTIRADRLPKYATDINQLFDIIYNQAQVDGVFTDFPDQGIQFLQKQQQHK

SEQ ID NO: 77515 - DNA, 1071 bp, Caulobacter crescentus CB15
  CDS (1)..(1071): transl_table=11
atgaccctgctgacccgtcgcgccctgaccaccgccgccctcgccggcaccttcctgccgggcctggcccgcgcccagagccgcaagccgatcgtcatcggccaccgcggctgcagcggcgagcgccccgagcacaccgccctggcctatgagcgggccatcgagcagggcgcggatttcattgagccggatctcgtcccgaccaaggacggacacctggtcgcccgccacgagaacgagatcggcggcacgaccgacgtcgccagccgtcccgagttcgccgcccgcaagaccaccaagacgatcgacggcgagcagatcaccggctggttcaccgaagacttcacgctggccgagctgaagaccctgcgggcccgcgaacgcctgccgcagctgcgccccgccagcgccgcctttgacggtcaggcccagatccccaccttcgaagaagtgtgggcgatcgcccaggcgggctccaagcggacgggccgcacgatcggcgtctatcccgagctgaagcacccgacctatttcgccgcgatcggcctgccgaccgaggcgcgcctggtgaccaagctgaaggcgctgggcctgaactcggccaccgccccggtgttcgtgcagtgcttcgaggtcgcccctctgaagcgactgcgcgccctgacgtcggcgcgcctggtgttcctggtcgacgcggaaggcgggccggccgaccagcccggcgtcaagtacgccgacctgatcaccgcccagggcctgaaggacgtggccgtctacgccgacggccttggccccaactggaagctcgtcgtgccccacgacggtcaggttctcggcgcgccgaccaccctggtccgcgacgcgcacgctgccggcctggcggtgcacccctggaccgtgcgctcggagaacgccttcctgccggtgagcctgcgcaagggcgaccccgccagcccgggcttcctggcccagcatggcgactccgaggccgtgctcaaggcgctctatgcggcgggcgtcgacggcgtgttcagcgacttcccggccctggcggtcgccgcgcgcggctga

SEQ ID NO: 77516 - protein, 356 aa, Caulobacter crescentus CB15
MTLLTRRALTTAALAGTFLPGLARAQSRKPIVIGHRGCSGERPEHTALAYERAIEQGADFIEPDLVPTKDGHLVARHENEIGGTTDVASRPEFAARKTTKTIDGEQITGWFTEDFTLAELKTLRARERLPQLRPASAAFDGQAQIPTFEEVWAIAQAGSKRTGRTIGVYPELKHPTYFAAIGLPTEARLVTKLKALGLNSATAPVFVQCFEVAPLKRLRALTSARLVFLVDAEGGPADQPGVKYADLITAQGLKDVAVYADGLGPNWKLVVPHDGQVLGAPTTLVRDAHAAGLAVHPWTVRSENAFLPVSLRKGDPASPGFLAQHGDSEAVLKALYAAGVDGVFSDFPALAVAARG

SEQ ID NO: 77517 - DNA, 1071 bp, Salmonella typhimurium LT2
  CDS (1)..(1071): transl_table=11
atgaaaaccacactgaaaaaccttagcgtggcgttaatgttggcaggaatgaccatcggaagcggcgccgtggcggctgaaaaagtcgttatcgcccaccgtggtgccagcggttatctgccggagcatacgctaccggcgaaagcgatggcgtatgcgcaaggggcagattatctggaacaggatttagtgatgacaaaggacgaccatctggtcgtcctccatgaccactaccttgaccgggtgactgacgtcgctgaccgttttccggaccgggcgcgtaaagatgggcgctattacgctatcgattttacgctggatgaaattaaatccctgaagtttaccgaagggtttgatattgaaaacggcaaaaaagtacaaacttatccgggccgtttcccgatgggaaaatctgatttccgcattcatacctttgaagaggaaattgaattcgttcagggattaaatcactctaccggtaaaaatatcggtatttatccggaaattaaagcgccgtggttccatcatcaggaagggaaagatattgccgcgaaaacgctggaagtgctgaagaagtatggttacaccggcaagcaggacaatgtctatttgcagtgttttgatgtcgctgagctgaaacgtattaagaatgaactggaacccaaaatggggatggatctcaatctggttcaacttattgcgtataccgactggaatgaaacacagcagaaacagccggacggtcgttgggtaaattacaactacgactggatgtttaagccgggcgctatgaagcaggtggcggaatatgcggacggtattggtccggattaccatatgctggttgcggaaggctcaacgaaagggaatatcaagctgactggaatggtgcaagacgcgcatcagaataagatggtagtgcatccttacactgtgcgtgccgatcaattgccggactatgccacagacgtcaatcagttgtacgacatcctgtataacaaggcgggcgtcgacgggctgttcactgacttcccggataaggcggtcatgttcctgcaaaaaaatgactaa

SEQ ID NO: 77518 - protein, 356 aa, Salmonella typhimurium LT2
MKTTLKNLSVALMLAGMTIGSGAVAAEKVVIAHRGASGYLPEHTLPAKAMAYAQGADYLEQDLVMTKDDHLVVLHDHYLDRVTDVADRFPDRARKDGRYYAIDFTLDEIKSLKFTEGFDIENGKKVQTYPGRFPMGKSDFRIHTFEEEIEFVQGLNHSTGKNIGIYPEIKAPWFHHQEGKDIAAKTLEVLKKYGYTGKQDNVYLQCFDVAELKRIKNELEPKMGMDLNLVQLIAYTDWNETQQKQPDGRWVNYNYDWMFKPGAMKQVAEYADGIGPDYHMLVAEGSTKGNIKLTGMVQDAHQNKMVVHPYTVRADQLPDYATDVNQLYDILYNKAGVDGLFTDFPDKAVMFLQKND

SEQ ID NO: 77519 - DNA, 1170 bp, Nostoc sp. PCC 7120
  CDS (1)..(1170): transl_table=11
atgcgacatttctttggagcatttttgctaggaatggctacactaacagttatgccaacagaacaagtcctagcaggaaccttaacgggtcaacctcctattgttattggacaccggggagctagcggttatcgtccagaacacaccttagcagcttatgaactagctattcaaatgggtgctgactatattgaacctgatttagttgctactaaagatggtgttttagtcgcccgtcacgaaaacgctttagcaatcttgaacgctgatggtacgctcaatctcacagataccagcacagatgtttttgagcgtctacagtttgcagaccgcaaaaccactaaagtcatcgatggacgctccattacaggctggtttaccgaagactttaccctagctgaattaaaaactctccgcgccatagagagaattcctggtatccgtccccagaatactcaatatgacagacaatttgaaattcctactttgcaagaagtcatcgatttagccaaagcacaaagcgcagccttgggacggactattggtatttatcctgaaactaagcacccgacttattttgattccattggtttatcaatggaagaaattttggtgagcgttttaaatgccaatggatatgttgatgaaagtgcgccagtttacattcaatcatttgaagttagcaatttaaaagacctcaaccgattaactaatgtctctttggtgcaactaattagtcccagtggaagaccttatgattttgtagttaatggagattctcgcctttacagggatttaattacacctttaggtttagcagaaattgctacctatgctaatggaataggagccaataaaaacttaattattcctagagatggtcgaggtaatttattgtcgcccacaaccttagttgatgatgctcacgcagccggcttaattgtccacgcttggacttttcgcaatgaagatgttttcttaccaacgaacttacaaggaaatccccaagaagagtataagcgattttatcaaacaggtatagatggtttatttagcgataatccagacacagcttttgctgtgcgctctaccttagttcccgaacccggtacaatctttggattaggttttgtgccacttttaggatggttatttcgccgtcgtaagtaa

SEQ ID NO: 77520 - protein, 389 aa, Nostoc sp. PCC 7120
MRHFFGAFLLGMATLTVMPTEQVLAGTLTGQPPIVIGHRGASGYRPEHTLAAYELAIQMGADYIEPDLVATKDGVLVARHENALAILNADGTLNLTDTSTDVFERLQFADRKTTKVIDGRSITGWFTEDFTLAELKTLRAIERIPGIRPQNTQYDRQFEIPTLQEVIDLAKAQSAALGRTIGIYPETKHPTYFDSIGLSMEEILVSVLNANGYVDESAPVYIQSFEVSNLKDLNRLTNVSLVQLISPSGRPYDFVVNGDSRLYRDLITPLGLAEIATYANGIGANKNLIIPRDGRGNLLSPTTLVDDAHAAGLIVHAWTFRNEDVFLPTNLQGNPQEEYKRFYQTGIDGLFSDNPDTAFAVRSTLVPEPGTIFGLGFVPLLGWLFRRRK

SEQ ID NO: 77521 - DNA, 1137 bp, Ralstonia solanacearum GMI1000
  CDS (1)..(1137): transl_table=11
atgccgcgccgcttcgctctgctgtgcccgctgatgttgacgaccgccatcgcactgtcggcctgccggctggaatacaaccacggcggcaaccacggcgacaccacgcccatcgccaccgtccaggtgatcggccatcgcggcgccccggcgttgcgcccggagcacacgctggcgtcataccagaaggccatcgacgacggcgccgacatcattgagccggacctcgtcgccacccaggacggcgtgctggtcgcgcgccacgagaacgagatctccggcaccaccaacgtggccgacctgccgcagttcgccggccgccgagccaccaagaccatcgacggccagagcgtcaccggctggttcacggaagacttcacgctggccgaactgaagaccctgcgcgcccgcgagcgcatccccgacatccgcccggacaacacggcctacaacgaccagttcgacatcccgacgctgtccgagatcatcgcgctcgcccgcgaccagtcgaccctgcgcggccgcaacatcggcctctaccccgagaccaagcacccgacctatttccagtcgatcggcctgccgctggaagaccggctgatcgccgcgctgcgccaggacgatttcacggccagccggaccacggtccatatccagtcgttcgaagtcgccaacctgaagtcgatccgcaaccggatcggcggcagccagcccaactggaagctcgtgcagctgctgggcaccgccacccagcgcccctacgacttcacggtggccaacgacgcccgcacctacgccgacctgatgaccgaccagggcctgcgcgacatcgccgcctatgccaacggcgtcgggccggacaagaacagcgtgatcgcgctggacgccaacggcgcgctgaccgaccccagcgacctcatccgcaatgcccacagcgccggcctcgtggtgcatccgtacacgttccggcccgagaacatcttcctgccggccgcgctgcgcagtggtgcggacaacgcgcgcaacgtgagcggctcgatccaggaaatccaggccttcctgcgcgcgggcgtcgacggcttcttcaccgacgacccggcggtcggccggcaggccgtggacaccctccagcgctag

SEQ ID NO: 77522 - protein, 378 aa, Ralstonia solanacearum GMI1000
MPRRFALLCPLMLTTAIALSACRLEYNHGGNHGDTTPIATVQVIGHRGAPALRPEHTLASYQKAIDDGADIIEPDLVATQDGVLVARHENEISGTTNVADLPQFAGRRATKTIDGQSVTGWFTEDFTLAELKTLRARERIPDIRPDNTAYNDQFDIPTLSEIIALARDQSTLRGRNIGLYPETKHPTYFQSIGLPLEDRLIAALRQDDFTASRTTVHIQSFEVANLKSIRNRIGGSQPNWKLVQLLGTATQRPYDFTVANDARTYADLMTDQGLRDIAAYANGVGPDKNSVIALDANGALTDPSDLIRNAHSAGLVVHPYTFRPENIFLPAALRSGADNARNVSGSIQEIQAFLRAGVDGFFTDDPAVGRQAVDTLQR

SEQ ID NO: 77523 - DNA, 738 bp, Clostridium perfringens str. 13
  CDS (1)..(738): transl_table=11
atgaaaaaaatattaaacgtagcacacagaggattaagtggattgtatccagaaaatactatgatagcttttaggaaggcaatagaagcagactgtgatggtatagaaatggatgttcatcttacaagggatggagttccagttgtaattcatgatgaagaagttgatagaacaactaatggaagtgggtatgtaaaggactttacttatgaacaattatgtaacttagatgctggaataaaattttctgatgaatttaagggagaaaaaatacctacattaaaagagttttttgattttatgaaggataataacaaacttataaatatagagcttaaaaatagcataatacattatgaaggtttagaagaaaaggtatataaagaaatagagaattatggatttgaggatagagttataatatcatcctttgatcactattcaataagaaaatgtataagacttaataaaaatataaaaacaggaatactttattgggattgtatttttgaaccacataattattgtaaggtagttggttcttcagcacttcatcctgaatttaatagtataacagaagaaatagttagggatgcccatgaagattttcaacaagtaaatgtgtacacagtaaatgagaaaaaagatatggaaaaaatgatagatttaaacgttgatatgataataaccaattatcctaatattttaaaagaagttttagaaagtaaaaataaataa

SEQ ID NO: 77524 - protein, 245 aa, Clostridium perfringens str. 13
MKKILNVAHRGLSGLYPENTMIAFRKAIEADCDGIEMDVHLTRDGVPVVIHDEEVDRTTNGSGYVKDFTYEQLCNLDAGIKFSDEFKGEKIPTLKEFFDFMKDNNKLINIELKNSIIHYEGLEEKVYKEIENYGFEDRVIISSFDHYSIRKCIRLNKNIKTGILYWDCIFEPHNYCKVVGSSALHPEFNSITEEIVRDAHEDFQQVNVYTVNEKKDMEKMIDLNVDMIITNYPNILKEVLESKNK

SEQ ID NO: 77525 - DNA, 1074 bp, Fusobacterium nucleatum subsp. nucleatum ATCC 25586
  CDS (1)..(1074): transl_table=11
atgaagttaaaaagttgtttagttttgttaggaattttatcaagtacagcattatttgctgctcataatgggaaaataataattgcccatagaggagcatcaggttatttacctgagcatactttggaatcaaaagcattggcatttgctcaacaagcagattatcttgaacaagatttagctatgtctaaggatggaaaattaatagtaatacatgaccactttctagatggtttaacagatgttgctaaaaaatttccaaatagaaaaagagcagatggaagatattatgtgattgattttacttggtcagaactacaaacattagaaatgactgaaaatttcactacaaaagatggtaaacaaacagctgtctatccaaatcgtttccctctttggaaatcagatttcaaattgcatacttttgaagaagaaattgaatttatccaaggattggaaaaatcaactggtaaaaaaattggaatttatccagaaattaaagcaccttggttccatcatcaaaatggaaaagatattgcaaaagcaactcttgaagttttaaaaaaatatggatacactaaaaaatcagatatggtttacttacaaacatttgattacaatgaattaaaaagaattaaaacagaacttatgccaaaaatgggaatggacttaaaattggtgcaacttatagcatacaatgattggcatgaaacagaagaaaaagataaaaatggtaaatgggtaaattatgattatgattggatgtttaaagaaggagcaatgaaagaaattgctaaatatgctgatggagttggaccaggttggtatatgctgattgatgataaaaattcaaaagtaggaaatatagtttatactccaatggtaaaagatatagcaactactaaaatggaactacacccttatactgtaagaaaagatgctttacctgaattttttacagatgttaatcaaatgtatgatgctttattaaataaagctggagcaacaggggtatttacagatttccctgatttaggagttcaatttttagaaaatcaaaagaataaaaaataa

SEQ ID NO: 77526 - protein, 357 aa, Fusobacterium nucleatum subsp. nucleatum ATCC 25586
MKLKSCLVLLGILSSTALFAAHNGKIIIAHRGASGYLPEHTLESKALAFAQQADYLEQDLAMSKDGKLIVIHDHFLDGLTDVAKKFPNRKRADGRYYVIDFTWSELQTLEMTENFTTKDGKQTAVYPNRFPLWKSDFKLHTFEEEIEFIQGLEKSTGKKIGIYPEIKAPWFHHQNGKDIAKATLEVLKKYGYTKKSDMVYLQTFDYNELKRIKTELMPKMGMDLKLVQLIAYNDWHETEEKDKNGKWVNYDYDWMFKEGAMKEIAKYADGVGPGWYMLIDDKNSKVGNIVYTPMVKDIATTKMELHPYTVRKDALPEFFTDVNQMYDALLNKAGATGVFTDFPDLGVQFLENQKNKK

SEQ ID NO: 77527 - DNA, 732 bp, Thermoanaerobacter tengcongensis MB4
  CDS (1)..(732): transl_table=11
atgaaaactttggtaattgcgcacaggggagattctaaaaatgtacctgaaaacaccatcgctgcttttaaaagggctatggaattgggggcggatggtattgagctggatgtacagcttacaaaggatgggcatcttgtggtgatccacgatgaaacagtagacagaacgacaaatggagagggctttgtgaaagattttacgctagaagaaattaagaagttggatgcaggtataaagtttggtgagaaatttgcgggagagagaatacctactttgtatgaggtttttgaactgattggagataaagactttcttgtaaatatagagataaaaagtggaattgtgctttatccgggaattgaagaaaaattgataaaagcaataaaagaatacaattttgaggagagagtcattatatcctcttttaatcattatagcttaagagatgtaaagaaaatggcgccccatcttaagataggtcttttataccaatgtgggcttgtagagccttggcacatggcacttcgcatggaagcttattcgctgcatcctttttatttcaacataatacccgagcttgttgagggttgcaagaaaaacggtgttaaattatttccttggacagttgacagaaaggaagacatggaaagaatgataaaggctggtgtagacgggattatcacagatgacccagagaccttgataaatcttgtgaggaaagggggataa

SEQ ID NO: 77528 - protein, 243 aa, Thermoanaerobacter tengcongensis MB4
MKTLVIAHRGDSKNVPENTIAAFKRAMELGADGIELDVQLTKDGHLVVIHDETVDRTTNGEGFVKDFTLEEIKKLDAGIKFGEKFAGERIPTLYEVFELIGDKDFLVNIEIKSGIVLYPGIEEKLIKAIKEYNFEERVIISSFNHYSLRDVKKMAPHLKIGLLYQCGLVEPWHMALRMEAYSLHPFYFNIIPELVEGCKKNGVKLFPWTVDRKEDMERMIKAGVDGIITDDPETLINLVRKGG

SEQ ID NO: 77529 - DNA, 1113 bp, Xanthomonas campestris pv. campestris str. ATCC 33913
  CDS (1)..(1113): transl_table=11
ttggagaaaggcatgatgcagttccaccgtgttctagtcttgggagcgatgatggccgtcatgagcagccctgcactggcagaagcgccgctggccaagacggtgcagatcttcgcgcaccgcggtgccagcgcattgcgcccggaacataccttggcgtcctacgccaaggctatcgtcgatggcgctgatttcgtcgagccggatctggtgtcgaccaaggatggcgtgctggtagcgcgccatgagaacgagatcggcggcaccaccgatgtggccagccatccggagtttgccgcgcgcaagacgcgcaagaccatcgatggccaggcgctggaaggctggttcaccgaagacttcaccctggccgagttgaagaccctgcgcgcgcgtgagcggttgccgcaattgcgtggcacgcagtgggatggccattttcagatcgtgacgctggacgagatcatcgacttcgttgcggcagagtcggccgccaccgggcgcacgattgggctgattcctgagatcaagcacccgagctatttcagcggcctgggcctggcgatggaagacaaggtgctggccaccctgcaagcgcacgcgtatacgcgcacggcgccggtggtgatccagtcgttcgagaccaccaacctgcgctatctgcgcggcaggatcgggcggcagagcaacatccggctgctgcaattgctcagtggtgcgcagatggcgctgcccgatgcgggcaagggcgctgcgccagccacctatgcgcaactgaggacgcctgcggggctcacgcaggttgccacctacgccgacgcgatcggcccggacatccgcgcgatcattccgctggatgcgcagcagcgcctgggtcaaccgaccagcctggtgcgcgatgcgcatgcggcgggattgcaggtgcagccgtacacctttcgtccggaaaactattttctcgccgccgacaaccgcagtggcggtgcgccgaccgaacgtaacgaagcgggtgcgctggcggaattgaagcgctatctagacaccggcatcgatgcgtttttcgccgatgacccgggcctggcgcggcgtgcattgagcgggaaaacaccgcggtaa

SEQ ID NO: 77530 - protein, 370 aa, Xanthomonas campestris pv. campestris str. ATCC 33913
MEKGMMQFHRVLVLGAMMAVMSSPALAEAPLAKTVQIFAHRGASALRPEHTLASYAKAIVDGADFVEPDLVSTKDGVLVARHENEIGGTTDVASHPEFAARKTRKTIDGQALEGWFTEDFTLAELKTLRARERLPQLRGTQWDGHFQIVTLDEIIDFVAAESAATGRTIGLIPEIKHPSYFSGLGLAMEDKVLATLQAHAYTRTAPVVIQSFETTNLRYLRGRIGRQSNIRLLQLLSGAQMALPDAGKGAAPATYAQLRTPAGLTQVATYADAIGPDIRAIIPLDAQQRLGQPTSLVRDAHAAGLQVQPYTFRPENYFLAADNRSGGAPTERNEAGALAELKRYLDTGIDAFFADDPGLARRALSGKTPR

SEQ ID NO: 77531 - DNA, 852 bp, Oceanobacillus iheyensis HTE831
  CDS (1)..(852): transl_table=11
atgtctagtaaacttatttttacattattagtagcattaatatttttgtcggtgtttacttcaccagcttttgcatctaatgcagaaacaaaagggaatccacatcataaaaaagtggtaaatgttgcacacagaggcgcatctggtcatgctccagaaaatacgattgcagcatttgataaagcatttcaaatgaagtcggattttattgaaattgatgtacaaatgaccgctgatggtaagttaatcgctatccatgatacgacagtaaacagaacgacagatggtactggaagtgttagtgattacacattagaagagatccaacaactggatgctggaagttggtttggagaagaatttgcaggagagcaaattcctacatttgaagaaattcttgataagtaccgtggaaagattggtattttaatagaattaaagtcccctgaactatatccaggtatggagcaaaaagttgccgaagcattaaaagaacgtaatatggataaacctagaaacggaaaaattattgttcagtcgttcaaccatgaatccgtacaattatcaaaagaactccttcctagaattccacacggtgtgttggcaggaatgtcatgggcagacgtaacgggtgaagaactggaggagtttgcaacatatgccgattactttaacccgaatatgaatatcgccaacgaagatttaattgatcgtgtacatggtaaagatatgaaaatgtggccttatacagtaagaacacaagaacaggcagatcgtttacttgacttaaaagtagatgggatcattacagatttccctgaatatgtacatagacacccggggaagaattaa

SEQ ID NO: 77532 - protein, 283 aa, Oceanobacillus iheyensis HTE831
MSSKLIFTLLVALIFLSVFTSPAFASNAETKGNPHHKKVVNVAHRGASGHAPENTIAAFDKAFQMKSDFIEIDVQMTADGKLIAIHDTTVNRTTDGTGSVSDYTLEEIQQLDAGSWFGEEFAGEQIPTFEEILDKYRGKIGILIELKSPELYPGMEQKVAEALKERNMDKPRNGKIIVQSFNHESVQLSKELLPRIPHGVLAGMSWADVTGEELEEFATYADYFNPNMNIANEDLIDRVHGKDMKMWPYTVRTQEQADRLLDLKVDGIITDFPEYVHRHPGKN

SEQ ID NO: 77533 - DNA, 1179 bp, Streptomyces coelicolor A3(2)
  CDS (1)..(1179)
atgggaacgcaggagtcggacgagcgggcgggtggcggcaccggacggcgggcgctcctcggggcggcggtgctcggcgcgggcggcgcggtactcggcctgcccggcacggcgagagccgccggcacccggcacggcggcggacacggcggcggggtcgggagcctgcccgtgccgaccgtcatcggtcaccgcggggccagcggctaccgccccgagcacaccttcggctcctacgaactggccctcgacctgggtgccgacatcgtcgaggccggtgacctggtccccacgaaggacggtcacctcgtctgccggcacgagccggagatcggcggcaccacggacgtcgccgaccaccgggagttcgccgaccgcaagcgcaccaagctgctcgacggggtctccaccaccggctggttcaccgaggacttcacgctcgccgaactcaagaccctccgcgccaccgaacgcatcccggccaatcgcccgcacaacaccctctacgacggccgctgggagatccccaccttcgaggaggtgctccgctggcagaacgagcagacccgcaggcgcggcaagcaggtctggatctacccggagctcaagcaccccacctacttccgcaagctgggcctgggcacggaggagcgcctggcacggctgctgcgtaagtacggcaaggaccggaagaactcgcccgtcatcatccagtccttcgagcccaccagcatccagcggatgaacaagctggtcggcaaccccctcgccgtcctgctgtccggcgccaacagccgcccctgggacttcgtcgagaccggtgacccgcgcacgaccgcggacctcgtcacccccgagggcctgaaggagatcgcctcctacgcgcagggcatcggccccaccctggacctgatcgtcccgaaggactccgccggccgcctcaccgaaccgacgacgctcgtccgcgacgcgcaccgcgcgggcttgatcctgcacccctacaccatgcgcaacgagaaccccttcctgcccgcggagttccgtcagggcagtgaccccgacgcctacggcgacgtcttcggtgccttccggacgtacttcgccaccggaatcgacggcgtcttcaccgacaatccggacacgggtgtgctggcccgcgaggacttcgtcaacggctga

SEQ ID NO: 77534 - protein, 392 aa, Streptomyces coelicolor A3(2)
MGTQESDERAGGGTGRRALLGAAVLGAGGAVLGLPGTARAAGTRHGGGHGGGVGSLPVPTVIGHRGASGYRPEHTFGSYELALDLGADIVEAGDLVPTKDGHLVCRHEPEIGGTTDVADHREFADRKRTKLLDGVSTTGWFTEDFTLAELKTLRATERIPANRPHNTLYDGRWEIPTFEEVLRWQNEQTRRRGKQVWIYPELKHPTYFRKLGLGTEERLARLLRKYGKDRKNSPVIIQSFEPTSIQRMNKLVGNPLAVLLSGANSRPWDFVETGDPRTTADLVTPEGLKEIASYAQGIGPTLDLIVPKDSAGRLTEPTTLVRDAHRAGLILHPYTMRNENPFLPAEFRQGSDPDAYGDVFGAFRTYFATGIDGVFTDNPDTGVLAREDFVNG

SEQ ID NO: 77535 - DNA, 1119 bp, Pseudomonas syringae pv. tomato str. DC3000
  CDS (1)..(1119): transl_table=11
ttgaaaaagaccctcctggccgcggcggtcatgtcgggcctgatgctgtcatccggtatggcagcggcggcggatgcgccgggcaaggtgttgagcgagaaatacggcctgccctggcccgccgcgatcgcccatcgcggtgcctcgtttgacgcaccggaagaaaccatcccggcctataccctggcgcgggatctgggcgcggattatctggagatggacatccagcgcaccaaggatggcgtgctgattgcgctgcacgacgacgtgctggaacgcaccaccaacatcgcccaagtgttccccacgcgggtcaaggatccggtcagcaccttcacgctggcagaactcaaacagctggacgcaggctcgtggttcaacaaggcctatccggaccgcgcgcgcgacagctacaacggcttgcagattctgaccctggacgaagtcatcgacatcgccgagggcggcgccaacaagccgggtctgtacatcgaaaccaaggtgccgaacaagtttcccggcgttgaagccgacctgaaaaaagtgctggccaagcgcggttggcttactcagcggcccgctgctgctgccgggcatgtcaacgtcgcgcacatgccggggcgcgtcgtgttgcagaccttcgagaaacagagcctggaactgctgcaaaaagaaatgccgcaggtgcccaaggtgctgttgctgtggattggcgaagggtcgatagagcctaaatccagcgtcgcgttcaaggactcgggggccaaggacaaggccagctattatgcagcgcaggaggtcaagtcgccggaggaattccagaagtggattgactgggccaaagcccatggcgcgatcggcaccggcccttcgtcgcaattggcccagggcggcgaccagagctacatggacctggtcaaaccctggatgaacaacctgacgcatgaaaaaggcatggtcatccacccgtataccgtggacgacgcggcggacttcaagcgcatccgcaatgacggtgtcgatggcttcttcactaaccgcaccgctgaactgttgaagttctatgatcggcccgcgaaagaaagcatcgatgccattctcaagcgtaacggctactga

SEQ ID NO: 77536 - protein, 372 aa, Pseudomonas syringae pv. tomato str. DC3000
MKKTLLAAAVMSGLMLSSGMAAAADAPGKVLSEKYGLPWPAAIAHRGASFDAPEETIPAYTLARDLGADYLEMDIQRTKDGVLIALHDDVLERTTNIAQVFPTRVKDPVSTFTLAELKQLDAGSWFNKAYPDRARDSYNGLQILTLDEVIDIAEGGANKPGLYIETKVPNKFPGVEADLKKVLAKRGWLTQRPAAAAGHVNVAHMPGRVVLQTFEKQSLELLQKEMPQVPKVLLLWIGEGSIEPKSSVAFKDSGAKDKASYYAAQEVKSPEEFQKWIDWAKAHGAIGTGPSSQLAQGGDQSYMDLVKPWMNNLTHEKGMVIHPYTVDDAADFKRIRNDGVDGFFTNRTAELLKFYDRPAKESIDAILKRNGY

SEQ ID NO: 77537 - DNA, 1056 bp, Vibrio parahaemolyticus RIMD 2210633
  CDS (1)..(1056): transl_table=11
atgaaaaccaagtcagtatgtctcacatttttagcgcttagcctatctgctggcgcaattgcaaagccgcttgttatcgctcaccgcggcgcttctggttatttaccggagcacactttagaagccaaagctttggcttatgcaatgaagccagattacatcgagcaagatgtcgtgatgacgaaagacgatcagttagtggtgttgcatgaccattacttggatcgcgtcacggatgtagcggagcgttttcctcatcgcgcacgcgaagatggtcgttattacgcgattgactttactctggctgaaatcaaatctctgcgagtcaccgaagggttcaatatcgacgaaaacggcaaaaaagtcgccggttatccaactcgattcccaatgtggaaatctgatttcactgtaccgacgtttgctgaagagattgaactgatccaaggccttaacaagacgttgggttacgacatcggtatttacccagaaattaaagcgccttggttccatcgtcacgaaggtaaggacatttctaaagcggcgcttaaagtcttgaagcagtacggttacgactcgcaagacgacaaagtctacctgcagtgttttgatgcgaatgaactgcaacgcattaacagtgagttgatgcccgcaatggacatggatttaaagctcgttcagctcatggcttacaccgattggaacgaaactatggtgtacaaaggcgataccgcaatgccatacagctatgattggatgttcgaagccgacggcatgaagaaagtggcgagttacgccgaaggtattggaccttggaagccgatgctggtggatgataagtccaccaaagacaatatcatcatcaagccgttgatgaaggctgcaaaagacgccggcttacaagttcatccatacacgttccgtgccgatccaggacgcattcctgcgtacacggacagctttgaaggcatgatggatgtgtactacaaccaagtgaaagtggatggtttgtttactgacttcccagataaagcagtcagttttttaaatcagtaa

SEQ ID NO: 77538 - protein, 351 aa, Vibrio parahaemolyticus RIMD 2210633
MKTKSVCLTFLALSLSAGAIAKPLVIAHRGASGYLPEHTLEAKALAYAMKPDYIEQDVVMTKDDQLVVLHDHYLDRVTDVAERFPHRAREDGRYYAIDFTLAEIKSLRVTEGFNIDENGKKVAGYPTRFPMWKSDFTVPTFAEEIELIQGLNKTLGYDIGIYPEIKAPWFHRHEGKDISKAALKVLKQYGYDSQDDKVYLQCFDANELQRINSELMPAMDMDLKLVQLMAYTDWNETMVYKGDTAMPYSYDWMFEADGMKKVASYAEGIGPWKPMLVDDKSTKDNIIIKPLMKAAKDAGLQVHPYTFRADPGRIPAYTDSFEGMMDVYYNQVKVDGLFTDFPDKAVSFLNQ

SEQ ID NO: 77539 - DNA, 1182 bp, Streptomyces avermitilis MA-4680
  CDS (1)..(1182)
atggggacgcaggaaacacgacggacacagcggtcggacgagccggggcgggggaccgggcggcgggcgctgctgggggccgcggtgctcggcgcgggcggagcggtcctcggactgcccgccgcggcgagagcggacgagcggcacgggggcggcggctaccggagtctgccgaagccgaccgtcatcggtcaccgcggggccagcggctaccggccggaacacaccttcggctcctacgagctggccctcgacctgggtgcgcacgtcgtcgaggccggcgatctggtgcccaccaaggacggccatctcgtatgccgtcacgagccggaaatcggcgggaccaccgatgtctcggcgcaccccgagttcgccgaccgcaggaccaccaagaccctcgacggggtcgccaccaccggctggttcaccgaggacttcacgctcgccgagctgaagaccctgcgcgccgtcgagcgcatccccgccacccgccagcgcaacacgatctacaacggccgctgggagatccccaccttcgaagaggtgctccggtggcaggacgagcagacccgcaagcgcggcaggcaggtgtggatctaccccgagaccaagcaccccacctacttccgcaagctgggcctcggcctggaggagcgggtcgccaagctgctgcgcaagtacggcaaggacaagaagaactcgcccgtcatcatccagtccttcgagccgagcagcatccagcgtctgaacaaactggtcggcaacccgctcgtcgtgctgctgtccgccgcgaacacccgcccctgggacttcgtcgaggcgggcgacccgcgcaccgtcgccgacctcgtcaagcccgagggcctggcgtggatcgcctcgtacgcgcagggcatcgggccgacgctcgacctggtcatcccgaaggacgcgagcggcaacctcaccacgccgaccacgctcgtcgccgacgcgcacgacgcgggcctgatcctgcacccgtacaccatgcgcaacgagaacaccttcctgccgaccaacttcaagaagggcaccgacgcgaacgcctacggcgatgtcttcggcgccttcaagacgtacttcgggacgggcatcgacggggtcttctcggacaacgcggacaccgcgctcctggcccgcgcggacttcctgaacggctga

SEQ ID NO: 77540 - protein, 393 aa, Streptomyces avermitilis MA-4680
MGTQETRRTQRSDEPGRGTGRRALLGAAVLGAGGAVLGLPAAARADERHGGGGYRSLPKPTVIGHRGASGYRPEHTFGSYELALDLGAHVVEAGDLVPTKDGHLVCRHEPEIGGTTDVSAHPEFADRRTTKTLDGVATTGWFTEDFTLAELKTLRAVERIPATRQRNTIYNGRWEIPTFEEVLRWQDEQTRKRGRQVWIYPETKHPTYFRKLGLGLEERVAKLLRKYGKDKKNSPVIIQSFEPSSIQRLNKLVGNPLVVLLSAANTRPWDFVEAGDPRTVADLVKPEGLAWIASYAQGIGPTLDLVIPKDASGNLTTPTTLVADAHDAGLILHPYTMRNENTFLPTNFKKGTDANAYGDVFGAFKTYFGTGIDGVFSDNADTALLARADFLNG

SEQ ID NO: 77541 - DNA, 1176 bp, Oryza sativa (japonica cultivar-group)
  CDS (1)..(1176)
atgcggccttcgctccgtactatctattttcttcttttgctacttccacatgtggttttttctagaccactctttccactaccaagcaagagtaatggaatagagaagagacccttacaaacttttcgaccatataacattgctcaccgtggctcaaatggggaaattcctgaggaaacagctgctgcttacctgagggctattgaagaaggtgcggattttatagaaacggacatccttgctagcaaagatggggccttgatctgctttcatgatgtaacactggatgctacaactgacgttgccagccgcaaggagttttccaatagaagaagaacctacgaggtggaatggttcaacgctactggctggtttgtagtggacttcacacttgaggaacttaaaacactgaaagtcaatcagcgatacccattcagagaccaacaatacaatggcaagttttcaattatcacatttgaagaattcatttctattgccttggatgcaagcagaactgtcggaatatacccagagatgaaagatccagtttttatcaacaagcatgtcaagtgggatggtgggaagaagtttgaggacaaatttgtggataccttactgaagtatggatataaaggccaatatatgtcagaaaattggctgaagcagccgttgtttatacaatcttttgctcctacttcccttgtacatgcatcaaagttgacagactctcccaagatattcctgattgacgatttctcagtgagaacacaagatacaaaccagtcatactgggacatcacttctgatgactacctagcatatattagtaactatgttgttggccttggtccatggaaagatacggttgttccagcagccaaaaactatacgatggcaccgactgatcttgttgcaagagcacatgctcataatcttcaggtacacccgtacacatacaggaacgagaaccaattcctgcacctcaacttccatcaggacccttatgctgagtatgatttctggataaacagcatgggggtcgatggattgttcactgatttcactggatccctgcaccgttaccaggaactggtagctccacatgcgaaggatgaaactgcaaacagcctcctagtaaaaattgctcaaatgatctcccaatatgaaggtttctga

SEQ ID NO: 77542 - protein, 391 aa, Oryza sativa (japonica cultivar-group)
MRPSLRTIYFLLLLLPHVVFSRPLFPLPSKSNGIEKRPLQTFRPYNIAHRGSNGEIPEETAAAYLRAIEEGADFIETDILASKDGALICFHDVTLDATTDVASRKEFSNRRRTYEVEWFNATGWFVVDFTLEELKTLKVNQRYPFRDQQYNGKFSIITFEEFISIALDASRTVGIYPEMKDPVFINKHVKWDGGKKFEDKFVDTLLKYGYKGQYMSENWLKQPLFIQSFAPTSLVHASKLTDSPKIFLIDDFSVRTQDTNQSYWDITSDDYLAYISNYVVGLGPWKDTVVPAAKNYTMAPTDLVARAHAHNLQVHPYTYRNENQFLHLNFHQDPYAEYDFWINSMGVDGLFTDFTGSLHRYQELVAPHAKDETANSLLVKIAQMISQYEGF

SEQ ID NO: 77543 - DNA, 1146 bp, Oryza sativa (japonica cultivar-group)
  CDS (1)..(1146)
atggcctctccgtgtacgtgcaaccctcgaacgttctccggcgacgggtggcgatggtggtgcttgtctggtgcgcggcgagcggcggcgcggccgttggtcggtggaggaggagcgggggggacgccgaaggcgccgctgcagacgtcgcggccgttcaacatcgcgcaccgggggtcgaacggcgagctccccgaggagacggcggcggcgtacatgcgcgccatcgacgagggcgccgacttcatcgaggccgacgtgacggcgaccaaggacggccacctcgtctgcttccacgacaccaccctcgacgccaccaccgacgtcgccgaccaccccgagttcgcctcccgccgtcgcaccctcgaggtccagtggaccaacgtcaccggcttcttcatcaccgatttcaccctggccgagctcaagacgctgagatccaagcagaggtacgcgttccgggacaggtcctacaacggcggcgagtcgtcgcggatcatcacgttcgacgagttcatcgacaccgcggctggcgcggcgtcgagggtggtgggcatctacccggagatcaagaacccggtgttcgtcaaccggcaggtgcggtggcgcgacggcaagaagttcgaggacaagttcgtggcggcgctcaagcgtcgcggctacggcggccggtacatgtcgccggcgtgggcggcgcggccggtgttcatccagtcgttcgccccgacgtcgctcgtctacgccgccggcctcaccgactcccccatggtgctcctcgtcgacgacaccacggtgcgcaccgaggacacgagccagtcctacgacgaggtgacctcggacgaacacctcgactacatgagggagtacgtcgtcggcgtcgggccgtggaaggatacggtggtgccgccgacgacggacaacaagctggcggcgccgacggacctcgtcgcaagggcgcacgccaggggcttgcaggtgcacccctacacgtaccggaacgagaaccagttcctgcacttcaacttccggcaggatccgtacgccgagtacgactactggatcaacgacgtcggtgacctcttcaccgactttccggcgagcctccgccgctaccaggagtggaccaccgccgggaggaagggctga

SEQ ID NO: 77544 - protein, 381 aa, Oryza sativa (japonica cultivar-group)
MASPCTCNPRTFSGDGWRWWCLSGARRAAARPLVGGGGAGGTPKAPLQTSRPFNIAHRGSNGELPEETAAAYMRAIDEGADFIEADVTATKDGHLVCFHDTTLDATTDVADHPEFASRRRTLEVQWTNVTGFFITDFTLAELKTLRSKQRYAFRDRSYNGGESSRIITFDEFIDTAAGAASRVVGIYPEIKNPVFVNRQVRWRDGKKFEDKFVAALKRRGYGGRYMSPAWAARPVFIQSFAPTSLVYAAGLTDSPMVLLVDDTTVRTEDTSQSYDEVTSDEHLDYMREYVVGVGPWKDTVVPPTTDNKLAAPTDLVARAHARGLQVHPYTYRNENQFLHFNFRQDPYAEYDYWINDVGDLFTDFPASLRRYQEWTTAGRKG

SEQ ID NO: 77545 - DNA, 864 bp, Bacillus thuringiensis serovar konkukian str. 97-27
  CDS (1)..(864): transl_table=11
atgaaaaagatatatatcgttacaatcatttgcacctttatagtactaggtacttttatttttcataaagtaaatgaacttaagtacacgaaagctattaatcaatcaaatcatataaaaaacattgcacatagaggggcttctgcgtatgcgcctgaacatacaatagcagcatataaattgggacaacaattaaaaggcgattatatagaaatagatcttcaaatgacaaaagatggacatttagtagctatgcatgatgaaacagtaaatcgtactacaaatggtacagggctagttaaggaacatacattagaggaattaaagcaattaaatgcaggttctacttacaataaaaagtatccaaatttagcaaagaaagaatatgaaaatgctaaagttccaacactagaagaagtaattgaagtgtttgggcatgacgcgaactattatattgaaaccaaatcacctgatgaatatccaggaatggaagaaaagttattagaaattatcaatcactatgaaatacaggataaagttattattcaatcatttagtgaagaaagtttgcaaaagctacatagtttacatgttaatatacctctagtccaattactatcttacaaaaaggcagttcaattaactgaatcagagataaaaaagtataaaacatactgcatcggtcttggtatgaactacaaatatattgatgcagcttatgtaaagagaataaagaaacatggattagaagttcatccatttactgtagataatgaaacagacatgaaaaagctaattttatggggcgttgacgggatgtttacgaattatccggatcgattatattcattattaaagtcttaa

SEQ ID NO: 77546 - protein, 287 aa, Bacillus thuringiensis serovar konkukian str. 97-27
MKKIYIVTIICTFIVLGTFIFHKVNELKYTKAINQSNHIKNIAHRGASAYAPEHTIAAYKLGQQLKGDYIEIDLQMTKDGHLVAMHDETVNRTTNGTGLVKEHTLEELKQLNAGSTYNKKYPNLAKKEYENAKVPTLEEVIEVFGHDANYYIETKSPDEYPGMEEKLLEIINHYEIQDKVIIQSFSEESLQKLHSLHVNIPLVQLLSYKKAVQLTESEIKKYKTYCIGLGMNYKYIDAAYVKRIKKHGLEVHPFTVDNETDMKKLILWGVDGMFTNYPDRLYSLLKS

SEQ ID NO: 77547 - DNA, 930 bp, Staphylococcus aureus subsp. aureus MRSA252
  CDS (1)..(930): transl_table=11
atgactaactcttcgaaaagcttcactaaatttatggctgcttctgctgtttttactatgggatttttatcagtacctactgctggcgctgaacaaactaatcatattgcaaataaacctcaggctattcaatggcatacaaatttaacgaatgagcgattcactactatcgcacatcgtggcgcaagtggctatgcacccgagcatacgtttcaagcatatgataagagtcataatgagttaaaagcatcgtatatcgaaattgatttacaacgtaccaaagatggccatttagttgctatgcatgatgaaaatgttaaccgtacaacaaatggacacggtaaagttgaggattatacccttgatgaattaaaacagttagatgcaggaagttggtttaataaaaaatatccaaaatacgcaagagcaagttataaaaatgctaaagtacccactttagatgaaattttagaacgttatggtccaaatgcaaactattatattgaaacaaagtcacctgatgtatacccaggaatggaagaacaattattagcttcattgaaaaagcatcaccttttaaataaaaataaattaaaaaatggacatgtaatgattcaatcattttctgacgaaagtttaaagaaaattcatcgtcaaaataagcatgtgccattagtaaaattagttgataaaggtgaactacaacaatttaacgaccaacgcttaaaagagatacgctcttatgcgattggattaggtcctgattatacagatttaactgaacaaaatacccatcatttaaaagacttaggatttatagtacatccttatacagtgaatgaaaaagctgatatgttacgattaaataaatacggcgttgatggtgtctttacaaatttcgctgataaatataaagaagtcattaaatag

SEQ ID NO: 77548 - protein, 309 aa, Staphylococcus aureus subsp. aureus MRSA252
MTNSSKSFTKFMAASAVFTMGFLSVPTAGAEQTNHIANKPQAIQWHTNLTNERFTTIAHRGASGYAPEHTFQAYDKSHNELKASYIEIDLQRTKDGHLVAMHDENVNRTTNGHGKVEDYTLDELKQLDAGSWFNKKYPKYARASYKNAKVPTLDEILERYGPNANYYIETKSPDVYPGMEEQLLASLKKHHLLNKNKLKNGHVMIQSFSDESLKKIHRQNKHVPLVKLVDKGELQQFNDQRLKEIRSYAIGLGPDYTDLTEQNTHHLKDLGFIVHPYTVNEKADMLRLNKYGVDGVFTNFADKYKEVIK

SEQ ID NO: 77549 - DNA, 1086 bp, Erwinia carotovora subsp. atroseptica SCRI1043
  CDS (1)..(1086)
atgaacgttaccgtaacatctttgatctccgcccttgcgctctccgtttcctttagtgtttctagtcactcaaatgtttccgcttcatcaaccgataaaatcgtcattgcccaccgcggtgccagtggctatctgcccgagcatacgcttccggcgaaggcgatggcctacgctcagggtgtcgattatctggaacaggatctggtactcaccaaagacaatgcgcttattgtcctgcacgatcactatctggatcgcgttaccgatgtggcagagcgtttccctcaacgcgcccgtaaagatggacgcttttacgctatcgactttacgctgaaagagatcaaatcactgaaattcaccgaagggttcgacatcaaaaacggcaagcaggtacagagctacccaaaccgtttcccgatgtggaaatccgacttccgcattcatacctttcaggaagagattgaatttattcagggtctgaaccactcaaccggcaagaacattggtctctatcctgaaatcaaagcaccgtggtttcaccatcaggaagggaaagacatcgcccgcgaaacgctgaccgtgctgaagcagtatggctatacggagaaaagcgatagggtcttcctgcaatcgtttgatgttgcagagttaaagcgtatcaaaaccgaattgcagccgcagatgaagatggatctgaagctgattcaactgatcgcctataccgactggcatgaaacctacgaaaaacaggccgatgggtcgtgggcgaattataactacgactggatgcaaaagcccggtgcgatgaaacagattgcgacctatgccgacggtatcggcccggactaccacatgctcgttcagaaagattcgacgcctgacagcatcatctttaccaatatggtgaaggaagcgcatcaacataaacttcaggtgcacccgtttacggcaagagccgacaggctaccgacgtacgccaaagatatcgatcaactctatgacattctctaccatcaagcggacgttgacggcctgttcaccgattttcccgacaaagcagtcgattttctgaaaaagccgcgctga

SEQ ID NO: 77550 - protein, 361 aa, Erwinia carotovora subsp. atroseptica SCRI1043
MNVTVTSLISALALSVSFSVSSHSNVSASSTDKIVIAHRGASGYLPEHTLPAKAMAYAQGVDYLEQDLVLTKDNALIVLHDHYLDRVTDVAERFPQRARKDGRFYAIDFTLKEIKSLKFTEGFDIKNGKQVQSYPNRFPMWKSDFRIHTFQEEIEFIQGLNHSTGKNIGLYPEIKAPWFHHQEGKDIARETLTVLKQYGYTEKSDRVFLQSFDVAELKRIKTELQPQMKMDLKLIQLIAYTDWHETYEKQADGSWANYNYDWMQKPGAMKQIATYADGIGPDYHMLVQKDSTPDSIIFTNMVKEAHQHKLQVHPFTARADRLPTYAKDIDQLYDILYHQADVDGLFTDFPDKAVDFLKKPR

SEQ ID NO: 77551 - DNA, 1095 bp, Desulfotalea psychrophila LSv54
  CDS (1)..(1095): transl_table=11
atgctttgtcgtctcattttcacagcccttcttatcctcctctgccatcaacctctactggccgcagaaacccaccaggacagcagccagaccggccaagctgaaccaagaaagagagttattatcagcacagccaccgagaataatctgcttggatcaatctccgaggcaagcattgccctgatggcaatgcaggagagtgattatatcagacttccactgactctgagtgccgacaatcaactgattgtggcaaataatattagcctgtcagaaaccaatgccaaagccctctttccacaaaagacgcaggacggcaacttctatatcaacgacttcaccgtccaggaacttcgccaactctccttctcaggagagaacagaggcgtggtgcttggcacaaccctggaaagagccctcaccattgtcgaggctgtgtcccaaaaacagaagaggcagatgggtatctcccttgaaccgcgcaaaccctggttttacagaagcaagggcaaggatatctgcgcctcccttatcgaaagcctcagccagtacgatttagcggggagcagaatcatgatccaatcctatgatcccgatgagttggaacggatcaaaaaggaacttctaccccgctatcaactgaatgtgcccctcatcctcctcatgggcgtcaatggtggtgaggaagccaaggagtatgactttggggcgtggaaagcatacaactatgactggctcttcaccagtactggcctgcgcttcatcgcctcctttgccgaaggaatcgcctttgatcagggccaactcttaaacggcaaaaggcaactgctcaactattgtaaacggggcagcacctatggccttcacctctttgccatggaaggcggcgatgagctcaaggaatacctcgaaagcgaacagaaccaaaaattatttgacggtatctataccaatagacctgaccagtacaaatcccccagacaatcagaagaggaacagatttctcctgccacctctggagatcaaaccagccctacaatcgtttcttcacagctctatatcccatcaaccccagcatcggaagaaaagctatga

SEQ ID NO: 77552 - protein, 364 aa, Desulfotalea psychrophila LSv54
MLCRLIFTALLILLCHQPLLAAETHQDSSQTGQAEPRKRVIISTATENNLLGSISEASIALMAMQESDYIRLPLTLSADNQLIVANNISLSETNAKALFPQKTQDGNFYINDFTVQELRQLSFSGENRGVVLGTTLERALTIVEAVSQKQKRQMGISLEPRKPWFYRSKGKDICASLIESLSQYDLAGSRIMIQSYDPDELERIKKELLPRYQLNVPLILLMGVNGGEEAKEYDFGAWKAYNYDWLFTSTGLRFIASFAEGIAFDQGQLLNGKRQLLNYCKRGSTYGLHLFAMEGGDELKEYLESEQNQKLFDGIYTNRPDQYKSPRQSEEEQISPATSGDQTSPTIVSSQLYIPSTPASEEKL

SEQ ID NO: 77553 - DNA, 846 bp, Symbiobacterium thermophilum IAM 14863
  CDS (1)..(846): transl_table=11
gtgcgggcgctcaccatccggccgttgcccgaccggcccttcacggctccccggcccgtggtgctggcgcaccagggagcgtcgggccatgcgccctccaacaccatggaggccttccggctggccctggagcagggggcggacatcctggagctggacgtgcacatgacccgggacggcgtggtggtggtcagccacgacgagaccatcgaccggatgagcgacgggaccgggctgatcaaggagatgaccctggccgagctgcgccggtacgacttcggctaccgcttcacgccggacggcgggctgacttatccctaccggggcaagggcgtcacgatcccgaccctggaggaggtcttgcaggccttcccggaggtgcccgtgaacatcgagatcaagcaggccgacccgccgatggaggcgcagctctgggagctgatccagcgctacggggcggaggaccgggtgctggtcgcctcgttccacggcaccgtggcgaagcggtggcgcgacctggccggcgaccgggtggccacctcggccccggtggaacacatgtacctggtggcggcgcactacctgtcccacctcgaccggctgtacgcccccgcccacgacgccttccaggtgccggtggcccagaaggcggggccgctcacggtgcggttcgacaccgaacggttcctgcggatggccgagcgggtaaacgtggccgttcactactggacgatcaacgacgaggacgagatgcggcggctgtaccagctgggcgcccacggcatcatcaccgactaccccgaccgggcggtgaaggtgctgagggagctggggctgcgggactag

SEQ ID NO: 77554 - protein, 281 aa, Symbiobacterium thermophilum IAM 14863
MRALTIRPLPDRPFTAPRPVVLAHQGASGHAPSNTMEAFRLALEQGADILELDVHMTRDGVVVVSHDETIDRMSDGTGLIKEMTLAELRRYDFGYRFTPDGGLTYPYRGKGVTIPTLEEVLQAFPEVPVNIEIKQADPPMEAQLWELIQRYGAEDRVLVASFHGTVAKRWRDLAGDRVATSAPVEHMYLVAAHYLSHLDRLYAPAHDAFQVPVAQKAGPLTVRFDTERFLRMAERVNVAVHYWTINDEDEMRRLYQLGAHGIITDYPDRAVKVLRELGLRD

SEQ ID NO: 77555 - DNA, 1107 bp, Mannheimia succiniciproducens MBEL55E
  CDS (1)..(1107): transl_table=11
atgaaacataaactaaaaacccttgcgatcggcttagcatttgcaaccttagcagcttgctccagtcaaaccgcacaacaaacaacgcctatgaacaatcaggaaaaattagtcattgcccaccgcggcgcaagcggttatttaccggaacatacattggaaagtaaagccttggcgtttgctcaacaggcggattacttagaacaagatttagccatgaccaaagacaaccatttgattgtgatccacgatcatttcctggacggcttaaccgatgtggctaaaaaattcccgaatcgtcaccgtaaagacgggcgttattatgtggcggatttcacattaaaagaaatcaaatccctcgaaatgacagaaaatttcaaaacggaaaacggcaaacaggtgcaggtttatccgaaccgcttccctatgtggaaatcccatttcactattcacacgtttgaagaagaacttgaatttattcagggtttagaaaaatccaccggcaaaaaagtggggatttatccggaaataaaagcaccttggttacatcatcaggaaggcaaagatattgccgtcgctactttaaaagtattacaaaaatacggctacaccaagaaaacggatcccgtttatctgcaaaccttcgattttaatgagctgaaacggattaaaaccgacttgctccctaaaatgggtatggatgtaaaactcgttcaattggttgcctataccgactggcatgaaaccgaagaaaaaaatgcacagggcaaatgggtaaactacgattatgactggatgtttaaagacggtgcgatggctgaagtcgctaaatatgccgacggtgtcggaccgggttggtatatgttaatcgacgataaaaactctaaagccggcgatataaaatatacaccgatggtagcggatattgcgaaaacgaaaatggaacttcatccttacacggtccgtaaagacgcattaccggcattctttaccgatgtaaaccaaatgtatgacgcattatataaccatgcgggcgcaaccggcttatttacggacttccccgatttagccgtgaagtttctaggtaaagataaaaataaacaataa

SEQ ID NO: 77556 - protein, 368 aa, Mannheimia succiniciproducens MBEL55E
MKHKLKTLAIGLAFATLAACSSQTAQQTTPMNNQEKLVIAHRGASGYLPEHTLESKALAFAQQADYLEQDLAMTKDNHLIVIHDHFLDGLTDVAKKFPNRHRKDGRYYVADFTLKEIKSLEMTENFKTENGKQVQVYPNRFPMWKSHFTIHTFEEELEFIQGLEKSTGKKVGIYPEIKAPWLHHQEGKDIAVATLKVLQKYGYTKKTDPVYLQTFDFNELKRIKTDLLPKMGMDVKLVQLVAYTDWHETEEKNAQGKWVNYDYDWMFKDGAMAEVAKYADGVGPGWYMLIDDKNSKAGDIKYTPMVADIAKTKMELHPYTVRKDALPAFFTDVNQMYDALYNHAGATGLFTDFPDLAVKFLGKDKNKQ

SEQ ID NO: 77557 - DNA, 861 bp, Bacillus licheniformis ATCC 14580
  CDS (1)..(861): transl_table=11
gtgtcagctttattcaaaaaattgatgttatcttcattgatcggggtttccatcgggtcagcgctgtttgcaccgaatgcgggtgcacaagagccggcggtgaagcctaaaaaagtggatgtcattgcacacagaggcgcttcgggatatgcgccggaaaacacgatggctgcttttgataaagcgcttcagatgaaagcagattatatcgagctggatgttcaaatgtccaaagacggggagcttgtcatcattcacgatacgaccgtaaaccgtacgacagatattgactcagtgctgccggttgccgtaaaggatttgacgcttgccgagctgcgcaagcttgatgccggcagcttcttcggtccgcagttcgcaggagagcgcattccgacatttgaagaagtgcttgaccggtataaagggaaggtcggaatgctgatcgaattgaaagagcctgcacgctatccgggaatcgaaggaaaagtgtcagcagcattgaaagagcggagaatggataagcctaaaaacggaaaaatcattgtacaatcgtttgattttaactctgtctataaaattcatcagctgcttccatcgatgccgacaggtgtcttgacgtcaaaagcggcggacttaacagatgcaaagcttaaggaattttccggctatgccaaatacgtgaacgccaacttgaaaaatgtggccgctgatcctacgcttgtgccgagaattcatgcgctcggcatgaagattacgccttggaccgtccgctcccgcgatgaagtgcctccgctattaaaggccggcgtggacgggattgtgacagactttcccgactatgttccgaaaaaagtacggtag

SEQ ID NO: 77558 - protein, 286 aa, Bacillus licheniformis ATCC 14580
MSALFKKLMLSSLIGVSIGSALFAPNAGAQEPAVKPKKVDVIAHRGASGYAPENTMAAFDKALQMKADYIELDVQMSKDGELVIIHDTTVNRTTDIDSVLPVAVKDLTLAELRKLDAGSFFGPQFAGERIPTFEEVLDRYKGKVGMLIELKEPARYPGIEGKVSAALKERRMDKPKNGKIIVQSFDFNSVYKIHQLLPSMPTGVLTSKAADLTDAKLKEFSGYAKYVNANLKNVAADPTLVPRIHALGMKITPWTVRSRDEVPPLLKAGVDGIVTDFPDYVPKKVR

SEQ ID NO: 77559 - DNA, 894 bp, Bacillus licheniformis ATCC 14580
  CDS (1)..(894): transl_table=11
atgaaaagactagtccgcagcatcttccttataacggccgcaatcgctgcttttggttttggattcagcgggcatgcggaggcggcaagccattcccagccgcagctcaatccgaacaagctactaaatgtcgcgcaccgcggcgcatcggggcatgctcccgagcacacgcttttggcttataagcttggacaaaaaatgaaaggcgattacatagaaatcgatcttcaaatgacaaaagacggccacttggtcgccatgcacgatgagacattggatcgtacgactaatggtacgggttttgtcaaagactatacgctgaaagaaatcaaagagcttgatgcaggctcctggtttaacgaagcatatcctgagcgggcaaaaccggagtacgccgggctgaaagtgcccacccttgaagaaatcatccaaacattcgggagaagcgcgcgctactatatcgaaacaaaatcaccggaagactatgatcatatggaagaaaagctcctggacatcctgaagcaatacaaattgaccggagcagacattcattcaagcaaagtcatcattcaatcttttagtcctgaaagcttaaaaatcattcataacgctaatccaaacattccgctagtgcaattattatggtacgacaaacctgctgccattactgacgccgaattaaaacaatatcaatcttacagcgtcggactcggcatgaactttgaccgcattggccgggcatacgtgcaaaagattcgacgcaccggcatgctggtccatccttatactgtgaataaaaaagaagatatgaagcggctgctcgattggggagcgaccggaatgttcaccaactttccggaccggctgcgcgatgttttgcgcgaaaagaagtaa

SEQ ID NO: 77560 - protein, 297 aa, Bacillus licheniformis ATCC 14580
MKRLVRSIFLITAAIAAFGFGFSGHAEAASHSQPQLNPNKLLNVAHRGASGHAPEHTLLAYKLGQKMKGDYIEIDLQMTKDGHLVAMHDETLDRTTNGTGFVKDYTLKEIKELDAGSWFNEAYPERAKPEYAGLKVPTLEEIIQTFGRSARYYIETKSPEDYDHMEEKLLDILKQYKLTGADIHSSKVIIQSFSPESLKIIHNANPNIPLVQLLWYDKPAAITDAELKQYQSYSVGLGMNFDRIGRAYVQKIRRTGMLVHPYTVNKKEDMKRLLDWGATGMFTNFPDRLRDVLREKK

SEQ ID NO: 77561 - DNA, 1137 bp, Burkholderia pseudomallei K96243
  CDS (1)..(1137): transl_table=11
atgtttctcaagcgctcgttcgctttctcccctgtcgcgctcgcgtgcgcggcgacactcgcgctcgccgcctgcggcggcgacgaccccgactacacgcagccgatctccgcgaaggtgcaggtggtgggccaccgcggcgcgagcgcgttgcgccccgagcacacgctcgcgtcgtaccgcaaggcgatcgaggacggcgcggacgtgatcgaaccggacctcgtcgcgacgcgagacggcgtgctcgtcgcgcgccacgagaacgagatctcgggcacgacgaacgtatcgacgctgccgcagttcgcgagccgcaagacgacgaagacgatcgacggcgcgcagctcaccggctggttcaccgaggatttcacgctcgccgaactgaagacgctgcgcgcgcgcgagcgcatcccgcagatccgtcccgcgaacaccgcgtacgacgatcagttcgagatcccgacgttcgacgagatcgtcgcgctcgcgaaacagatgtccgcgcaggtcggccgcacgatccacctctatccggaaacgaagcacccgacctacttccagtcgatcggcctgccgctcgaggatcgcctcgtcgacgcgctgcgcaaggccccctacaccgcgcgcaacgcgaccgtctacattcagtcgttcgaagtcgcgaacctgaaggcgatccgcgcgcggatcggcgcgagccagccgaactggaagctcgtgcaactgatggacgagccgaagcagcgcccgtacgatttcgtgaaggcgggcgacgcgcgcacgtacggcgacctgtcgacgcaaggcggcatgcgcgagatcgcgacgtacgcgaacggcgtcggcccgtacaagacgtcgatcattccggtcggcccggacggctcgctgcagcagccgaccggctacgtacgcttcgcgcacgaggcggggctcaccgtacatccgtacacgttccggccggagaacaacttcctgccggcgtcgctgaaggacggcggcacgccgagcgcgcgccacacggcgggctcggtgcgcgaaatccaggcgtatctgcgcgcgggcatcgacggcttcttcaccgacgatcccgcggtcggccgcacggccgtcgacacgttccgccggtaa

SEQ ID NO: 77562 - protein, 378 aa, Burkholderia pseudomallei K96243
MFLKRSFAFSPVALACAATLALAACGGDDPDYTQPISAKVQVVGHRGASALRPEHTLASYRKAIEDGADVIEPDLVATRDGVLVARHENEISGTTNVSTLPQFASRKTTKTIDGAQLTGWFTEDFTLAELKTLRARERIPQIRPANTAYDDQFEIPTFDEIVALAKQMSAQVGRTIHLYPETKHPTYFQSIGLPLEDRLVDALRKAPYTARNATVYIQSFEVANLKAIRARIGASQPNWKLVQLMDEPKQRPYDFVKAGDARTYGDLSTQGGMREIATYANGVGPYKTSIIPVGPDGSLQQPTGYVRFAHEAGLTVHPYTFRPENNFLPASLKDGGTPSARHTAGSVREIQAYLRAGIDGFFTDDPAVGRTAVDTFRR

SEQ ID NO: 77563 - DNA, 1083 bp, Photobacterium profundum SS9
  CDS (1)..(1083): transl_table=11
atgaaaaagctatggcttaccgctgctgttagtagcaccttacttatgtccccattttttgctcactcagcttctgaaacagataaagtcgttgttgcccaccgtggcgcatcggggtatctgcctgaacacaccttggctgcaaaggcgatggcatatgctatgaagccagattatattgaacaagatgttgttatgacaaaagacaataaacttgtcgtactgcatgatcattatcttgatcgtgttacaaatgtcgcgcaaaagtttccagaacgagcacgtaatgatggtcgatattacgcgatagattttactcttgctgaaattaagcagttgagcgtaaccgaagggtttaatgtcgacaaagagggcaaacaggttcaaggtttccctgaacgttacccaatgtggaagtcagattttaaagtaccgacttttgaagaagaaattgaaatgatccaaggtttgaataaatcgttgggttatgacattggtatctatcctgaaattaaagcaccttggttccaccgtcatgaaggtaaagatatcagtaaagcggtattaaaagtgctgaaagagtacggttataccgataaaggcagcaatgtgtatctgcaaacatttgattttaatgagttaaaacgtattcatgaagaattgatgccagccatggatatggatctgaagctgatacagttaatggcgtacaccgattggaatgaaaccatggtgtatgacaagaaaggcaattcacagccttacagctatgattggatgtttgaaaaagaagggatgaagcaagtagcgaaatatgctgatggtatcggaccatggaagccaatggttgtatcagataaatcctctaaaggtaacattcaattaacagggttggttaaagcagcgcatgctgaaggcatgaaagtacatccgtacacgttccgtgcagaccaaggaagaattccaacttatgccaataactttgatgatatgttagatgttttttataatacagctaatgttgatggtgtattcactgattttccagacaaagccgtcaattatctcgcctctgaaaagtag

SEQ ID NO: 77564 - protein, 360 aa, Photobacterium profundum SS9
MKKLWLTAAVSSTLLMSPFFAHSASETDKVVVAHRGASGYLPEHTLAAKAMAYAMKPDYIEQDVVMTKDNKLVVLHDHYLDRVTNVAQKFPERARNDGRYYAIDFTLAEIKQLSVTEGFNVDKEGKQVQGFPERYPMWKSDFKVPTFEEEIEMIQGLNKSLGYDIGIYPEIKAPWFHRHEGKDISKAVLKVLKEYGYTDKGSNVYLQTFDFNELKRIHEELMPAMDMDLKLIQLMAYTDWNETMVYDKKGNSQPYSYDWMFEKEGMKQVAKYADGIGPWKPMVVSDKSSKGNIQLTGLVKAAHAEGMKVHPYTFRADQGRIPTYANNFDDMLDVFYNTANVDGVFTDFPDKAVNYLASEK

SEQ ID NO: 77565 - DNA, 888 bp, Geobacillus kaustophilus HTA426
  CDS (1)..(888): transl_table=11
atgtatatgcgccggatcacggtttttcgctcctatctttgcacattgtttttgttatcgttgccgatcgtcttagcggccgcggctgcctggcagccacccagccagccgaaaaccgccgtcatcgcccaccgcggcgcgtccggacacgcgccggagcatacgctctcatcctaccgcctcgccgccctcatgaatgccgattatatcgaagtcgatgtgcgcgcaacgaaagacgggaagctcgttgccctgcatgatgcgacgctcgcccggacgacaaatgccgaaacggtttacccgcaccggtcgccatggcgggtcagcgatttttcattgcgtgagctcaaaaaattggatgccggatcgtggttcgatccacgctttgccggcgagcgcatcccgacgcttgatgaggtgattcagatgctgaaagcggagcgtgtggaagccccgttgtacatcgaaacgaaacagcccggcatcgaacgggcggtcgtccatctattgaaaaaacacggtttcctgcaacagcgccgcgtcatgtttcaatcgttccacccggaaagcttgcaggcgctccgcccgctcatcccgcacggcattcggctcattcaattggtcggcgaaaaggaagcgcgaagtggccgcgacgagctgttgcaacaaatcgccgtctatgccgatggcatcggcttgccgctctcagccgtcaccgaagagtgggtgcgcgccgcccatggccgcgggctcatggttcacgtctataccgtcaatgaaccacacgatctcgctcgcctatgcgccatgggcgttgacggtgtgttcaccgattatccagaccgccctggccgcattgccgcctgccgtcgtttgccccgtcattga

SEQ ID NO: 77566 - protein, 295 aa, Geobacillus kaustophilus HTA426
MYMRRITVFRSYLCTLFLLSLPIVLAAAAAWQPPSQPKTAVIAHRGASGHAPEHTLSSYRLAALMNADYIEVDVRATKDGKLVALHDATLARTTNAETVYPHRSPWRVSDFSLRELKKLDAGSWFDPRFAGERIPTLDEVIQMLKAERVEAPLYIETKQPGIERAVVHLLKKHGFLQQRRVMFQSFHPESLQALRPLIPHGIRLIQLVGEKEARSGRDELLQQIAVYADGIGLPLSAVTEEWVRAAHGRGLMVHVYTVNEPHDLARLCAMGVDGVFTDYPDRPGRIAACRRLPRH

SEQ ID NO: 77567 - DNA, 729 bp, Geobacillus kaustophilus HTA426
  CDS (1)..(729): transl_table=11
atgacattgatttttgcccaccgcggggcggcggggacgcacccggaaaatacgatggcggcgtttatcgaggcggaaaaagcgggagcggacggcattgaattggatgtgcagctcacaaaagacggcgaagtggtcgtcattcatgacgaaacggtcgaccggacgacggacggcagcggctgggtgaaagacatcacgtaccgcgaactgcgccgattgaacgcggcggccatgtgggacggcaaacacggccattgtccgattccgcatcttgaggaagtgcttgcttggctgtcatcaacacggatggcggtcaacatcgagctgaaaaatagcctcatcgcctacgaaacgcttgagcaaaaaacgatctccctcgtgcgccgctatgggcttgagaagcggacgattttgtcatcgttcaatcatcatagcatgcgcctttgccgaacgcttgcaccggaaatcgagacggcgctcttgtacattgagccgctgtatgccccatggacgtatgtgcgtgccatgaacgccgacggggtgcatccgcactatcggacggtgacggcggaatttgccgccgaagcgcggcggcgcggggtggcggtccgcccgtttacggtaaataagcgaaatgtgatgaaaacgatgtttgcttatggcgttgacgccgtcttcaccgactacccgcgccaagcgaagcaatggaaagagaaaacgccttaa

SEQ ID NO: 77568 - protein, 242 aa, Geobacillus kaustophilus HTA426
MTLIFAHRGAAGTHPENTMAAFIEAEKAGADGIELDVQLTKDGEVVVIHDETVDRTTDGSGWVKDITYRELRRLNAAAMWDGKHGHCPIPHLEEVLAWLSSTRMAVNIELKNSLIAYETLEQKTISLVRRYGLEKRTILSSFNHHSMRLCRTLAPEIETALLYIEPLYAPWTYVRAMNADGVHPHYRTVTAEFAAEARRRGVAVRPFTVNKRNVMKTMFAYGVDAVFTDYPRQAKQWKEKTP

SEQ ID NO: 77569 - DNA, 1020 bp, Idiomarina loihiensis L2TR
  CDS (1)..(1020): transl_table=11
atgactaaacgtatttttgggtgtttgtttttattggtatcagcaaccgcagttcaggcgcaggacgagacgccggatgcgccgttccatgaccttcaagttccgcagtttctggacattgcgcaccgcggtgcttccggttatttacccgagcacactcaggccagcaccgttatggctcatgggctgggagcggacttcatagagcaagacgtgcaactgagccgtgacagcgttccggtcgttctgcatgatgaaattctggaccatgtcaccaatgtctccgaagtgtttccggaaaagcatcgtcccgatggtaaatactatgtggtcgatttttcgctggaagagcttaaacagttaactatggtcgcccggcataaagattatgagctggtttaccctaagcgattttctcaccccgatgttcactttcctatacaaacgctggatgaggaaatcaaactgattcaggagctgaatcgcgttcgggatatgtcgacaggcatttatatcgagatcaaatctccgcgctggtatcagcagcaagggtacgacgcgacggcggcagtgatgtctgtcctggctcacaacggataccacgacaaacggccaacaccggtttatctgcagtcttttgacccggaagtgttacgtcgcttaaagcgtgaatttaactgggactttccgttaattcagctggtgggtgacaatgagtggggagagaccgatattgattacagcgccatgcgcacgggtgccgggctggagtcagtaaaaagctacgctgaaggtgtcggcttgtgggtaaaccacgtattgaccggagtgaatgaaaacggtgagcctgaatgggacagtgttttaaagtcagcggaagagaaaggtctggatgttcatgtttataccttgcgggccgatgacttacccgaaggcgtggagtctcatgcgcaattgcgccagtggttaaaacaagctggcgtagagggcgtgtttactgactttccggacaaaaagtaa

SEQ ID NO: 77570 - protein, 339 aa, Idiomarina loihiensis L2TR
MTKRIFGCLFLLVSATAVQAQDETPDAPFHDLQVPQFLDIAHRGASGYLPEHTQASTVMAHGLGADFIEQDVQLSRDSVPVVLHDEILDHVTNVSEVFPEKHRPDGKYYVVDFSLEELKQLTMVARHKDYELVYPKRFSHPDVHFPIQTLDEEIKLIQELNRVRDMSTGIYIEIKSPRWYQQQGYDATAAVMSVLAHNGYHDKRPTPVYLQSFDPEVLRRLKREFNWDFPLIQLVGDNEWGETDIDYSAMRTGAGLESVKSYAEGVGLWVNHVLTGVNENGEPEWDSVLKSAEEKGLDVHVYTLRADDLPEGVESHAQLRQWLKQAGVEGVFTDFPDKK

SEQ ID NO: 77571 - DNA, 1050 bp, Staphylococcus epidermidis RP62A
  CDS (1)..(1050): transl_table=11
atgtttaaatctaagaaaataatcatttcaactttatctaccgttacactgggtttagctagtttaagttccccttcgatagctgaaacttcgaaccactctccagcaccaaaccaatcagagaaatcgatacaacaacaaacaaatattccatctaatatgaatcaatcatcagctaaaacatttaaacgacaagctgaatcagactcagtaagtggtaaaacaaacgatactcataatcattggactaaaaatttaactggagagaaatttacaaccattgcacatcgtggcgcaagtggttacgccccagaacatacttttgaagcatatgataaaagtcataatgaattaggagcatcttacatagaaatcgatttacaacgtactaaagatggtcacttggttgctatgcatgacgaaaaggtcaatcgtacaactaatggccatggacgtgtcgaccaacttactttaaaagagttaaaacaacttgatgcaggaagctggtttaatcgaaagcaccctgaatatgccaaaaataaatataaaaatgctaaagttcctactttagacgaaattttaaatcgctatggcaaaaatgcaaactattatattgaaactaaatcgccagatgtttatcctggcatggaaaaacaattattagatacattagataaacatgacttgttaacacaaaaatcacttaaacatggacatgtgatgatccaatcattttcagggagtagtttagaaaaggtacatcacatgaacgccaatataccacttattagactaatgaataaatttgaacttaaaaaagctactaatcaagatttaaaaaatattaaatcttatgccattggagtaggtcctgaatacacagatttaaatattaagaacacaagacatttaaaaaatttaggatttttagttcatccttatacagttgatgatgaaaatcaaatgagaaacttaaatcaatatggtgttgatggtgtattcactaattttgctgatagatataaaaaagtttcagaaacacaacaataa

SEQ ID NO: 77572 - protein, 349 aa, Staphylococcus epidermidis RP62A
MFKSKKIIISTLSTVTLGLASLSSPSIAETSNHSPAPNQSEKSIQQQTNIPSNMNQSSAKTFKRQAESDSVSGKTNDTHNHWTKNLTGEKFTTIAHRGASGYAPEHTFEAYDKSHNELGASYIEIDLQRTKDGHLVAMHDEKVNRTTNGHGRVDQLTLKELKQLDAGSWFNRKHPEYAKNKYKNAKVPTLDEILNRYGKNANYYIETKSPDVYPGMEKQLLDTLDKHDLLTQKSLKHGHVMIQSFSGSSLEKVHHMNANIPLIRLMNKFELKKATNQDLKNIKSYAIGVGPEYTDLNIKNTRHLKNLGFLVHPYTVDDENQMRNLNQYGVDGVFTNFADRYKKVSETQQ

SEQ ID NO: 77573 - DNA, 747 bp, Staphylococcus epidermidis RP62A
  CDS (1)..(747): transl_table=11
atgaaatttcgacgtccaaatcaacatttccaaatcgtagcgcatagaggattacctgaagattatcctgaaaatactattatcgcttatcgacatgcgctcatgttacatatagatatgttggaaattgatgtacattacacaaaagataaagaacttgtcgttatacatgatgatactatcgatcgtacgtcaaatggtaaaggtaaggtttctgattttactttaaaagaattaaaagcgttagattttggtttctataaaggagagaaatttaaaggggagagtataccgacttttgatgaagtgttagatttagcagataacttttcacaaaaattattaatagaaataaaaaagcctagtcagtatccaaatattgaaaatatgattgttgataaattgaaggaaagacaaatatctaaatctaaagtgattttacaatcattcgattttgattgtgtaaaaaaattgtcagcaatgaatttagattatgaattaggtttattaattagtaagaaaaaatattggcacaagttaccaaatttcaaaaaaattgccaaagttgctgattatgctaatcctaattatcaaattgtttcgaagaaatttatgcaacttgctcatgaggaagagttaaaagtattaccttatactgtaaataaattaaaagaatcacaaaaattaatagatattggtgttgacggtattatttccgatgtacctgaagatttatttgagctataa

SEQ ID NO: 77574 - protein, 248 aa, Staphylococcus epidermidis RP62A
MKFRRPNQHFQIVAHRGLPEDYPENTIIAYRHALMLHIDMLEIDVHYTKDKELVVIHDDTIDRTSNGKGKVSDFTLKELKALDFGFYKGEKFKGESIPTFDEVLDLADNFSQKLLIEIKKPSQYPNIENMIVDKLKERQISKSKVILQSFDFDCVKKLSAMNLDYELGLLISKKKYWHKLPNFKKIAKVADYANPNYQIVSKKFMQLAHEEELKVLPYTVNKLKESQKLIDIGVDGIISDVPEDLFEL

SEQ ID NO: 77575 - DNA, 1107 bp, Gluconobacter oxydans 621H
  CDS (1)..(1107): transl_table=11
atgctgtcacgccgccgcgcactgggcctgctggctgccggagttcccgctctccacctccgggcaaaggcggcgccgtcactggcgccgaagcccctcgtgttcgcccatcgcggggcctcggccctgcgtccggagcatacgctggcctcctatgcccgcgccatgatggatggtgcggacttcattgagcctgatcttgtcatgacaaaggacggccatctggtcgtccgccatgagagcaacatcgccggcacgacggacgtggcggaccatccggaattcgcctcccgtcatcgcacgctgaagatcgacggaaagaacgaaaccggctggttcaccaccgattttacactagccgaactcaagaccctccgcgcccgcgaacgcctctccacgatccgggtccacaacacccgctatgacgaccatttcgaaatcccgaccttcgaggaagtcatcgagcaggtcgccgcccagtcggccgcgacgggtaaggtctttggactggtgccggaaatcaagcattccacgcatttcaacagcctcggcctgaaccccgaagccgcgttcctgcggaccatcgccgcccacgactacacccggcaggctccgctggaactccagtctttcgagaccggcaatctgggtcgcatccgggcggacgtcctgtccatcaatccgcaggcgcgtctgatgctgcttatgggcgagcgcaaggatgttccgccggatcttctggcagccggcaagaccacgacgttcggagatctcatgacgccggaaggcctcaaggaaatccgccgctatgccgacgtgattggtccctccaacacggacctgatcccgcgtgacagcaagggtgcctggcttgaaccctccacgctcgtaacggacgcccataaggccggactgctggttcattcctatacggcacgaccagaaaaccacttccttccggctcagctgcgcagcgatgccggagacgccgctcgcaatcccaaaggcatgatcgcggaagtccgccgctatctggacatggggatcgacggcttcttcacggatgatcccgcactgggacgcattgccgtgaagggcacgatctga

SEQ ID NO: 77576 - protein, 368 aa, Gluconobacter oxydans 621H
MLSRRRALGLLAAGVPALHLRAKAAPSLAPKPLVFAHRGASALRPEHTLASYARAMMDGADFIEPDLVMTKDGHLVVRHESNIAGTTDVADHPEFASRHRTLKIDGKNETGWFTTDFTLAELKTLRARERLSTIRVHNTRYDDHFEIPTFEEVIEQVAAQSAATGKVFGLVPEIKHSTHFNSLGLNPEAAFLRTIAAHDYTRQAPLELQSFETGNLGRIRADVLSINPQARLMLLMGERKDVPPDLLAAGKTTTFGDLMTPEGLKEIRRYADVIGPSNTDLIPRDSKGAWLEPSTLVTDAHKAGLLVHSYTARPENHFLPAQLRSDAGDAARNPKGMIAEVRRYLDMGIDGFFTDDPALGRIAVKGTI

SEQ ID NO: 77577 - DNA, 1143 bp, Xanthomonas oryzae pv. oryzae KACC10331
  CDS (1)..(1143): transl_table=11
gtgatgtgtcgattcggaaactgtttttcgttggagagatgcatgatgcagttcggtcgtatctggttggtgggagcgatgatggttggcatgagcggcgctgcagttgccgaagcaccgctggccaggacggtgcagatctttgcgcaccgtggtgccagtgcgttgcgcccggaacacaccttggcctcgtacgctaaagccgttgtcgatggcgccgatttcgtcgagccggatctggtgtcgaccaaagacggcgtgcttatcgcacggcatgagaacgagatcggcggcaccaccgatgtggccagccacccggagttcgctgcgcgcaagacgcgcaagaccatcgacggtcaggcgatggaaggctggtttaccgaagatttcagcttggccgagttgaagacgctacgtgcgcgcgagcgcttgccgcagttgcgcggcacgcgctgggatgggcagtttcagatcgtcaccttcgatgaaatcatcgatttcgtcggcgcagaatcggcagcgaccggccgcaccatcgggctgattccggagatcaagcacccgagctatttcaaggcgctgggtctgccgatggaagacaaggtgttggccaccctgcatgcgcatgcctacacgcagactgcgccggtgatcatccaatcgttcgagaccaacaacctgcgctatctgcgcggcacgatcgggcgcagcagcaacatcggcctgctgcaattgctcggtggcgcgcagatggcgctgcccgatgccggtacgggcgatgcaccgaagacctacgggcagatgatcacgccggacggtctgaagcaggttgcaacctatgccgatgcgatcggccccgacatccgcagcatcatcccgctggatgcgcagcaacgcctgggcacgcccaccagcctggtgcgcgacgcacatgcggccgggctgcaggtgcagccgtataccttccgtccggaaaattattttctgtccgccaacaaccgcagcggcggcccgatgaccgagcgcaacgacgcgggtgcgttggtcgagttgaaggcgtatctggacgccggcatcgatgcgttctttgccgacgaccctggtctggcgcggcgcgcattgagcgggcacacctcgcggtaa

SEQ ID NO: 77578 - protein, 380 aa, Xanthomonas oryzae pv. oryzae KACC10331
MMCRFGNCFSLERCMMQFGRIWLVGAMMVGMSGAAVAEAPLARTVQIFAHRGASALRPEHTLASYAKAVVDGADFVEPDLVSTKDGVLIARHENEIGGTTDVASHPEFAARKTRKTIDGQAMEGWFTEDFSLAELKTLRARERLPQLRGTRWDGQFQIVTFDEIIDFVGAESAATGRTIGLIPEIKHPSYFKALGLPMEDKVLATLHAHAYTQTAPVIIQSFETNNLRYLRGTIGRSSNIGLLQLLGGAQMALPDAGTGDAPKTYGQMITPDGLKQVATYADAIGPDIRSIIPLDAQQRLGTPTSLVRDAHAAGLQVQPYTFRPENYFLSANNRSGGPMTERNDAGALVELKAYLDAGIDAFFADDPGLARRALSGHTSR

SEQ ID NO: 77579 - DNA, 999 bp, Nostoc punctiforme PCC 73102
  CDS (1)..(999)
atgtcagtggctattagtacaacatctccaattatcattgcacaccgaggcgctagcggctatcgtccagaacatactttagccgcttatgaattagcgattgtactaggtgctgattatattgaacctgatttagtttccaccaaagatggtgttttaattgctcgtcacgaaaatgagatttctgaaaccaccgacgttgctagacatgtagaatttgctcaccttcaaaccacaaaaataatagatggcgaatcaaaaactggctggtttactgaagattttaccctggcagaactgaaaacactacgagccaaagagcgaatagggcaaatgcgatcgcaaaataccgcttatgatggactctttgaaattcccacgctgcaagaaatcatcgatttagtgaagcgtaaaagtgctgaaattaatcgtgcgatcggcatttatccagaaactaagcacccaacttactttaaatctattgggttagccctagaaccattcctacttgcaactttgacagccaacggttatgagggagctaatgcacctattttcattcagtcttttgaagtgagtaatttacaagatttatctacaaagactgatttacctctggtgcaattgctgaataacagtggtaagcctaatgattttgttgttagtggcgatgaacgcacttatgcagatttagtcactgcatcaggtttaagggaaattgctaaatatgcacaggcggttggggttcataaaaatttgctgattcctagagatagtagtggtaaattgcaatcgcctacatctttagtaactgacgctcatacggctggtttgctggttcatgtctggactttccgcaatgaagactgctttttgccactggattttcaaggaaatccccaaggggaatatgaactatttttcagcttaggtgttaatggcgtatttagcgattacccggatatggcttctactgtgaaggaaaatcttcgattgtaa

SEQ ID NO: 77580 - protein, 332 aa, Nostoc punctiforme PCC 73102
MSVAISTTSPIIIAHRGASGYRPEHTLAAYELAIVLGADYIEPDLVSTKDGVLIARHENEISETTDVARHVEFAHLQTTKIIDGESKTGWFTEDFTLAELKTLRAKERIGQMRSQNTAYDGLFEIPTLQEIIDLVKRKSAEINRAIGIYPETKHPTYFKSIGLALEPFLLATLTANGYEGANAPIFIQSFEVSNLQDLSTKTDLPLVQLLNNSGKPNDFVVSGDERTYADLVTASGLREIAKYAQAVGVHKNLLIPRDSSGKLQSPTSLVTDAHTAGLLVHVWTFRNEDCFLPLDFQGNPQGEYELFFSLGVNGVFSDYPDMASTVKENLRL

SEQ ID NO: 77581 - DNA, 1086 bp, Haemophilus somnus 2336
  CDS (1)..(1086)
atgaaattagctacccctctttgtgcaattgctttagtagctgcaacactatcaggttgttctgcacaatttgaaaacaacgttaaccaaaaagataaaattatcattgctcaccgtggagcaagcggttatttacctgagcatacgttagaaagtaaagcacttgcttttggccaacacgctgattatctagaacaagatcttgcaatgaccaaagataatcatctcatcgtcattcatgatcattttttagatggtttaacagatgtggcgaaaaagtttccacatcgtcatagaaaagatgggcgttattatgtagtagattttacgctgaaagaaattcaatcattagaaatgacggaaaattttagtctgaaagacggaaaacaggttcaggtttacccaaatagattcccgctttggcaatctcatttccgtattcatacttttgaagatgaattagaatttattcaaggtcttgaaaaatcaactggtcaaaaaatcggtatctatcccgaaattaaagcaccttggctacatcaccaagaaggcaaagatattgctttagcaacattaaaagttttgaaaaaatacggttatacgcaaaaagatgacttagtctatttacaaacttttgattttaatgagctaaaacgaattaaaacagaattgttgcctaaactaggtatggatgtaaaacttgttcaattagtggcttattctgattggggtgaaacacaagaaaaaaatgctcaaggcaagtgggttaattacgattatgattggatgtttaaaccgggtgcggtagaaaaaattgcaaaatatgctgatggtataggccctggctggtacatgatgatcgatcaagaaaaatctaaaccgaatgccgtcgcttatactccattagcagaagaattggcaaaatataaattagaggtacatccttataccgttcgcaaagatgctttacctgacttttttgataatgtagatcaaatgtatgatgctctatttaaaggcggtgcaacgggagtatttactgatttccctgatacaggtgtaaattacttaaaaacccataaataa

SEQ ID NO: 77582 - protein, 361 aa, Haemophilus somnus 2336
MKLATPLCAIALVAATLSGCSAQFENNVNQKDKIIIAHRGASGYLPEHTLESKALAFGQHADYLEQDLAMTKDNHLIVIHDHFLDGLTDVAKKFPHRHRKDGRYYVVDFTLKEIQSLEMTENFSLKDGKQVQVYPNRFPLWQSHFRIHTFEDELEFIQGLEKSTGQKIGIYPEIKAPWLHHQEGKDIALATLKVLKKYGYTQKDDLVYLQTFDFNELKRIKTELLPKLGMDVKLVQLVAYSDWGETQEKNAQGKWVNYDYDWMFKPGAVEKIAKYADGIGPGWYMMIDQEKSKPNAVAYTPLAEELAKYKLEVHPYTVRKDALPDFFDNVDQMYDALFKGGATGVFTDFPDTGVNYLKTHK

SEQ ID NO: 77583 - DNA, 1128 bp, Pseudomonas aeruginosa UCBPP-PA14
  CDS (1)..(1128)
atgcggcaaagattctggcaaggaacattcaagaccctgggcctcctcggcctgacggcggggctcgccgcccaggccgcggagccgtccggcaaggccctcagcgccgccgccggcgtgccctggccggcggtcatcgcccaccgcggcgcctcgtacgacgcccccgaggaaaccgccgcggcctacctactggcccgcgacctcggcgccgactacctggaagccgacgtgcagcgcagccgcgacggcgtactggtcgccctccacgacgacaccctggagcgcaccaccgacgtcgccgaggtcttcccgggacgcgccaaggacccggtgagcagcttcactctcgccgaactcaagcgcctggacgccggctcctggttcaatcgcgccttccccgagcgcgcccggcccggcttcgtcggcctgcgcatcctcaccctcgacgagatgctcgacatcgccgagggcggcgccaacaagccgggcctgtacctggagaccaaggtaccggcgcaattccccggcatcgaagacgacctgcgcaagctgctggaacgccgcggctggctgcaaccccgcgagcgcgccgccgccgggcatgtcgacgtggcccacggcaatggccgggtgatcctgcagaccttcgagaagagcagcctggaactgctgcaagaaagcatgccgcaagtgccgaagattctcctgctgtggctcggcgacggttacctggaagcccgttcgccagtgaccttcaaggaatccggggaaaccgacaaggcggccttctacgccaggcaggaagtgaagtccgaagccgagttcggcgcctggctggactgggccaaggcccacggcgcgctgggcaccgggccctcggcgaccctcagcgaacgcggcgaacagagctacgccgacctggtgaaaccctggatgaaccgcatgacccacgcgcgcgggttgttcatccatgcctactcggtggactcggaggaagacttcaaggccctaggtgcggccggcgtcgacggtttcttcaccaaccgcacctcggaactgctgaagttccagggccgcccggcggcgcaagacatggacgcgctgctgcgccggcacggctactga

SEQ ID NO: 77584 - protein, 375 aa, Pseudomonas aeruginosa UCBPP-PA14
MRQRFWQGTFKTLGLLGLTAGLAAQAAEPSGKALSAAAGVPWPAVIAHRGASYDAPEETAAAYLLARDLGADYLEADVQRSRDGVLVALHDDTLERTTDVAEVFPGRAKDPVSSFTLAELKRLDAGSWFNRAFPERARPGFVGLRILTLDEMLDIAEGGANKPGLYLETKVPAQFPGIEDDLRKLLERRGWLQPRERAAAGHVDVAHGNGRVILQTFEKSSLELLQESMPQVPKILLLWLGDGYLEARSPVTFKESGETDKAAFYARQEVKSEAEFGAWLDWAKAHGALGTGPSATLSERGEQSYADLVKPWMNRMTHARGLFIHAYSVDSEEDFKALGAAGVDGFFTNRTSELLKFQGRPAAQDMDALLRRHGY

SEQ ID NO: 77585 - DNA, 735 bp, Fusobacterium nucleatum subsp. vincentii ATCC 49256
  CDS (1)..(735): transl_table=11
atgacaaaaaattttgctcatagagggtttagtggaaaatatcctgaaaatacaatattagcttttcaaaaagcaatagaagttggggcagatggaattgaattagatgttcaacttacaaaagatggagaagttgtaataattcatgatgaaacaatagatagaacaacagatggaaaaggttatgtagtagattatacatataaagaattatcaaagtttgatgcttcatatatttatagagggaaaatgggggttaataaaattcctacattgaaagagtattttgaattagtaaaagacttggattttataactaatattgaactaaaaacagggataaatgaatatttggggatagaagaaaaagtatatcagcttattaaagaatataaattagagaagaaagttataatttcaagttttaatcatttttcaattttaagaatgaaaaaaattgcacctgaactaaaatgtggctttttatcagaagattggataatagatgcaggagcatacacagcctctcataagattgaatgttttcatccaagatttaacaatttgataccagaagttgtagcagaattgaagaagaataatatagaaattaatacttggacagttaatagagaagaagatattaatgatttaatagataagaaagtggatattttaatagggaattatcctaacttaattaaaaaaataattaatcaaaaaaatagggggtag

SEQ ID NO: 77586 - protein, 244 aa, Fusobacterium nucleatum subsp. vincentii ATCC 49256
MTKNFAHRGFSGKYPENTILAFQKAIEVGADGIELDVQLTKDGEVVIIHDETIDRTTDGKGYVVDYTYKELSKFDASYIYRGKMGVNKIPTLKEYFELVKDLDFITNIELKTGINEYLGIEEKVYQLIKEYKLEKKVIISSFNHFSILRMKKIAPELKCGFLSEDWIIDAGAYTASHKIECFHPRFNNLIPEVVAELKKNNIEINTWTVNREEDINDLIDKKVDILIGNYPNLIKKIINQKNRG

SEQ ID NO: 77587 - DNA, 1239 bp, Dechloromonas aromatica RCB
  CDS (1)..(1239)
atgcgcatgacactgccaacactcgccacgctgctggtcgcgggtgccctgaatctggccggcagcacaccggcacaggcccatgaccaccacggcggactcgacaaccgggggccgctggtggtcggccatcggggcaccgcaggctacctgcccgaccacacgctcgaaggctacacgctggccatcgaactcggcgccgacttcatcgagccagacctcgtttccaccaaggatggttacctgatcgcccgccacgaaccgaacatcatcgccaccaccgacgtcgccagccgccccgaattcgctgcccgcaagcgcacccgcctggtcgatggcgcggccgagaccggattcttcgcctccgacttcacactggccgaaatcaagaccctgcgggcaaagcagccgatcccggccgaccggccgacgcaatttgacggcaaattccagattccgaccttcgatgaagtgatcgaactggccaagcgcaaatctgctgaaaccggccgcaccatcggcatctatccggaaaccaagcacccgacctaccaccagtccattggcctgccgctggaaggcaaactgctcgcagcgctgacccgagccggctggaacaaccgccacgctccggtcttcatccagagtttcgagcaggccaacctgaaagcgctgagcaaactgaccaaggtccgcctgatccagctggtcgacgccgacgacgtcaacgcggatggcagcctggcctacaacgcaccgttcgaccgcccgtacgactggacggcctccggcaagccggaactgctggcccgcaccttcggctggttcgccaccgatgccggcctcgatgaagtcgccacctacgcctacggtatcagcccctggaagcgctacatcgtcagcaccgttgatgccggcgccagcggcccaggtgaagcaagtcgcaccctgagcacgccgaccgacctgatcgaacgtgcccacgcccgcggcctcaaggtgcacacctggaccttccgtaacgagcagcgccgcctggccagcgactacaccggcaacccggtcaatgagtacctgcagttctaccgtctcggtatcgatggcgtcttttctgattttgccgataccgctgttgccgcccgcacgctgttcaagctggaacaggacggctacaacaaatgctttaccggcagcggtctgaaccgcgccgaactgcgcgcctgcgccgctggcgagtaa

SEQ ID NO: 77588 - protein, 412 aa, Dechloromonas aromatica RCB
MRMTLPTLATLLVAGALNLAGSTPAQAHDHHGGLDNRGPLVVGHRGTAGYLPDHTLEGYTLAIELGADFIEPDLVSTKDGYLIARHEPNIIATTDVASRPEFAARKRTRLVDGAAETGFFASDFTLAEIKTLRAKQPIPADRPTQFDGKFQIPTFDEVIELAKRKSAETGRTIGIYPETKHPTYHQSIGLPLEGKLLAALTRAGWNNRHAPVFIQSFEQANLKALSKLTKVRLIQLVDADDVNADGSLAYNAPFDRPYDWTASGKPELLARTFGWFATDAGLDEVATYAYGISPWKRYIVSTVDAGASGPGEASRTLSTPTDLIERAHARGLKVHTWTFRNEQRRLASDYTGNPVNEYLQFYRLGIDGVFSDFADTAVAARTLFKLEQDGYNKCFTGSGLNRAELRACAAGE

SEQ ID NO: 77589 - DNA, 1170 bp, Anabaena variabilis ATCC 29413
  CDS (1)..(1170)
atgcgacatttctttggagcatttttgctaggaatggctacactaacagttatgccaacagaaaaagtcctagcaggaaccttgacgggtcaagcgcctattgttattggacaccggggagctagcggttatcgtccagaacataccttagccgcttatgaactagccattcaaatgggtgctgactatattgaacctgatttagttgccactaaagatggtgttttagtcgcgcgtcacgaaaacgctttagcaattttgaatgctgatggtacgctcaatctcacagataccagcacagatgtttatgagcgtctacagtttgcagaccgcaaaaccactaaagtcatcgatggacgctccattacaggctggtttacagaagactttaccctagaagaattaaaaactctccgcgccatagagagaattcctggtatccgtccccagaatactcaatatgacagacagtttgaaattcctactttgcaagaagtcatcgatttagccaaagcacaaagcgcagccttgggacggactattggcatttatcctgaaactaagcacccgacttattttgattccattggtttatcaatggaagaaattttggtgagcgttttaaatgccaatggatatgttgatgaaactgcgccagtttacatccaatcatttgaagtcagcaatttaaaagacctcaatcaattaactaacgtctctttggtacaactaattaatcctagtggaagaccttatgattttgtagttaatgcagattctcggctttacagggatttaattacacctttaggtttagcagaaatcgctacctacgctaatggcataggagccaataaaaacttaattattcctagagatagtcaaggtaatttattgtcgcccacaaccttagttgatgatgctcacgcagccggcttaatcgttcatgcttggactttccgcgatgaagatgttttcttgccaacaaacttacaaggaaatccccaggaagagtataagcgattttatcaaacaggtatagacggtttatttagcgataatccagacacagcttttgcggtgcgctctaccttagttcccgaacccggtacaatctttggattaggttttatgccactgttaggatggttatttcgccgtcgtaagtaa

SEQ ID NO: 77590 - protein, 389 aa, Anabaena variabilis ATCC 29413
MRHFFGAFLLGMATLTVMPTEKVLAGTLTGQAPIVIGHRGASGYRPEHTLAAYELAIQMGADYIEPDLVATKDGVLVARHENALAILNADGTLNLTDTSTDVYERLQFADRKTTKVIDGRSITGWFTEDFTLEELKTLRAIERIPGIRPQNTQYDRQFEIPTLQEVIDLAKAQSAALGRTIGIYPETKHPTYFDSIGLSMEEILVSVLNANGYVDETAPVYIQSFEVSNLKDLNQLTNVSLVQLINPSGRPYDFVVNADSRLYRDLITPLGLAEIATYANGIGANKNLIIPRDSQGNLLSPTTLVDDAHAAGLIVHAWTFRDEDVFLPTNLQGNPQEEYKRFYQTGIDGLFSDNPDTAFAVRSTLVPEPGTIFGLGFMPLLGWLFRRRK

SEQ ID NO: 77591 - DNA, 1125 bp, Ralstonia eutropha JMP134
  CDS (1)..(1125)
atgaccctggccgcagcgctgctggcgggctgcgccacgaggccaaccctgcctccagcgcccaagtctgcggccgtgcctgcggcagcccccacccccgccgcgaagccactggtcatcgcccaccgcggcgccagcgcactgcgccccgaacacacgctggcggcctacgcgaaggccatcgaggacggcgccgatgtcatcgagcccgatctcgtcagcacgcgcgatggcgtcctcatagcacgccatgagaacgacatcggcggcacctccaacgtcgccgagctaccgcagttcgccagccgcaagcgcaccaaggtcatcgacggcgtgcgcctgaccggctggttcacagaagacttcacgctggccgaattgaagacactgcgcgcgcgagagcgcattcccaaactgcgccccgccaacgcccgcctgaacgaccagttcgagatcccgacgttcgacgagatcgtacagctcgcgcagcaggcatcgctgcgcaccggccggcagatcggcctgtatccggagctgaagcatccgagctatttccgcggcatcggcttgccgctcgaagacaagctcgtcgatgcgctgcgccggcagccgtacctgcgcgaggcacccgtcttcatccagtcgttcgaggctggcagcctgcggcaggtgcgcaagatgatcaatcacggcatgccgaatgtccggctcatgcagctcatcgggaacctgaagcaaaccccgcccgactggcggctcgccggcgacacgcgcacctatggcgacatgctgactacgaccggcctgcgcgaggtggccagctacgccgatggcatcggtccggaaaagaacagcgtggtgccgcgcgatgcgcagggcggccttggcgcgcccacggccgtcgtgcgcaatgcgcatgcagcgggcctgctggtgcacccgtacacgttccggcccgagaacgcctttctgcccaaggcattccagaccggcggcgacgatgcgacgcgcagtccggccggcatggtgcgcgaggtgcaggtctttgtcgccgccggcgtggatggcgtctttaccgacgacccggcgctgggccggcgcgccatcgacgcaggaactccgtga

SEQ ID NO: 77592 - protein, 374 aa, Ralstonia eutropha JMP134
MTLAAALLAGCATRPTLPPAPKSAAVPAAAPTPAAKPLVIAHRGASALRPEHTLAAYAKAIEDGADVIEPDLVSTRDGVLIARHENDIGGTSNVAELPQFASRKRTKVIDGVRLTGWFTEDFTLAELKTLRARERIPKLRPANARLNDQFEIPTFDEIVQLAQQASLRTGRQIGLYPELKHPSYFRGIGLPLEDKLVDALRRQPYLREAPVFIQSFEAGSLRQVRKMINHGMPNVRLMQLIGNLKQTPPDWRLAGDTRTYGDMLTTTGLREVASYADGIGPEKNSVVPRDAQGGLGAPTAVVRNAHAAGLLVHPYTFRPENAFLPKAFQTGGDDATRSPAGMVREVQVFVAAGVDGVFTDDPALGRRAIDAGTP

SEQ ID NO: 77593 - DNA, 891 bp, Exiguobacterium sp. 255-15
  CDS (1)..(891)
atgttgaaacaaatcggtgtcacggtagtcgcaggaatgatcgtcgcaagcggtacaacgagtattgaagcagcggggaaagcgaaagggttgcttgatccaaatcgagttgtcaacatcgctcaccgcggagcatccggttatgcaccggaacatacgatgcttgcctacgatatgagccataaaaagtttaaagcggattatattgaaattgatttacaaatgacgaaggacggtcaactgattgcgatgcacgacgagacggttgaccggacgacgaatggtaccggagccgtcaaggataaaacgcttgcgcaaatcaagcgtctcgatgcgggcagctggtttaacgaaacctatccggcatatgccaacgcgaagtataaaggactgaaagtaccgacattaaatgaaattttcgaccggtacggcaaacaggcaaactactatatcgaaacgaaatctccggaagtttacccggggatggagaaaaaactgttggatacgttacgacgtcacggattatcgagcaatcggattaaaccgggacaagtcatgattcaatcgttcagccgggacagtttactgaaggtcaagcagttagatccgaaacttccgctcgttcaacttcttgaggcaccgcaaatgacggatgttacgaaccaggaattaaagacgattaaatcgtatgctgtcggtgtcggaccatcatttaaatcgttgacacgacaaaatacgaaacaaatccggaatgctggattgttgcttcatccgtatacagtcaatgaaaaagtagatatgcaacggatgctcgattacggtgtgaccggcgtctttacgaacttcgccgaccggttcaatgaagttctgaaacatacaaaaaagaaatga

SEQ ID NO: 77594 - protein, 296 aa, Exiguobacterium sp. 255-15
MLKQIGVTVVAGMIVASGTTSIEAAGKAKGLLDPNRVVNIAHRGASGYAPEHTMLAYDMSHKKFKADYIEIDLQMTKDGQLIAMHDETVDRTTNGTGAVKDKTLAQIKRLDAGSWFNETYPAYANAKYKGLKVPTLNEIFDRYGKQANYYIETKSPEVYPGMEKKLLDTLRRHGLSSNRIKPGQVMIQSFSRDSLLKVKQLDPKLPLVQLLEAPQMTDVTNQELKTIKSYAVGVGPSFKSLTRQNTKQIRNAGLLLHPYTVNEKVDMQRMLDYGVTGVFTNFADRFNEVLKHTKKK

SEQ ID NO: 77595 - DNA, 960 bp, Rubrobacter xylanophilus DSM 9941
  CDS (1)..(960)
ttgctcgccgccgcgcccgccggggcgaaggccggggcgaagcagccggagcccgaggacgtggtgctgaacgtcgggcacaggggcgcctccgggtacgcgccggagcacaccttcaccgcctacgacctggcgctcaggatgggcgccgactacatcgagcaggacctgcagatgacgcgcgacggcgtgctcgtcgtcctgcacgacgagacgcttgaccgcaccgctaggccgacggccgagtccgggccgggcgactgcacgggcctcgtgcgcgagaagacgctcgcgcagataaagacctgcgacgtcgggagctggttcaacgaggcgtacccgcagtacgcgaggccggagtacgtgggcctgaggatccccacgctcgaggaggtcttccagaggtaccgcaagagcgtcaactactacatcgagacgaagagccccgaggccgcgcccgggatggaggaggagctgttgcggctgatggacgagtacgggctcacgaggcccgccgccgagcgatggcaggtccttatccagtccttctcccccgccagcctgcagaaggtccacgcgctcgacccctcgctgcccctgatacagctcttctccggcacggagacgagcgagaccatccgggccaagctcgacgccaccgccgcctacgcggtcggcataggcccctcgaaggacgacgtggacgccgagctcgtgggggcggcgcacgcccgctgcctcgacgtccacccctacaccgtcaacgagagcgcggagatggaggggctcatcgcgacgggcgtggacgggatgttcacgaacttccccgaccggctcgacgcggtcctcggagagagcgccatagacggcaggaagcgcgccgccgccctcgccgagcgggcgaacgacgcctgcaggggcgaggaggagcgcgggcggacagcatcgaacgggatatag

SEQ ID NO: 77596 - protein, 319 aa, Rubrobacter xylanophilus DSM 9941
MLAAAPAGAKAGAKQPEPEDVVLNVGHRGASGYAPEHTFTAYDLALRMGADYIEQDLQMTRDGVLVVLHDETLDRTARPTAESGPGDCTGLVREKTLAQIKTCDVGSWFNEAYPQYARPEYVGLRIPTLEEVFQRYRKSVNYYIETKSPEAAPGMEEELLRLMDEYGLTRPAAERWQVLIQSFSPASLQKVHALDPSLPLIQLFSGTETSETIRAKLDATAAYAVGIGPSKDDVDAELVGAAHARCLDVHPYTVNESAEMEGLIATGVDGMFTNFPDRLDAVLGESAIDGRKRAAALAERANDACRGEEERGRTASNGI

SEQ ID NO: 77597 - DNA, 1146 bp, Burkholderia cepacia R18194
  CDS (1)..(1146)
atgctcttcaagcgcccgaccaccctgcgctacgttccgttcgcctgtgccgccgcgttcctgctcgctgcttgcggcggcgacgacgatgtcgcatccgatcccacccagccaatttccgcgaaggtccaggtggtcggccatcgcggcgcaagcgcgctgcgccccgaacacacgctcgcgtcgtaccgcaaggcggtcgaggacggcgcggacgtaatcgagcccgacctcgtatcgacccgcgacggcgtgctggtcgcgcgtcacgaaaacgagatctcgggcacgacgaacgtgtcgacgctgccgcagttcgcgagccgcaaggcgaccaagacgatcgacggcgcggagctgaccggctggttcaccgaggatttcacgctcgccgagctgaagacgctgcgcgcccgcgagcgcattccgcaggtgcgccccgcgaacaccgcgtacaacgaccagttcgagattccgacgttcgacgagatcgtcgcgctcgcgaagcagctgtccgcgcagaccggccgcacgatccacctgtatccggaaaccaagcatccgacctacttccagtcgatcggcctgccgctcgaggaccgtctcgtcgatgcgctgctgaaggattcgtacacggcgcgcacggcgaccgtctacatccagtcgttcgaggtcgcgaacctgaagacgatccgcaaccggatcaagtcgagccagccgaactggaagctcgtgcagctgatggacgaagccggccagcgcccgtacgacttcgtgaaggcgaacgacaagcgcacctacggcgacctgtcgacgcgtgacggcatgcgcgaggtcgcgacctatgcgaacggcgtcggcccgtacaagacgtcgatcatcgcggtcgccgcggacggcacgctgcagcagccgacgccgtacgtgcgctacgcgcacgaggccggcctcgtcgtgcatccgtacacgttccgcccggagaacaacttcctgcccgcgtcgttgaaggacggcggcacgccggccacgcgcaacacggccggctcggtgcgcgagatccaggcgtacctgcgcgcgggcatcgacggcttcttcaccgacgatccggccgtcggccgcacggcggtcgatacgttcaagcgctga

SEQ ID NO: 77598 - protein, 381 aa, Burkholderia cepacia R18194
MLFKRPTTLRYVPFACAAAFLLAACGGDDDVASDPTQPISAKVQVVGHRGASALRPEHTLASYRKAVEDGADVIEPDLVSTRDGVLVARHENEISGTTNVSTLPQFASRKATKTIDGAELTGWFTEDFTLAELKTLRARERIPQVRPANTAYNDQFEIPTFDEIVALAKQLSAQTGRTIHLYPETKHPTYFQSIGLPLEDRLVDALLKDSYTARTATVYIQSFEVANLKTIRNRIKSSQPNWKLVQLMDEAGQRPYDFVKANDKRTYGDLSTRDGMREVATYANGVGPYKTSIIAVAADGTLQQPTPYVRYAHEAGLVVHPYTFRPENNFLPASLKDGGTPATRNTAGSVREIQAYLRAGIDGFFTDDPAVGRTAVDTFKR

SEQ ID NO: 77599 - DNA, 1128 bp, Pseudomonas fluorescens PfO-1
  CDS (1)..(1128)
atgcccgccacgttcaccaaaagcgcactgctgctgagcctgctgctcggcctcggccagacccacgccgccagccagccaagccctgttgcgctcgctgcctccgagggcattccgcacccggcggtgatcgcccatcgtggcgcgtccttcgatgccccggaatccaccgccgcctcctacaaactggcccgcgacctgggcgccgactacctggaaatggacttgcagcgcagcaaggacggcgtgctgttcgccctgcacgacgacaacctgcaacgcaccaccgacgtcgctaccaagttcccggagcgcaaggacagcccggccaatgccttcaccatggccgaactgaaaaccctcgacgccggcagctggtacaacgccaagtaccccgatcgcgcgcgtccgtcctatgtcggtctgaagattctgacactcgacgaaatcatcgacatcgcccaggccaatccgaagcacaagccgggcctgtacatcgaaaccaaggagccgaagctgttcccggggatcgagcatgacctgaaggaaaaactccaggctcgtggctggttgattccggcggacgccaaaccggcgaaaaacgtcgccagcgtcggcgagagcaacggcaaggtgatcctgcaaaccttcgagaagagcagcctggaaatgctgcaaaaggaaatgccgcaggtgccgaagatcctgttgctgtgggtcggcgaaggcagcatcgagccgaaatccaaagtgacctttgccgactccggcgagaaggacaagaacgcgttctacggcaagcaagagccgaaatccgaagccgagttcaagcagtggatcgactacgccaaggcacagggtgcgatcggcaccggcccttcggcgaagctgacccacggcggcgatcagagctattcggatctggtgcagccatggatgaacaagtacacccacgacaagggtctgctggtgcacgtctacaccgtggatgagccggtggacttcgaaaaagtcatggccgctggtgtcgacggcatcttcaccaaccgcgccagcgaactgctgaaattcttcaaacgcccggccgccgccagtgtggatcaggtgttgaagaacaacggtttctga

SEQ ID NO: 77600 - protein, 375 aa, Pseudomonas fluorescens PfO-1
MPATFTKSALLLSLLLGLGQTHAASQPSPVALAASEGIPHPAVIAHRGASFDAPESTAASYKLARDLGADYLEMDLQRSKDGVLFALHDDNLQRTTDVATKFPERKDSPANAFTMAELKTLDAGSWYNAKYPDRARPSYVGLKILTLDEIIDIAQANPKHKPGLYIETKEPKLFPGIEHDLKEKLQARGWLIPADAKPAKNVASVGESNGKVILQTFEKSSLEMLQKEMPQVPKILLLWVGEGSIEPKSKVTFADSGEKDKNAFYGKQEPKSEAEFKQWIDYAKAQGAIGTGPSAKLTHGGDQSYSDLVQPWMNKYTHDKGLLVHVYTVDEPVDFEKVMAAGVDGIFTNRASELLKFFKRPAAASVDQVLKNNGF

SEQ ID NO: 77601 - DNA, 1179 bp, Ralstonia metallidurans CH34
  CDS (1)..(1179)
atgcatcatccgttcatcacccgattcacgcttgccgcgctgaccgctggcctcattgccggctgcgcggcgccgcctcgtgcgcccacgtccactgctgcgcgggaggcgccatccacggcatacgctaccaccagcgctgcgccgaagcccgtgctgatcatcggccatcgcggcgctagcgcgctgcggccagaacacacgctggcgtcctatcagaaggcgatcgacgacggcgccgacatcatcgagcccgatctcgtggcaacgaaggacggcgtactggtggcgcggcacgaaaacgacatcacgggtaccaccaatgtggccgagatgccggagttcgccgaccgcaagcgtgtgaaggtcatcgacggcgagcggctgaccggctggttcaccgaggacttcacgctggccgaactgaagacgctgcgcgcccgggagcggattccgaagctgcgtcccgccaatgcaaagctcaatgaccagttcgagatcccgacattcgacgaaatcctgaagctcgccgagctggccgccatgaagcgtggacgcccggttgggatctatcccgaactcaagcatcccacttacttccgcggtatcggtctgccgctggaggagcgactcgtgactgcgctgcagggcagcgcctatgcgaagaccgtgccggtgtatgtgcagtcgttcgaagccgcgccgttgcgcaccgtcaagcgattgctgggtaactcgatgcccaacgtgatgatcgtccagcttatcggcaatccgcgcagccgtcccgcggactggcgactggcaggtgatacgcgcacgtacgccgacatgttgaagccgatcggccttcgcgaagtggccacctacgccaacggcatcggccccgagaagaacagcgtgatcccgcgcgacgccagcggcaatctcgcctcgccgaccgcgctactcgccaacgcccacgcggcgggcctggtagtgcacccttacacattccggcccgagaacgcgttcctgccgaaatcgctgcgtgcgcccggtgacgatgccacacgcaacccggccggcatgatcagcgagatccagaccttcgcagccgcgggtgtcgacggcgtcttcaccgacgacccggcgctgggtcgccgcgccgtggatccccccgccaacggcggccattaa

SEQ ID NO: 77602 - protein, 392 aa, Ralstonia metallidurans CH34
MHHPFITRFTLAALTAGLIAGCAAPPRAPTSTAAREAPSTAYATTSAAPKPVLIIGHRGASALRPEHTLASYQKAIDDGADIIEPDLVATKDGVLVARHENDITGTTNVAEMPEFADRKRVKVIDGERLTGWFTEDFTLAELKTLRARERIPKLRPANAKLNDQFEIPTFDEILKLAELAAMKRGRPVGIYPELKHPTYFRGIGLPLEERLVTALQGSAYAKTVPVYVQSFEAAPLRTVKRLLGNSMPNVMIVQLIGNPRSRPADWRLAGDTRTYADMLKPIGLREVATYANGIGPEKNSVIPRDASGNLASPTALLANAHAAGLVVHPYTFRPENAFLPKSLRAPGDDATRNPAGMISEIQTFAAAGVDGVFTDDPALGRRAVDPPANGGH

SEQ ID NO: 77603 - DNA, 738 bp, Enterococcus faecium
  CDS (1)..(738)
atgttacaaatctatgcccatcgcggaagcagcggcacccacccagaaaatacgcttcctgcatttgcagaagctgtacgagtaggtgcagatggtatcgaactagatgtccatctaagcaaagatggttatttgatcgttatgcacgacgaagaagtggaccggacgactaacggtaaagggctgattcgagaaaaaacattggaagaactcaaaaaattgaatgcagggggcaaattcagcaaagaatttccagcagctaaagttcctgaattgagagaagtgttaggactgctcctccaaaaaaattaccgagggatgctaatgattgaaattaaaactgatcagtatgaatatcccggtatcgaagaaaaattagccgaaacattaaaaagtagagattggccttttcaacatgcatattgcagctttcatttggattctttggaaaaaatcgcattactggaaccggagatacagctggacttattgatgagtacttctgataaaaagatccaactagcagcagaaaccccttatatagaaggagtacatccaaaaaatacttggttgttcgaacatccagtccaggcagctgattttccaaaagcaattcgtgcatggacgattaacgatgaagaagaaatggccaaatgtcaagaactcaaaatagatggaataataactgattttccggagaaagctcttcggtggaaacaatcaacgaaaagtaggtaa

SEQ ID NO: 77604 - protein, 245 aa, Enterococcus faecium
MLQIYAHRGSSGTHPENTLPAFAEAVRVGADGIELDVHLSKDGYLIVMHDEEVDRTTNGKGLIREKTLEELKKLNAGGKFSKEFPAAKVPELREVLGLLLQKNYRGMLMIEIKTDQYEYPGIEEKLAETLKSRDWPFQHAYCSFHLDSLEKIALLEPEIQLDLLMSTSDKKIQLAAETPYIEGVHPKNTWLFEHPVQAADFPKAIRAWTINDEEEMAKCQELKIDGIITDFPEKALRWKQSTKSR

SEQ ID NO: 77605 - DNA, 999 bp, Thermobifida fusca
  CDS (1)..(999)
atgcccaagaagaagccgcaacctccgcacctcaagatcatttctcaccggggcgcgtctggacaccgtcccgagcacactctggcctcctacgaactgggagcgcgctacggcggcgacttcatcgaggtggacttggtggccaccgccgacgggcatctcatcgcccgccacgaaccggagatcgggcagaccacggacgtggcgtcccgtcccgagttcgccgaccgccgccgcacagtgaccatcgacgggcgcgaggtcaccgggttcttcgcgcacgacttcaccctggcggagatcaagacgctgcgcgcggtcgaacggctcccggacgtgcgcccgtacaacgcggagctcaacggcaggtacgagattcccaccctggaagagatcgtcgacctggcggatgagctgaccagggagctgggacggccgatcggggtctacccggagaccaagcacccctcctaccacgcttccctgggcctggatctggagccgccgctgatcgccctgctacgggagcgcgggctgcacggccccgagccgcggctccccgtgttcctccagtcgtttgaggcggacagtctgcgcaaactgcaggaactggaggtgccgctggtgttcctcatgggcaccggcgagcagtggcagcgctacaccaccccggaagggctggcagaagtggcgtccttcgcgcaagcgatcggtccggagaagtccctcgtcatcccggtcactgaggagggcggactcggcgaacccacctcgcttgtcgccgacgcccacgaggccggcctgctcgtgcacccctacacgttccgcagcgagaaccacttcctgccgccgaagctgcgctccggggacgacccgaccgcctacgggtcgtttgccgccgaatacgaggcgttcttcgcagcgggggtcgacggggtgttcaccgaccactcccggcacgcgttcctggcccgggagatgttcctggcccaggcttga

SEQ ID NO: 77606 - protein, 332 aa, Thermobifida fusca
MPKKKPQPPHLKIISHRGASGHRPEHTLASYELGARYGGDFIEVDLVATADGHLIARHEPEIGQTTDVASRPEFADRRRTVTIDGREVTGFFAHDFTLAEIKTLRAVERLPDVRPYNAELNGRYEIPTLEEIVDLADELTRELGRPIGVYPETKHPSYHASLGLDLEPPLIALLRERGLHGPEPRLPVFLQSFEADSLRKLQELEVPLVFLMGTGEQWQRYTTPEGLAEVASFAQAIGPEKSLVIPVTEEGGLGEPTSLVADAHEAGLLVHPYTFRSENHFLPPKLRSGDDPTAYGSFAAEYEAFFAAGVDGVFTDHSRHAFLAREMFLAQA

SEQ ID NO: 77607 - DNA, 1095 bp, Haemophilus influenzae 86-028NP
  CDS (1)..(1095)
atgaaacttaaaactttagccctttctttattagcagctggtgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacaggctgattatttagagcaagatttagcaatgactaaggatggtcgtttagtggttattcacgatcactttttagatggcttgactgatgttgcgaaaaaattcccacatcgtcatcgtaaagatggccgttactatgtcatcgactttaccttaaaagaaattcaaagtttagaaatgacagaaaactttgaaaccaaagatggcaaacaagcgcaagtttatcctaatcgtttccctctttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctgctgaaacgctcaaagtgttaaaaaaatatggctatgataagaaaaccgatatggtttacttacaaactttcgattttaatgaattaaaacgtatcaaaacggaattacttccacaaatgggaatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggcccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataa

SEQ ID NO: 77608 - protein, 364 aa, Haemophilus influenzae 86-028NP
MKLKTLALSLLAAGVLAGCSSHSSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 77609 - DNA, 1113 bp, Azotobacter vinelandii
  CDS (1)..(1113)
atgccccgcccgcagtccccacgtcccggccagtccctggccgccgccgccctgctgctgcccctgctcgcctgcgccgccccggaaccgccggcagcggcgcatccccgggccgaagagcccagtccgctggtcatcgcccaccgcggcgccagcggctacgtgccggagcacaccctggccgcctacgcgctggcggtattgcagggcgccgactacgtcgaaccggatctggtgatgacccgggacggccaactggtcgctcgccacgacaatcagttggacctaaccaccgatgtcgccgcgcgtcccgaattcgccgaccgccggcgcaccaggaatgtcgacggcgtcgagctgaccggctggttcagcgaggacttcagtctggcggagatcaagaccctgcgcgccatcgagcgcatcccggcgatccgccccggcaacgcccgcctggacaagtccctcgaagtgcccaccctgcaggaaatcatcgacctggtgaagagcctggagaagagccagggacgacgcatcggcctgtacctggaaaccaagcaccccacccacttccagcacctcggcctggccatggaggagccactgctggaaatcctccgccgcaacggctaccacggccgccatgcttcggtgtacatccagtccttcgaggtggagaacctcaagaccctgcgccggctgagcccgctgcgcctggtccagttgttcggctccggccagccctacgaccagacggtgatcggcagcgccctgacctacgagcagatggctacccctgccgggctgcaggccatcgccgcctacgccgacggcgtcggcccggacaagggctatgtgatcccgcgcgacgccaacggcaacctcggcagccccaccgacttcgtgcccaatgcccatgccgccggcctcaaggtgcatccctacaccttccgcgcggagaacaatttcctgccgctcgagttgcgcagcagcgccaaccccgccgaacacggcgatctcgaagcggaaatccatgccttcctcgacgccggcgtcgacggcctgttcagcgacaatccggacatcgccctgcgcctgcgcgcgcaaccgtaa

SEQ ID NO: 77610 - protein, 370 aa, Azotobacter vinelandii
MPRPQSPRPGQSLAAAALLLPLLACAAPEPPAAAHPRAEEPSPLVIAHRGASGYVPEHTLAAYALAVLQGADYVEPDLVMTRDGQLVARHDNQLDLTTDVAARPEFADRRRTRNVDGVELTGWFSEDFSLAEIKTLRAIERIPAIRPGNARLDKSLEVPTLQEIIDLVKSLEKSQGRRIGLYLETKHPTHFQHLGLAMEEPLLEILRRNGYHGRHASVYIQSFEVENLKTLRRLSPLRLVQLFGSGQPYDQTVIGSALTYEQMATPAGLQAIAAYADGVGPDKGYVIPRDANGNLGSPTDFVPNAHAAGLKVHPYTFRAENNFLPLELRSSANPAEHGDLEAEIHAFLDAGVDGLFSDNPDIALRLRAQP

SEQ ID NO: 77611 - DNA, 1194 bp, Polaromonas sp. JS666
  CDS (1)..(1194)
atggcgaaatcgaccaccactcacgcacggcaagccatcggctggctcacccttgcaagcaccagcctattgctgggcgcctgcagcatgccgggcacacgcaccaacgccagcctgcccacgctggacggccgtgccccgctggtgattgcccaccgcggcgcatccggctacgtgcccgaagaaaccctggaagcctacgcccgcgcgattgaactcggcgccgatgtcatcgagatggacctggtgtccaccaaggacggcgtactgatcacccgccacgaccccaacctggccatcagcacggacgtggccaaacaccctgaattcgcatcgcgcaagaaaaccatccgggtcgatggcgaaacacagacgggctggttcagcaacgacttcacgctggccgaaatccggatgctgggcgccatttccaccgacgccgaacgcccgcagcagtacaacgggctgtacaaggtgccgactttccaggaggtcatcgacctggccaaagccaggtcggcgcaaaccggccgcaccgtcgcgatttacccggaaaccaaaaaccccagctacttccgcgcgctcggcctgcccatggaggacaagctgatcgccatgatcaacgccgctggctggaacagcaagacggcacccatctatgtgcagtcatttgaacccggcagcctgaagtacatgaagagcaaaggcctgaacacgcgcctgatccagttgatagatggcgacggcgtggacatgaaaacggggacggtgacttttgccaaccccagcgaccgcccttatgactggacccaggctggcgacaagcgcctttataacgtcatgaccacgccggcagggctggccgagatcaagacctatgcggacggcatcggcccctggaagcgcttcatcatcagcaccaaaggagccatcggtgccgacggcaagatcaacgatgccgatgcgacgtcaatccaggccaccagcctggtggcggacgcccacaaggcgggcctgtttgttcatccctttaccttccgcaacgagtcacgccgccttgctgccgactacaggggcggcgccaaaaatgagtacctggccttttaccgtgcgggtgtggatggcgtcttcaccgacttcccggacacggcgcttgaagcccgcgcgttgtacctgaaagaaaccggccgctga

SEQ ID NO: 77612 - protein, 397 aa, Polaromonas sp. JS666
MAKSTTTHARQAIGWLTLASTSLLLGACSMPGTRTNASLPTLDGRAPLVIAHRGASGYVPEETLEAYARAIELGADVIEMDLVSTKDGVLITRHDPNLAISTDVAKHPEFASRKKTIRVDGETQTGWFSNDFTLAEIRMLGAISTDAERPQQYNGLYKVPTFQEVIDLAKARSAQTGRTVAIYPETKNPSYFRALGLPMEDKLIAMINAAGWNSKTAPIYVQSFEPGSLKYMKSKGLNTRLIQLIDGDGVDMKTGTVTFANPSDRPYDWTQAGDKRLYNVMTTPAGLAEIKTYADGIGPWKRFIISTKGAIGADGKINDADATSIQATSLVADAHKAGLFVHPFTFRNESRRLAADYRGGAKNEYLAFYRAGVDGVFTDFPDTALEARALYLKETGR

SEQ ID NO: 77613 - DNA, 1047 bp, Campylobacter upsaliensis RM3195
  CDS (1)..(1047): transl_table=11
atgaaaaaatttacttttgttctaatatttttaggacttaatctattcgcaaacgataagcttatcatcgcacacagaggtgctagtgcgtatctaccagaacatacgcttgagagtaaagttttagcctttgcacaaggtgtgccttatattgagcaagatgtggttttaagtaaagatgatcgcctagttgtgattcacgatttatatttggataaaacaagtgatgtggcacaaaaattcccagagagaaagcgtaaagatggacattattatgtgattgactttactttagatgagcttaaaagcttaaaaatgagtgagggttttaaaagggaaaatgatagtgttaatgtttatcctaaacgcttcccaactaaaaaggcagattttacaattaacactcttgaggaagaaatagagcttattcaaggacttaataaaacacttaataaaaatgtaggtatttatgtagaaacaaaacgcccttggtttcacaagcaggaaggcaaggacatttcaaaacttaccttagaggtgtttaaaaaatatggctatacaaataaagattctaaagtctattttcaaagcttcgattatccggatttagtgcgtgtgaaaaaggagttattaccacaaatgggtatggatattaaacttgttggacttataggcttaaatgagtgggaggaaacctttgaatttaaaaatggcaaatggcaaaattatgatttttcttatcttctaaatattaaaaattatgctgaaatttcaaaaattgtcgatggcttaggaccaacctatgttttactctttgatgaaagagagcttaaaaatcataaaattgtgccaaataactttgttaaaaacgctcataagtataatataaaggtgcatccttacaccattagagcggacgcacttccaatctgggctaagtctgctgatgagctttttgatgctattttatttaaggctggggctgatggagtttttacggattttcctgatttgggcttggaatttttgagaaaagtaagatattag

SEQ ID NO: 77614 - protein, 348 aa, Campylobacter upsaliensis RM3195
MKKFTFVLIFLGLNLFANDKLIIAHRGASAYLPEHTLESKVLAFAQGVPYIEQDVVLSKDDRLVVIHDLYLDKTSDVAQKFPERKRKDGHYYVIDFTLDELKSLKMSEGFKRENDSVNVYPKRFPTKKADFTINTLEEEIELIQGLNKTLNKNVGIYVETKRPWFHKQEGKDISKLTLEVFKKYGYTNKDSKVYFQSFDYPDLVRVKKELLPQMGMDIKLVGLIGLNEWEETFEFKNGKWQNYDFSYLLNIKNYAEISKIVDGLGPTYVLLFDERELKNHKIVPNNFVKNAHKYNIKVHPYTIRADALPIWAKSADELFDAILFKAGADGVFTDFPDLGLEFLRKVRY

SEQ ID NO: 77615 - DNA, 1023 bp, Borrelia hermsii
  CDS (1)..(1023): transl_table=11
atgaaatcaattaaagcaaaatcattaatatttataattaacatttttctcacaatttcctgtcagggcgaaaaaatgagtcaaaaccaaaaatcaccattagttatagctcacagaggtgccagcggatatcttccagaacataccttagaagctaaagcatacgcttatgccttaggagctgactacctagaacaagacattgttttaacaaaggataatattcctgttataatgcacgatccagaacttgatacaacaacaaacgttgcaaaactatttcccgaaagagctagagaaaacggaaggtattattctgttgatttcacactagatgaacttaaatcattaagccttagtgaaagatttgatccggcaagcagaaacccaatatatcctaaccgtttccccctaaatgaacatgattttaaaattccaactttagaagaagaaatacaatttatacaaggattaaataaaagcacaggtaggaatgttggaatttatcctgagattaaaaaaccattatggcataaacaacaaggtaaagacatatctaaaattgtaatagaaattttaaataaatacggatataaatcaaaagaagacaaaatttatcttcaaacattcgattttgacgaattaaagagaataagggaagaacttggatatcaaggaaaattaataatgcttgttggtgagaatgactgggatgaagcaccaacagactatgaatatatcaaatcagaagaaggtatggcagaagttgcaaaatattctgatggaattggaccttggataccccaaattataattgaaggcaaaataacagatcttacaagtttagcacataaacataatatggaggttcatccttacacatttagaattgacgcattgccttcatatgtaaaagatgcagatgaactattagatttattattcaacaaagcaaaagtagatggtatatttacagactttactgatacagtagtgaatttcatcacaaaaataaaaccatag

SEQ ID NO: 77616 - protein, 340 aa, Borrelia hermsii
MKSIKAKSLIFIINIFLTISCQGEKMSQNQKSPLVIAHRGASGYLPEHTLEAKAYAYALGADYLEQDIVLTKDNIPVIMHDPELDTTTNVAKLFPERARENGRYYSVDFTLDELKSLSLSERFDPASRNPIYPNRFPLNEHDFKIPTLEEEIQFIQGLNKSTGRNVGIYPEIKKPLWHKQQGKDISKIVIEILNKYGYKSKEDKIYLQTFDFDELKRIREELGYQGKLIMLVGENDWDEAPTDYEYIKSEEGMAEVAKYSDGIGPWIPQIIIEGKITDLTSLAHKHNMEVHPYTFRIDALPSYVKDADELLDLLFNKAKVDGIFTDFTDTVVNFITKIKP

SEQ ID NO: 77617 - DNA, 1047 bp, Cryptosporidium parvum
  CDS (1)..(1047)
atgcctggtatttatttaattattttctacatgatggtgagggcaaaagcaagtcttcatttagttgctcatagaggcgcatcttatttcgtgccagaagaatccttagctgcatattctcttgcagcaaaacatggagtgaattttattgaatgtgatgtcgtctcaactaaagatggtgtattgattttgaggcacagcccgaacttatccgagtctacaaatatcgatgatttgatcgaatttagtcacctcaggagaacagaaatcctttatgataataacagtaatgatgcaatcacgggtatattttcatgggatcttacatatgaagaaatcaaaagaatcaaatgcactcatgaaaagaagtacaataacagaaatccaagtctaaatggaatatatgatatacttacactagatgagttcctgaagtttagtgtttctgggttcgatggcaatttccccggattatatattgagattaaatatcccactttacatgagagaaaaggaattgacaacattactgataaattactagatgcattggatagatttggcattaataaaaagactgatgcagtttatattcaaagttttgagccatctaatttagaatatatacgcgctaggagtgaggtaaatttggtacaacttttaactagagatagtgaaaacaactttgtatatgcaattgaagatgtggaaaatggtggacaaatgaaatatgtgacttgcgatatagagtacatttcgaaatttgcaaatgttgtatctccttataaagaggacttgatcgatcgaactagcacttcaaataatactttgcctagctcaagtcacttcgtttctaaagcacatgaacttggtctaattgttgtaccgtatacatttagaccggagtctatattgtcgtacttcaaagatatttacgaagaatacgactattttattaaaactttaaaagcagatggtttgttcactgatgactctgaaagtattatgcaatacgtaaataatacttatacacgactttatgagtga

SEQ ID NO: 77618 - protein, 348 aa, Cryptosporidium parvum
MPGIYLIIFYMMVRAKASLHLVAHRGASYFVPEESLAAYSLAAKHGVNFIECDVVSTKDGVLILRHSPNLSESTNIDDLIEFSHLRRTEILYDNNSNDAITGIFSWDLTYEEIKRIKCTHEKKYNNRNPSLNGIYDILTLDEFLKFSVSGFDGNFPGLYIEIKYPTLHERKGIDNITDKLLDALDRFGINKKTDAVYIQSFEPSNLEYIRARSEVNLVQLLTRDSENNFVYAIEDVENGGQMKYVTCDIEYISKFANVVSPYKEDLIDRTSTSNNTLPSSSHFVSKAHELGLIVVPYTFRPESILSYFKDIYEEYDYFIKTLKADGLFTDDSESIMQYVNNTYTRLYE

SEQ ID NO: 77619 - DNA, 1014 bp, Borrelia lonestari
  CDS (1)..(1014): transl_table=11
atgaaattaaaactattattaataattataatcaatatctttttcataatttcatgctttaatgaaaaaatgagtacaaataaaaaattaaaattaccattagttatagctcacagaggtgctagcggatacctcccagagcatactttagaatctaaagcatacgcttatgccttaggggctgattatttagaacaagacatagtgctaacaaaagataatattcctgttataatgcacgatccagaacttgatacaaccacaaatgttaaaaaactatttcccaaccgagctagggaagacgggcgatattactctactgacttcacactagatgaacttaaatcactaagtcttagtgaaagatttaatcctgaaaataaacaaccaatatatcctaaccgttttccaacaactaaatacaattttaaaattccaactttagaagaagaaatacaattcatacaaggactaaataaaagcacaggaaaaaatgttggtatttgccctgaaattaaaaaaccctactggcataaacaacaaaataaagacatctctaaaattgtaatagaaattctaaataaatatggatatagctcaaaagaagataagatttatctacaaacattcgactttgatgaactaaaaagaataagaaacgaacttggataccaaggaaaattaataatgcttattggagaaaataactggaatgagtccccaacagactatgaatatataaaatcagaagaaggtatagctgaagttgcaaaatattctgacggaatcggagcttggatgccccatattatcattaatggtaaaataacaaaacttacaagtttagctcataaatataatatagaagttcatacttatacatttagaatagatgaattaccttcatatgttaacaacgcaaatgaactactagatttattattcaataaagcaaaagtagatggcatatttacagatttcactgacacagtagtgaatttcataaaaaaataa

SEQ ID NO: 77620 - protein, 337 aa, Borrelia lonestari
MKLKLLLIIIINIFFIISCFNEKMSTNKKLKLPLVIAHRGASGYLPEHTLESKAYAYALGADYLEQDIVLTKDNIPVIMHDPELDTTTNVKKLFPNRAREDGRYYSTDFTLDELKSLSLSERFNPENKQPIYPNRFPTTKYNFKIPTLEEEIQFIQGLNKSTGKNVGICPEIKKPYWHKQQNKDISKIVIEILNKYGYSSKEDKIYLQTFDFDELKRIRNELGYQGKLIMLIGENNWNESPTDYEYIKSEEGIAEVAKYSDGIGAWMPHIIINGKITKLTSLAHKYNIEVHTYTFRIDELPSYVNNANELLDLLFNKAKVDGIFTDFTDTVVNFIKK

SEQ ID NO: 77621 - DNA, 1176 bp, Oryza sativa
  CDS (1)..(1176)
atggctgccttctggctcatctctatcattgtccttgtactactttctggagaatccaatgccaatccagctgcctctcagcagagtcagctggatgtaaaccacaggaagccacttcaaactttcagaccttacaacattgcccacaggggttccaatggtgaaatacccgaagagaccacggctgcctacctgagggctattgaagaaggtgcagacttcatagagtctgacatacttgcaacaaaggacggacatctgatatgtttccacgatgttatattggacgcaacaactgatatcgccaatcgtacagaatttgccaacaggaagagaacctatgaagttgagagacaaaatgtgaccggctggtttgttgtggattttactcttgaagaactcaagtcactgagggtgaaacaacgctacaatttcagggaccaacagtacaatgggaagtaccagattattacatttgatgagtacatcttgattgcgctttatgccgatagggttgttgggatatacccagagctcaagaatcccattttcatcaacgagcacgtcaaatggtcagacgggaagaagtttgaggacaagtttgtccagacactgctgaaatatggttacaaaggcgaatacatgtctgaagattggcttaaacagccattgttcattcaatccttcgcaccatcgtcactcatttacatgtcaaatatgacaaactctccaaaaatattcctaatcgacgataccacagttagaactcaagacactaatcagtcatactacgagataacttcggacgcttaccttgcgttcataaggaagtacatagttggcattggaccatggaaagatacaattgttcctcccataaataattacctaggtcccccaaccgatcttgtcgcgcgagcacacgctctgaatcttcaggtgcatccatacactttcagaaacgagaacatgttcttgcacttcgacttccaccaagacccttatcttgagtacgagtattggctcggtgagattggcgtcgacgggcttttcactgatttcactggtaccttgcacaggttccaggaatgcacaactccgtatccaaagaatgaaaagaatgcagaggcactcttgcagaaaattaactacatgctgaaggatagcggatactaa

SEQ ID NO: 77622 - protein, 391 aa, Oryza sativa
MAAFWLISIIVLVLLSGESNANPAASQQSQLDVNHRKPLQTFRPYNIAHRGSNGEIPEETTAAYLRAIEEGADFIESDILATKDGHLICFHDVILDATTDIANRTEFANRKRTYEVERQNVTGWFVVDFTLEELKSLRVKQRYNFRDQQYNGKYQIITFDEYILIALYADRVVGIYPELKNPIFINEHVKWSDGKKFEDKFVQTLLKYGYKGEYMSEDWLKQPLFIQSFAPSSLIYMSNMTNSPKIFLIDDTTVRTQDTNQSYYEITSDAYLAFIRKYIVGIGPWKDTIVPPINNYLGPPTDLVARAHALNLQVHPYTFRNENMFLHFDFHQDPYLEYEYWLGEIGVDGLFTDFTGTLHRFQECTTPYPKNEKNAEALLQKINYMLKDSGY

SEQ ID NO: 77623 - DNA, 1011 bp, Borrelia lonestari
  CDS (1)..(1011): transl_table=11
atgaaattaaaactattattaataataatcaatatctttttcataatttcatgctttaatgaaaaaatgagtacaaataaaaaattaaaattgccattagttatagctcacagaggtgctagcggatacctcccagaacatactttagaatctaaagcatacgcttatgccttaggagctgattatttagaacaagacatagtgctaacaaaagataatattcctgttataatgcacgatccagaacttgatacaaccacaaatgttaaaaaactatttcccaaccgagctagggaagacggacgatattactctactgacttcacactagatgaacttaaatcactaagtcttagtgaaagatttaatcctgaaaataaacaaccaatatatcctaaccgttttccaacaactaaatacaattttaaaattccaactttagaagaagaaatacaattcatacaaggactaaataaaagcacaggaaaaaatgttggtatttgccctgaaattaaaaaaccctactggcataaacaacaaaataaagacatctctaaaattgtaatagaaattctaaataaatatggatatacctcaaaagaagataagatttatctacaaacattcgactttgatgaactaaaaagaataagaaacgaacttggataccaaggaaaattaataatgcttattggagaaaataactggaatgagtccccaacagactatgaatatataaaatcagaagaaggtatggctgaagttgcaaaatattctgacggaatcggagcttggatgccccatattatcattaatggtaaaataacaaaacttacaagtttagctcataaatataatatagaagttcatacttatacatttagaatagatgacttaccttcatatgttaacaacgcaaatgaactactagatttattattcaataaagcaaaagtagatggcatatttacagatttcactgacacagtagtgaatttcataaaaaaataa

SEQ ID NO: 77624 - protein, 336 aa, Borrelia lonestari
MKLKLLLIIINIFFIISCFNEKMSTNKKLKLPLVIAHRGASGYLPEHTLESKAYAYALGADYLEQDIVLTKDNIPVIMHDPELDTTTNVKKLFPNRAREDGRYYSTDFTLDELKSLSLSERFNPENKQPIYPNRFPTTKYNFKIPTLEEEIQFIQGLNKSTGKNVGICPEIKKPYWHKQQNKDISKIVIEILNKYGYTSKEDKIYLQTFDFDELKRIRNELGYQGKLIMLIGENNWNESPTDYEYIKSEEGMAEVAKYSDGIGAWMPHIIINGKITKLTSLAHKYNIEVHTYTFRIDDLPSYVNNANELLDLLFNKAKVDGIFTDFTDTVVNFIKK

SEQ ID NO: 77625 - DNA, 1119 bp, Bombyx mori
  CDS (1)..(1119)
atgaaaatcttcgggctgttggtgctttcctttagcaccgtggggatcacttttggaattccagtaaatgagaaccttgatttcaattctgaattcttaaactcagatttctgttcgccactaatcattgcccaccgcggagccagcggatatgtccccgaacacaccctaggttcttatgctctcagtataaccatgggagctgattacatcgaacctgatctggtaatgacgaaagacggggtacttgtggcccgacatgacaacgaactgagtttgacaaccgacgtcgcaagtcgtattgaattcgctacacgcaaccggactcaaacagtggacggatctgctatcaccggttggttcacggaagattttacactggccgaaataaaaacgttacgagctagagaacgcataccagatatcagagctggcaacgcacgtatggatggcaccttcacgattcctacgtttcaagaaatcattagtctggcgaaaggtctgcaaaaaagtcaaaaaagaactattggaatttatccagaaataaaacatagcacacattttaagaaactaggtctggcaatggaggagcctgttgtgaacatactccataaaaacggataccgtgacccatccgcaccggtttatattcaatcgttcgaagttaccaatttaaaagaacttaaaacaaagaccaggcttcgtttgttacaactattcgagagtgataaatctctacagcctttcgaccaactagaactgggaactaatcttacgtatggagaaatggcttcacaagaaggcttgaaggaagtcgccaaatacgcacacgcagccggtcctgacaaaagctacataattccccgcgatacagacaatcgattaggtgctaagactacatttgtagacgatgcacatgaagcaggccttaaggtccacccgtatacatttcgcgccgagaacgcatttctaccaacggaattccggagtaatgaatcagaatcgaatagtggagatttcgaagctgaattaagagcgtatttggatgcagggatcgatggtctgttctcagatcagccggacagagtggctcgtcttcgaggaccttgtttgaaatag

SEQ ID NO: 77626 - protein, 372 aa, Bombyx mori
MKIFGLLVLSFSTVGITFGIPVNENLDFNSEFLNSDFCSPLIIAHRGASGYVPEHTLGSYALSITMGADYIEPDLVMTKDGVLVARHDNELSLTTDVASRIEFATRNRTQTVDGSAITGWFTEDFTLAEIKTLRARERIPDIRAGNARMDGTFTIPTFQEIISLAKGLQKSQKRTIGIYPEIKHSTHFKKLGLAMEEPVVNILHKNGYRDPSAPVYIQSFEVTNLKELKTKTRLRLLQLFESDKSLQPFDQLELGTNLTYGEMASQEGLKEVAKYAHAAGPDKSYIIPRDTDNRLGAKTTFVDDAHEAGLKVHPYTFRAENAFLPTEFRSNESESNSGDFEAELRAYLDAGIDGLFSDQPDRVARLRGPCLK

SEQ ID NO: 77627 - DNA, 882 bp, Bacillus subtilis
  CDS (1)..(882): transl_table=11
atgagaaaaaatagaatactggccttgtttgttctgtcgctgggcttactctcatttatggtaacgccagtgtcggcagcgtcaaaaggaaacctgctgtcacctgaccgtatcctgaccgtcgcgcacagaggggcttctggatatgtgcctgagcacacgattctgtcttacgaaaccgctcagaaaatgaaagctgattttattgaattggatctgcaaatgacaaaagacggaaaattgattgtcatgcatgacgaaaaactggaccgcaccacaaacggaatgggttgggtgaaagaccatacgctcgcagacattaagaagcttgacgccggttcttggtttaatgaagcctatccggaaaaagcaaagccgcagtacgtcggccttaaagttcctacattagaagaggtattagaccgtttcggaaagcacgcgaactactacattgaaacaaaatcgcctgacacctacccaggtatggaagaaaaactgatcgcttctttgcagaaacataaattactgggaaagcattctaagccaggccaggtgatcattcaatcgttcagcaaagaaagcctggtaaaagtccatcaattacagccaaacctgccgaccgttcaattgctggaagccaaacaaatggcgtcaatgacagatgctgccctggaagaaatcaaaacatacgctgtcggtgcgggcccggattataaagctttaaatcaagaaaacgtccgtatgatccgcagccacggcctcctgcttcatccttacacagtcaataatgaagctgatatgcatcgcctgcttgattggggcgtaacaggagtgttcaccaactatcctgatcttttccacaaagtaaaaaagggttattaa

SEQ ID NO: 77628 - protein, 293 aa, Bacillus subtilis
MRKNRILALFVLSLGLLSFMVTPVSAASKGNLLSPDRILTVAHRGASGYVPEHTILSYETAQKMKADFIELDLQMTKDGKLIVMHDEKLDRTTNGMGWVKDHTLADIKKLDAGSWFNEAYPEKAKPQYVGLKVPTLEEVLDRFGKHANYYIETKSPDTYPGMEEKLIASLQKHKLLGKHSKPGQVIIQSFSKESLVKVHQLQPNLPTVQLLEAKQMASMTDAALEEIKTYAVGAGPDYKALNQENVRMIRSHGLLLHPYTVNNEADMHRLLDWGVTGVFTNYPDLFHKVKKGY

SEQ ID NO: 77629 - DNA, 1071 bp, Treponema pallidum
  CDS (1)..(1071): transl_table=11
atgcggggaacatattgtgtgacgctttgggggggggtgtttgcggcattggttgcaggctgtgcgtccgaacgtatgatagttgcgtatcggggcgctgcaggatatgtgcccgagcacacctttgcctcgaaagttcttgcttttgcacaaggagcagattacctgcagcaggatgtcgtgctttcaaaggataatcagcttatcgtagcgcaaagccatattctggataatatgactgacgtggcagaaaaatttccacgccggcagcgtgcggatgggcatttctatgtcatagattttacggtagaagaactttccctcctccgtgcaaccaatagtttctatacgcgcggtaagcgacatacgccggtgtatggccagcgctttcctctttggaagcctggttttaggctgcacacttttgaagaggagttgcagtttatccgtgggttggaacagacaaccgggaaaaagattggaatttactctgaaataaaggtgccgtggtttcatcatcaggaaggaaaagacatcgcagcgcttaccctcgctctgttgaaaaaatacggttaccaaagtcgatcggatctagtgtatgtgcaaacgtatgattttaacgagctgaagcgtatcaaacgagaacttttaccaaagtacgaaatgaacgtgaagctgattcagcgtgttgcttacacagatcaacgtgaaacacaggagaaggactcgcgtgggaaatggataaactacaattacaattggatgtttgagcccggtggtatgcagaaaatagcaaaatatgcagacggcgtgggtcctgactggaggatgctcatagagaatgaatggtcgaaggtgggcgctgttcgcctgagtccgatggtttctgcaatccaagatgcgaaattggaatgtcatgtgcacacggtacggaaagaaacactgcctagctacgcgcgcaccatggacgagatgttttccattttgttcaaacagacgggcgcaaacgtggtgctcacggattttcctgatcttggggtaaagtttctgggcaaacccgcccgctattga

SEQ ID NO: 77630 - protein, 356 aa, Treponema pallidum
MRGTYCVTLWGGVFAALVAGCASERMIVAYRGAAGYVPEHTFASKVLAFAQGADYLQQDVVLSKDNQLIVAQSHILDNMTDVAEKFPRRQRADGHFYVIDFTVEELSLLRATNSFYTRGKRHTPVYGQRFPLWKPGFRLHTFEEELQFIRGLEQTTGKKIGIYSEIKVPWFHHQEGKDIAALTLALLKKYGYQSRSDLVYVQTYDFNELKRIKRELLPKYEMNVKLIQRVAYTDQRETQEKDSRGKWINYNYNWMFEPGGMQKIAKYADGVGPDWRMLIENEWSKVGAVRLSPMVSAIQDAKLECHVHTVRKETLPSYARTMDEMFSILFKQTGANVVLTDFPDLGVKFLGKPARY

SEQ ID NO: 77631 - DNA, 720 bp, Bacillus subtilis
  CDS (1)..(720): transl_table=11
atgacaaagatttttccccaccggggggcatcaggtcaatttcccgaaaatacaatgcttgcatttgaaaaaggaattgaagccggagcggatgggatagagcttgatgtacagctgacgaaagacggacgcattgttgtaattcatgatgaaagacttaatcgcacgacatcacttaaaggattcgtgaaggatacagcctatgatgaggtaaagactgcgaatgcggccgctggtcacgatcaagcgtacagcgatataaaagtgccgctgctagaagatgtgctctcgtgggcggtaaaaaaggattttctcatcaacattgaattaaaaaacagcgtgatccgctatgagggaatggaagaaaaagtgctggaggcagtgaagcgatttaatgtagaggacagagtcatcctatccacgtttaatcatgacagcttggcgctgtgcgcccggcttgcaccgcatatcgaacgggcagtattaacttcagatgtgctttatcaggcagatcgatatatcgcgtctattccggcttccggctatcacccgaagataaacagcccaggggtcacagatgaagtactgaagaaaatgaggaacggtttgattaaggtaaggccgtatacagtcaatcgtccggaagatatgaagcgtctcattgaagcgggagcagaccgcatgtttaccgactttccagaaaggcttcggcattgctga

SEQ ID NO: 77632 - protein, 239 aa, Bacillus subtilis
MTKIFPHRGASGQFPENTMLAFEKGIEAGADGIELDVQLTKDGRIVVIHDERLNRTTSLKGFVKDTAYDEVKTANAAAGHDQAYSDIKVPLLEDVLSWAVKKDFLINIELKNSVIRYEGMEEKVLEAVKRFNVEDRVILSTFNHDSLALCARLAPHIERAVLTSDVLYQADRYIASIPASGYHPKINSPGVTDEVLKKMRNGLIKVRPYTVNRPEDMKRLIEAGADRMFTDFPERLRHC

SEQ ID NO: 77633 - DNA, 24 bp, Primer
atgaaattgacgctgaaaaacctt

SEQ ID NO: 77634 - DNA, 28 bp, Primer
ttactctttattaagaaattttactgcc

SEQ ID NO: 77635 - protein, 391 aa, consensus
  MISC_FEATURE (1)..(391): consensus for the disclosure of xaa see table XV
HRGXSXXXPEXTXXXXXXAXXXXXDXXEXXDXXXTXDXXLXXXHXXXXXXXXXXXXXXXXXXXXXXXXXXXXXXXXXXXXXXXXXXXXXXXXXXXXDXTLXEXXXLXXXXXXXXXXXXXXXXXXXXXXXXXXXXXXXXTXXEXXXXXXXXXXXXXXXXXXXXXXXXXXXXXXXXXXXXXXXXXXXLXXXXXXXXXXXXXXXXXXXXXXXXXXXXXQXFXXXXLXXXXXXXXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXXXTXXXXXXXXXXXXXXXXXXXXXXXXXXXXXXXXXXXXXXXXXXGXFTD

SEQ ID NO: 77636 - protein, 46 aa, consensus
  MISC_FEATURE (1)..(46): consensus for the disclosure of xaa see table XV
XXXGXXXXXPXXXXXXXXXXXXXXXXXXXXXDXXXXXDXXXXXXXX

SEQ ID NO: 77637 - protein, 10 aa, consensus
  MISC_FEATURE (1)..(10): consensus for the disclosure of xaa see table XV
XXXXXXXXXX

SEQ ID NO: 77638 - DNA, 1923 bp, Escherichia coli K12; identical to SEQ ID NO: 24353
  CDS (777)..(1748)

SEQ ID NO: 77639 - protein, 323 aa, Escherichia coli K12; identical to SEQ ID NO: 24354

SEQ ID NO: 77640 - DNA, 1313 bp, Capsicum annuum (pepper); identical to SEQ ID NO: 24355
  CDS (2)..(1126)

SEQ ID NO: 77641 - protein, 374 aa, Capsicum annuum (pepper); identical to SEQ ID NO: 24356

SEQ ID NO: 77642 - DNA, 1468 bp, Spinacia oleracea (spinach); identical to SEQ ID NO: 24357
  CDS (167)..(1273)

SEQ ID NO: 77643 - protein, 368 aa, Spinacia oleracea (spinach); identical to SEQ ID NO: 24358

SEQ ID NO: 77644 - DNA, 1656 bp, Homo sapiens (man); identical to SEQ ID NO: 24359
  CDS (1)..(1656)

SEQ ID NO: 77645 - protein, 551 aa, Homo sapiens (man); identical to SEQ ID NO: 24360

SEQ ID NO: 77646 - DNA, 984 bp, Aquifex aeolicus; identical to SEQ ID NO: 24361
  CDS (1)..(984)

SEQ ID NO: 77647 - protein, 327 aa, Aquifex aeolicus; identical to SEQ ID NO: 24362

SEQ ID NO: 77648 - DNA, 954 bp, Deinococcus radiodurans; identical to SEQ ID NO: 24363
  CDS (1)..(954)

SEQ ID NO: 77649 - protein, 317 aa, Deinococcus radiodurans; identical to SEQ ID NO: 24364

SEQ ID NO: 77650 - DNA, 1149 bp, Pseudomonas aeruginosa; identical to SEQ ID NO: 24365
  CDS (250)..(1149)

SEQ ID NO: 77651 - protein, 299 aa, Pseudomonas aeruginosa; identical to SEQ ID NO: 24366

SEQ ID NO: 77652 - DNA, 1210 bp, Arabidopsis thaliana (mouse-ear cress); identical to SEQ ID NO: 24367
  CDS (1)..(1179)

SEQ ID NO: 77653 - protein, 392 aa, Arabidopsis thaliana (mouse-ear cress); identical to SEQ ID NO: 24368

SEQ ID NO: 77654 - DNA, 960 bp, Nostoc sp. PCC 7120; identical to SEQ ID NO: 24369
  CDS (1)..(960)

SEQ ID NO: 77655 - protein, 319 aa, Nostoc sp. PCC 7120; identical to SEQ ID NO: 24370

SEQ ID NO: 77656 - DNA, 972 bp, Salmonella enterica subsp. enterica serovar Typhi; identical to SEQ ID NO: 24371
  CDS (1)..(972)

SEQ ID NO: 77657 - protein, 323 aa, Salmonella enterica subsp. enterica serovar Typhi; identical to SEQ ID NO: 24372

SEQ ID NO: 77658 - DNA, 1029 bp, Brucella melitensis; identical to SEQ ID NO: 24373
  CDS (1)..(1029)

SEQ ID NO: 77659 - protein, 342 aa, Brucella melitensis; identical to SEQ ID NO: 24374

SEQ ID NO: 77660 - DNA, 927 bp, Listeria innocua; identical to SEQ ID NO: 24375
  CDS (1)..(927)

SEQ ID NO: 77661 - protein, 308 aa, Listeria innocua; identical to SEQ ID NO: 24376

SEQ ID NO: 77662 - DNA, 975 bp, Nostoc sp. PCC 7120; identical to SEQ ID NO: 24377
  CDS (1)..(975)

SEQ ID NO: 77663 - protein, 324 aa, Nostoc sp. PCC 7120; identical to SEQ ID NO: 24378

SEQ ID NO: 77664 - DNA, 963 bp, Nostoc sp. PCC 7120; identical to SEQ ID NO: 24379
  CDS (1)..(963)

SEQ ID NO: 77665 - protein, 320 aa, Nostoc sp. PCC 7120; identical to SEQ ID NO: 24380

SEQ ID NO: 77666 - DNA, 1011 bp, Brucella melitensis; identical to SEQ ID NO: 24381
  CDS (1)..(1011)

SEQ ID NO: 77667 - protein, 336 aa, Brucella melitensis; identical to SEQ ID NO: 24382

SEQ ID NO: 77668 - DNA, 969 bp, Yersinia pestis; identical to SEQ ID NO: 24383
  CDS (1)..(969)

SEQ ID NO: 77669 - protein, 322 aa, Yersinia pestis; identical to SEQ ID NO: 24384

SEQ ID NO: 77670 - DNA, 942 bp, Staphylococcus aureus; identical to SEQ ID NO: 24385
  CDS (10)..(942)

SEQ ID NO: 77671 - protein, 310 aa, Staphylococcus aureus; identical to SEQ ID NO: 24386

SEQ ID NO: 77672 - DNA, 1038 bp, Agrobacterium tumefaciens; identical to SEQ ID NO: 24387
  CDS (1)..(1038)

SEQ ID NO: 77673 - protein, 345 aa, Agrobacterium tumefaciens; identical to SEQ ID NO: 24388

SEQ ID NO: 77674 - DNA, 921 bp, Helicobacter pylori; identical to SEQ ID NO: 24389
  CDS (1)..(921)

SEQ ID NO: 77675 - protein, 306 aa, Helicobacter pylori; identical to SEQ ID NO: 24390

SEQ ID NO: 77676 - DNA, 1395 bp, Mycobacterium tuberculosis; identical to SEQ ID NO: 24391
  CDS (1)..(1395)

SEQ ID NO: 77677 - protein, 464 aa, Mycobacterium tuberculosis; identical to SEQ ID NO: 24392

SEQ ID NO: 77678 - DNA, 969 bp, Vibrio cholerae; identical to SEQ ID NO: 24393
  CDS (1)..(969)

SEQ ID NO: 77679 - protein, 322 aa, Vibrio cholerae; identical to SEQ ID NO: 24394

SEQ ID NO: 77680 - DNA, 984 bp, Halobacterium sp. NRC-1; identical to SEQ ID NO: 24395
  CDS (1)..(984)

SEQ ID NO: 77681 - protein, 327 aa, Halobacterium sp. NRC-1; identical to SEQ ID NO: 24396

SEQ ID NO: 77682 - DNA, 999 bp, Caulobacter crescentus; identical to SEQ ID NO: 24397
  CDS (1)..(999)

SEQ ID NO: 77683 - protein, 332 aa, Caulobacter crescentus; identical to SEQ ID NO: 24398

SEQ ID NO: 77684 - DNA, 1014 bp, Caenorhabditis elegans; identical to SEQ ID NO: 24399
  CDS (1)..(1014)

SEQ ID NO: 77685 - protein, 337 aa, Caenorhabditis elegans; identical to SEQ ID NO: 24400

SEQ ID NO: 77686 - DNA, 972 bp, Mycobacterium tuberculosis; identical to SEQ ID NO: 24401
  CDS (1)..(972)

SEQ ID NO: 77687 - protein, 323 aa, Mycobacterium tuberculosis; identical to SEQ ID NO: 24402

SEQ ID NO: 77688 - DNA, 888 bp, Vibrio cholerae; identical to SEQ ID NO: 24403
  CDS (1)..(888)

SEQ ID NO: 77689 - protein, 295 aa, Vibrio cholerae; identical to SEQ ID NO: 24404

SEQ ID NO: 77690 - DNA, 999 bp, Xylella fastidiosa; identical to SEQ ID NO: 24405
  CDS (1)..(999)

SEQ ID NO: 77691 - protein, 332 aa, Xylella fastidiosa; identical to SEQ ID NO: 24406

SEQ ID NO: 77692 - DNA, 933 bp, Lactococcus lactis subsp. lactis; identical to SEQ ID NO: 24407
  CDS (1)..(933)

SEQ ID NO: 77693 - protein, 310 aa, Lactococcus lactis subsp. lactis; identical to SEQ ID NO: 24408

SEQ ID NO: 77694 - DNA, 921 bp, Streptococcus pneumoniae; identical to SEQ ID NO: 24409
  CDS (1)..(921)

SEQ ID NO: 77695 - protein, 306 aa, Streptococcus pneumoniae; identical to SEQ ID NO: 24410

SEQ ID NO: 77696 - DNA, 975 bp, Pseudomonas aeruginosa; identical to SEQ ID NO: 24411
  CDS (1)..(975)

SEQ ID NO: 77697 - protein, 324 aa, Pseudomonas aeruginosa; identical to SEQ ID NO: 24412

SEQ ID NO: 77698 - DNA, 1374 bp, Pseudomonas aeruginosa; identical to SEQ ID NO: 24413
  CDS (1)..(1374)

SEQ ID NO: 77699 - protein, 457 aa, Pseudomonas aeruginosa; identical to SEQ ID NO: 24414

SEQ ID NO: 77700 - DNA, 948 bp, Buchnera sp; identical to SEQ ID NO: 24415
  CDS (1)..(948)

SEQ ID NO: 77701 - protein, 315 aa, Buchnera sp; identical to SEQ ID NO: 24416

SEQ ID NO: 77702 - DNA, 906 bp, Staphylococcus aureus; identical to SEQ ID NO: 24417
  CDS (1)..(906)

SEQ ID NO: 77703 - protein, 301 aa, Staphylococcus aureus; identical to SEQ ID NO: 24418

SEQ ID NO: 77704 - DNA, 930 bp, Clostridium acetobutylicum; identical to SEQ ID NO: 24419
  CDS (1)..(930)

SEQ ID NO: 77705 - protein, 309 aa, Clostridium acetobutylicum; identical to SEQ ID NO: 24420

SEQ ID NO: 77706 - DNA, 951 bp, Haemophilus influenzae; identical to SEQ ID NO: 24421
  CDS (1)..(951)

SEQ ID NO: 77707 - protein, 316 aa, Haemophilus influenzae; identical to SEQ ID NO: 24422

SEQ ID NO: 77708 - DNA, 876 bp, Thermotoga maritima; identical to SEQ ID NO: 24423
  CDS (1)..(876)

SEQ ID NO: 77709 - protein, 291 aa, Thermotoga maritima; identical to SEQ ID NO: 24424

SEQ ID NO: 77710 - DNA, 1182 bp, Aeropyrum pernix; identical to SEQ ID NO: 24425
  CDS (1)..(1182)

SEQ ID NO: 77711 - protein, 393 aa, Aeropyrum pernix; identical to SEQ ID NO: 24426

SEQ ID NO: 77712 - DNA, 921 bp, Lactococcus lactis subsp. lactis; identical to SEQ ID NO: 24427
  CDS (1)..(921)

SEQ ID NO: 77713 - protein, 306 aa, Lactococcus lactis subsp. lactis; identical to SEQ ID NO: 24428

SEQ ID NO: 77714 - DNA, 933 bp, Mycobacterium tuberculosis; identical to SEQ ID NO: 24429
  CDS (1)..(933)

SEQ ID NO: 77715 - protein, 310 aa, Mycobacterium tuberculosis; identical to SEQ ID NO: 24430

SEQ ID NO: 77716 - DNA, 900 bp, Campylobacter jejuni; identical to SEQ ID NO: 24431
  CDS (1)..(900)

SEQ ID NO: 77717 - protein, 299 aa, Campylobacter jejuni; identical to SEQ ID NO: 24432

SEQ ID NO: 77718 - DNA, 1371 bp, Xylella fastidiosa; identical to SEQ ID NO: 24433
  CDS (1)..(1371)

SEQ ID NO: 77719 - protein, 456 aa, Xylella fastidiosa; identical to SEQ ID NO: 24434

SEQ ID NO: 77720 - DNA, 918 bp, Pseudomonas aeruginosa; identical to SEQ ID NO: 24435
  CDS (1)..(918)

SEQ ID NO: 77721 - protein, 305 aa, Pseudomonas aeruginosa; identical to SEQ ID NO: 24436

SEQ ID NO: 77722 - DNA, 939 bp, Bacillus halodurans; identical to SEQ ID NO: 24437
  CDS (1)..(939)

SEQ ID NO: 77723 - protein, 312 aa, Bacillus halodurans; identical to SEQ ID NO: 24438

SEQ ID NO: 77724 - DNA, 825 bp, Halobacterium sp. NRC-1; identical to SEQ ID NO: 24439
  CDS (1)..(825)

SEQ ID NO: 77725 - protein, 274 aa, Halobacterium sp. NRC-1; identical to SEQ ID NO: 24440

SEQ ID NO: 77726 - DNA, 987 bp, Caulobacter crescentus; identical to SEQ ID NO: 24441
  CDS (1)..(987)

SEQ ID NO: 77727 - protein, 328 aa, Caulobacter crescentus; identical to SEQ ID NO: 24442

SEQ ID NO: 77728 - DNA, 969 bp, Agrobacterium tumefaciens; identical to SEQ ID NO: 24443
  CDS (1)..(969)

SEQ ID NO: 77729 - protein, 322 aa, Agrobacterium tumefaciens; identical to SEQ ID NO: 24444

SEQ ID NO: 77730 - DNA, 924 bp, Bacillus subtilis; identical to SEQ ID NO: 24445
  CDS (1)..(924)

SEQ ID NO: 77731 - protein, 307 aa, Bacillus subtilis; identical to SEQ ID NO: 24446

SEQ ID NO: 77732 - DNA, 936 bp, Bacillus subtilis; identical to SEQ ID NO: 24447
  CDS (1)..(936)

SEQ ID NO: 77733 - protein, 311 aa, Bacillus subtilis; identical to SEQ ID NO: 24448

SEQ ID NO: 77734 - DNA, 933 bp, Neisseria meningitidis; identical to SEQ ID NO: 24449
  CDS (1)..(933)

SEQ ID NO: 77735 - protein, 310 aa, Neisseria meningitidis; identical to SEQ ID NO: 24450

SEQ ID NO: 77736 - DNA, 924 bp, Bacillus halodurans; identical to SEQ ID NO: 24451
  CDS (1)..(924)

SEQ ID NO: 77737 - protein, 307 aa, Bacillus halodurans; identical to SEQ ID NO: 24452

SEQ ID NO: 77738 - DNA, 1014 bp, Caenorhabditis elegans; identical to SEQ ID NO: 24453
  CDS (1)..(1014)

SEQ ID NO: 77739 - protein, 337 aa, Caenorhabditis elegans; identical to SEQ ID NO: 24454

SEQ ID NO: 77740 - DNA, 912 bp, Clostridium acetobutylicum; identical to SEQ ID NO: 24455
  CDS (1)..(912)

SEQ ID NO: 77741 - protein, 303 aa, Clostridium acetobutylicum; identical to SEQ ID NO: 24456

SEQ ID NO: 77742 - DNA, 1128 bp, Campylobacter jejuni; identical to SEQ ID NO: 24457
  CDS (105)..(1004)

SEQ ID NO: 77743 - protein, 299 aa, Campylobacter jejuni; identical to SEQ ID NO: 24458

SEQ ID NO: 77744 - DNA, 1371 bp, Triticum aestivum (common wheat); identical to SEQ ID NO: 24459
  CDS (72)..(1049)

SEQ ID NO: 77745 - protein, 325 aa, Triticum aestivum (common wheat); identical to SEQ ID NO: 24460

SEQ ID NO: 77746 - DNA, 1351 bp, Salmonella typhimurium; identical to SEQ ID NO: 24461
  CDS (423)..(1334)

SEQ ID NO: 77747 - protein, 303 aa, Salmonella typhimurium; identical to SEQ ID NO: 24462

SEQ ID NO: 77748 - DNA, 1432 bp, Spinacia oleracea (spinach); identical to SEQ ID NO: 24463
  CDS (54)..(1205)

SEQ ID NO: 77749 - protein, 383 aa, Spinacia oleracea (spinach); identical to SEQ ID NO: 24464

SEQ ID NO: 77750 - DNA, 1281 bp, Spinacia oleracea (spinach); identical to SEQ ID NO: 24465
  CDS (52)..(1029)

SEQ ID NO: 77751 - protein, 325 aa, Spinacia oleracea (spinach) [sequence omitted]

SEQ ID NO: 77752 - DNA, 1855 bp, Citrullus lanatus (watermelon); identical to SEQ ID NO: 24467
  CDS (564)..(1541)

SEQ ID NO: 77753 - protein, 325 aa, Citrullus lanatus (watermelon); identical to SEQ ID NO: 24468

SEQ ID NO: 77754 - DNA, 1278 bp, Arabidopsis thaliana (mouse-ear cress); identical to SEQ ID NO: 24469
  CDS (87)..(1061)

SEQ ID NO: 77755 - protein, 324 aa, Arabidopsis thaliana (mouse-ear cress); identical to SEQ ID NO: 24470

SEQ ID NO: 77756 - DNA, 1319 bp, Zea mays (maize); identical to SEQ ID NO: 24471
  CDS (73)..(1050)

SEQ ID NO: 77757 - protein, 325 aa, Zea mays (maize); identical to SEQ ID NO: 24472

SEQ ID NO: 77758 - DNA, 990 bp, Synechococcus sp; identical to SEQ ID NO: 24473
  CDS (1)..(990)

SEQ ID NO: 77759 - protein, 329 aa, Synechococcus sp; identical to SEQ ID NO: 24474

SEQ ID NO: 77760 - DNA, 1775 bp, Flavobacterium sp; identical to SEQ ID NO: 24475
  CDS (509)..(1432)

SEQ ID NO: 77761 - protein, 307 aa, Flavobacterium sp; identical to SEQ ID NO: 24476

SEQ ID NO: 77762 - DNA, 927 bp, Bacillus subtilis; identical to SEQ ID NO: 24477
  CDS (1)..(927)

SEQ ID NO: 77763 - protein, 308 aa, Bacillus subtilis; identical to SEQ ID NO: 24478

SEQ ID NO: 77764 - DNA, 978 bp, Synechocystis sp; identical to SEQ ID NO: 24479
  CDS (1)..(978)

SEQ ID NO: 77765 - protein, 325 aa, Synechocystis sp; identical to SEQ ID NO: 24480

SEQ ID NO: 77766 - DNA, 996 bp, Synechocystis sp; identical to SEQ ID NO: 24481
  CDS (1)..(996)

SEQ ID NO: 77767 - protein, 331 aa, Synechocystis sp; identical to SEQ ID NO: 24482

SEQ ID NO: 77768 - DNA, 912 bp, Escherichia coli; identical to SEQ ID NO: 24483
  CDS (1)..(912)

SEQ ID NO: 77769 - protein, 303 aa, Escherichia coli; identical to SEQ ID NO: 24484

SEQ ID NO: 77770 - DNA, 1308 bp, Solanum tuberosum (potato); identical to SEQ ID NO: 24485
  CDS (35)..(1012)

SEQ ID NO: 77771 - protein, 325 aa, Solanum tuberosum (potato); identical to SEQ ID NO: 24486

SEQ ID NO: 77772 - DNA, 1404 bp, Solanum tuberosum (potato); identical to SEQ ID NO: 24487
  CDS (21)..(1181)

SEQ ID NO: 77773 - protein, 386 aa, Solanum tuberosum (potato); identical to SEQ ID NO: 24488

SEQ ID NO: 77774 - DNA, 1492 bp, Chlamydomonas reinhardtii; identical to SEQ ID NO: 24489
  CDS (73)..(1131)

SEQ ID NO: 77775 - protein, 352 aa, Chlamydomonas reinhardtii; identical to SEQ ID NO: 24490

SEQ ID NO: 77776 - DNA, 1446 bp, chloroplast Spinacia oleracea (spinach); identical to SEQ ID NO: 24491
  CDS (43)..(1215)

SEQ ID NO: 77777 - protein, 390 aa, chloroplast Spinacia oleracea (spinach); identical to SEQ ID NO: 24492

SEQ ID NO: 77778 - DNA, 1035 bp, Caenorhabditis elegans; identical to SEQ ID NO: 24493
  CDS (1)..(1035)

SEQ ID NO: 77779 - protein, 344 aa, Caenorhabditis elegans; identical to SEQ ID NO: 24494

SEQ ID NO: 77780 - DNA, 1014 bp, Caenorhabditis elegans; identical to SEQ ID NO: 24495
  CDS (1)..(1014)

SEQ ID NO: 77781 - protein, 337 aa, Caenorhabditis elegans; identical to SEQ ID NO: 24496

SEQ ID NO: 77782 - DNA, 951 bp, Streptomyces coelicolor; identical to SEQ ID NO: 24497
  CDS (1)..(951)

SEQ ID NO: 77783 - protein, 316 aa, Streptomyces coelicolor; identical to SEQ ID NO: 24498

SEQ ID NO: 77784 - DNA, 1056 bp, Schizosaccharomyces pombe; identical to SEQ ID NO: 24499
  CDS (1)..(1056)

SEQ ID NO: 77785 - protein, 351 aa, Schizosaccharomyces pombe; identical to SEQ ID NO: 24500

SEQ ID NO: 77786 - DNA, 909 bp, Clostridium perfringens; identical to SEQ ID NO: 24501
  CDS (1)..(909)

SEQ ID NO: 77787 - protein, 302 aa, Clostridium perfringens; identical to SEQ ID NO: 24502

SEQ ID NO: 77788 - DNA, 927 bp, Methanosarcina barkeri; identical to SEQ ID NO: 24503
  CDS (1)..(927)

SEQ ID NO: 77789 - protein, 308 aa, Methanosarcina barkeri; identical to SEQ ID NO: 24504

SEQ ID NO: 77790 - DNA, 933 bp, Mycobacterium leprae; identical to SEQ ID NO: 24505
  CDS (1)..(933)

SEQ ID NO: 77791 - protein, 310 aa, Mycobacterium leprae; identical to SEQ ID NO: 24506

SEQ ID NO: 77792 - DNA, 1329 bp, Arabidopsis thaliana (mouse-ear cress); identical to SEQ ID NO: 24507
  CDS (1)..(1329)

SEQ ID NO: 77793 - protein, 442 aa, Arabidopsis thaliana (mouse-ear cress); identical to SEQ ID NO: 24508

SEQ ID NO: 77794 - DNA, 1142 bp, Arabidopsis thaliana (mouse-ear cress); identical to SEQ ID NO: 24509
  CDS (1)..(1107)

SEQ ID NO: 77795 - protein, 368 aa, Arabidopsis thaliana (mouse-ear cress); identical to SEQ ID NO: 24510

SEQ ID NO: 77796 - DNA, 1056 bp, Corynebacterium glutamicum; identical to SEQ ID NO: 24511
  CDS (101)..(1036)

SEQ ID NO: 77797 - protein, 311 aa, Corynebacterium glutamicum; identical to SEQ ID NO: 24512

SEQ ID NO: 77798 - DNA, 1035 bp, Rhodobacter sphaeroides; identical to SEQ ID NO: 24513
  CDS (1)..(1035)

SEQ ID NO: 77799 - protein, 344 aa, Rhodobacter sphaeroides; identical to SEQ ID NO: 24514

SEQ ID NO: 77800 - DNA, 1200 bp, Entamoeba histolytica; identical to SEQ ID NO: 24515
  CDS (83)..(1096)

SEQ ID NO: 77801 - protein, 337 aa, Entamoeba histolytica; identical to SEQ ID NO: 24516

SEQ ID NO: 77802 - DNA, 1524 bp, Saccharomyces cerevisiae; identical to SEQ ID NO: 24517
  CDS (1)..(1524)

SEQ ID NO: 77803 - protein, 507 aa, Saccharomyces cerevisiae; identical to SEQ ID NO: 24518

SEQ ID NO: 77804 - DNA, 894 bp, Yersinia pseudotuberculosis IP 32953; identical to SEQ ID NO: 24519
  CDS (1)..(894)

SEQ ID NO: 77805 - protein, 297 aa, Yersinia pseudotuberculosis IP 32953; identical to SEQ ID NO: 24520

SEQ ID NO: 77806 - DNA, 936 bp, Symbiobacterium thermophilum; identical to SEQ ID NO: 24521
  CDS (1)..(936)

SEQ ID NO: 77807 - protein, 311 aa, Symbiobacterium thermophilum; identical to SEQ ID NO: 24522

SEQ ID NO: 77808 - DNA, 936 bp, Propionibacterium acnes; identical to SEQ ID NO: 24523
  CDS (1)..(936)

SEQ ID NO: 77809 - protein, 311 aa, Propionibacterium acnes; identical to SEQ ID NO: 24524

SEQ ID NO: 77810 - DNA, 921 bp, Desulfotalea psychrophila; identical to SEQ ID NO: 24525
  CDS (1)..(921)

SEQ ID NO: 77811 - protein, 306 aa, Desulfotalea psychrophila; identical to SEQ ID NO: 24526

SEQ ID NO: 77812 - DNA, 1095 bp, Debaryomyces hansenii CBS767; identical to SEQ ID NO: 24527
  CDS (1)..(1095)

SEQ ID NO: 77813 - protein, 364 aa, Debaryomyces hansenii CBS767; identical to SEQ ID NO: 24528

SEQ ID NO: 77814 - DNA, 1476 bp, Debaryomyces hansenii CBS767; identical to SEQ ID NO: 24529
  CDS (1)..(1476)

SEQ ID NO: 77815 - protein, 491 aa, Debaryomyces hansenii CBS767; identical to SEQ ID NO: 24530

SEQ ID NO: 77816 - DNA, 1134 bp, Yarrowia lipolytica CLIB99; identical to SEQ ID NO: 24531
  CDS (1)..(1134)

SEQ ID NO: 77817 - protein, 377 aa, Yarrowia lipolytica CLIB99; identical to SEQ ID NO: 24532

SEQ ID NO: 77818 - DNA, 1617 bp, Yarrowia lipolytica CLIB99; identical to SEQ ID NO: 24533
  CDS (1)..(1617)

SEQ ID NO: 77819 - protein, 538 aa, Yarrowia lipolytica CLIB99; identical to SEQ ID NO: 24534

SEQ ID NO: 77820 - DNA, 1482 bp, Kluyveromyces lactis NRRL Y; identical to SEQ ID NO: 24535
  CDS (1)..(1482)

SEQ ID NO: 77821 - protein, 493 aa, Kluyveromyces lactis NRRL Y; identical to SEQ ID NO: 24536

SEQ ID NO: 77822 - DNA, 969 bp, Erwinia carotovora; identical to SEQ ID NO: 24537
  CDS (1)..(969)

SEQ ID NO: 77823 - protein, 322 aa, Erwinia carotovora; identical to SEQ ID NO: 24538

SEQ ID NO: 77824 - DNA, 2098 bp, Xenopus laevis; identical to SEQ ID NO: 24539
  CDS (30)..(1718)

SEQ ID NO: 77825 - protein, 562 aa, Xenopus laevis; identical to SEQ ID NO: 24540

SEQ ID NO: 77826 - DNA, 924 bp, Acinetobacter sp; identical to SEQ ID NO: 24541
  CDS (1)..(924)

SEQ ID NO: 77827 - protein, 307 aa, Acinetobacter sp; identical to SEQ ID NO: 24542

SEQ ID NO: 77828 - DNA, 999 bp, Acinetobacter sp; identical to SEQ ID NO: 24543
  CDS (1)..(999)

SEQ ID NO: 77829 - protein, 332 aa, Acinetobacter sp; identical to SEQ ID NO: 24544

SEQ ID NO: 77830 - DNA, 1506 bp, Candida glabrata CBS138; identical to SEQ ID NO: 24545
  CDS (1)..(1506)

SEQ ID NO: 77831 - protein, 501 aa, Candida glabrata CBS138; identical to SEQ ID NO: 24546

SEQ ID NO: 77832 - DNA, 918 bp, Bacillus thuringiensis; identical to SEQ ID NO: 24547
  CDS (1)..(918)

SEQ ID NO: 77833 - protein, 305 aa, Bacillus thuringiensis; identical to SEQ ID NO: 24548

SEQ ID NO: 77834 - DNA, 924 bp, Bacillus thuringiensis; identical to SEQ ID NO: 24549
  CDS (1)..(924)

SEQ ID NO: 77835 - protein, 307 aa, Bacillus thuringiensis; identical to SEQ ID NO: 24550

SEQ ID NO: 77836 - DNA, 951 bp, Picrophilus torridus; identical to SEQ ID NO: 24551
  CDS (1)..(951)

SEQ ID NO: 77837 - protein, 316 aa, Picrophilus torridus; identical to SEQ ID NO: 24552

SEQ ID NO: 77838 - DNA, 969 bp, Photobacterium profundum; identical to SEQ ID NO: 24553
  CDS (1)..(969)

SEQ ID NO: 77839 - protein, 322 aa, Photobacterium profundum; identical to SEQ ID NO: 24554

SEQ ID NO: 77840 - DNA, 936 bp, Corynebacterium glutamicum; identical to SEQ ID NO: 24555
  CDS (1)..(936)

SEQ ID NO: 77841 - protein, 311 aa, Corynebacterium glutamicum; identical to SEQ ID NO: 24556

SEQ ID NO: 77842 - DNA, 1047 bp, Bdellovibrio bacteriovorus; identical to SEQ ID NO: 24557
  CDS (1)..(1047)

SEQ ID NO: 77843 - protein, 348 aa, Bdellovibrio bacteriovorus; identical to SEQ ID NO: 24558

SEQ ID NO: 77844 - DNA, 990 bp, Bdellovibrio bacteriovorus; identical to SEQ ID NO: 24559
  CDS (1)..(990)

SEQ ID NO: 77845 - protein, 329 aa, Bdellovibrio bacteriovorus; identical to SEQ ID NO: 24560

SEQ ID NO: 77846 - DNA, 990 bp, Bdellovibrio bacteriovorus; identical to SEQ ID NO: 24561
  CDS (1)..(990)

SEQ ID NO: 77847 - protein, 329 aa, Bdellovibrio bacteriovorus; identical to SEQ ID NO: 24562

SEQ ID NO: 77848 - DNA, 1038 bp, Rhodopseudomonas palustris; identical to SEQ ID NO: 24563
  CDS (1)..(1038)

SEQ ID NO: 77849 - protein, 345 aa, Rhodopseudomonas palustris; identical to SEQ ID NO: 24564

SEQ ID NO: 77850 - DNA, 1398 bp, Rhodopseudomonas palustris; identical to SEQ ID NO: 24565
  CDS (1)..(1398)

SEQ ID NO: 77851 - protein, 465 aa, Rhodopseudomonas palustris; identical to SEQ ID NO: 24566

SEQ ID NO: 77852 - DNA, 999 bp, Rhodopseudomonas palustris; identical to SEQ ID NO: 24567
  CDS (1)..(999)

SEQ ID NO: 77853 - protein, 332 aa, Rhodopseudomonas palustris; identical to SEQ ID NO: 24568

SEQ ID NO: 77854 - DNA, 936 bp, Corynebacterium diphtheriae; identical to SEQ ID NO: 24569
  CDS (1)..(936)

SEQ ID NO: 77855 - protein, 311 aa, Corynebacterium diphtheriae; identical to SEQ ID NO: 24570

SEQ ID NO: 77856 - DNA, 906 bp, uncultured bacterium 561; identical to SEQ ID NO: 24571
  CDS (1)..(906)

SEQ ID NO: 77857 - protein, 301 aa, uncultured bacterium 561; identical to SEQ ID NO: 24572

SEQ ID NO: 77858 - DNA, 927 bp, Desulfovibrio vulgaris; identical to SEQ ID NO: 24573
  CDS (1)..(927)

SEQ ID NO: 77859 - protein, 308 aa, Desulfovibrio vulgaris; identical to SEQ ID NO: 24574

SEQ ID NO: 77860 - DNA, 915 bp, Thermus thermophilus; identical to SEQ ID NO: 24575
  CDS (1)..(915)

SEQ ID NO: 77861 - protein, 304 aa, Thermus thermophilus; identical to SEQ ID NO: 24576

SEQ ID NO: 77862 - DNA, 924 bp, Bacillus cereus; identical to SEQ ID NO: 24577
  CDS (1)..(924)

SEQ ID NO: 77863 - protein, 307 aa, Bacillus cereus; identical to SEQ ID NO: 24578

SEQ ID NO: 77864 - DNA, 933 bp, Mycobacterium paratuberculosis; identical to SEQ ID NO: 24579
  CDS (1)..(933)

SEQ ID NO: 77865 - protein, 310 aa, Mycobacterium paratuberculosis; identical to SEQ ID NO: 24580

SEQ ID NO: 77866 - DNA, 1407 bp, Mycobacterium paratuberculosis; identical to SEQ ID NO: 24581
  CDS (1)..(1407)

SEQ ID NO: 77867 - protein, 468 aa, Mycobacterium paratuberculosis; identical to SEQ ID NO: 24582

SEQ ID NO: 77868 - DNA, 927 bp, Geobacter sulfurreducens; identical to SEQ ID NO: 24583
  CDS (1)..(927)

SEQ ID NO: 77869 - protein, 308 aa, Geobacter sulfurreducens; identical to SEQ ID NO: 24584

SEQ ID NO: 77870 - DNA, 924 bp, Geobacter sulfurreducens; identical to SEQ ID NO: 24585
  CDS (1)..(924)

SEQ ID NO: 77871 - protein, 307 aa, Geobacter sulfurreducens; identical to SEQ ID NO: 24586

SEQ ID NO: 77872 - DNA, 1479 bp, Ashbya gossypii; identical to SEQ ID NO: 24587
  CDS (1)..(1479)

SEQ ID NO: 77873 - protein, 492 aa, Ashbya gossypii; identical to SEQ ID NO: 24588

SEQ ID NO: 77874 - DNA, 1098 bp, Spinacia oleracea; identical to SEQ ID NO: 24589
  CDS (78)..(1076)

SEQ ID NO: 77875 - protein, 332 aa, Spinacia oleracea; identical to SEQ ID NO: 24590

SEQ ID NO: 77876 - DNA, 1221 bp, Penicillium chrysogenum; identical to SEQ ID NO: 24591
  CDS (45)..(1160)

SEQ ID NO: 77877 - protein, 371 aa, Penicillium chrysogenum; identical to SEQ ID NO: 24592

SEQ ID NO: 77878 - DNA, 1206 bp, Solanum tuberosum; identical to SEQ ID NO: 24593
  CDS (35)..(1090)

SEQ ID NO: 77879 - protein, 351 aa, Solanum tuberosum; identical to SEQ ID NO: 24594

SEQ ID NO: 77880 - DNA, 999 bp, Wolinella succinogenes; identical to SEQ ID NO: 24595
  CDS (1)..(999)

SEQ ID NO: 77881 - protein, 332 aa, Wolinella succinogenes; identical to SEQ ID NO: 24596

SEQ ID NO: 77882 - DNA, 969 bp, Vibrio vulnificus; identical to SEQ ID NO: 24597
  CDS (1)..(969)

SEQ ID NO: 77883 - protein, 322 aa, Vibrio vulnificus; identical to SEQ ID NO: 24598

SEQ ID NO: 77884 - DNA, 1029 bp, Photorhabdus luminescens; identical to SEQ ID NO: 24599
  CDS (1)..(1029)

SEQ ID NO: 77885 - protein, 342 aa, Photorhabdus luminescens; identical to SEQ ID NO: 24600

SEQ ID NO: 77886 - DNA, 954 bp, Photorhabdus luminescens; identical to SEQ ID NO: 24601
  CDS (1)..(954)

SEQ ID NO: 77887 - protein, 317 aa, Photorhabdus luminescens; identical to SEQ ID NO: 24602

SEQ ID NO: 77888 - DNA, 882 bp, Photorhabdus luminescens; identical to SEQ ID NO: 24603
  CDS (1)..(882)

SEQ ID NO: 77889 - protein, 293 aa, Photorhabdus luminescens; identical to SEQ ID NO: 24604

SEQ ID NO: 77890 - DNA, 1368 bp, Photorhabdus luminescens; identical to SEQ ID NO: 24605
  CDS (1)..(1368)

SEQ ID NO: 77891 - protein, 455 aa, Photorhabdus luminescens; identical to SEQ ID NO: 24606

SEQ ID NO: 77892 - DNA, 963 bp, Gloeobacter violaceus; identical to SEQ ID NO: 24607
  CDS (1)..(963)

SEQ ID NO: 77893 - protein, 320 aa, Gloeobacter violaceus; identical to SEQ ID NO: 24608

SEQ ID NO: 77894 - DNA, 963 bp, Gloeobacter violaceus; identical to SEQ ID NO: 24609
  CDS (1)..(963)

SEQ ID NO: 77895 - protein, 320 aa, Gloeobacter violaceus; identical to SEQ ID NO: 24610

SEQ ID NO: 77896 - DNA, 933 bp, Chromobacterium violaceum; identical to SEQ ID NO: 24611
  CDS (1)..(933)

SEQ ID NO: 77897 - protein, 310 aa, Chromobacterium violaceum; identical to SEQ ID NO: 24612

SEQ ID NO: 77898 - DNA, 1371 bp, Chromobacterium violaceum; identical to SEQ ID NO: 24613
  CDS (1)..(1371)

SEQ ID NO: 77899 - protein, 456 aa, Chromobacterium violaceum; identical to SEQ ID NO: 24614

SEQ ID NO: 77900 - DNA, 891 bp, Chromobacterium violaceum; identical to SEQ ID NO: 24615
  CDS (1)..(891)

SEQ ID NO: 77901 - protein, 296 aa, Chromobacterium violaceum; identical to SEQ ID NO: 24616

SEQ ID NO: 77902 - DNA, 1131 bp, Neurospora crassa; identical to SEQ ID NO: 24617
  CDS (1)..(1131)

SEQ ID NO: 77903 - protein, 376 aa, Neurospora crassa; identical to SEQ ID NO: 24618

SEQ ID NO: 77904 - DNA, 1587 bp, Neurospora crassa; identical to SEQ ID NO: 24619
  CDS (1)..(1587)

SEQ ID NO: 77905 - protein, 528 aa, Neurospora crassa; identical to SEQ ID NO: 24620

SEQ ID NO: 77906 - DNA, 1371 bp, Neurospora crassa; identical to SEQ ID NO: 24621
  CDS (1)..(1371)

SEQ ID NO: 77907 - protein, 456 aa, Neurospora crassa; identical to SEQ ID NO: 24622

SEQ ID NO: 77908 - DNA, 969 bp, Synechococcus sp; identical to SEQ ID NO: 24623
  CDS (1)..(969)

SEQ ID NO: 77909 - protein, 322 aa, Synechococcus sp; identical to SEQ ID NO: 24624

SEQ ID NO: 77910 - DNA, 987 bp, Synechococcus sp; identical to SEQ ID NO: 24625
  CDS (1)..(987)

SEQ ID NO: 77911 - protein, 328 aa, Synechococcus sp; identical to SEQ ID NO: 24626

SEQ ID NO: 77912 - DNA, 960 bp, Rhodopirellula baltica; identical to SEQ ID NO: 24627
  CDS (1)..(960)

SEQ ID NO: 77913 - protein, 319 aa, Rhodopirellula baltica; identical to SEQ ID NO: 24628

SEQ ID NO: 77914 - DNA, 987 bp, Prochlorococcus marinus subsp; identical to SEQ ID NO: 24629
  CDS (1)..(987)

SEQ ID NO: 77915 - protein, 328 aa, Prochlorococcus marinus subsp; identical to SEQ ID NO: 24630

SEQ ID NO: 77916 - DNA, 969 bp, Prochlorococcus marinus subsp; identical to SEQ ID NO: 24631
  CDS (1)..(969)

SEQ ID NO: 77917 - protein, 322 aa, Prochlorococcus marinus subsp; identical to SEQ ID NO: 24632

SEQ ID NO: 77918 - DNA, 969 bp, Prochlorococcus marinus; identical to SEQ ID NO: 24633
  CDS (1)..(969)

SEQ ID NO: 77919 - protein, 322 aa, Prochlorococcus marinus; identical to SEQ ID NO: 24634

SEQ ID NO: 77920 - DNA, 987 bp, Prochlorococcus marinus; identical to SEQ ID NO: 24635
  CDS (1)..(987)

SEQ ID NO: 77921 - protein, 328 aa, Prochlorococcus marinus; identical to SEQ ID NO: 24636

SEQ ID NO: 77922 - DNA, 987 bp, Prochlorococcus marinus; identical to SEQ ID NO: 24637
  CDS (1)..(987)

SEQ ID NO: 77923 - protein, 328 aa, Prochlorococcus marinus; identical to SEQ ID NO: 24638

SEQ ID NO: 77924 - DNA, 969 bp, Prochlorococcus marinus; identical to SEQ ID NO: 24639
  CDS (1)..(969)

SEQ ID NO: 77925 - protein, 322 aa, Prochlorococcus marinus; identical to SEQ ID NO: 24640

SEQ ID NO: 77926 - DNA, 903 bp, Helicobacter hepaticus; identical to SEQ ID NO: 24641
  CDS (1)..(903)

SEQ ID NO: 77927 - protein, 300 aa, Helicobacter hepaticus; identical to SEQ ID NO: 24642

SEQ ID NO: 77928 - DNA, 942 bp, Helicobacter hepaticus; identical to SEQ ID NO: 24643
  CDS (1)..(942)

SEQ ID NO: 77929 - protein, 313 aa, Helicobacter hepaticus; identical to SEQ ID NO: 24644

SEQ ID NO: 77930 - DNA, 951 bp, Haemophilus ducreyi; identical to SEQ ID NO: 24645
  CDS (1)..(951)

SEQ ID NO: 77931 - protein, 316 aa, Haemophilus ducreyi; identical to SEQ ID NO: 24646

SEQ ID NO: 77932 - DNA, 945 bp, Candidatus Blochmannia floridanus; identical to SEQ ID NO: 24647
  CDS (1)..(945)

SEQ ID NO: 77933 - protein, 314 aa, Candidatus Blochmannia floridanus; identical to SEQ ID NO: 24648

SEQ ID NO: 77934 - DNA, 912 bp, Bordetella parapertussis; identical to SEQ ID NO: 24649
  CDS (1)..(912)

SEQ ID NO: 77935 - protein, 303 aa, Bordetella parapertussis; identical to SEQ ID NO: 24650

SEQ ID NO: 77936 - DNA, 969 bp, Propionibacterium freudenreichii shermanii; identical to SEQ ID NO: 24651
  CDS (1)..(969)

SEQ ID NO: 77937 - protein, 322 aa, Propionibacterium freudenreichii shermanii; identical to SEQ ID NO: 24652

SEQ ID NO: 77938 - DNA, 927 bp, Propionibacterium freudenreichii shermanii; identical to SEQ ID NO: 24653
  CDS (1)..(927)

SEQ ID NO: 77939 - protein, 308 aa, Propionibacterium freudenreichii shermanii; identical to SEQ ID NO: 24654

SEQ ID NO: 77940 - DNA, 1466 bp, Porphyra purpurea; identical to SEQ ID NO: 24655
  CDS (149)..(1282)

SEQ ID NO: 77941 - protein, 377 aa, Porphyra purpurea; identical to SEQ ID NO: 24656

SEQ ID NO: 77942 - DNA, 1436 bp, Oryza sativa; identical to SEQ ID NO: 24657
  CDS (57)..(1190)

SEQ ID NO: 77943 - protein, 377 aa, Oryza sativa; identical to SEQ ID NO: 24658

SEQ ID NO: 77944 - DNA, 1059 bp, Betula verrucosa; identical to SEQ ID NO: 24659
  CDS (1)..(1059)

SEQ ID NO: 77945 - protein, 352 aa, Betula verrucosa; identical to SEQ ID NO: 24660

SEQ ID NO: 77946 - DNA, 1990 bp, Xenopus laevis; identical to SEQ ID NO: 24661
  CDS (68)..(1765)

SEQ ID NO: 77947 - protein, 565 aa, Xenopus laevis; identical to SEQ ID NO: 24662

SEQ ID NO: 77948 - DNA, 924 bp, Bacillus cereus; identical to SEQ ID NO: 24663
  CDS (1)..(924)

SEQ ID NO: 77949 - protein, 307 aa, Bacillus cereus; identical to SEQ ID NO: 24664

SEQ ID NO: 77950 - DNA, 924 bp, Bacillus cereus; identical to SEQ ID NO: 24665
  CDS (1)..(924)

SEQ ID NO: 77951 - protein, 307 aa, Bacillus cereus; identical to SEQ ID NO: 24666

SEQ ID NO: 77952 - DNA, 951 bp, Streptomyces avermitilis; identical to SEQ ID NO: 24667
  CDS (1)..(951)

SEQ ID NO: 77953 - protein, 316 aa, Streptomyces avermitilis; identical to SEQ ID NO: 24668

SEQ ID NO: 77954 - DNA, 1395 bp, Streptomyces avermitilis; identical to SEQ ID NO: 24669
  CDS (1)..(1395)

SEQ ID NO: 77955 - protein, 464 aa, Streptomyces avermitilis; identical to SEQ ID NO: 24670

SEQ ID NO: 77956 - DNA, 888 bp, Nitrosomonas europaea; identical to SEQ ID NO: 24671
  CDS (1)..(888)

SEQ ID NO: 77957 - protein, 295 aa, Nitrosomonas europaea; identical to SEQ ID NO: 24672

SEQ ID NO: 77958 - DNA, 933 bp, Enterococcus faecalis; identical to SEQ ID NO: 24673
  CDS (1)..(933)

SEQ ID NO: 77959 - protein, 310 aa, Enterococcus faecalis; identical to SEQ ID NO: 24674

SEQ ID NO: 77960 - DNA, 918 bp, Enterococcus faecalis; identical to SEQ ID NO: 24675
  CDS (1)..(918)

SEQ ID NO: 77961 - protein, 305 aa, Enterococcus faecalis; identical to SEQ ID NO: 24676

SEQ ID NO: 77962 - DNA, 951 bp, Coxiella burnetii; identical to SEQ ID NO: 24677
  CDS (1)..(951)

SEQ ID NO: 77963 - protein, 316 aa, Coxiella burnetii; identical to SEQ ID NO: 24678

SEQ ID NO: 77964 - DNA, 990 bp, Shigella flexneri; identical to SEQ ID NO: 24679
  CDS (1)..(990)

SEQ ID NO: 77965 - protein, 329 aa, Shigella flexneri; identical to SEQ ID NO: 24680

SEQ ID NO: 77966 - DNA, 927 bp, Bacillus stearothermophilus; identical to SEQ ID NO: 24681
  CDS (1)..(927)

SEQ ID NO: 77967 - protein, 308 aa, Bacillus stearothermophilus [sequence omitted]

SEQ ID NO: 77968 - DNA, 1230 bp, Oryza sativa; identical to SEQ ID NO: 24683
  CDS (1)..(1230)

SEQ ID NO: 77969 - protein, 409 aa, Oryza sativa; identical to SEQ ID NO: 24684

SEQ ID NO: 77970 - DNA, 1371 bp, Xylella fastidiosa; identical to SEQ ID NO: 24685
  CDS (1)..(1371)

SEQ ID NO: 77971 - protein, 456 aa, Xylella fastidiosa; identical to SEQ ID NO: 24686

SEQ ID NO: 77972 - DNA, 969 bp, Vibrio parahaemolyticus; identical to SEQ ID NO: 24687
  CDS (1)..(969)

SEQ ID NO: 77973 - protein, 322 aa, Vibrio parahaemolyticus; identical to SEQ ID NO: 24688

SEQ ID NO: 77974 - DNA, 975 bp, Pseudomonas syringae; identical to SEQ ID NO: 24689
  CDS (1)..(975)

SEQ ID NO: 77975 - protein, 324 aa, Pseudomonas syringae; identical to SEQ ID NO: 24690

SEQ ID NO: 77976 - DNA, 984 bp, Pseudomonas syringae; identical to SEQ ID NO: 24691
  CDS (1)..(984)

SEQ ID NO: 77977 - protein, 327 aa, Pseudomonas syringae; identical to SEQ ID NO: 24692

SEQ ID NO: 77978 - DNA, 903 bp, Pseudomonas syringae; identical to SEQ ID NO: 24693
  CDS (1)..(903)

SEQ ID NO: 77979 - protein, 300 aa, Pseudomonas syringae; identical to SEQ ID NO: 24694

SEQ ID NO: 77980 - DNA, 975 bp, Pseudomonas putida; identical to SEQ ID NO: 24695
  CDS (1)..(975)

SEQ ID NO: 77981 - protein, 324 aa, Pseudomonas putida; identical to SEQ ID NO: 24696

SEQ ID NO: 77982 - DNA, 900 bp, Pseudomonas putida; identical to SEQ ID NO: 24697
  CDS (1)..(900)

SEQ ID NO: 77983 - protein, 299 aa, Pseudomonas putida; identical to SEQ ID NO: 24698

SEQ ID NO: 77984 - DNA, 912 bp, Lactobacillus plantarum; identical to SEQ ID NO: 24699
  CDS (1)..(912)

SEQ ID NO: 77985 - protein, 303 aa, Lactobacillus plantarum; identical to SEQ ID NO: 24700

SEQ ID NO: 77986 - DNA, 918 bp, Clostridium tetani; identical to SEQ ID NO: 24701
  CDS (1)..(918)

SEQ ID NO: 77987 - protein, 305 aa, Clostridium tetani; identical to SEQ ID NO: 24702

SEQ ID NO: 77988 - DNA, 978 bp, Bradyrhizobium japonicum; identical to SEQ ID NO: 24703
  CDS (1)..(978)

SEQ ID NO: 77989 - protein, 325 aa, Bradyrhizobium japonicum; identical to SEQ ID NO: 24704

SEQ ID NO: 77990 - DNA, 1035 bp, Bradyrhizobium japonicum; identical to SEQ ID NO: 24705
  CDS (1)..(1035)

SEQ ID NO: 77991 - protein, 344 aa, Bradyrhizobium japonicum; identical to SEQ ID NO: 24706

SEQ ID NO: 77992 - DNA, 948 bp, Bacteroides thetaiotaomicron; identical to SEQ ID NO: 24707
  CDS (1)..(948)

SEQ ID NO: 77993 - protein, 315 aa, Bacteroides thetaiotaomicron; identical to SEQ ID NO: 24708

SEQ ID NO: 77994 - DNA, 954 bp, Bacteroides thetaiotaomicron; identical to SEQ ID NO: 24709
  CDS (1)..(954)

SEQ ID NO: 77995 - protein, 317 aa, Bacteroides thetaiotaomicron; identical to SEQ ID NO: 24710

SEQ ID NO: 77996 - DNA, 909 bp, Staphylococcus epidermidis; identical to SEQ ID NO: 24711
  CDS (1)..(909)

SEQ ID NO: 77997 - protein, 302 aa, Staphylococcus epidermidis; identical to SEQ ID NO: 24712

SEQ ID NO: 77998 - DNA, 930 bp, Oceanobacillus iheyensis; identical to SEQ ID NO: 24713
  CDS (1)..(930)

SEQ ID NO: 77999 - protein, 309 aa, Oceanobacillus iheyensis; identical to SEQ ID NO: 24714

SEQ ID NO: 78000 - DNA, 1089 bp, Synechococcus elongatus; identical to SEQ ID NO: 24715
  CDS (1)..(1089)

SEQ ID NO: 78001 - protein, 362 aa, Synechococcus elongatus; identical to SEQ ID NO: 24716

SEQ ID NO: 78002 - DNA, 966 bp, Synechococcus elongatus; identical to SEQ ID NO: 24717
  CDS (1)..(966)

SEQ ID NO: 78003 - protein, 321 aa, Synechococcus elongatus; identical to SEQ ID NO: 24718

SEQ ID NO: 78004 - DNA, 927 bp, Streptococcus mutans; identical to SEQ ID NO: 24719
  CDS (1)..(927)

SEQ ID NO: 78005 - protein, 308 aa, Streptococcus mutans; identical to SEQ ID NO: 24720

SEQ ID NO: 78006 - DNA, 927 bp, Streptococcus agalactiae; identical to SEQ ID NO: 24721
  CDS (1)..(927)

SEQ ID NO: 78007 - protein, 308 aa, Streptococcus agalactiae; identical to SEQ ID NO: 24722

SEQ ID NO: 78008 - DNA, 969 bp, Shewanella oneidensis; identical to SEQ ID NO: 24723
  CDS (1)..(969)

SEQ ID NO: 78009 - protein, 322 aa, Shewanella oneidensis; identical to SEQ ID NO: 24724

SEQ ID NO: 78010 - DNA, 924 bp, Oceanobacillus iheyensis; identical to SEQ ID NO: 24725
  CDS (1)..(924)

SEQ ID NO: 78011 - protein, 307 aa, Oceanobacillus iheyensis; identical to SEQ ID NO: 24726

SEQ ID NO: 78012 - DNA, 927 bp, Oceanobacillus iheyensis; identical to SEQ ID NO: 24727
  CDS (1)..(927)

SEQ ID NO: 78013 - protein, 308 aa, Oceanobacillus iheyensis; identical to SEQ ID NO: 24728

SEQ ID NO: 78014 - DNA, 930 bp, Leptospira interrogans; identical to SEQ ID NO: 24729
  CDS (1)..(930)

SEQ ID NO: 78015 - protein, 309 aa, Leptospira interrogans; identical to SEQ ID NO: 24730

SEQ ID NO: 78016 - DNA, 936 bp, Corynebacterium efficiens; identical to SEQ ID NO: 24731
  CDS (1)..(936)

SEQ ID NO: 78017 - protein, 311 aa, Corynebacterium efficiens; identical to SEQ ID NO: 24732

SEQ ID NO: 78018 - DNA, 1227 bp, Bifidobacterium longum; identical to SEQ ID NO: 24733
  CDS (1)..(1227)

SEQ ID NO: 78019 - protein, 408 aa, Bifidobacterium longum; identical to SEQ ID NO: 24734

SEQ ID NO: 78020 - DNA, 1572 bp, Phytophthora infestans; identical to SEQ ID NO: 24735
  CDS (5)..(1474)

SEQ ID NO: 78021 - protein, 489 aa, Phytophthora infestans; identical to SEQ ID NO: 24736

SEQ ID NO: 78022 - DNA, 942 bp, Streptococcus pyogenes; identical to SEQ ID NO: 24737
  CDS (1)..(942)

SEQ ID NO: 78023 - protein, 313 aa, Streptococcus pyogenes; identical to SEQ ID NO: 24738

SEQ ID NO: 78024 - DNA, 1371 bp, Chlorobium tepidum; identical to SEQ ID NO: 24739
  CDS (1)..(1371)

SEQ ID NO: 78025 - protein, 456 aa, Chlorobium tepidum; identical to SEQ ID NO: 24740

SEQ ID NO: 78026 - DNA, 933 bp, Chlorobium tepidum; identical to SEQ ID NO: 24741
  CDS (1)..(933)

SEQ ID NO: 78027 - protein, 310 aa, Chlorobium tepidum; identical to SEQ ID NO: 24742

SEQ ID NO: 78028 - DNA, 1075 bp, Fusobacterium nucleatum; identical to SEQ ID NO: 24743
  CDS (135)..(1055)

SEQ ID NO: 78029 - protein, 306 aa, Fusobacterium nucleatum; identical to SEQ ID NO: 24744

SEQ ID NO: 78030 - DNA, 1386 bp, Rhodococcus erythropolis; identical to SEQ ID NO: 24745
  CDS (1)..(1386)

SEQ ID NO: 78031 - protein, 461 aa, Rhodococcus erythropolis; identical to SEQ ID NO: 24746

SEQ ID NO: 78032 - DNA, 1303 bp, Arabidopsis thaliana; identical to SEQ ID NO: 24747
  CDS (93)..(1067)

SEQ ID NO: 78033 - protein, 324 aa, Arabidopsis thaliana; identical to SEQ ID NO: 24748

SEQ ID NO: 78034 - DNA, 1422 bp, Arabidopsis thaliana; identical to SEQ ID NO: 24749
  CDS (239)..(1210)

SEQ ID NO: 78035 - protein, 323 aa, Arabidopsis thaliana; identical to SEQ ID NO: 24750

SEQ ID NO: 78036 - DNA, 1602 bp, Magnaporthe grisea; identical to SEQ ID NO: 24751
  CDS (1)..(1602)

SEQ ID NO: 78037 - protein, 533 aa, Magnaporthe grisea; identical to SEQ ID NO: 24752

SEQ ID NO: 78038 - DNA, 960 bp, Xanthomonas campestris; identical to SEQ ID NO: 24753
  CDS (1)..(960)

SEQ ID NO: 78039 - protein, 319 aa, Xanthomonas campestris; identical to SEQ ID NO: 24754

SEQ ID NO: 78040 - DNA, 1371 bp, Xanthomonas campestris; identical to SEQ ID NO: 24755
  CDS (1)..(1371)

SEQ ID NO: 78041 - protein, 456 aa, Xanthomonas campestris; identical to SEQ ID NO: 24756

SEQ ID NO: 78042 - DNA, 1371 bp, Xanthomonas axonopodis; identical to SEQ ID NO: 24757
  CDS (1)..(1371)

SEQ ID NO: 78043 - protein, 456 aa, Xanthomonas axonopodis; identical to SEQ ID NO: 24758

SEQ ID NO: 78044 - DNA, 960 bp, Xanthomonas axonopodis; identical to SEQ ID NO: 24759
  CDS (1)..(960)

SEQ ID NO: 78045 - protein, 319 aa, Xanthomonas axonopodis; identical to SEQ ID NO: 24760

SEQ ID NO: 78046 - DNA, 939 bp, Thermoanaerobacter tengcongensis; identical to SEQ ID NO: 24761
  CDS (1)..(939)

SEQ ID NO: 78047 - protein, 312 aa, Thermoanaerobacter tengcongensis; identical to SEQ ID NO: 24762

SEQ ID NO: 78048 - DNA, 921 bp, Thermoanaerobacter tengcongensis; identical to SEQ ID NO: 24763
  CDS (1)..(921)

SEQ ID NO: 78049 - protein, 306 aa, Thermoanaerobacter tengcongensis; identical to SEQ ID NO: 24764

SEQ ID NO: 78050 - DNA, 951 bp, Fusobacterium nucleatum; identical to SEQ ID NO: 24765
  CDS (1)..(951)

SEQ ID NO: 78051 - protein, 316 aa, Fusobacterium nucleatum; identical to SEQ ID NO: 24766

SEQ ID NO: 78052 - DNA, 927 bp, Methanosarcina acetivorans; identical to SEQ ID NO: 24767
  CDS (1)..(927)

SEQ ID NO: 78053 - protein, 308 aa, Methanosarcina acetivorans; identical to SEQ ID NO: 24768

SEQ ID NO: 78054 - DNA, 1267 bp, Glycine max; identical to SEQ ID NO: 24769
  CDS (82)..(1059)

SEQ ID NO: 78055 - protein, 325 aa, Glycine max; identical to SEQ ID NO: 24770

SEQ ID NO: 78056 - DNA, 903 bp, Clostridium perfringens; identical to SEQ ID NO: 24771
  CDS (1)..(903)

SEQ ID NO: 78057 - protein, 300 aa, Clostridium perfringens; identical to SEQ ID NO: 24772

SEQ ID NO: 78058 - DNA, 975 bp, Ralstonia solanacearum; identical to SEQ ID NO: 24773
  CDS (1)..(975)

SEQ ID NO: 78059 - protein, 324 aa, Ralstonia solanacearum; identical to SEQ ID NO: 24774

SEQ ID NO: 78060 - DNA, 903 bp, Ralstonia solanacearum; identical to SEQ ID NO: 24775
  CDS (1)..(903)

SEQ ID NO: 78061 - protein, 300 aa, Ralstonia solanacearum; identical to SEQ ID NO: 24776

SEQ ID NO: 78062 - DNA, 2433 bp, Mus musculus; identical to SEQ ID NO: 24777
  CDS (187)..(1872)

SEQ ID NO: 78063 - protein, 561 aa, Mus musculus; identical to SEQ ID NO: 24778

SEQ ID NO: 78064 - DNA, 969 bp, Rhizobium meliloti; identical to SEQ ID NO: 24779
  CDS (1)..(969)

SEQ ID NO: 78065 - protein, 322 aa, Rhizobium meliloti; identical to SEQ ID NO: 24780

SEQ ID NO: 78066 - DNA, 1601 bp, Pichia pastoris; identical to SEQ ID NO: 24781
  CDS (14)..(1519)

SEQ ID NO: 78067 - protein, 501 aa, Pichia pastoris; identical to SEQ ID NO: 24782

SEQ ID NO: 78068 - DNA, 1089 bp, Rhizobium loti; identical to SEQ ID NO: 24783
  CDS (1)..(1089)

SEQ ID NO: 78069 - protein, 362 aa, Rhizobium loti; identical to SEQ ID NO: 24784

SEQ ID NO: 78070 - DNA, 1440 bp, Rhizobium loti; identical to SEQ ID NO: 24785
  CDS (1)..(1440)

SEQ ID NO: 78071 - protein, 479 aa, Rhizobium loti; identical to SEQ ID NO: 24786

SEQ ID NO: 78072 - DNA, 1035 bp, Rhizobium loti; identical to SEQ ID NO: 24787
  CDS (1)..(1035)

SEQ ID NO: 78073 - protein, 344 aa, Rhizobium loti; identical to SEQ ID NO: 24788

SEQ ID NO: 78074 - DNA, 1370 bp, Trypanosoma cruzi; identical to SEQ ID NO: 24789
  CDS (15)..(1169)

SEQ ID NO: 78075 - protein, 384 aa, Trypanosoma cruzi; identical to SEQ ID NO: 24790

SEQ ID NO: 78076 - DNA, 1200 bp, Arabidopsis thaliana; identical to SEQ ID NO: 24791
  CDS (1)..(1200)

SEQ ID NO: 78077 - protein, 399 aa, Arabidopsis thaliana; identical to SEQ ID NO: 24792

SEQ ID NO: 78078 - DNA, 948 bp, Pasteurella multocida; identical to SEQ ID NO: 24793
  CDS (1)..(948)

SEQ ID NO: 78079 - protein, 315 aa, Pasteurella multocida; identical to SEQ ID NO: 24794

SEQ ID NO: 78080 - DNA, 1392 bp, Streptomyces venezuelae; identical to SEQ ID NO: 24795
  CDS (1)..(1392)

SEQ ID NO: 78081 - protein, 463 aa, Streptomyces venezuelae; identical to SEQ ID NO: 24796

SEQ ID NO: 78082 - DNA, 927 bp, Bacillus stearothermophilus; identical to SEQ ID NO: 24797
  CDS (1)..(927)

SEQ ID NO: 78083 - protein, 308 aa, Bacillus stearothermophilus; identical to SEQ ID NO: 24798

SEQ ID NO: 78084 - DNA, 951 bp, Selenomonas ruminantium; identical to SEQ ID NO: 24799
  CDS (19)..(951)

SEQ ID NO: 78085 - protein, 310 aa, Selenomonas ruminantium; identical to SEQ ID NO: 24800

SEQ ID NO: 78086 - DNA, 1378 bp, Solanum tuberosum; identical to SEQ ID NO: 24801
  CDS (55)..(1215)

SEQ ID NO: 78087 - protein, 386 aa, Solanum tuberosum; identical to SEQ ID NO: 24802

SEQ ID NO: 78088 - DNA, 1354 bp, Solanum tuberosum; identical to SEQ ID NO: 24803
  CDS (85)..(1062)

SEQ ID NO: 78089 - protein, 325 aa, Solanum tuberosum; identical to SEQ ID NO: 24804

SEQ ID NO: 78090 - DNA, 1250 bp, Solanum tuberosum; identical to SEQ ID NO: 24805
  CDS (96)..(1139)

SEQ ID NO: 78091 - protein, 347 aa, Solanum tuberosum; identical to SEQ ID NO: 24806

SEQ ID NO: 78092 - DNA, 1493 bp, Nicotiana tabacum; identical to SEQ ID NO: 24807
  CDS (88)..(1062)

SEQ ID NO: 78093 - protein, 324 aa, Nicotiana tabacum; identical to SEQ ID NO: 24808

SEQ ID NO: 78094 - DNA, 927 bp, Methanosarcina thermophila; identical to SEQ ID NO: 24809
  CDS (1)..(927)

SEQ ID NO: 78095 - protein, 308 aa, Methanosarcina thermophila; identical to SEQ ID NO: 24810

SEQ ID NO: 78096 - DNA, 1269 bp, Salmonella enterica subsp; identical to SEQ ID NO: 24811
  CDS (205)..(1176)

SEQ ID NO: 78097 - protein, 323 aa, Salmonella enterica subsp; identical to SEQ ID NO: 24812

SEQ ID NO: 78098 - DNA, 1386 bp, Streptomyces coelicolor; identical to SEQ ID NO: 24813
  CDS (1)..(1386)

SEQ ID NO: 78099 - protein, 461 aa, Streptomyces coelicolor; identical to SEQ ID NO: 24814

SEQ ID NO: 78100 - DNA, 915 bp, Clostridium sticklandii; identical to SEQ ID NO: 24815
  CDS (1)..(915)

SEQ ID NO: 78101 - protein, 304 aa, Clostridium sticklandii; identical to SEQ ID NO: 24816

SEQ ID NO: 78102 - DNA, 1671 bp, Allium tuberosum; identical to SEQ ID NO: 24817
  CDS (417)..(1394)

SEQ ID NO: 78103 - protein, 325 aa, Allium tuberosum; identical to SEQ ID NO: 24818

SEQ ID NO: 78104 - DNA, 1868 bp, Oryctolagus cuniculus; identical to SEQ ID NO: 24819
  CDS (71)..(1726)

SEQ ID NO: 78105 - protein, 551 aa, Oryctolagus cuniculus; identical to SEQ ID NO: 24820

SEQ ID NO: 78106 - DNA, 1077 bp, Leishmania tarentolae; identical to SEQ ID NO: 24821
  CDS (1)..(1077)

SEQ ID NO: 78107 - protein, 358 aa, Leishmania tarentolae; identical to SEQ ID NO: 24822

SEQ ID NO: 78108 - DNA, 990 bp, Synechococcus sp; identical to SEQ ID NO: 24823
  CDS (1)..(990)

SEQ ID NO: 78109 - protein, 329 aa, Synechococcus sp; identical to SEQ ID NO: 24824

SEQ ID NO: 78110 - DNA, 921 bp, Lactococcus lactis; identical to SEQ ID NO: 24825
  CDS (1)..(921)

SEQ ID NO: 78111 - protein, 306 aa, Lactococcus lactis; identical to SEQ ID NO: 24826

SEQ ID NO: 78112 - DNA, 1014 bp, Zymomonas mobilis; identical to SEQ ID NO: 24827
  CDS (1)..(1014)

SEQ ID NO: 78113 - protein, 337 aa, Zymomonas mobilis; identical to SEQ ID NO: 24828

SEQ ID NO: 78114 - DNA, 927 bp, Streptococcus suis; identical to SEQ ID NO: 24829
  CDS (1)..(927)

SEQ ID NO: 78115 - protein, 308 aa, Streptococcus suis; identical to SEQ ID NO: 24830

SEQ ID NO: 78116 - DNA, 1173 bp, Cyanidioschyzon merolae; identical to SEQ ID NO: 24831
  CDS (1)..(1173)

SEQ ID NO: 78117 - protein, 390 aa, Cyanidioschyzon merolae; identical to SEQ ID NO: 24832

SEQ ID NO: 78118 - DNA, 1170 bp, Cyanidioschyzon merolae; identical to SEQ ID NO: 24833
  CDS (1)..(1170)

SEQ ID NO: 78119 - protein, 389 aa, Cyanidioschyzon merolae; identical to SEQ ID NO: 24834

SEQ ID NO: 78120 - DNA, 972 bp, Arabidopsis thaliana; identical to SEQ ID NO: 24835
  CDS (1)..(972)

SEQ ID NO: 78121 - protein, 323 aa, Arabidopsis thaliana; identical to SEQ ID NO: 24836

SEQ ID NO: 78122 - DNA, 1068 bp, Entamoeba dispar; identical to SEQ ID NO: 24837
  CDS (26)..(1036)

SEQ ID NO: 78123 - protein, 336 aa, Entamoeba dispar; identical to SEQ ID NO: 24838

SEQ ID NO: 78124 - DNA, 1151 bp, Entamoeba dispar; identical to SEQ ID NO: 24839
  CDS (100)..(1110)

SEQ ID NO: 78125 - protein, 336 aa, Entamoeba dispar; identical to SEQ ID NO: 24840

SEQ ID NO: 78126 - DNA, 1780 bp, Drosophila melanogaster; identical to SEQ ID NO: 24841
  CDS (66)..(1634)

SEQ ID NO: 78127 - protein, 522 aa, Drosophila melanogaster; identical to SEQ ID NO: 24842

SEQ ID NO: 78128 - DNA, 1020 bp, Oryza sativa; identical to SEQ ID NO: 24843
  CDS (1)..(1020)

SEQ ID NO: 78129 - protein, 339 aa, Oryza sativa; identical to SEQ ID NO: 24844

SEQ ID NO: 78130 - DNA, 1758 bp, Fugu rubripes; identical to SEQ ID NO: 24845
  CDS (1)..(1758)

SEQ ID NO: 78131 - protein, 585 aa, Fugu rubripes; identical to SEQ ID NO: 24846

SEQ ID NO: 78132 - DNA, 1511 bp, Dictyostelium discoideum; identical to SEQ ID NO: 24847
  CDS (1)..(1494)

SEQ ID NO: 78133 - protein, 497 aa, Dictyostelium discoideum; identical to SEQ ID NO: 24848

SEQ ID NO: 78134 - DNA, 1280 bp, Brassica juncea; identical to SEQ ID NO: 24849
  CDS (74)..(1042)

SEQ ID NO: 78135 - protein, 322 aa, Brassica juncea; identical to SEQ ID NO: 24850

SEQ ID NO: 78136 - DNA, 1290 bp, Oryza sativa; identical to SEQ ID NO: 24851
  CDS (74)..(1039)

SEQ ID NO: 78137 - protein, 321 aa, Oryza sativa; identical to SEQ ID NO: 24852

SEQ ID NO: 78138 - DNA, 1238 bp, Brassica juncea; identical to SEQ ID NO: 24853
  CDS (18)..(992)

SEQ ID NO: 78139 - protein, 324 aa, Brassica juncea; identical to SEQ ID NO: 24854

SEQ ID NO: 78140 - DNA, 1363 bp, Oryza sativa; identical to SEQ ID NO: 24855
  CDS (139)..(1116)

SEQ ID NO: 78141 - protein, 325 aa, Oryza sativa; identical to SEQ ID NO: 24856

SEQ ID NO: 78142 - DNA, 969 bp, Buchnera aphidicola; identical to SEQ ID NO: 24857
  CDS (1)..(969)

SEQ ID NO: 78143 - protein, 322 aa, Buchnera aphidicola; identical to SEQ ID NO: 24858

SEQ ID NO: 78144 - DNA, 942 bp, Staphylococcus epidermidis; identical to SEQ ID NO: 24859
  CDS (10)..(942)

SEQ ID NO: 78145 - protein, 310 aa, Staphylococcus epidermidis; identical to SEQ ID NO: 24860

SEQ ID NO: 78146 - DNA, 1459 bp, Arabidopsis thaliana; identical to SEQ ID NO: 24861
  CDS (1)..(1215)

SEQ ID NO: 78147 - protein, 404 aa, Arabidopsis thaliana; identical to SEQ ID NO: 24862

SEQ ID NO: 78148 - DNA, 24 bp, Primer
atgagtaagatttttgaagataac

SEQ ID NO: 78149 - DNA, 25 bp, Primer
ttactgttgcaattctttctcagtg

SEQ ID NO: 78150 - protein, 420 aa, consensus; identical to SEQ ID NO: 25512
  MISC_FEATURE (1)..(420): consensus for the disclosure of xaa see table XV

SEQ ID NO: 78151 - protein, 56 aa, consensus; identical to SEQ ID NO: 25508
  MISC_FEATURE (1)..(56): consensus for the disclosure of xaa see table XV

SEQ ID NO: 78152 - protein, 53 aa, consensus; identical to SEQ ID NO: 25509
  MISC_FEATURE (1)..(53): consensus for the disclosure of xaa see table XV

SEQ ID NO: 78153 - protein, 74 aa, consensus; identical to SEQ ID NO: 25510
  MISC_FEATURE (1)..(74): consensus for the disclosure of xaa see table XV

SEQ ID NO: 78154 - protein, 32 aa, consensus; identical to SEQ ID NO: 25511
  MISC_FEATURE (1)..(32): consensus for the disclosure of xaa see table XV

SEQ ID NO: 78155 - DNA, 858 bp, Escherichia coli; identical to SEQ ID NO: 61757
  CDS (1)..(858)

SEQ ID NO: 78156 - protein, 285 aa, Escherichia coli; identical to SEQ ID NO: 61758

SEQ ID NO: 78157 - DNA, 735 bp, Staphylococcus aureus subsp. aureus COL; identical to SEQ ID NO: 61759
  CDS (1)..(735)

SEQ ID NO: 78158 - protein, 244 aa, Staphylococcus aureus subsp. aureus COL; identical to SEQ ID NO: 61760

SEQ ID NO: 78159 - DNA, 741 bp, Gluconobacter oxydans 621H; identical to SEQ ID NO: 61761
  CDS (1)..(741)

SEQ ID NO: 78160 - protein, 246 aa, Gluconobacter oxydans 621H; identical to SEQ ID NO: 61762

SEQ ID NO: 78161 - DNA, 738 bp, Vibrio fischeri ES114; identical to SEQ ID NO: 61763
  CDS (1)..(738)

SEQ ID NO: 78162 - protein, 245 aa, Vibrio fischeri ES114; identical to SEQ ID NO: 61764

SEQ ID NO: 78163 - DNA, 777 bp, Mesorhizobium loti MAFF303099; identical to SEQ ID NO: 61765
  CDS (1)..(777): transl_table=11

SEQ ID NO: 78164 - protein, 258 aa, Mesorhizobium loti MAFF303099; identical to SEQ ID NO: 61766

SEQ ID NO: 78165 - DNA, 732 bp, Mesorhizobium loti MAFF303099; identical to SEQ ID NO: 61767
  CDS (1)..(732): transl_table=11

SEQ ID NO: 78166 - protein, 243 aa, Mesorhizobium loti MAFF303099; identical to SEQ ID NO: 61768

SEQ ID NO: 78167 - DNA, 765 bp, Mesorhizobium loti MAFF303099; identical to SEQ ID NO: 61769
  CDS (1)..(765): transl_table=11

SEQ ID NO: 78168 - protein, 254 aa, Mesorhizobium loti MAFF303099; identical to SEQ ID NO: 61770

SEQ ID NO: 78169 - DNA, 777 bp, Mesorhizobium loti MAFF303099; identical to SEQ ID NO: 61771
  CDS (1)..(777): transl_table=11

SEQ ID NO: 78170 - protein, 258 aa, Mesorhizobium loti MAFF303099; identical to SEQ ID NO: 61772

SEQ ID NO: 78171 - DNA, 738 bp, Mesorhizobium loti MAFF303099; identical to SEQ ID NO: 7296
  CDS (1)..(738): transl_table=11

SEQ ID NO: 78172 - protein, 245 aa, Mesorhizobium loti MAFF303099; identical to SEQ ID NO: 7297

SEQ ID NO: 78173 - DNA, 771 bp, Mesorhizobium loti MAFF303099; identical to SEQ ID NO: 61775
  CDS (1)..(771): transl_table=11

SEQ ID NO: 78174 - protein, 256 aa, Mesorhizobium loti MAFF303099; identical to SEQ ID NO: 61776

SEQ ID NO: 78175 - DNA, 747 bp, Chlamydia trachomatis D/UW-3/CX; identical to SEQ ID NO: 7338
  CDS (1)..(747): transl_table=11

SEQ ID NO: 78176 - protein, 248 aa, Chlamydia trachomatis D/UW-3/CX; identical to SEQ ID NO: 61778

SEQ ID NO: 78177 - DNA, 774 bp, Thermotoga maritima MSB8; identical to SEQ ID NO: 61779
  CDS (1)..(774): transl_table=11

SEQ ID NO: 78178 - protein, 257 aa, Thermotoga maritima MSB8; identical to SEQ ID NO: 61780

SEQ ID NO: 78179 - DNA, 747 bp, Vibrio cholerae O1 biovar eltor str. N16961; identical to SEQ ID NO: 61781
  CDS (1)..(747): transl_table=11

SEQ ID NO: 78180 - protein, 248 aa, Vibrio cholerae O1 biovar eltor str. N16961; identical to SEQ ID NO: 61782

SEQ ID NO: 78181 - DNA, 741 bp, Bacillus halodurans C-125; identical to SEQ ID NO: 7050
  CDS (1)..(741): transl_table=11

SEQ ID NO: 78182 - protein, 246 aa, Bacillus halodurans C-125; identical to SEQ ID NO: 7051

SEQ ID NO: 78183 - DNA, 741 bp, Bacillus halodurans C-125; identical to SEQ ID NO: 7090
  CDS (1)..(741): transl_table=11

SEQ ID NO: 78184 - protein, 246 aa, Bacillus halodurans C-125; identical to SEQ ID NO: 7091

SEQ ID NO: 78185 - DNA, 729 bp, Pasteurella multocida subsp. multocida str. Pm70; identical to SEQ ID NO: 7306
  CDS (1)..(729): transl_table=11

SEQ ID NO: 78186 - protein, 242 aa, Pasteurella multocida subsp. multocida str. Pm70; identical to SEQ ID NO: 7307

SEQ ID NO: 78187 - DNA, 783 bp, Pseudomonas aeruginosa PAO1; identical to SEQ ID NO: 61789
  CDS (1)..(783): transl_table=11

SEQ ID NO: 78188 - protein, 260 aa, Pseudomonas aeruginosa PAO1; identical to SEQ ID NO: 61790

SEQ ID NO: 78189 - DNA, 732 bp, Lactococcus lactis subsp. lactis Il1403; identical to SEQ ID NO: 7068
  CDS (1)..(732): transl_table=11

SEQ ID NO: 78190 - protein, 243 aa, Lactococcus lactis subsp. lactis Il1403; identical to SEQ ID NO: 7069

SEQ ID NO: 78191 - DNA, 780 bp, Streptococcus pyogenes M1 GAS; identical to SEQ ID NO: 61793
  CDS (1)..(780): transl_table=11

SEQ ID NO: 78192 - protein, 259 aa, Streptococcus pyogenes M1 GAS; identical to SEQ ID NO: 61794

SEQ ID NO: 78193 - DNA, 744 bp, Xylella fastidiosa 9a5c; identical to SEQ ID NO: 7066
  CDS (1)..(744): transl_table=11

SEQ ID NO: 78194 - protein, 247 aa, Xylella fastidiosa 9a5c; identical to SEQ ID NO: 7067

SEQ ID NO: 78195 - DNA, 750 bp, Clostridium acetobutylicum ATCC 824; identical to SEQ ID NO: 7072
  CDS (1)..(750): transl_table=11

SEQ ID NO: 78196 - protein, 249 aa, Clostridium acetobutylicum ATCC 824; identical to SEQ ID NO: 7073

SEQ ID NO: 78197 - DNA, 918 bp, Agrobacterium tumefaciens str. C58; identical to SEQ ID NO: 61799
  CDS (1)..(918): transl_table=11

SEQ ID NO: 78198 - protein, 305 aa, Agrobacterium tumefaciens str. C58; identical to SEQ ID NO: 61800

SEQ ID NO: 78199 - DNA, 819 bp, Staphylococcus aureus subsp. aureus Mu50; identical to SEQ ID NO: 61801
  CDS (1)..(819): transl_table=11

SEQ ID NO: 78200 - protein, 272 aa, Staphylococcus aureus subsp. aureus Mu50; identical to SEQ ID NO: 61802

SEQ ID NO: 78201 - DNA, 753 bp, Sulfolobus tokodaii str. 7; identical to SEQ ID NO: 7294
  CDS (1)..(753): transl_table=11

SEQ ID NO: 78202 - protein, 250 aa, Sulfolobus tokodaii str. 7; identical to SEQ ID NO: 7295

SEQ ID NO: 78203 - DNA, 738 bp, Sinorhizobium meliloti 1021; identical to SEQ ID NO: 7316
  CDS (1)..(738): transl_table=11

SEQ ID NO: 78204 - protein, 245 aa, Sinorhizobium meliloti 1021; identical to SEQ ID NO: 7317

SEQ ID NO: 78205 - DNA, 759 bp, Sinorhizobium meliloti 1021; identical to SEQ ID NO: 7282
  CDS (1)..(759): transl_table=11

SEQ ID NO: 78206 - protein, 252 aa, Sinorhizobium meliloti 1021; identical to SEQ ID NO: 7283

SEQ ID NO: 78207 - DNA, 741 bp, Caulobacter crescentus CB15; identical to SEQ ID NO: 7026
  CDS (1)..(741): transl_table=11

SEQ ID NO: 78208 - protein, 246 aa, Caulobacter crescentus CB15; identical to SEQ ID NO: 7027

SEQ ID NO: 78209 - DNA, 780 bp, Sinorhizobium meliloti 1021; identical to SEQ ID NO: 61811
  CDS (1)..(780): transl_table=11

SEQ ID NO: 78210 - protein, 259 aa, Sinorhizobium meliloti 1021; identical to SEQ ID NO: 61812

SEQ ID NO: 78211 - DNA, 735 bp, Sinorhizobium meliloti 1021; identical to SEQ ID NO: 61813
  CDS (1)..(735): transl_table=11

SEQ ID NO: 78212 - protein, 244 aa, Sinorhizobium meliloti 1021; identical to SEQ ID NO: 61814

SEQ ID NO: 78213 - DNA, 744 bp, Listeria monocytogenes EGD-e; identical to SEQ ID NO: 61815
  CDS (1)..(744): transl_table=11

SEQ ID NO: 78214 - protein, 247 aa, Listeria monocytogenes EGD-e; identical to SEQ ID NO: 61816

SEQ ID NO: 78215 - DNA, 756 bp, Nostoc sp. PCC 7120; identical to SEQ ID NO: 7036
  CDS (1)..(756): transl_table=11

SEQ ID NO: 78216 - protein, 251 aa, Nostoc sp. PCC 7120; identical to SEQ ID NO: 7037

SEQ ID NO: 78217 - DNA, 798 bp, Ralstonia solanacearum GMI1000; identical to SEQ ID NO: 61819
  CDS (1)..(798): transl_table=11

SEQ ID NO: 78218 - protein, 265 aa, Ralstonia solanacearum GMI1000; identical to SEQ ID NO: 61820

SEQ ID NO: 78219 - DNA, 738 bp, Agrobacterium tumefaciens str. C58; identical to SEQ ID NO: 7054
  CDS (1)..(738): transl_table=11

SEQ ID NO: 78220 - protein, 245 aa, Agrobacterium tumefaciens str. C58; identical to SEQ ID NO: 7055

SEQ ID NO: 78221 - DNA, 777 bp, Agrobacterium tumefaciens str. C58; identical to SEQ ID NO: 61823
  CDS (1)..(777): transl_table=11

SEQ ID NO: 78222 - protein, 258 aa, Agrobacterium tumefaciens str. C58; identical to SEQ ID NO: 61824

SEQ ID NO: 78223 - DNA, 735 bp, Brucella melitensis 16M; identical to SEQ ID NO: 61825
  CDS (1)..(735): transl_table=11

SEQ ID NO: 78224 - protein, 244 aa, Brucella melitensis 16M; identical to SEQ ID NO: 61826

SEQ ID NO: 78225 - DNA, 741 bp, Clostridium perfringens str. 13; identical to SEQ ID NO: 7272
  CDS (1)..(741): transl_table=11

SEQ ID NO: 78226 - protein, 246 aa, Clostridium perfringens str. 13; identical to SEQ ID NO: 7273

SEQ ID NO: 78227 - DNA, 732 bp, Fusobacterium nucleatum subsp. nucleatum ATCC 25586; identical to SEQ ID NO: 7268
  CDS (1)..(732): transl_table=11

SEQ ID NO: 78228 - protein, 243 aa, Fusobacterium nucleatum subsp. nucleatum ATCC 25586; identical to SEQ ID NO: 7269

SEQ ID NO: 78229 - DNA, 780 bp, Streptococcus pyogenes MGAS8232; identical to SEQ ID NO: 61831
  CDS (1)..(780): transl_table=11

SEQ ID NO: 78230 - protein, 259 aa, Streptococcus pyogenes MGAS8232; identical to SEQ ID NO: 61832

SEQ ID NO: 78231 - DNA, 735 bp, Streptococcus pyogenes MGAS8232; identical to SEQ ID NO: 61833
  CDS (1)..(735): transl_table=11

SEQ ID NO: 78232 - protein, 244 aa, Streptococcus pyogenes MGAS8232; identical to SEQ ID NO: 61834

SEQ ID NO: 78233 - DNA, 903 bp, Xanthomonas campestris pv. campestris str. ATCC 33913; identical to SEQ ID NO: 61835
  CDS (1)..(903): transl_table=11

SEQ ID NO: 78234 - protein, 300 aa, Xanthomonas campestris pv. campestris str. ATCC 33913; identical to SEQ ID NO: 61836

SEQ ID NO: 78235 - DNA, 771 bp, Xanthomonas axonopodis pv. citri str. 306; identical to SEQ ID NO: 61837
  CDS (1)..(771): transl_table=11

SEQ ID NO: 78236 - protein, 256 aa, Xanthomonas axonopodis pv. citri str. 306; identical to SEQ ID NO: 61838

SEQ ID NO: 78237 - DNA, 741 bp, Bacillus anthracis str. A2012; identical to SEQ ID NO: 61839
  CDS (1)..(741): r means g or a, n means a or g or c or t/u

SEQ ID NO: 78238 - protein, 246 aa, Bacillus anthracis str. A2012; identical to SEQ ID NO: 61840
  misc_feature (17)..(17): Xaa can be Glu or Gly
  misc_feature (109)..(109): Xaa can be Arg or Gln or Leu or Pro

SEQ ID NO: 78239 - DNA, 741 bp, Bacillus anthracis str. A2012; identical to SEQ ID NO: 61841
  CDS (1)..(741): transl_table=11

SEQ ID NO: 78240 - protein, 246 aa, Bacillus anthracis str. A2012; identical to SEQ ID NO: 61842

SEQ ID NO: 78241 - DNA, 738 bp, Chlorobium tepidum TLS; identical to SEQ ID NO: 7248
  CDS (1)..(738): transl_table=11

SEQ ID NO: 78242 - protein, 245 aa, Chlorobium tepidum TLS; identical to SEQ ID NO: 7249

SEQ ID NO: 78243 - DNA, 741 bp, Yersinia pestis KIM; identical to SEQ ID NO: 61845
  CDS (1)..(741): transl_table=11

SEQ ID NO: 78244 - protein, 246 aa, Yersinia pestis KIM; identical to SEQ ID NO: 61846

SEQ ID NO: 78245 - DNA, 735 bp, Streptococcus agalactiae 2603V/R; identical to SEQ ID NO: 7232
  CDS (1)..(735): transl_table=11

SEQ ID NO: 78246 - protein, 244 aa, Streptococcus agalactiae 2603V/R; identical to SEQ ID NO: 7233

SEQ ID NO: 78247 - DNA, 765 bp, Oceanobacillus iheyensis HTE831; identical to SEQ ID NO: 7238
  CDS (1)..(765): transl_table=11

SEQ ID NO: 78248 - protein, 254 aa, Oceanobacillus iheyensis HTE831; identical to SEQ ID NO: 7239

SEQ ID NO: 78249 - DNA, 741 bp, Oceanobacillus iheyensis HTE831; identical to SEQ ID NO: 7236
  CDS (1)..(741): transl_table=11

SEQ ID NO: 78250 - protein, 246 aa, Oceanobacillus iheyensis HTE831; identical to SEQ ID NO: 7237

SEQ ID NO: 78251 - DNA, 735 bp, Brucella suis 1330; identical to SEQ ID NO: 61853
  CDS (1)..(735): transl_table=11

SEQ ID NO: 78252 - protein, 244 aa, Brucella suis 1330; identical to SEQ ID NO: 61854

SEQ ID NO: 78253 - DNA, 741 bp, Brucella suis 1330; identical to SEQ ID NO: 61855
  CDS (1)..(741): transl_table=11

SEQ ID NO: 78254 - protein, 246 aa, Brucella suis 1330; identical to SEQ ID NO: 61856

SEQ ID NO: 78255 - DNA, 792 bp, Shigella flexneri 2a str. 301; identical to SEQ ID NO: 61857
  CDS (1)..(792): transl_table=11

SEQ ID NO: 78256 - protein, 263 aa, Shigella flexneri 2a str. 301; identical to SEQ ID NO: 61858

SEQ ID NO: 78257 - DNA, 771 bp, Leptospira interrogans serovar Lai str. 56601; identical to SEQ ID NO: 61859
  CDS (1)..(771): transl_table=11

SEQ ID NO: 78258 - protein, 256 aa, Leptospira interrogans serovar Lai str. 56601; identical to SEQ ID NO: 61860

SEQ ID NO: 78259 - DNA, 780 bp, Leptospira interrogans serovar Lai str. 56601; identical to SEQ ID NO: 61861
  CDS (1)..(780): transl_table=11

SEQ ID NO: 78260 - protein, 259 aa, Leptospira interrogans serovar Lai str. 56601; identical to SEQ ID NO: 7243

SEQ ID NO: 78261 - DNA, 765 bp, Leptospira interrogans serovar Lai str. 56601; identical to SEQ ID NO: 61863
  CDS (1)..(765): transl_table=11

SEQ ID NO: 78262 - protein, 254 aa, Leptospira interrogans serovar Lai str. 56601; identical to SEQ ID NO: 7241

SEQ ID NO: 78263 - DNA, 735 bp, Streptococcus mutans UA159; identical to SEQ ID NO: 7230
  CDS (1)..(735): transl_table=11

SEQ ID NO: 78264 - protein, 244 aa, Streptococcus mutans UA159; identical to SEQ ID NO: 7231

SEQ ID NO: 78265 - DNA, 750 bp, Corynebacterium efficiens YS-314; identical to SEQ ID NO: 7244
  CDS (1)..(750): transl_table=11

SEQ ID NO: 78266 - protein, 249 aa, Corynebacterium efficiens YS-314; identical to SEQ ID NO: 7245

SEQ ID NO: 78267 - DNA, 819 bp, Staphylococcus epidermidis ATCC 12228; identical to SEQ ID NO: 61869
  CDS (1)..(819): transl_table=11

SEQ ID NO: 78268 - protein, 272 aa, Staphylococcus epidermidis ATCC 12228; identical to SEQ ID NO: 61870

SEQ ID NO: 78269 - DNA, 807 bp, Bradyrhizobium japonicum USDA 110; identical to SEQ ID NO: 61871
  CDS (1)..(807)

SEQ ID NO: 78270 - protein, 268 aa, Bradyrhizobium japonicum USDA 110; identical to SEQ ID NO: 61872

SEQ ID NO: 78271 - DNA, 810 bp, Bradyrhizobium japonicum USDA 110; identical to SEQ ID NO: 61873
  CDS (1)..(810)

SEQ ID NO: 78272 - protein, 269 aa, Bradyrhizobium japonicum USDA 110; identical to SEQ ID NO: 61874

SEQ ID NO: 78273 - DNA, 738 bp, Bradyrhizobium japonicum USDA 110; identical to SEQ ID NO: 7216
  CDS (1)..(738)

SEQ ID NO: 78274 - protein, 245 aa, Bradyrhizobium japonicum USDA 110; identical to SEQ ID NO: 7217

SEQ ID NO: 78275 - DNA, 744 bp, Xylella fastidiosa Temecula1; identical to SEQ ID NO: 7198
  CDS (1)..(744): transl_table=11

SEQ ID NO: 78276 - protein, 247 aa, Xylella fastidiosa Temecula1; identical to SEQ ID NO: 7199

SEQ ID NO: 78277 - DNA, 756 bp, Clostridium tetani E88; identical to SEQ ID NO: 7214
  CDS (1)..(756): transl_table=11

SEQ ID NO: 78278 - protein, 251 aa, Clostridium tetani E88; identical to SEQ ID NO: 7215

SEQ ID NO: 78279 - DNA, 750 bp, Clostridium tetani E88; identical to SEQ ID NO: 7212
  CDS (1)..(750): transl_table=11

SEQ ID NO: 78280 - protein, 249 aa, Clostridium tetani E88; identical to SEQ ID NO: 7213

SEQ ID NO: 78281 - DNA, 756 bp, Lactobacillus plantarum WCFS1; identical to SEQ ID NO: 61883
  CDS (1)..(756): transl_table=11

SEQ ID NO: 78282 - protein, 251 aa, Lactobacillus plantarum WCFS1; identical to SEQ ID NO: 61884

SEQ ID NO: 78283 - DNA, 765 bp, Pseudomonas syringae pv. tomato str. DC3000; identical to SEQ ID NO: 61885
  CDS (1)..(765): transl_table=11

SEQ ID NO: 78284 - protein, 254 aa, Pseudomonas syringae pv. tomato str. DC3000; identical to SEQ ID NO: 61886

SEQ ID NO: 78285 - DNA, 735 bp, Vibrio parahaemolyticus RIMD 2210633; identical to SEQ ID NO: 61887
  CDS (1)..(735): transl_table=11

SEQ ID NO: 78286 - protein, 244 aa, Vibrio parahaemolyticus RIMD 2210633; identical to SEQ ID NO: 61888

SEQ ID NO: 78287 - DNA, 747 bp, Bacteroides thetaiotaomicron VPI-5482; identical to SEQ ID NO: 7220
  CDS (1)..(747): transl_table=11

SEQ ID NO: 78288 - protein, 248 aa, Bacteroides thetaiotaomicron VPI-5482; identical to SEQ ID NO: 7221

SEQ ID NO: 78289 - DNA, 738 bp, Enterococcus faecalis V583; identical to SEQ ID NO: 61891
  CDS (1)..(738): transl_table=11

SEQ ID NO: 78290 - protein, 245 aa, Enterococcus faecalis V583; identical to SEQ ID NO: 7185

SEQ ID NO: 78291 - DNA, 831 bp, Streptomyces avermitilis MA-4680; identical to SEQ ID NO: 61893
  CDS (1)..(831)

SEQ ID NO: 78292 - protein, 276 aa, Streptomyces avermitilis MA-4680; identical to SEQ ID NO: 61894

SEQ ID NO: 78293 - DNA, 747 bp, Chlamydophila caviae GPIC; identical to SEQ ID NO: 7182
  CDS (1)..(747): transl_table=11

SEQ ID NO: 78294 - protein, 248 aa, Chlamydophila caviae GPIC; identical to SEQ ID NO: 7183

SEQ ID NO: 78295 - DNA, 744 bp, Bacillus cereus ATCC 14579; identical to SEQ ID NO: 61897
  CDS (1)..(744): transl_table=11

SEQ ID NO: 78296 - protein, 247 aa, Bacillus cereus ATCC 14579; identical to SEQ ID NO: 61898

SEQ ID NO: 78297 - DNA, 741 bp, Bacillus cereus ATCC 14579; identical to SEQ ID NO: 61899
  CDS (1)..(741): transl_table=11

SEQ ID NO: 78298 - protein, 246 aa, Bacillus cereus ATCC 14579; identical to SEQ ID NO: 61900

SEQ ID NO: 78299 - DNA, 741 bp, Bacillus cereus ATCC 14579; identical to SEQ ID NO: 7176
  CDS (1)..(741): transl_table=11

SEQ ID NO: 78300 - protein, 246 aa, Bacillus cereus ATCC 14579; identical to SEQ ID NO: 7177

SEQ ID NO: 78301 - DNA, 753 bp, Prochlorococcus marinus subsp. marinus str. CCMP1375; identical to SEQ ID NO: 7156
  CDS (1)..(753): transl_table=11

SEQ ID NO: 78302 - protein, 250 aa, Prochlorococcus marinus subsp. marinus str. CCMP1375; identical to SEQ ID NO: 7157

SEQ ID NO: 78303 - DNA, 768 bp, Bordetella pertussis Tohama I; identical to SEQ ID NO: 61905
  CDS (1)..(768): transl_table=11

SEQ ID NO: 78304 - protein, 255 aa, Bordetella pertussis Tohama I; identical to SEQ ID NO: 61906

SEQ ID NO: 78305 - DNA, 753 bp, Bordetella parapertussis 12822; identical to SEQ ID NO: 61907
  CDS (1)..(753): transl_table=11

SEQ ID NO: 78306 - protein, 250 aa, Bordetella parapertussis 12822; identical to SEQ ID NO: 61908

SEQ ID NO: 78307 - DNA, 738 bp, Bordetella parapertussis 12822; identical to SEQ ID NO: 7164
  CDS (1)..(738): transl_table=11

SEQ ID NO: 78308 - protein, 245 aa, Bordetella parapertussis 12822; identical to SEQ ID NO: 7165

SEQ ID NO: 78309 - DNA, 753 bp, Bordetella bronchiseptica RB50; identical to SEQ ID NO: 61911
  CDS (1)..(753): transl_table=11

SEQ ID NO: 78310 - protein, 250 aa, Bordetella bronchiseptica RB50; identical to SEQ ID NO: 61912

SEQ ID NO: 78311 - DNA, 738 bp, Bordetella bronchiseptica RB50; identical to SEQ ID NO: 61913
  CDS (1)..(738): transl_table=11

SEQ ID NO: 78312 - protein, 245 aa, Bordetella bronchiseptica RB50; identical to SEQ ID NO: 61914

SEQ ID NO: 78313 - DNA, 750 bp, Prochlorococcus marinus subsp. pastoris str. CCMP1986; identical to SEQ ID NO: 7152
  CDS (1)..(750): transl_table=11

SEQ ID NO: 78314 - protein, 249 aa, Prochlorococcus marinus subsp. pastoris str. CCMP1986; identical to SEQ ID NO: 7153

SEQ ID NO: 78315 - DNA, 753 bp, Prochlorococcus marinus str. MIT 9313; identical to SEQ ID NO: 7154
  CDS (1)..(753): transl_table=11

SEQ ID NO: 78316 - protein, 250 aa, Prochlorococcus marinus str. MIT 9313; identical to SEQ ID NO: 7155

SEQ ID NO: 78317 - DNA, 741 bp, Chromobacterium violaceum ATCC 12472; identical to SEQ ID NO: 7132
  CDS (1)..(741): transl_table=11

SEQ ID NO: 78318 - protein, 246 aa, Chromobacterium violaceum ATCC 12472; identical to SEQ ID NO: 7133

SEQ ID NO: 78319 - DNA, 747 bp, Porphyromonas gingivalis W83; identical to SEQ ID NO: 7128
  CDS (1)..(747): transl_table=11

SEQ ID NO: 78320 - protein, 248 aa, Porphyromonas gingivalis W83; identical to SEQ ID NO: 7129

SEQ ID NO: 78321 - DNA, 735 bp, Photorhabdus luminescens subsp. laumondii TTO1; identical to SEQ ID NO: 7138
  CDS (1)..(735): transl_table=11

SEQ ID NO: 78322 - protein, 244 aa, Photorhabdus luminescens subsp. laumondii TTO1; identical to SEQ ID NO: 7139

SEQ ID NO: 78323 - DNA, 747 bp, Vibrio vulnificus YJ016; identical to SEQ ID NO: 7224
  CDS (1)..(747): transl_table=11

SEQ ID NO: 78324 - protein, 248 aa, Vibrio vulnificus YJ016; identical to SEQ ID NO: 7225

SEQ ID NO: 78325 - DNA, 789 bp, Rhodopseudomonas palustris CGA009; identical to SEQ ID NO: 61927
  CDS (1)..(789): transl_table=11

SEQ ID NO: 78326 - protein, 262 aa, Rhodopseudomonas palustris CGA009; identical to SEQ ID NO: 61928

SEQ ID NO: 78327 - DNA, 768 bp, Rhodopseudomonas palustris CGA009; identical to SEQ ID NO: 61929
  CDS (1)..(768): transl_table=11

SEQ ID NO: 78328 - protein, 255 aa, Rhodopseudomonas palustris CGA009; identical to SEQ ID NO: 61930

SEQ ID NO: 78329 - DNA, 735 bp, Rhodopseudomonas palustris CGA009; identical to SEQ ID NO: 61931
  CDS (1)..(735): transl_table=11

SEQ ID NO: 78330 - protein, 244 aa, Rhodopseudomonas palustris CGA009; identical to SEQ ID NO: 61932

SEQ ID NO: 78331 - DNA, 747 bp, Rhodopseudomonas palustris CGA009; identical to SEQ ID NO: 61933
  CDS (1)..(747): transl_table=11

SEQ ID NO: 78332 - protein, 248 aa, Rhodopseudomonas palustris CGA009; identical to SEQ ID NO: 61934

SEQ ID NO: 78333 - DNA, 741 bp, Geobacter sulfurreducens PCA; identical to SEQ ID NO: 7370
  CDS (1)..(741): transl_table=11

SEQ ID NO: 78334 - protein, 246 aa, Geobacter sulfurreducens PCA; identical to SEQ ID NO: 7371

SEQ ID NO: 78335 - DNA, 807 bp, Mycobacterium avium subsp. paratuberculosis str. k10; identical to SEQ ID NO: 61937
  CDS (1)..(807): transl_table=11

SEQ ID NO: 78336 - protein, 268 aa, Mycobacterium avium subsp. paratuberculosis str. k10; identical to SEQ ID NO: 61938

SEQ ID NO: 78337 - DNA, 750 bp, Mycobacterium avium subsp. paratuberculosis str. k10; identical to SEQ ID NO: 61939
  CDS (1)..(750): transl_table=11

SEQ ID NO: 78338 - protein, 249 aa, Mycobacterium avium subsp. paratuberculosis str. k10; identical to SEQ ID NO: 61940

SEQ ID NO: 78339 - DNA, 795 bp, Bacillus cereus ATCC 10987; identical to SEQ ID NO: 61941
  CDS (1)..(795): transl_table=11

SEQ ID NO: 78340 - protein, 264 aa, Bacillus cereus ATCC 10987; identical to SEQ ID NO: 61942

SEQ ID NO: 78341 - DNA, 741 bp, Bacillus cereus ATCC 10987; identical to SEQ ID NO: 7378
  CDS (1)..(741): transl_table=11

SEQ ID NO: 78342 - protein, 246 aa, Bacillus cereus ATCC 10987; identical to SEQ ID NO: 7379

SEQ ID NO: 78343 - DNA, 738 bp, Canis familiaris; identical to SEQ ID NO: 61945
  CDS (1)..(738)

SEQ ID NO: 78344 - protein, 245 aa, Canis familiaris; identical to SEQ ID NO: 61946

SEQ ID NO: 78345 - DNA, 744 bp, Desulfovibrio vulgaris subsp. vulgaris str. Hildenborough; identical to SEQ ID NO: 7384
  CDS (1)..(744): transl_table=11

SEQ ID NO: 78346 - protein, 247 aa, Desulfovibrio vulgaris subsp. vulgaris str. Hildenborough; identical to SEQ ID NO: 7385

SEQ ID NO: 78347 - DNA, 777 bp, Desulfovibrio vulgaris subsp. vulgaris str. Hildenborough; identical to SEQ ID NO: 61949
  CDS (1)..(777): transl_table=11

SEQ ID NO: 78348 - protein, 258 aa, Desulfovibrio vulgaris subsp. vulgaris str. Hildenborough; identical to SEQ ID NO: 61950

SEQ ID NO: 78349 - DNA, 738 bp, Bartonella henselae str. Houston-1; identical to SEQ ID NO: 61951
  CDS (1)..(738): transl_table=11

SEQ ID NO: 78350 - protein, 245 aa, Bartonella henselae str. Houston-1; identical to SEQ ID NO: 61952

SEQ ID NO: 78351 - DNA, 741 bp, Bacillus thuringiensis serovar konkukian str. 97-27; identical to SEQ ID NO: 61953
  CDS (1)..(741): transl_table=11

SEQ ID NO: 78352 - protein, 246 aa, Bacillus thuringiensis serovar konkukian str. 97-27; identical to SEQ ID NO: 61954

SEQ ID NO: 78353 - DNA, 735 bp, Erwinia carotovora subsp. atroseptica SCRI1043; identical to SEQ ID NO: 61955
  CDS (1)..(735)

SEQ ID NO: 78354 - protein, 244 aa, Erwinia carotovora subsp. atroseptica SCRI1043; identical to SEQ ID NO: 61956

SEQ ID NO: 78355 - DNA, 762 bp, Propionibacterium acnes KPA171202; identical to SEQ ID NO: 61957
  CDS (1)..(762): transl_table=11

SEQ ID NO: 78356 - protein, 253 aa, Propionibacterium acnes KPA171202; identical to SEQ ID NO: 61958

SEQ ID NO: 78357 - DNA, 780 bp, Streptococcus pyogenes MGAS10394; identical to SEQ ID NO: 61959
  CDS (1)..(780): transl_table=11

SEQ ID NO: 78358 - protein, 259 aa, Streptococcus pyogenes MGAS10394; identical to SEQ ID NO: 61960

SEQ ID NO: 78359 - DNA, 765 bp, Symbiobacterium thermophilum IAM 14863; identical to SEQ ID NO: 61961
  CDS (1)..(765): transl_table=11

SEQ ID NO: 78360 - protein, 254 aa, Symbiobacterium thermophilum IAM 14863; identical to SEQ ID NO: 61962

SEQ ID NO: 78361 - DNA, 744 bp, Bacillus licheniformis ATCC 14580; identical to SEQ ID NO: 61963
  CDS (1)..(744): transl_table=11

SEQ ID NO: 78362 - protein, 247 aa, Bacillus licheniformis ATCC 14580; identical to SEQ ID NO: 61964

SEQ ID NO: 78363 - DNA, 747 bp, Bacteroides fragilis YCH46; identical to SEQ ID NO: 61965
  CDS (1)..(747): transl_table=11

SEQ ID NO: 78364 - protein, 248 aa, Bacteroides fragilis YCH46; identical to SEQ ID NO: 61966

SEQ ID NO: 78365 - DNA, 744 bp, Burkholderia mallei ATCC 23344; identical to SEQ ID NO: 61967
  CDS (1)..(744): transl_table=11

SEQ ID NO: 78366 - protein, 247 aa, Burkholderia mallei ATCC 23344; identical to SEQ ID NO: 61968

SEQ ID NO: 78367 - DNA, 834 bp, Burkholderia mallei ATCC 23344; identical to SEQ ID NO: 61969
  CDS (1)..(834): transl_table=11

SEQ ID NO: 78368 - protein, 277 aa, Burkholderia mallei ATCC 23344; identical to SEQ ID NO: 61970

SEQ ID NO: 78369 - DNA, 780 bp, Burkholderia pseudomallei K96243; identical to SEQ ID NO: 61971
  CDS (1)..(780): transl_table=11

SEQ ID NO: 78370 - protein, 259 aa, Burkholderia pseudomallei K96243; identical to SEQ ID NO: 61972

SEQ ID NO: 78371 - DNA, 738 bp, Methylococcus capsulatus str. Bath; identical to SEQ ID NO: 61973
  CDS (1)..(738): transl_table=11

SEQ ID NO: 78372 - protein, 245 aa, Methylococcus capsulatus str. Bath; identical to SEQ ID NO: 61974

SEQ ID NO: 78373 - DNA, 735 bp, Photobacterium profundum SS9; identical to SEQ ID NO: 7394
  CDS (1)..(735): transl_table=11

SEQ ID NO: 78374 - protein, 244 aa, Photobacterium profundum SS9; identical to SEQ ID NO: 7395

SEQ ID NO: 78375 - DNA, 807 bp, Haloarcula marismortui ATCC 43049; identical to SEQ ID NO: 61977
  CDS (1)..(807): transl_table=11

SEQ ID NO: 78376 - protein, 268 aa, Haloarcula marismortui ATCC 43049; identical to SEQ ID NO: 61978

SEQ ID NO: 78377 - DNA, 744 bp, Haloarcula marismortui ATCC 43049; identical to SEQ ID NO: 61979
  CDS (1)..(744): transl_table=11

SEQ ID NO: 78378 - protein, 247 aa, Haloarcula marismortui ATCC 43049; identical to SEQ ID NO: 61980

SEQ ID NO: 78379 - DNA, 735 bp, Streptococcus thermophilus LMG 18311; identical to SEQ ID NO: 61981
  CDS (1)..(735): transl_table=11

SEQ ID NO: 78380 - protein, 244 aa, Streptococcus thermophilus LMG 18311; identical to SEQ ID NO: 61982

SEQ ID NO: 78381 - DNA, 744 bp, Geobacillus kaustophilus HTA426; identical to SEQ ID NO: 61983
  CDS (1)..(744): transl_table=11

SEQ ID NO: 78382 - protein, 247 aa, Geobacillus kaustophilus HTA426; identical to SEQ ID NO: 61984

SEQ ID NO: 78383 - DNA, 738 bp, Idiomarina loihiensis L2TR; identical to SEQ ID NO: 61985
  CDS (1)..(738): transl_table=11

SEQ ID NO: 78384 - protein, 245 aa, Idiomarina loihiensis L2TR; identical to SEQ ID NO: 61986

SEQ ID NO: 78385 - DNA, 747 bp, Azoarcus sp. EbN1; identical to SEQ ID NO: 61987
  CDS (1)..(747): transl_table=11

SEQ ID NO: 78386 - protein, 248 aa, Azoarcus sp. EbN1; identical to SEQ ID NO: 61988

SEQ ID NO: 78387 - DNA, 738 bp, Silicibacter pomeroyi DSS-3; identical to SEQ ID NO: 61989
  CDS (1)..(738): transl_table=11

SEQ ID NO: 78388 - protein, 245 aa, Silicibacter pomeroyi DSS-3; identical to SEQ ID NO: 61990

SEQ ID NO: 78389 - DNA, 774 bp, Bacillus clausii KSM-K16; identical to SEQ ID NO: 61991
  CDS (1)..(774): transl_table=11

SEQ ID NO: 78390 - protein, 257 aa, Bacillus clausii KSM-K16; identical to SEQ ID NO: 61992

SEQ ID NO: 78391 - DNA, 744 bp, Dehalococcoides ethenogenes 195; identical to SEQ ID NO: 61993
  CDS (1)..(744): transl_table=11

SEQ ID NO: 78392 - protein, 247 aa, Dehalococcoides ethenogenes 195; identical to SEQ ID NO: 61994

SEQ ID NO: 78393 - DNA, 744 bp, Xylella fastidiosa Ann-1; identical to SEQ ID NO: 61995
  CDS (1)..(744)

SEQ ID NO: 78394 - protein, 247 aa, Xylella fastidiosa Ann-1; identical to SEQ ID NO: 61996

SEQ ID NO: 78395 - DNA, 741 bp, Magnetospirillum magnetotacticum MS-1; identical to SEQ ID NO: 61997
  CDS (1)..(741)

SEQ ID NO: 78396 - protein, 246 aa, Magnetospirillum magnetotacticum MS-1; identical to SEQ ID NO: 61998

SEQ ID NO: 78397 - DNA, 774 bp, Magnetospirillum magnetotacticum MS-1; identical to SEQ ID NO: 61999
  CDS (1)..(774)

SEQ ID NO: 78398 - protein, 257 aa, Magnetospirillum magnetotacticum MS-1; identical to SEQ ID NO: 62000

SEQ ID NO: 78399 - DNA, 759 bp, Azotobacter vinelandii; identical to SEQ ID NO: 62001
  CDS (1)..(759)

SEQ ID NO: 78400 - protein, 252 aa, Azotobacter vinelandii; identical to SEQ ID NO: 62002

SEQ ID NO: 78401 - DNA, 747 bp, Nostoc punctiforme PCC 73102; identical to SEQ ID NO: 62003
  CDS (1)..(747)

SEQ ID NO: 78402 - protein, 248 aa, Nostoc punctiforme PCC 73102; identical to SEQ ID NO: 62004

SEQ ID NO: 78403 - DNA, 726 bp, Haemophilus somnus 129PT; identical to SEQ ID NO: 62005
  CDS (1)..(726)

SEQ ID NO: 78404 - protein, 241 aa, Haemophilus somnus 129PT; identical to SEQ ID NO: 62006

SEQ ID NO: 78405 - DNA, 765 bp, Pseudomonas syringae pv. syringae B728a; identical to SEQ ID NO: 62007
  CDS (1)..(765)

SEQ ID NO: 78406 - protein, 254 aa, Pseudomonas syringae pv. syringae B728a; identical to SEQ ID NO: 62008

SEQ ID NO: 78407 - DNA, 729 bp, Haemophilus somnus 2336; identical to SEQ ID NO: 62009
  CDS (1)..(729)

SEQ ID NO: 78408 - protein, 242 aa, Haemophilus somnus 2336; identical to SEQ ID NO: 62010

SEQ ID NO: 78409 - DNA, 726 bp, Actinobacillus pleuropneumoniae serovar 1 str. 4074; identical to SEQ ID NO: 62011
  CDS (1)..(726)

SEQ ID NO: 78410 - protein, 241 aa, Actinobacillus pleuropneumoniae serovar 1 str. 4074; identical to SEQ ID NO: 62012

SEQ ID NO: 78411 - DNA, 783 bp, Pseudomonas aeruginosa UCBPP-PA14; identical to SEQ ID NO: 62013
  CDS (1)..(783)

SEQ ID NO: 78412 - protein, 260 aa, Pseudomonas aeruginosa UCBPP-PA14; identical to SEQ ID NO: 62014

SEQ ID NO: 78413 - DNA, 756 bp, Ralstonia eutropha JMP134; identical to SEQ ID NO: 62015
  CDS (1)..(756)

SEQ ID NO: 78414 - protein, 251 aa, Ralstonia eutropha JMP134; identical to SEQ ID NO: 62016

SEQ ID NO: 78415 - DNA, 819 bp, Ralstonia eutropha JMP134; identical to SEQ ID NO: 62017
  CDS (1)..(819)

SEQ ID NO: 78416 - protein, 272 aa, Ralstonia eutropha JMP134; identical to SEQ ID NO: 62018

SEQ ID NO: 78417 - DNA, 732 bp, Exiguobacterium sp. 255-15; identical to SEQ ID NO: 62019
  CDS (1)..(732)

SEQ ID NO: 78418 - protein, 243 aa, Exiguobacterium sp. 255-15; identical to SEQ ID NO: 62020

SEQ ID NO: 78419 - DNA, 783 bp, Exiguobacterium sp. 255-15; identical to SEQ ID NO: 62021
  CDS (1)..(783)

SEQ ID NO: 78420 - protein, 260 aa, Exiguobacterium sp. 255-15; identical to SEQ ID NO: 62022

SEQ ID NO: 78421 - DNA, 768 bp, Rubrobacter xylanophilus DSM 9941; identical to SEQ ID NO: 62023
  CDS (1)..(768)

SEQ ID NO: 78422 - protein, 255 aa, Rubrobacter xylanophilus DSM 9941; identical to SEQ ID NO: 62024

SEQ ID NO: 78423 - DNA, 780 bp, Rubrobacter xylanophilus DSM 9941; identical to SEQ ID NO: 62025
  CDS (1)..(780)

SEQ ID NO: 78424 - protein, 259 aa, Rubrobacter xylanophilus DSM 9941; identical to SEQ ID NO: 62026

SEQ ID NO: 78425 - DNA, 771 bp, Rubrobacter xylanophilus DSM 9941; identical to SEQ ID NO: 62027
  CDS (1)..(771)

SEQ ID NO: 78426 - protein, 256 aa, Rubrobacter xylanophilus DSM 9941; identical to SEQ ID NO: 62028

SEQ ID NO: 78427 - DNA, 738 bp, Mesorhizobium sp. BNC1; identical to SEQ ID NO: 62029
  CDS (1)..(738)

SEQ ID NO: 78428 - protein, 245 aa, Mesorhizobium sp. BNC1; identical to SEQ ID NO: 62030

SEQ ID NO: 78429 - DNA, 777 bp, Mesorhizobium sp. BNC1; identical to SEQ ID NO: 62031
  CDS (1)..(777)

SEQ ID NO: 78430 - protein, 258 aa, Mesorhizobium sp. BNC1; identical to SEQ ID NO: 62032

SEQ ID NO: 78431 - DNA, 747 bp, Rubrobacter xylanophilus DSM 9941; identical to SEQ ID NO: 62033
  CDS (1)..(747)

SEQ ID NO: 78432 - protein, 248 aa, Rubrobacter xylanophilus DSM 9941; identical to SEQ ID NO: 62034

SEQ ID NO: 78433 - DNA, 774 bp, Burkholderia cepacia R18194; identical to SEQ ID NO: 62035
  CDS (1)..(774)

SEQ ID NO: 78434 - protein, 257 aa, Burkholderia cepacia R18194; identical to SEQ ID NO: 62036

SEQ ID NO: 78435 - DNA, 810 bp, Burkholderia cepacia R18194; identical to SEQ ID NO: 62037
  CDS (1)..(810)

SEQ ID NO: 78436 - protein, 269 aa, Burkholderia cepacia R18194; identical to SEQ ID NO: 62038

SEQ ID NO: 78437 - DNA, 780 bp, Burkholderia cepacia R18194; identical to SEQ ID NO: 62039
  CDS (1)..(780)

SEQ ID NO: 78438 - protein, 259 aa, Burkholderia cepacia R18194; identical to SEQ ID NO: 62040

SEQ ID NO: 78439 - DNA, 741 bp, Burkholderia cepacia R18194; identical to SEQ ID NO: 62041
  CDS (1)..(741)

SEQ ID NO: 78440 - protein, 246 aa, Burkholderia cepacia R18194; identical to SEQ ID NO: 62042

SEQ ID NO: 78441 - DNA, 759 bp, Burkholderia cepacia R1808; identical to SEQ ID NO: 62043
  CDS (1)..(759)

SEQ ID NO: 78442 - protein, 252 aa, Burkholderia cepacia R1808; identical to SEQ ID NO: 62044

SEQ ID NO: 78443 - DNA, 741 bp, Bacillus cereus G9241; identical to SEQ ID NO: 62045
  CDS (1)..(741): transl_table=11

SEQ ID NO: 78444 - protein, 246 aa, Bacillus cereus G9241; identical to SEQ ID NO: 62046

SEQ ID NO: 78445 - DNA, 786 bp, Rubrivivax gelatinosus PM1; identical to SEQ ID NO: 62047
  CDS (1)..(786)

SEQ ID NO: 78446 - protein, 261 aa, Rubrivivax gelatinosus PM1; identical to SEQ ID NO: 62048

SEQ ID NO: 78447 - DNA, 750 bp, Rubrivivax gelatinosus PM1; identical to SEQ ID NO: 62049
  CDS (1)..(750)

SEQ ID NO: 78448 - protein, 249 aa, Rubrivivax gelatinosus PM1; identical to SEQ ID NO: 62050

SEQ ID NO: 78449 - DNA, 819 bp, Pseudomonas fluorescens PfO-1; identical to SEQ ID NO: 62051
  CDS (1)..(819)

SEQ ID NO: 78450 - protein, 272 aa, Pseudomonas fluorescens PfO-1; identical to SEQ ID NO: 62052

SEQ ID NO: 78451 - DNA, 774 bp, Pseudomonas fluorescens PfO-1; identical to SEQ ID NO: 62053
  CDS (1)..(774)

SEQ ID NO: 78452 - protein, 257 aa, Pseudomonas fluorescens PfO-1; identical to SEQ ID NO: 62054

SEQ ID NO: 78453 - DNA, 741 bp, Ralstonia metallidurans CH34; identical to SEQ ID NO: 62055
  CDS (1)..(741)

SEQ ID NO: 78454 - protein, 246 aa, Ralstonia metallidurans CH34; identical to SEQ ID NO: 62056

SEQ ID NO: 78455 - DNA, 744 bp, Burkholderia fungorum LB400; identical to SEQ ID NO: 62057
  CDS (1)..(744)

SEQ ID NO: 78456 - protein, 247 aa, Burkholderia fungorum LB400; identical to SEQ ID NO: 62058

SEQ ID NO: 78457 - DNA, 768 bp, Burkholderia fungorum LB400; identical to SEQ ID NO: 62059
  CDS (1)..(768)

SEQ ID NO: 78458 - protein, 255 aa, Burkholderia fungorum LB400; identical to SEQ ID NO: 62060

SEQ ID NO: 78459 - DNA, 804 bp, Thermobifida fusca; identical to SEQ ID NO: 62061
  CDS (1)..(804)

SEQ ID NO: 78460 - protein, 267 aa, Thermobifida fusca; identical to SEQ ID NO: 62062

SEQ ID NO: 78461 - DNA, 741 bp, Geobacter metallireducens GS-15; identical to SEQ ID NO: 62063
  CDS (1)..(741)

SEQ ID NO: 78462 - protein, 246 aa, Geobacter metallireducens GS-15; identical to SEQ ID NO: 62064

SEQ ID NO: 78463 - DNA, 768 bp, Geobacter metallireducens GS-15; identical to SEQ ID NO: 62065
  CDS (1)..(768)

SEQ ID NO: 78464 - protein, 255 aa, Geobacter metallireducens GS-15; identical to SEQ ID NO: 62066

SEQ ID NO: 78465 - DNA, 741 bp, Novosphingobium aromaticivorans DSM 12444; identical to SEQ ID NO: 62067
  CDS (1)..(741)

SEQ ID NO: 78466 - protein, 246 aa, Novosphingobium aromaticivorans DSM 12444; identical to SEQ ID NO: 62068

SEQ ID NO: 78467 - DNA, 747 bp, Novosphingobium aromaticivorans DSM 12444; identical to SEQ ID NO: 62069
  CDS (1)..(747)

SEQ ID NO: 78468 - protein, 248 aa, Novosphingobium aromaticivorans DSM 12444; identical to SEQ ID NO: 62070

SEQ ID NO: 78469 - DNA, 747 bp, Cytophaga hutchinsonii; identical to SEQ ID NO: 62071
  CDS (1)..(747)

SEQ ID NO: 78470 - protein, 248 aa, Cytophaga hutchinsonii; identical to SEQ ID NO: 62072

SEQ ID NO: 78471 - DNA, 744 bp, Clostridium thermocellum ATCC 27405; identical to SEQ ID NO: 62073
  CDS (1)..(744)

SEQ ID NO: 78472 - protein, 247 aa, Clostridium thermocellum ATCC 27405; identical to SEQ ID NO: 62074

SEQ ID NO: 78473 - DNA, 759 bp, Trichodesmium erythraeum IMS101; identical to SEQ ID NO: 62075
  CDS (1)..(759)

SEQ ID NO: 78474 - protein, 252 aa, Trichodesmium erythraeum IMS101; identical to SEQ ID NO: 62076

SEQ ID NO: 78475 - DNA, 735 bp, Streptococcus suis 89/1591; identical to SEQ ID NO: 62077
  CDS (1)..(735)

SEQ ID NO: 78476 - protein, 244 aa, Streptococcus suis 89/1591; identical to SEQ ID NO: 62078

SEQ ID NO: 78477 - DNA, 750 bp, Silicibacter sp. TM1040; identical to SEQ ID NO: 62079
  CDS (1)..(750)

SEQ ID NO: 78478 - protein, 249 aa, Silicibacter sp. TM1040; identical to SEQ ID NO: 62080

SEQ ID NO: 78479 - DNA, 738 bp, Silicibacter sp. TM1040; identical to SEQ ID NO: 62081
  CDS (1)..(738)

SEQ ID NO: 78480 - protein, 245 aa, Silicibacter sp. TM1040; identical to SEQ ID NO: 62082

SEQ ID NO: 78481 - DNA, 741 bp, Ralstonia eutropha JMP134; identical to SEQ ID NO: 62083
  CDS (1)..(741)

SEQ ID NO: 78482 - protein, 246 aa, Ralstonia eutropha JMP134; identical to SEQ ID NO: 62084

SEQ ID NO: 78483 - DNA, 771 bp, Rubrobacter xylanophilus DSM 9941; identical to SEQ ID NO: 62085
  CDS (1)..(771)

SEQ ID NO: 78484 - protein, 256 aa, Rubrobacter xylanophilus DSM 9941; identical to SEQ ID NO: 62086

SEQ ID NO: 78485 - DNA, 759 bp, Chloroflexus aurantiacus; identical to SEQ ID NO: 62087
  CDS (1)..(759)

SEQ ID NO: 78486 - protein, 252 aa, Chloroflexus aurantiacus; identical to SEQ ID NO: 62088

SEQ ID NO: 78487 - DNA, 753 bp, Chloroflexus aurantiacus; identical to SEQ ID NO: 62089
  CDS (1)..(753)

SEQ ID NO: 78488 - protein, 250 aa, Chloroflexus aurantiacus; identical to SEQ ID NO: 62090

SEQ ID NO: 78489 - DNA, 750 bp, Chloroflexus aurantiacus; identical to SEQ ID NO: 62091
  CDS (1)..(750)

SEQ ID NO: 78490 - protein, 249 aa, Chloroflexus aurantiacus; identical to SEQ ID NO: 62092

SEQ ID NO: 78491 - DNA, 732 bp, Polaromonas sp. JS666; identical to SEQ ID NO: 62093
  CDS (1)..(732)

SEQ ID NO: 78492 - protein, 243 aa, Polaromonas sp. JS666; identical to SEQ ID NO: 62094

SEQ ID NO: 78493 - DNA, 750 bp, Polaromonas sp. JS666; identical to SEQ ID NO: 62095
  CDS (1)..(750)

SEQ ID NO: 78494 - protein, 249 aa, Polaromonas sp. JS666; identical to SEQ ID NO: 62096

SEQ ID NO: 78495 - DNA, 780 bp, Streptococcus pyogenes M49 591; identical to SEQ ID NO: 62097
  CDS (1)..(780)

SEQ ID NO: 78496 - protein, 259 aa, Streptococcus pyogenes M49 591; identical to SEQ ID NO: 62098

SEQ ID NO: 78497 - DNA, 774 bp, Nocardioides sp; identical to SEQ ID NO: 62099
  CDS (1)..(774): transl_table=11

SEQ ID NO: 78498 - protein, 257 aa, Nocardioides sp; identical to SEQ ID NO: 62100

SEQ ID NO: 78499 - DNA, 783 bp, uncultured bacterium; identical to SEQ ID NO: 62101
  CDS (1)..(783): transl_table=11

SEQ ID NO: 78500 - protein, 260 aa, uncultured bacterium; identical to SEQ ID NO: 62102

SEQ ID NO: 78501 - DNA, 798 bp, uncultured bacterium; identical to SEQ ID NO: 62103
  CDS (1)..(798): transl_table=11

SEQ ID NO: 78502 - protein, 265 aa, uncultured bacterium; identical to SEQ ID NO: 62104

SEQ ID NO: 78503 - DNA, 738 bp, Homo sapiens; identical to SEQ ID NO: 62105
  CDS (1)..(738)

SEQ ID NO: 78504 - protein, 245 aa, Homo sapiens [sequence omitted]

SEQ ID NO: 78505 - DNA, 750 bp, Brachyspira pilosicoli; identical to SEQ ID NO: 7366
  CDS (1)..(750): transl_table=11

SEQ ID NO: 78506 - protein, 249 aa, Brachyspira pilosicoli; identical to SEQ ID NO: 7367

SEQ ID NO: 78507 - DNA, 777 bp, Mycobacterium smegmatis; identical to SEQ ID NO: 62109
  CDS (1)..(777): transl_table=11

SEQ ID NO: 78508 - protein, 258 aa, Mycobacterium smegmatis; identical to SEQ ID NO: 62110

SEQ ID NO: 78509 - DNA, 759 bp, Terrabacter sp; identical to SEQ ID NO: 62111
  CDS (1)..(759): transl_table=11

SEQ ID NO: 78510 - protein, 252 aa, Terrabacter sp; identical to SEQ ID NO: 62112

SEQ ID NO: 78511 - DNA, 777 bp, Sinorhizobium sp; identical to SEQ ID NO: 62113
  CDS (1)..(777): transl_table=11

SEQ ID NO: 78512 - protein, 258 aa, Sinorhizobium sp; identical to SEQ ID NO: 62114

SEQ ID NO: 78513 - DNA, 786 bp, Azospirillum brasilense; identical to SEQ ID NO: 62115
  CDS (1)..(786): transl_table=11

SEQ ID NO: 78514 - protein, 261 aa, Azospirillum brasilense; identical to SEQ ID NO: 62116

SEQ ID NO: 78515 - DNA, 747 bp, Azoarcus evansii; identical to SEQ ID NO: 7270
  CDS (1)..(747): transl_table=11

SEQ ID NO: 78516 - protein, 248 aa, Azoarcus evansii; identical to SEQ ID NO: 7271

SEQ ID NO: 78517 - DNA, 822 bp, Streptomyces antibioticus; identical to SEQ ID NO: 62119
  CDS (1)..(822): transl_table=11

SEQ ID NO: 78518 - protein, 273 aa, Streptomyces antibioticus; identical to SEQ ID NO: 7311

SEQ ID NO: 78519 - DNA, 768 bp, Pseudomonas sp; identical to SEQ ID NO: 62121
  CDS (1)..(768): transl_table=11

SEQ ID NO: 78520 - protein, 255 aa, Pseudomonas sp; identical to SEQ ID NO: 62122

SEQ ID NO: 78521 - DNA, 747 bp, Thauera aromatica; identical to SEQ ID NO: 62123
  CDS (1)..(747): transl_table=11

SEQ ID NO: 78522 - protein, 248 aa, Thauera aromatica; identical to SEQ ID NO: 62124

SEQ ID NO: 78523 - DNA, 738 bp, Rhizobium leguminosarum; identical to SEQ ID NO: 7318
  CDS (1)..(738): transl_table=11

SEQ ID NO: 78524 - protein, 245 aa, Rhizobium leguminosarum; identical to SEQ ID NO: 7319

SEQ ID NO: 78525 - DNA, 738 bp, Homo sapiens; identical to SEQ ID NO: 62127
  CDS (1)..(738)

SEQ ID NO: 78526 - protein, 245 aa, Homo sapiens; identical to SEQ ID NO: 62128

SEQ ID NO: 78527 - DNA, 744 bp, Bacillus megaterium; identical to SEQ ID NO: 7330
  CDS (1)..(744): transl_table=11

SEQ ID NO: 78528 - protein, 247 aa, Bacillus megaterium; identical to SEQ ID NO: 7331

SEQ ID NO: 78529 - DNA, 786 bp, Bacillus subtilis; identical to SEQ ID NO: 62131
  CDS (1)..(786): transl_table=11

SEQ ID NO: 78530 - protein, 261 aa, Bacillus subtilis; identical to SEQ ID NO: 62132

SEQ ID NO: 78531 - DNA, 786 bp, Streptomyces cinnamonensis; identical to SEQ ID NO: 62133
  CDS (1)..(786): transl_table=11

SEQ ID NO: 78532 - protein, 261 aa, Streptomyces cinnamonensis; identical to SEQ ID NO: 62134

SEQ ID NO: 78533 - DNA, 747 bp, Chlamydia muridarum; identical to SEQ ID NO: 7060
  CDS (1)..(747): transl_table=11

SEQ ID NO: 78534 - protein, 248 aa, Chlamydia muridarum; identical to SEQ ID NO: 7061

SEQ ID NO: 78535 - DNA, 747 bp, Chlamydia trachomatis; identical to SEQ ID NO: 7338
  CDS (1)..(747)

SEQ ID NO: 78536 - protein, 248 aa, Chlamydia trachomatis; identical to SEQ ID NO: 61778

SEQ ID NO: 78537 - DNA, 735 bp, Escherichia coli; identical to SEQ ID NO: 62139
  CDS (1)..(735): transl_table=11

SEQ ID NO: 78538 - protein, 244 aa, Escherichia coli; identical to SEQ ID NO: 7021

SEQ ID NO: 78539 - DNA, 735 bp, Salmonella typhimurium; identical to SEQ ID NO: 7030
  CDS (1)..(735): transl_table=11

SEQ ID NO: 78540 - protein, 244 aa, Salmonella typhimurium; identical to SEQ ID NO: 7031

SEQ ID NO: 78541 - DNA, 741 bp, Staphylococcus aureus; identical to SEQ ID NO: 62143
  CDS (1)..(741): transl_table=11

SEQ ID NO: 78542 - protein, 246 aa, Staphylococcus aureus; identical to SEQ ID NO: 7043

SEQ ID NO: 78543 - DNA, 741 bp, Thermotoga maritima; identical to SEQ ID NO: 7088
  CDS (1)..(741): transl_table=11

SEQ ID NO: 78544 - protein, 246 aa, Thermotoga maritima; identical to SEQ ID NO: 7089

SEQ ID NO: 78545 - DNA, 735 bp, Vibrio cholerae; identical to SEQ ID NO: 7346
  CDS (1)..(735)

SEQ ID NO: 78546 - protein, 244 aa, Vibrio cholerae; identical to SEQ ID NO: 7347

SEQ ID NO: 78547 - DNA, 738 bp, Rhizobium meliloti; identical to SEQ ID NO: 7046
  CDS (1)..(738): transl_table=11

SEQ ID NO: 78548 - protein, 245 aa, Rhizobium meliloti; identical to SEQ ID NO: 7047

SEQ ID NO: 78549 - DNA, 738 bp, Rhizobium sp; identical to SEQ ID NO: 7348
  CDS (1)..(738): transl_table=11

SEQ ID NO: 78550 - protein, 245 aa, Rhizobium sp; identical to SEQ ID NO: 7349

SEQ ID NO: 78551 - DNA, 747 bp, Acinetobacter sp; identical to SEQ ID NO: 7352
  CDS (1)..(747): transl_table=11

SEQ ID NO: 78552 - protein, 248 aa, Acinetobacter sp; identical to SEQ ID NO: 7353

SEQ ID NO: 78553 - DNA, 792 bp, Salmonella typhimurium; identical to SEQ ID NO: 62155
  CDS (1)..(792): transl_table=11

SEQ ID NO: 78554 - protein, 263 aa, Salmonella typhimurium; identical to SEQ ID NO: 62156

SEQ ID NO: 78555 - DNA, 744 bp, Mycobacterium tuberculosis; identical to SEQ ID NO: 62157
  CDS (1)..(744): transl_table=11

SEQ ID NO: 78556 - protein, 247 aa, Mycobacterium tuberculosis; identical to SEQ ID NO: 62158

SEQ ID NO: 78557 - DNA, 756 bp, Thermotoga maritima; identical to SEQ ID NO: 62159
  CDS (1)..(756): transl_table=11

SEQ ID NO: 78558 - protein, 251 aa, Thermotoga maritima; identical to SEQ ID NO: 62160

SEQ ID NO: 78559 - DNA, 768 bp, Bacillus subtilis; identical to SEQ ID NO: 62161
  CDS (1)..(768): transl_table=11

SEQ ID NO: 78560 - protein, 255 aa, Bacillus subtilis; identical to SEQ ID NO: 62162

SEQ ID NO: 78561 - DNA, 822 bp, Bacillus subtilis; identical to SEQ ID NO: 62163
  CDS (1)..(822): transl_table=11

SEQ ID NO: 78562 - protein, 273 aa, Bacillus subtilis; identical to SEQ ID NO: 62164

SEQ ID NO: 78563 - DNA, 26 bp, Primer
atgtttatcctgtattttcagaggga

SEQ ID NO: 78564 - DNA, 24 bp, Primer
ttagataccgacgctaaccgtctc

SEQ ID NO: 78565 - protein, 285 aa, consensus; identical to SEQ ID NO: 62167
  MISC_FEATURE (1)..(285): consensus for the disclosure of xaa see table XV

SEQ ID NO: 78566 - protein, 26 aa, consensus
  MISC_FEATURE (1)..(26): consensus for the disclosure of xaa see table XV
XXXXXXXXXGXGXXXXXXXXXXGXXX

SEQ ID NO: 78567 - protein, 9 aa, consensus
  MISC_FEATURE (1)..(9): consensus for the disclosure of xaa see table XV
XXXXXXXAG

SEQ ID NO: 78568 - protein, 58 aa, consensus; identical to SEQ ID NO: 62170
  MISC_FEATURE (1)..(58): consensus for the disclosure of xaa see table XV

SEQ ID NO: 78569 - protein, 37 aa, consensus; identical to SEQ ID NO: 62171
  MISC_FEATURE (1)..(37): consensus for the disclosure of xaa see table XV

SEQ ID NO: 78570 - DNA, 759 bp, Escherichia coli; identical to SEQ ID NO: 62172
  CDS (1)..(759)

SEQ ID NO: 78571 - protein, 252 aa, Escherichia coli; identical to SEQ ID NO: 62173

SEQ ID NO: 78572 - DNA, 582 bp, Thermococcus kodakaraensis; identical to SEQ ID NO: 62174
  CDS (1)..(582)

SEQ ID NO: 78573 - protein, 193 aa, Thermococcus kodakaraensis; identical to SEQ ID NO: 62175

SEQ ID NO: 78574 - DNA, 531 bp, Thermococcus kodakaraensis; identical to SEQ ID NO: 62176
  CDS (1)..(531)

SEQ ID NO: 78575 - protein, 176 aa, Thermococcus kodakaraensis; identical to SEQ ID NO: 62177

SEQ ID NO: 78576 - DNA, 1062 bp, Archaeoglobus fulgidus DSM 4304; identical to SEQ ID NO: 62178
  CDS (1)..(1062): transl_table=11

SEQ ID NO: 78577 - protein, 353 aa, Archaeoglobus fulgidus DSM 4304; identical to SEQ ID NO: 62179

SEQ ID NO: 78578 - DNA, 669 bp, Thermoplasma volcanium GSS1; identical to SEQ ID NO: 62180
  CDS (1)..(669): transl_table=11

SEQ ID NO: 78579 - protein, 222 aa, Thermoplasma volcanium GSS1; identical to SEQ ID NO: 62181

SEQ ID NO: 78580 - DNA, 513 bp, Pyrococcus abyssi GE5; identical to SEQ ID NO: 62182
  CDS (1)..(513): transl_table=11

SEQ ID NO: 78581 - protein, 170 aa, Pyrococcus abyssi GE5; identical to SEQ ID NO: 62183

SEQ ID NO: 78582 - DNA, 816 bp, Pyrococcus abyssi GE5; identical to SEQ ID NO: 62184
  CDS (1)..(816): transl_table=11

SEQ ID NO: 78583 - protein, 271 aa, Pyrococcus abyssi GE5; identical to SEQ ID NO: 62185

SEQ ID NO: 78584 - DNA, 447 bp, Methanothermobacter thermautotrophicus str. Delta H; identical to SEQ ID NO: 62186
  CDS (1)..(447): transl_table=11

SEQ ID NO: 78585 - protein, 148 aa, Methanothermobacter thermautotrophicus str. Delta H; identical to SEQ ID NO: 62187

SEQ ID NO: 78586 - DNA, 447 bp, Methanothermobacter thermautotrophicus str. Delta H; identical to SEQ ID NO: 62188
  CDS (1)..(447): transl_table=11

SEQ ID NO: 78587 - protein, 148 aa, Methanothermobacter thermautotrophicus str. Delta H; identical to SEQ ID NO: 62189

SEQ ID NO: 78588 - DNA, 480 bp, Mycobacterium tuberculosis CDC1551; identical to SEQ ID NO: 62190
  CDS (1)..(480): transl_table=11

SEQ ID NO: 78589 - protein, 159 aa, Mycobacterium tuberculosis CDC1551; identical to SEQ ID NO: 62191

SEQ ID NO: 78590 - DNA, 606 bp, Sulfolobus solfataricus P2; identical to SEQ ID NO: 62192
  CDS (1)..(606): transl_table=11

SEQ ID NO: 78591 - protein, 201 aa, Sulfolobus solfataricus P2; identical to SEQ ID NO: 62193

SEQ ID NO: 78592 - DNA, 489 bp, Methanopyrus kandleri AV19; identical to SEQ ID NO: 62194
  CDS (1)..(489): transl_table=11

SEQ ID NO: 78593 - protein, 162 aa, Methanopyrus kandleri AV19; identical to SEQ ID NO: 62195

SEQ ID NO: 78594 - DNA, 555 bp, Methanosarcina acetivorans C2A; identical to SEQ ID NO: 62196
  CDS (1)..(555): transl_table=11

SEQ ID NO: 78595 - protein, 184 aa, Methanosarcina acetivorans C2A; identical to SEQ ID NO: 62197

SEQ ID NO: 78596 - DNA, 513 bp, Methanosarcina acetivorans C2A; identical to SEQ ID NO: 62198
  CDS (1)..(513): transl_table=11

SEQ ID NO: 78597 - protein, 170 aa, Methanosarcina acetivorans C2A; identical to SEQ ID NO: 62199

SEQ ID NO: 78598 - DNA, 744 bp, Thermoanaerobacter tengcongensis MB4; identical to SEQ ID NO: 62200
  CDS (1)..(744): transl_table=11

SEQ ID NO: 78599 - protein, 247 aa, Thermoanaerobacter tengcongensis MB4; identical to SEQ ID NO: 62201

SEQ ID NO: 78600 - DNA, 513 bp, Methanosarcina mazei Go1; identical to SEQ ID NO: 62202
  CDS (1)..(513): transl_table=11

SEQ ID NO: 78601 - protein, 170 aa, Methanosarcina mazei Go1; identical to SEQ ID NO: 62203

SEQ ID NO: 78602 - DNA, 471 bp, Methanosarcina mazei Go1; identical to SEQ ID NO: 62204
  CDS (1)..(471): transl_table=11

SEQ ID NO: 78603 - protein, 156 aa, Methanosarcina mazei Go1; identical to SEQ ID NO: 62205

SEQ ID NO: 78604 - DNA, 555 bp, Methanosarcina mazei Go1; identical to SEQ ID NO: 62206
  CDS (1)..(555): transl_table=11

SEQ ID NO: 78605 - protein, 184 aa, Methanosarcina mazei Go1; identical to SEQ ID NO: 62207

SEQ ID NO: 78606 - DNA, 534 bp, Bradyrhizobium japonicum USDA 110; identical to SEQ ID NO: 62208
  CDS (1)..(534)

SEQ ID NO: 78607 - protein, 177 aa, Bradyrhizobium japonicum USDA 110; identical to SEQ ID NO: 62209

SEQ ID NO: 78608 - DNA, 768 bp, Salmonella enterica subsp. enterica serovar Typhi Ty2; identical to SEQ ID NO: 62210
  CDS (1)..(768): transl_table=11

SEQ ID NO: 78609 - protein, 255 aa, Salmonella enterica subsp. enterica serovar Typhi Ty2; identical to SEQ ID NO: 62211

SEQ ID NO: 78610 - DNA, 831 bp, Wolinella succinogenes DSM 1740; identical to SEQ ID NO: 62212
  CDS (1)..(831): transl_table=11

SEQ ID NO: 78611 - protein, 276 aa, Wolinella succinogenes DSM 1740; identical to SEQ ID NO: 62213

SEQ ID NO: 78612 - DNA, 471 bp, Methanococcus maripaludis S2; identical to SEQ ID NO: 62214
  CDS (1)..(471): transl_table=11

SEQ ID NO: 78613 - protein, 156 aa, Methanococcus maripaludis S2; identical to SEQ ID NO: 62215

SEQ ID NO: 78614 - DNA, 444 bp, Methanococcus maripaludis S2; identical to SEQ ID NO: 62216
  CDS (1)..(444): transl_table=11

SEQ ID NO: 78615 - protein, 147 aa, Methanococcus maripaludis S2; identical to SEQ ID NO: 62217

SEQ ID NO: 78616 - DNA, 822 bp, Leptospira interrogans serovar Copenhageni str. Fiocruz L1-130; identical to SEQ ID NO: 62218
  CDS (1)..(822): transl_table=11

SEQ ID NO: 78617 - protein, 273 aa, Leptospira interrogans serovar Copenhageni str. Fiocruz L1-130; identical to SEQ ID NO: 62219

SEQ ID NO: 78618 - DNA, 474 bp, Desulfovibrio vulgaris subsp. vulgaris str. Hildenborough; identical to SEQ ID NO: 62220
  CDS (1)..(474): transl_table=11

SEQ ID NO: 78619 - protein, 157 aa, Desulfovibrio vulgaris subsp. vulgaris str. Hildenborough; identical to SEQ ID NO: 62221

SEQ ID NO: 78620 - DNA, 435 bp, Desulfovibrio vulgaris subsp. vulgaris str. Hildenborough; identical to SEQ ID NO: 62222
  CDS (1)..(435): transl_table=11

SEQ ID NO: 78621 - protein, 144 aa, Desulfovibrio vulgaris subsp. vulgaris str. Hildenborough; identical to SEQ ID NO: 62223

SEQ ID NO: 78622 - DNA, 780 bp, Erwinia carotovora subsp. atroseptica SCRI1043; identical to SEQ ID NO: 62224
  CDS (1)..(780)

SEQ ID NO: 78623 - protein, 259 aa, Erwinia carotovora subsp. atroseptica SCRI1043; identical to SEQ ID NO: 62225

SEQ ID NO: 78624 - DNA, 747 bp, Desulfotalea psychrophila LSv54; identical to SEQ ID NO: 62226
  CDS (1)..(747): transl_table=11

SEQ ID NO: 78625 - protein, 248 aa, Desulfotalea psychrophila LSv54; identical to SEQ ID NO: 62227

SEQ ID NO: 78626 - DNA, 510 bp, Methylococcus capsulatus str. Bath; identical to SEQ ID NO: 62228
  CDS (1)..(510): transl_table=11

SEQ ID NO: 78627 - protein, 169 aa, Methylococcus capsulatus str. Bath; identical to SEQ ID NO: 62229

SEQ ID NO: 78628 - DNA, 564 bp, Azoarcus sp. EbN1; identical to SEQ ID NO: 62230
  CDS (1)..(564): transl_table=11

SEQ ID NO: 78629 - protein, 187 aa, Azoarcus sp. EbN1; identical to SEQ ID NO: 62231

SEQ ID NO: 78630 - DNA, 468 bp, Dehalococcoides ethenogenes 195; identical to SEQ ID NO: 62232
  CDS (1)..(468): transl_table=11

SEQ ID NO: 78631 - protein, 155 aa, Dehalococcoides ethenogenes 195; identical to SEQ ID NO: 62233

SEQ ID NO: 78632 - DNA, 516 bp, Dehalococcoides ethenogenes 195; identical to SEQ ID NO: 62234
  CDS (1)..(516): transl_table=11

SEQ ID NO: 78633 - protein, 171 aa, Dehalococcoides ethenogenes 195; identical to SEQ ID NO: 62235

SEQ ID NO: 78634 - DNA, 543 bp, Magnetospirillum magnetotacticum MS-1; identical to SEQ ID NO: 62236
  CDS (1)..(543)

SEQ ID NO: 78635 - protein, 180 aa, Magnetospirillum magnetotacticum MS-1; identical to SEQ ID NO: 62237

SEQ ID NO: 78636 - DNA, 414 bp, Desulfitobacterium hafniense DCB-2; identical to SEQ ID NO: 62238
  CDS (1)..(414)

SEQ ID NO: 78637 - protein, 137 aa, Desulfitobacterium hafniense DCB-2; identical to SEQ ID NO: 62239

SEQ ID NO: 78638 - DNA, 522 bp, Rhodospirillum rubrum; identical to SEQ ID NO: 62240
  CDS (1)..(522)

SEQ ID NO: 78639 - protein, 173 aa, Rhodospirillum rubrum; identical to SEQ ID NO: 62241

SEQ ID NO: 78640 - DNA, 516 bp, Ralstonia metallidurans CH34; identical to SEQ ID NO: 62242
  CDS (1)..(516)

SEQ ID NO: 78641 - protein, 171 aa, Ralstonia metallidurans CH34; identical to SEQ ID NO: 62243

SEQ ID NO: 78642 - DNA, 528 bp, Burkholderia fungorum LB400; identical to SEQ ID NO: 62244
  CDS (1)..(528)

SEQ ID NO: 78643 - protein, 175 aa, Burkholderia fungorum LB400; identical to SEQ ID NO: 62245

SEQ ID NO: 78644 - DNA, 534 bp, Burkholderia fungorum LB400; identical to SEQ ID NO: 62246
  CDS (1)..(534)

SEQ ID NO: 78645 - protein, 177 aa, Burkholderia fungorum LB400; identical to SEQ ID NO: 62247

SEQ ID NO: 78646 - DNA, 492 bp, Methanosarcina barkeri str. fusaro; identical to SEQ ID NO: 62248
  CDS (1)..(492)

SEQ ID NO: 78647 - protein, 163 aa, Methanosarcina barkeri str. fusaro; identical to SEQ ID NO: 62249

SEQ ID NO: 78648 - DNA, 735 bp, Geobacter metallireducens GS-15; identical to SEQ ID NO: 62250
  CDS (1)..(735)

SEQ ID NO: 78649 - protein, 244 aa, Geobacter metallireducens GS-15; identical to SEQ ID NO: 62251

SEQ ID NO: 78650 - DNA, 600 bp, Ferroplasma acidarmanus; identical to SEQ ID NO: 62252
  CDS (1)..(600)

SEQ ID NO: 78651 - protein, 199 aa, Ferroplasma acidarmanus; identical to SEQ ID NO: 62253

SEQ ID NO: 78652 - DNA, 438 bp, Clostridium thermocellum ATCC 27405; identical to SEQ ID NO: 62254
  CDS (1)..(438)

SEQ ID NO: 78653 - protein, 145 aa, Clostridium thermocellum ATCC 27405; identical to SEQ ID NO: 62255

SEQ ID NO: 78654 - DNA, 759 bp, Moorella thermoacetica ATCC 39073; identical to SEQ ID NO: 62256
  CDS (1)..(759)

SEQ ID NO: 78655 - protein, 252 aa, Moorella thermoacetica ATCC 39073; identical to SEQ ID NO: 62257

SEQ ID NO: 78656 - DNA, 546 bp, Polaromonas sp. JS666; identical to SEQ ID NO: 62258
  CDS (1)..(546)

SEQ ID NO: 78657 - protein, 181 aa, Polaromonas sp. JS666; identical to SEQ ID NO: 62259

SEQ ID NO: 78658 - DNA, 444 bp, Methanococcus maripaludis; identical to SEQ ID NO: 62260
  CDS (1)..(444): transl_table=11

SEQ ID NO: 78659 - protein, 147 aa, Methanococcus maripaludis; identical to SEQ ID NO: 62261

SEQ ID NO: 78660 - DNA, 429 bp, Rhodospirillum rubrum; identical to SEQ ID NO: 62262
  CDS (1)..(429): transl_table=11

SEQ ID NO: 78661 - protein, 142 aa, Rhodospirillum rubrum; identical to SEQ ID NO: 62263

SEQ ID NO: 78662 - DNA, 528 bp, uncultured archaeon GZfos37B2; identical to SEQ ID NO: 62264
  CDS (1)..(528)

SEQ ID NO: 78663 - protein, 175 aa, uncultured archaeon GZfos37B2; identical to SEQ ID NO: 62265

SEQ ID NO: 78664 - DNA, 444 bp, Desulfovibrio gigas; identical to SEQ ID NO: 62266
  CDS (1)..(444): transl_table=11

SEQ ID NO: 78665 - protein, 147 aa, Desulfovibrio gigas; identical to SEQ ID NO: 62267

SEQ ID NO: 78666 - DNA, 447 bp, Methanobacterium thermoformicicum; identical to SEQ ID NO: 62268
  CDS (1)..(447): transl_table=11

SEQ ID NO: 78667 - protein, 148 aa, Methanobacterium thermoformicicum; identical to SEQ ID NO: 62269

SEQ ID NO: 78668 - DNA, 768 bp, Escherichia coli; identical to SEQ ID NO: 62270
  CDS (1)..(768): transl_table=11

SEQ ID NO: 78669 - protein, 255 aa, Escherichia coli; identical to SEQ ID NO: 62271

SEQ ID NO: 78670 - DNA, 24 bp, Primer
atgagtccagtgcttacacaacat

SEQ ID NO: 78671 - DNA, 24 bp, Primer
ttagtcatgtaacccccggagtac

SEQ ID NO: 78672 - protein, 119 aa, consensus; identical to SEQ ID NO: 62274
  MISC_FEATURE (1)..(119): consensus for the disclosure of xaa see table XV

SEQ ID NO: 78673 - protein, 76 aa, consensus; identical to SEQ ID NO: 62275
  MISC_FEATURE (1)..(76): consensus for the disclosure of xaa see table XV

SEQ ID NO: 78674 - protein, 19 aa, consensus
  MISC_FEATURE (1)..(19): consensus for the disclosure of xaa see table XV
XXDXXXXGXXXXPXXXXXX

SEQ ID NO: 78675 - DNA, 1992 bp, Escherichia coli
  CDS (1)..(1992)
atgtttgccccgccacaaggaataacaattgaagcggtaaacggaatgctcgcggagcggttagcacagaaacacggcaaggcgtctttattacgcgccttcatcccgctgccgccgccgttcagcccggtacaacttattgaactgcatgttctcaaaagcaacttctattaccgctaccatgatgatggcagcgatgtgacggcaacaacagagtatcagggcgagatggtcgattattcgcgtcacgccgtccttctcggcagtagtggaatggcggagctacgctttattcgcacccacggcagtcgttttacttcccaggattgcacactgtttaactggctggcgcggataatcaccccggttctgcaatcatggctcaatgatgaagaacagcaggtggcgctgcgtttgctggagaaagatcgcgatcatcatcgggtactggttgatattactaatgcagtgctgtcacatcttgatctcgacgatctgatcgctgacgtcgctcgtgagatccatcattttttcggtctggcttcagtcagtatggtactgggcgatcatcgaaagaacgagaagttcagcctgtggtgcagcgatctttctgcctcacattgtgcgtgtctgccacgctgtatgcctggcgaaagtgtattgctgacacaaacgctacaaacccgacaaccgaccttgacgcaccgtgcagatgatctgtttctctggcaacgcgacccgttattactcttacttgcatctaacggctgcgaatctgcgctccttataccgcttacctttggcaaccatacaccgggtgcattgttgctggcgcatacctcttccactctctttagtgaggaaaactgccagctactacaacacatagccgatcgcatcgctattgccgttggcaatgccgatgcctggcgtagcatgaccgatttgcaggaaagtttgcagcaagaaaaccaccagcttagcgagcagctcctttcgaatctgggcatcggtgacattatctatcaaagccaggcaatggaagacctgctccagcaggtagatattgtggcgaagagcgacagtacggtgttgatttgtggtgaaaccggaactggcaaagaggtgatcgccagagcgatccatcaacttagcccgcgacgcgacaagccgctggtcaaaatcaactgcgctgccatccccgccagtcttctggaaagtgagttattcggtcatgacaaaggggcgtttactggtgcgattaatacccatcgtggtcgttttgaaattgccgatggcggcacgttgtttctcgatgaaattggcgatctgccgttagaacttcagcctaaactgctgcgcgtattgcaggagcgggagattgagcgtctcggcgggagtagaacgatcccggtgaatgtcagagtcattgccgccaccaaccgtgatttgtggcaaatggttgaagatcgccagtttcgcagcgatctcttttatcgcctgaatgtcttcccactggaattgccgccgctacgcgaccgtccggaagatatccctcttttagcaaaacatttcacgcaaaaaatggcgcgccatatgaatcgcgcaattgacgccatcccgaccgaggcactacgccagttgatgtcgtgggattggccgggcaacgtgcgcgagctggaaaacgtgattgagcgggcggtactgttgactcgtggtaacagtctgaatttacatctaaatgtccgacaaagccgtttactgccgacgctaaatgaagattcagcgcttcgcagttcaatggcgcagttactgcacccgacgacgccagagaatgacgaagaagaacgtcagcgcattgttcaggtattgcgagaaaccaatggcattgttgccgggccccgtggcgcagcgacgcgattagggatgaagcgcaccacgctgctgtcacgaatgcagcggctggggatctcggttcgcgaggtgttgtaa

SEQ ID NO: 78676 - protein, 663 aa, Escherichia coli
MFAPPQGITIEAVNGMLAERLAQKHGKASLLRAFIPLPPPFSPVQLIELHVLKSNFYYRYHDDGSDVTATTEYQGEMVDYSRHAVLLGSSGMAELRFIRTHGSRFTSQDCTLFNWLARIITPVLQSWLNDEEQQVALRLLEKDRDHHRVLVDITNAVLSHLDLDDLIADVAREIHHFFGLASVSMVLGDHRKNEKFSLWCSDLSASHCACLPRCMPGESVLLTQTLQTRQPTLTHRADDLFLWQRDPLLLLLASNGCESALLIPLTFGNHTPGALLLAHTSSTLFSEENCQLLQHIADRIAIAVGNADAWRSMTDLQESLQQENHQLSEQLLSNLGIGDIIYQSQAMEDLLQQVDIVAKSDSTVLICGETGTGKEVIARAIHQLSPRRDKPLVKINCAAIPASLLESELFGHDKGAFTGAINTHRGRFEIADGGTLFLDEIGDLPLELQPKLLRVLQEREIERLGGSRTIPVNVRVIAATNRDLWQMVEDRQFRSDLFYRLNVFPLELPPLRDRPEDIPLLAKHFTQKMARHMNRAIDAIPTEALRQLMSWDWPGNVRELENVIERAVLLTRGNSLNLHLNVRQSRLLPTLNEDSALRSSMAQLLHPTTPENDEEERQRIVQVLRETNGIVAGPRGAATRLGMKRTTLLSRMQRLGISVREVL

SEQ ID NO: 78677 - DNA, 2079 bp, Escherichia coli O157:H7
  CDS (1)..(2079): transl_table=11
atgtcatatacaccgatgagtgatctcggacagcaagggttgttcgacatcactcggacactattgcagcagcccgatctggcctcgctgtgtgaggctctttcgcaactggtaaagcgttctgcgctcgccgacaacgcggctattgtgttgtggcaagcgcagactcaacgtgcgtcttattacgcatcgcgtgaaaaagacacccccattaaatatgaagacgaaactgttctggcacacggtccggtacgcagcattttgtcgcgccctgatacgttgcattgcagttacgaagaattttgtgaaacctggccgcagctggccgcaggtgggctatacccaaaatttggtcactattgcctgatgccactggcggcggaagggcatatttttggtggctgtgaatttattcgttatgacgatcgcccctggagcgaaaaagagttcaatcgtctgcaaacatttacgcagatcgtttctgtcgtcaccgaacaaatccagagtcgcgtcgttaacaatgtcgactatgagttgttatgccgggaacgcgataacttccgcatcctggtcgccatcaccaacgcggtgctttcccgcctggatatggacgaactggtcagcgaagtcgccaaagaaatccattactatttcgatattgacgatatcagtatcgtcttacgcagccaccgtaaaaacaaactcaacatctactccactcactatcttgataaacagcatcccgcccacgaacagagcgaagtcgatgaagccggaaccctcaccgaacgcgtgttcaaaagtaaagagatgctgctgattaatctccacgagcgggatgatttagccccctatgaacgcatgttgttcgatacctggggcaaccagattcaaaccttgtgcctgttaccgctgatgtctggcgacaccatgctgggcgtgctgaaactggcgcaatgtgaagagaaagtgtttaccactaccaatctgaatttactgcgccagattgccgaacgtgtggcaatcgctgtcgataacgccctcgcctatcaggaaatccatcgtctgaaagaacggctggttgatgaaaacctcgccctgaccgagcagctcaacaatgttgatagtgaatttggcgagattattggccgcagcgaagccatgtacagcgtgcttaaacaagttgaaatggtggcgcaaagtgacagtaccgtgctgatcctcggtgaaactggcacgggtaaagagctgattgcccgtgctatccataatctcagtgggcgtaataatcgccgcatggtcaaaatgaactgcgcggcgatgcctgccggattgctggagagcgatctgtttggtcatgagcgtggggcttttaccggtgccagcgcccagcgtatcggtcgttttgaactggcggataaaagctccctgttcctcgacgaagtgggcgatatgccactggagttacagccgaagttgctgcgtgtattgcaggaacaggagtttgaacgcctcggcagcaacaaaatcattcagacggacgtgcgtctaatcgccgcgactaaccgcgatctgaaaaaaatggtcgccgaccgtgagttccgtagcgatctctattaccgcctgaacgtattcccgattcacctgccgccactacgcgagcgtccggaagatattccgctgctggcgaaagcctttaccttcaaaattgcccgtcgtctggggcgcaatatcgacagcattcctgccgagacgttgcgcaccttgagcaatatggagtggccgggtaacgtacgcgaactggaaaacgtcattgagcgcgcggtattgctaacacgcggcaacgtgctgcagctgtcattgccagatattgctttaccggagcctgaaacgccgcctgccgcaacggttgtcgctcaggagggcgaagatgaatatcagttgattgttcgcgtgctgaaagaaactaacggcgtggttgccgggcctaaaggcgctgcgcaacgtctggggctgaaacgcacgaccctgctgtcacggatgaagcgactgggaattgataaatcggcattgatttaa

SEQ ID NO: 78678 - protein, 692 aa, Escherichia coli O157:H7
MSYTPMSDLGQQGLFDITRTLLQQPDLASLCEALSQLVKRSALADNAAIVLWQAQTQRASYYASREKDTPIKYEDETVLAHGPVRSILSRPDTLHCSYEEFCETWPQLAAGGLYPKFGHYCLMPLAAEGHIFGGCEFIRYDDRPWSEKEFNRLQTFTQIVSVVTEQIQSRVVNNVDYELLCRERDNFRILVAITNAVLSRLDMDELVSEVAKEIHYYFDIDDISIVLRSHRKNKLNIYSTHYLDKQHPAHEQSEVDEAGTLTERVFKSKEMLLINLHERDDLAPYERMLFDTWGNQIQTLCLLPLMSGDTMLGVLKLAQCEEKVFTTTNLNLLRQIAERVAIAVDNALAYQEIHRLKERLVDENLALTEQLNNVDSEFGEIIGRSEAMYSVLKQVEMVAQSDSTVLILGETGTGKELIARAIHNLSGRNNRRMVKMNCAAMPAGLLESDLFGHERGAFTGASAQRIGRFELADKSSLFLDEVGDMPLELQPKLLRVLQEQEFERLGSNKIIQTDVRLIAATNRDLKKMVADREFRSDLYYRLNVFPIHLPPLRERPEDIPLLAKAFTFKIARRLGRNIDSIPAETLRTLSNMEWPGNVRELENVIERAVLLTRGNVLQLSLPDIALPEPETPPAATVVAQEGEDEYQLIVRVLKETNGVVAGPKGAAQRLGLKRTTLLSRMKRLGIDKSALI

SEQ ID NO: 78679 - DNA, 2079 bp, Shigella flexneri 2a str. 301
  CDS (1)..(2079): transl_table=11
atgtcatatacaccgatgagtgatctcggacagcaagggttgttcgacatcactcggacactattgcagcagcccgatctggcctcgctgtgtgaggctctttcgcaactggtaaagcgttctgcgctcgccgacaacgcggctattgtgttgtggcaagcgcagactcaacgtgcgtcttattacgcgtcgcgtgaaaaagacacccccattaaatatgaagacgaaactgttctggcacacggtccggtacgcagcattttgtcgcgccctgatacgctgcattgcagttacgaagaattttgtgaaacctggccgcagctggccgcaggtgggctataccccaaatttggtcactattgcctgatgccactggcggcgggagggcatatttttggtggctgtgaatttattcgttatgacgagcgtccctggagcgaaaaagagttcaatcgtctgcaaacatttacgcagatcgtttctgtcgtcaccgaacaaatccagagccgcgtcgtcaacaatgtcgactatgagttgttatgccgggagcgcgataacttccgcatcctggttgccattaccaacgcggtgctttcccgcctggatatggacgaactggtcagcgaagtcgccaaagaaatccattactatttcgacattgacgatatcagcattgtcttacgcagccaccgtaaaaacaaactcaacatctactccactcactatcttgataaacaacatcccgcccacgaacagagcgaagtcgatgaagccggaaccctcaccgaacgcgtgttcaaaagtaaagagatgctgctgatcaatctctacgagcgggacgatttagccccctatgaacgcatgttgttcgacacctggggcaaccagattcaaaccttgtgcctgttaccgctgatgtctggcgacaccatgctgggcgtgctgaaactggcgcaatgcgaagagaaagtgtttaccactaccaatctgaatttgctgcgccagattgccgaacgtgtggcaatcgctgtcgataacgccctcgcctatcaggaaatccatcgtctgaaagaacggctggttgatgaaaacctcgccctgaccgagcagctcaacaatgttgatagtgaatttggcgagattattggccgcagcgaagccatgtacagcgtgcttaaacaagttgaaatggtggcgcaaagtgacagtaccgtgctgatcctcggtgaaactggctcgggtaaagagctgattgcccgtgcgatccataatctcagtgggcgtaataatcgccgcatggtcaaaatgaactgcgcggcgatgcctgccggattgctggaaagcgatctgtttggtcatgagcgtggggcttttaccggtgccaacgcccagcgcattggtcgttttgaactggcggataaaagctctctgttcctcgacgaagtgggcgatatgccactggagttacagccgaagttgctgcgtgtattgcaggaacaggagtttgaacgtctcggcagcaacaaaatcattcagacggacgtacgtttaattgccgcgactaaccgcgatctgaaaaaaatggtcgccgaccgagagttccgtagcgatctctattaccgcctgaacgtattcccgattcacctgccgccactacgcgagcgtccggaagatattccgctgctggcgaaagcctttaccttcaaaattgcccgtcgtctggggcgcaatatcgacagcattcctgccgagacgctgcgcaccttgagcaacatggagtggccgggtaacgtacgcgaactggaaaacgtcattgagcgcgcagtattgctaacacgcggcaacgtgctgcagctgtcattgccagatattgctttaccggagcctgaaacgccgcctgccgcaacggttgtcgcccaggagggcgaagatgaatatcagttgattgtgcgcgtgctgaaagaaaccaacagcgtggttgccgggcctaaaggcgctgcgcaacgtctggggctgaaacgcacgaccctgctgtcacggatgaagcggctgggaattgataaatcggcattgatttaa

SEQ ID NO: 78680 - protein, 692 aa, Shigella flexneri 2a str. 301
MSYTPMSDLGQQGLFDITRTLLQQPDLASLCEALSQLVKRSALADNAAIVLWQAQTQRASYYASREKDTPIKYEDETVLAHGPVRSILSRPDTLHCSYEEFCETWPQLAAGGLYPKFGHYCLMPLAAGGHIFGGCEFIRYDERPWSEKEFNRLQTFTQIVSVVTEQIQSRVVNNVDYELLCRERDNFRILVAITNAVLSRLDMDELVSEVAKEIHYYFDIDDISIVLRSHRKNKLNIYSTHYLDKQHPAHEQSEVDEAGTLTERVFKSKEMLLINLYERDDLAPYERMLFDTWGNQIQTLCLLPLMSGDTMLGVLKLAQCEEKVFTTTNLNLLRQIAERVAIAVDNALAYQEIHRLKERLVDENLALTEQLNNVDSEFGEIIGRSEAMYSVLKQVEMVAQSDSTVLILGETGSGKELIARAIHNLSGRNNRRMVKMNCAAMPAGLLESDLFGHERGAFTGANAQRIGRFELADKSSLFLDEVGDMPLELQPKLLRVLQEQEFERLGSNKIIQTDVRLIAATNRDLKKMVADREFRSDLYYRLNVFPIHLPPLRERPEDIPLLAKAFTFKIARRLGRNIDSIPAETLRTLSNMEWPGNVRELENVIERAVLLTRGNVLQLSLPDIALPEPETPPAATVVAQEGEDEYQLIVRVLKETNSVVAGPKGAAQRLGLKRTTLLSRMKRLGIDKSALI

SEQ ID NO: 78681 - DNA, 2079 bp, Salmonella enterica subsp. enterica serovar Typhi Ty2
  CDS (1)..(2079): transl_table=11
atgtcgtatacacccatgagcgatcttggacagcaaggcttgttcgatatcactcgtaccttattgcagcagcccgatttggcgtcgctcagtgaagcgctttcgcaactggtaaagcgttcagcgctcgccgacagcgccggcattgtgctatggcaggcgcagtcgcaacgcgcacaatattatgcgacgcgagaaaatggccgtcctgttgaatatgaagatgaaaccgtactggcgcacggcccggtacgtcgcatcctttctcgccccgatgcattgcactgtaatttccatgagtttaccgaaacctggccgcagcttgccgcgagcggcctctaccctgaatttggtcattactgtctgcttcctttagccgcggagggccgtattttcggcggctgcgaattcatccgtcaggaagatcgcccctggagtgaaaaggaatatgaccgtctgcatacgtttacccaaattgtcggcgtggtcgccgagcaaattcaaaaccgggtaaacaataatgtcgattatgatctgttgtgccgcgaacgcgataacttccgtattctggttgcgattaccaacgccgtcctgtcgcgtctggatattaatgagctggtaagcgaagtcgcaaaagagatccaccactatttcaatatcgacgcgatcagcatcgtgttgcgcagccatcgcaaaaataagctgaatatctactccactcactaccttgatgagcatcatccggcgcacgaacagagcgaagtcgacgaagccggcacgctcacggagcgcgtctttaaaagtaaagagatgctgcttatcaacctcaacgaacgcgatccgcttgccccctacgaacgaatgctgttcgatacctggggcaatcagatccagacgctttgcctgctgccgttgatgtccggcaagacgatgcttggcgtgctcaaactggcccagtgcgaagaaaaagtgtttaccaccgccaacctcaagctgctacgtcagattgccgaacgggtagccattgccgtggataatgcgctggcctatcaggaaatccaccgtctgaaggaacgcctggtcgacgaaaatctggcgctcacggagcagcttaataacgtcgacagcgagtttggcgagatcatcgggcgcagcgaagcgatgtacaacgtgctaaagcaggttgagatggtggcgcagagcgacagtaccgtgctgattctgggcgaaacgggaaccagtaaagagttgattgcccgcgccattcacaacctgagcggacgtagcgggcgcagaatggtaaagatgaactgcgccgcgatgccggcggggctgctggaaagcgatctgtttggtcatgagcgcggcgcgtttaccggcgccagcgcgcagcggattggccgtttcgagctggcggataaaagctcgctgtttctggatgaagtgggcgacatgccgctggagctacagcctaagctgctgcgcgtccttcaggagcaagagtttgaacgtctcggcagcaataaactgatccagaccgacgtgcggctgatcgccgcgactaaccgcgatctgaaaaaaatggtcgccgatcgcgaattccataacgatctctactatcggctgaatgtttttccgattcagcttcctccgttacgcgaacgtccggaagatattccactgctggtcaaagcgtttaccttcaaaatcgcccgccgaatggggcgtaatatcgacagcattcccgccgaaacgctgcgcacgctcagcggtatggaatggccggggaacgttcgcgaactggagaatgtcgtcgagcgcgccgtgctgctgacgcgcggcaatgtgctacaactgtcgctgccggatatgactgccgtaacgcccgatacctcgcctgttgcgactgaaagcgccaaagaaggcgaagatgaatatcagcttattatacgcgtgctgaaagagaccaatggcgtagtggctggaccaaaaggcgcggcgcagcgtctggggcttaaacgaacccccctgctgtcgcgtatgaagcgattgggtattgataaagacgcgttagcgtaa

SEQ ID NO: 78682 - protein, 692 aa, Salmonella enterica subsp. enterica serovar Typhi Ty2
MSYTPMSDLGQQGLFDITRTLLQQPDLASLSEALSQLVKRSALADSAGIVLWQAQSQRAQYYATRENGRPVEYEDETVLAHGPVRRILSRPDALHCNFHEFTETWPQLAASGLYPEFGHYCLLPLAAEGRIFGGCEFIRQEDRPWSEKEYDRLHTFTQIVGVVAEQIQNRVNNNVDYDLLCRERDNFRILVAITNAVLSRLDINELVSEVAKEIHHYFNIDAISIVLRSHRKNKLNIYSTHYLDEHHPAHEQSEVDEAGTLTERVFKSKEMLLINLNERDPLAPYERMLFDTWGNQIQTLCLLPLMSGKTMLGVLKLAQCEEKVFTTANLKLLRQIAERVAIAVDNALAYQEIHRLKERLVDENLALTEQLNNVDSEFGEIIGRSEAMYNVLKQVEMVAQSDSTVLILGETGTSKELIARAIHNLSGRSGRRMVKMNCAAMPAGLLESDLFGHERGAFTGASAQRIGRFELADKSSLFLDEVGDMPLELQPKLLRVLQEQEFERLGSNKLIQTDVRLIAATNRDLKKMVADREFHNDLYYRLNVFPIQLPPLRERPEDIPLLVKAFTFKIARRMGRNIDSIPAETLRTLSGMEWPGNVRELENVVERAVLLTRGNVLQLSLPDMTAVTPDTSPVATESAKEGEDEYQLIIRVLKETNGVVAGPKGAAQRLGLKRTPLLSRMKRLGIDKDALA

SEQ ID NO: 78683 - DNA, 1980 bp, Erwinia carotovora subsp. atroseptica SCRI1043
  CDS (1)..(1980)
atgatttcactaaatacttcccgagttgctggcacctgggatatccggcgagagaaactggtcgatatcgcggaggcgttactccgccagcaggatccactctccgttttatcggttctggcagccctatcctctgaattcgttttcttccagtcggttacgttgtcgttgcccagctatggtgtctggcagcaggatgtcacgcaggaaaccccgccgcagggcgagtgttgttccggtggcggacactgtacgatgccgctaaacagtaccagcccgttgcagggggaattgagttttattcgttcccgtggtggacattttacgccagaagagcttggttttctgcgtcaggtggcctgccttgctggcggagtgctttcccatatttgccacaacaaaaccttgctggatgagtcccagcagatgcgccatcagcgcgatcatttccgcattctggtcgatattacgaactcggtgctatctcatctggatatggatgcgctggtgcaggaagtttcgcgggagatccaccgtttttttggcgttcagtatattgcgatggcgctcagcaacagtgaaaaacctgctgatttccgcctatggtcgacctattatgccccagagtccccggtatcccgccatcagtgtacgtttcctcgtgcgaaatcgttaactgagcacgttctacaaagccacgaggtcgtcgtgctcaatcttgacgacgatcgctgccaacaggctcgcgatactttttttgatgaattgcgttcccgccagttgtctacggtgtgtctgttgccgctttctttcaatagtgagccgctaggtgtgctggttctggcctatgagcaagcggatttttttcatgacaatcatctgaatctgttgcagcaaatagcggctcgtatcggcatcgctgtggataacgccgatgcttacggtcagatttcgcgtctgaaagataccttaaagaatgaaaatatctggctcaatgcgcgtattcagaacacggatgccgagggcgatatcatatatcaaagcgctcagatgcggtcggtattggagcaaatgagtatggtggcgacgagcgacagtaccgtactgatcctcggggaaaccggtacgggtaaagagctgattgcacgggctattcataagatgagctatcggcacaaagggtcgatggtcaaaatgaactgcgccgccgtgccttcaggtctgttggaaagcgatctgtttgggcatgaaaaaggggcatttaccggggcttccacggttcatatcgggcgttttgaaatggcggaaggcggctcgctgtttttggatgaaattggcgatatgccgcttgagcttcagcccaagctgttgcgggtgctacaggagagggaaatcgagcgactgggtagtaataaggtcatcccagtagatgtacgcctgattgccgcaaccaatcgcgacctgaagcagatgtcgatggatcgcgaattcagaagcgatttgtattaccggctgaatgttttcccgatctctattccgccgctacgcgaacggcctgaagatattcctctgctggcgaaattctttgtccagaaaattgcgcatagaatgaaacgtagcatagacaacattccggcgcaggcgctgcgccagctctgccagtacccctggccgggaaatgtgcgcgagctggaaaatgtcatcgaaagggcggtgatcctgacccgaggttcaacgctgaatttgcagatgcacgagctgaatgtgtctgtaccgtcggtatcggtgaaagagaataaaattgctctgacaccgccgccggaaaacgatgagaatgaacgtcagcgcatcatccaagtgctgcgagaaaccaacggcgtggtggctgggccacgtggtgcggccctgcggttagggctgaaacgcaccacgctgctttcgcgtatgcagcggctagggatttcgatatacgatttataa

SEQ ID NO: 78684 - protein, 659 aa, Erwinia carotovora subsp. atroseptica SCRI1043
MISLNTSRVAGTWDIRREKLVDIAEALLRQQDPLSVLSVLAALSSEFVFFQSVTLSLPSYGVWQQDVTQETPPQGECCSGGGHCTMPLNSTSPLQGELSFIRSRGGHFTPEELGFLRQVACLAGGVLSHICHNKTLLDESQQMRHQRDHFRILVDITNSVLSHLDMDALVQEVSREIHRFFGVQYIAMALSNSEKPADFRLWSTYYAPESPVSRHQCTFPRAKSLTEHVLQSHEVVVLNLDDDRCQQARDTFFDELRSRQLSTVCLLPLSFNSEPLGVLVLAYEQADFFHDNHLNLLQQIAARIGIAVDNADAYGQISRLKDTLKNENIWLNARIQNTDAEGDIIYQSAQMRSVLEQMSMVATSDSTVLILGETGTGKELIARAIHKMSYRHKGSMVKMNCAAVPSGLLESDLFGHEKGAFTGASTVHIGRFEMAEGGSLFLDEIGDMPLELQPKLLRVLQEREIERLGSNKVIPVDVRLIAATNRDLKQMSMDREFRSDLYYRLNVFPISIPPLRERPEDIPLLAKFFVQKIAHRMKRSIDNIPAQALRQLCQYPWPGNVRELENVIERAVILTRGSTLNLQMHELNVSVPSVSVKENKIALTPPPENDENERQRIIQVLRETNGVVAGPRGAALRLGLKRTTLLSRMQRLGISIYDL

SEQ ID NO: 78685 - DNA, 2079 bp, Salmonella enterica subsp. enterica serovar Paratypi A str. ATCC
  CDS (1)..(2079): transl_table=11
atgtcgtatacacccatgagcgatcttggacagcaaggcttgttcgatatcactcgtaccttattgcagcagcccgatttggcgtcgctcagtgaagcgctttcgcaactggtaaagcgttcagcgctcgccgacagcgccggcattgtgctatggcaggcgcagtcgcaacgcgcacaatattatgcgacgcgagaaaatggccgtcctgttgaatatgaagatgaaaccgtactggcgcacggcccggtacgtcgcatcctttctcgccccgatgcattgcactgtaatttccatgagtttaccgaaacctggccgcagcttgccgcgagcggcctctaccctgaatttggtcattgctgtctgcttcctttagccgcggagggccgtattttcggcggctgcgaattcatccgtcaggaagatcgcccctggagtgaaaaggaatatgaccgtctgcatacgtttacccaaattgtcggcgtggtcgccgagcaaattcaaaaccgggtaaacaataatgtcgattatgatctgttgtgccgcgaacgcgataacttccgtattctggttgcgattaccaacgccgtcctgtcgcgtctggatattgatgagttggtaagcgaagtcgcaaaagagatccaccactatttcaatatcgacgcgatcagcatcgtgttgcgcagccatcgcaaaaataagctgaatatctactccacccactaccttgatgagcatcatccggcgcacgaacagagcgaagtcgacgaagccggcacgctcacggagcgcgtctttaaaagtaaagagatgctgcttatcaacctcaacgaacgcgatccgcttgccccctacgaacgaatgctgttcgatacctggggcaatcagatccagacgctttgcctgctgccgttgatgtccggcaagacgatgcttggcgtgctcaaactggcccagtgcgaagaaaaagtgtttaccaccgccaacctcaagctgctgcgtcagattgccgaacgggtagccattgccgtggataatgcgctggcctatcaggaaatccaccgtctgaaggaacgcctggtcgacgaaaatctggcgctcacggagcagcttaataacgtcgacagcgagtttggcgagatcatcgggcgcagcgaagcgatgtacaacgtgctaaagcaggttgagatggtggcgcagagcgacagtaccgtgctgattctgggcgaaacgggaaccggtaaagagttgattgcccgcgccattcacaacctgagcggacgtagcggacgcaggatggtaaagatgaactgcgccgcgatgccggcggggctgctggaaagcgatttgtttggtcatgagcgcggcgcgtttaccggcgccagcgcgcagcggattggccgtttcgagctggcggataaaagctcgctgtttctggatgaagtgggcgacatgccgctggagctacagcctaagctgctgcgcgtccttcaggagcaagagtttgaacgtctcggcagcaataaactgatccagaccgacgtgcggctgatcgccgcgactaaccgcgatctggaaaaaatggtcgccgatcgcgaattccgtaacgatctctactatcggctgaatgtatttccgatccagcttcctccgttacgcgaacgtccggaagatattccactactggtcaaagcgttcaccttcaaaatcgcccgccgaatggggcgtaatatcgacagcattcccgctgaaacgctgcgcacgctcagcagcatggaatggccggggaacgttcgcgagctggagaatgtcgtcgagcgcgccgtgctgctgacgcgcggcaatgtgctacaactgtcgctgccggatattaccgccgtaacacccgatacctcgcctgttgcgactgaaagcgccaaagaaggcgaagatgaatatcagcttattatacgcgtgctgaaagagaccaatggcgtagtggctggaccaaaaggcgcggcgcagcgtctggggcttaaacgaaccaccctgttgtcgcgtatgaagcgattgggtattgataaagacgcgttagcgtaa

SEQ ID NO: 78686 - protein, 692 aa, Salmonella enterica subsp. enterica serovar Paratypi A str. ATCC
MSYTPMSDLGQQGLFDITRTLLQQPDLASLSEALSQLVKRSALADSAGIVLWQAQSQRAQYYATRENGRPVEYEDETVLAHGPVRRILSRPDALHCNFHEFTETWPQLAASGLYPEFGHCCLLPLAAEGRIFGGCEFIRQEDRPWSEKEYDRLHTFTQIVGVVAEQIQNRVNNNVDYDLLCRERDNFRILVAITNAVLSRLDIDELVSEVAKEIHHYFNIDAISIVLRSHRKNKLNIYSTHYLDEHHPAHEQSEVDEAGTLTERVFKSKEMLLINLNERDPLAPYERMLFDTWGNQIQTLCLLPLMSGKTMLGVLKLAQCEEKVFTTANLKLLRQIAERVAIAVDNALAYQEIHRLKERLVDENLALTEQLNNVDSEFGEIIGRSEAMYNVLKQVEMVAQSDSTVLILGETGTGKELIARAIHNLSGRSGRRMVKMNCAAMPAGLLESDLFGHERGAFTGASAQRIGRFELADKSSLFLDEVGDMPLELQPKLLRVLQEQEFERLGSNKLIQTDVRLIAATNRDLEKMVADREFRNDLYYRLNVFPIQLPPLRERPEDIPLLVKAFTFKIARRMGRNIDSIPAETLRTLSSMEWPGNVRELENVVERAVLLTRGNVLQLSLPDITAVTPDTSPVATESAKEGEDEYQLIIRVLKETNGVVAGPKGAAQRLGLKRTTLLSRMKRLGIDKDALA

SEQ ID NO: 78687 - DNA, 2202 bp, Rhodospirillum rubrum
  CDS (1)..(2202)
atgggtgaggcgcacagtctggcggaacgctacgaactgttgctcgatgtgtcggagattctcgagctgaaccgcgatctaaattcgctgctcggcgcgctttgcgacctgccggccagcattggtctgttcgattatgtcaatctgctgctctatgacgcgcccaccgatacgatgacgttgttttcgcagggcgatgtcggcggcggctatgcgcggatcgacggtctcgccccgaccgagggaccggggcaggtggtctgggcccgtcaacgtcccttcgtgtgcagcggcgaggaataccgccggcatttcctgaagatcgccgctctgcgccgcaaccagcgggtcggactgtattgtcagatgccgctgaccaccagccagcgccggctgggcggggtggaattcatcagttcacgccccactacctatgacgaggatgatctgaccttcctgcgccgggtcgcctcggtcatcgccatttcggttgaaaacgccctgatcggcgaaatgcgccagatggaggaggagcgtctgcgcggcgaacgcgatcacaaccacattctggtcgaggtgaccaatgcggtgatttccaagctgaagctggaggatctggtcgacgaggtgtcgcgctccattcaccggtttttcggcgtcgatttcgtctccctcgatctggtcgatccggccaccgccaccatcaaatcgcgctcggtctatttccagaaggggttggggccggtctggggctcggcccaggggccgcttggcgcctcgccgatggcacccttgttcgagaccaaggcgccgcgcatcctggcccgcgccgatctgggggccctggcgcgcggccatgatcagatgaccttgctgaccaacgccggtttccaagtggcttgcggtatcccgttgctttcggcggggcatgttctgggggtgctgaccctggccagccgcgagcgcgacaagttcaccgattacaatatcggcttgctgggcgaggtcgcctcgcgcatttgcatcgccgtggaaaacgccctggcttacggcgagatttcccggctcaaggaccagttgtcgcgcgagaacaagcaactggccaaggaacgctattacctggaagaggaaatccgccgcaccgaggatttcggcgatatcatcggcatcagcccggccattcgcggcgttctcgaacaggtggagctggtcgccgacagcgacagcacggtgctgatcctcggcgagacgggcacgggcaaggaactgatcgcgcgcgccatccatatgctgagccagcgcaagaagcgcacgatgatcaaggtgaactgcgcggccattccctcggccctgctggaaagcgatctgttcggccatgaaaaaggcgccttcaccggcgccatcgcccagaagtccggccgcttcgaactggccgatcgcggcacgctgtttcttgacgaggtcggcgacatccccatcgatctgcagcccaaactgctgcgcgccttgcaggagcgcgaaatcgagcgggtcggcggacatcagccgatcccagtggatgtgcggatgatcgccgccaccaaccgcgacctgacgggcatggtcgagaagcggctgttccggggcgatctgtattatcgcctgaacgtctttccgattctgatcccgcctttgcgcgagcgccgcgaggatattccgctgatggcggattatttcatgcgcaagacggcgcgcaagatgaaccgggcgatcgaggccttctcggccgaaaccatggatatgctgcttaacttgccgtggccgggcaatgtgcgcgagctgcaaaacgtcatcgagcgcgcggtcatcctgaccaaggggccggtgctgcatctgcccgccaccgaactgcgccatcatctggcgcccagcgccgccctgccgtccgaagacgcggtgattcctctccgcgccgcggtgctgccctccgccgcgagcgcgcccgatccgctcccgcccccggccgggtcgtcccccaatcccggcgatctcgccggcgaggcgatcgagcgcgaccagatcttgcgagtattgcgcgaaaccaatggcatcgtcggtggtccgcgcggcgcggcggcccatctcggaatgaagcggaccaccttgctgtcgcggatgcgccgccttggcatctcgcccaaggaggtcgatcaccgcgcgtga

SEQ ID NO: 78688 - protein, 733 aa, Rhodospirillum rubrum
MGEAHSLAERYELLLDVSEILELNRDLNSLLGALCDLPASIGLFDYVNLLLYDAPTDTMTLFSQGDVGGGYARIDGLAPTEGPGQVVWARQRPFVCSGEEYRRHFLKIAALRRNQRVGLYCQMPLTTSQRRLGGVEFISSRPTTYDEDDLTFLRRVASVIAISVENALIGEMRQMEEERLRGERDHNHILVEVTNAVISKLKLEDLVDEVSRSIHRFFGVDFVSLDLVDPATATIKSRSVYFQKGLGPVWGSAQGPLGASPMAPLFETKAPRILARADLGALARGHDQMTLLTNAGFQVACGIPLLSAGHVLGVLTLASRERDKFTDYNIGLLGEVASRICIAVENALAYGEISRLKDQLSRENKQLAKERYYLEEEIRRTEDFGDIIGISPAIRGVLEQVELVADSDSTVLILGETGTGKELIARAIHMLSQRKKRTMIKVNCAAIPSALLESDLFGHEKGAFTGAIAQKSGRFELADRGTLFLDEVGDIPIDLQPKLLRALQEREIERVGGHQPIPVDVRMIAATNRDLTGMVEKRLFRGDLYYRLNVFPILIPPLRERREDIPLMADYFMRKTARKMNRAIEAFSAETMDMLLNLPWPGNVRELQNVIERAVILTKGPVLHLPATELRHHLAPSAALPSEDAVIPLRAAVLPSAASAPDPLPPPAGSSPNPGDLAGEAIERDQILRVLRETNGIVGGPRGAAAHLGMKRTTLLSRMRRLGISPKEVDHRA

SEQ ID NO: 78689 - DNA, 2073 bp, Enterobacter aerogenes
  CDS (1)..(2073): transl_table=11
atgtcgtatacaccaatgggcgatctcgggcagcagggtctgtttgatatcacccgtattttattacagcagcccgatctggccgcgctgagcgaaacgctaacccgtctggtgcagcaatccgcgcttgccgaccgggcggcgattatcttgtggaaccacggcaaccatcgcgccgccaggtacgcctgcgacgacgccgggcagccggcaagctacgaagatgaaaccgtactggcgcacggcccggtacgccgcctgctgtcgcgccccgacgcgctacattgcgacaacgtgaccttcgccgaaacctggccgcagctggccgccagcggcatttacccggaattcggctactactgcctgctgccgctggcggcggaaggccgcatcttcggcggttgtgagttcatccgcgacgacaaccggccatggagcgaaaaagagtaccagcgcctgcatactttcgcgcagattgtcgccgtcgtgaccgagcagatccaaagccgggtcagcaacaacgtcgattacgacctgctgtgccacgagcgcgataacttccgcatcctggtggccatcaccaacgccgtcctgtcgcgcctcgatattgacgagctggtcagcgaggtggcgaaagagatccaccgctatttccgcatcgacgccatcagcgtggtgctgcgcagcaaccgcaaaggcaagcttaacatctactctacccactatctcgacgccagccatccggtccacgaccaaagcgaagtcgatgaagccggcacgctaaccgagcgggtgtttaagagcaaagagatgctgttactcaatctgcatgagcacgactcgctggcgccgtatgagaaaatgctcttcgagatgtgggataaccagatccagaccctgtgcctgttgccgctcatgtccggcaatacgctgctcggggtacttaagctggcgcagtgcgatgaacaagtatttaccaccaccaaccttaaactgctgcggcaaatcgccgagcgcgtatcgatagctatcgataatgccctcgcctaccgcgagatccagcgtctgaaagaacggctggtggatgaaaacctggcgctcactgaacagctcaacaacgtcgaaagcgagttcggcgaaatcatcggtcgcagcgaagcgatgcacagcgtgcttaaacaggtggagatggtggcgcagagcgacagtacggtgctgatcctcggtgaaaccggcaccggtaaggaactgattgcccgcgctattcataacctgagcgggcgcaacggccggcggatggtgaaaatgaactgcgcggcgatgcccgcgggcctgctggaaagcgatctgttcggccacgagcgcggcgcttttaccggcgccagcgcccagcgcatcggccgtttcgaactagcggacaaaagctcgctgttcctcgatgaggtcggcgatatgccgctggaactgcagccgaagctgctgcgcgttctccaggagcaggaattcgaacgtctgggcagcaataaactgattcagaccgatgtacggctgatagccgccaccaaccgcgatctcaaacagatggttatcgatcgtgaattccgcagcgatctttactatcggctcaatgtgttcccgatccacctgccgccgctgcgcgaacgcccggacgatattccactgctggtgaaagcattcactttcaaaatcgcccgccgtctggggcgcaacatcgacagtattcccgcggagaccctgcgcacgctttcgcgcatggagtggccgggcaacgtgcgcgagctggaaaacgtcgtcgagcgcgcggtgttgttgacccgcggcaacgtactgcaactgtcgctgccggaaatgcatattgaacaggagacgctggcgccggaagtgctgccggaggaaggcgaagatgaatatcagctgatcgtccgggtactgaaagagagcaacggcgtggtggccgggccaaaaggcgccgcccagcgcctggggctcaagcgcacgacgctgctgtcgcgcatgaagcgtttaggcattaataaggatcggttagtctag

SEQ ID NO: 78690 - protein, 690 aa, Enterobacter aerogenes
MSYTPMGDLGQQGLFDITRILLQQPDLAALSETLTRLVQQSALADRAAIILWNHGNHRAARYACDDAGQPASYEDETVLAHGPVRRLLSRPDALHCDNVTFAETWPQLAASGIYPEFGYYCLLPLAAEGRIFGGCEFIRDDNRPWSEKEYQRLHTFAQIVAVVTEQIQSRVSNNVDYDLLCHERDNFRILVAITNAVLSRLDIDELVSEVAKEIHRYFRIDAISVVLRSNRKGKLNIYSTHYLDASHPVHDQSEVDEAGTLTERVFKSKEMLLLNLHEHDSLAPYEKMLFEMWDNQIQTLCLLPLMSGNTLLGVLKLAQCDEQVFTTTNLKLLRQIAERVSIAIDNALAYREIQRLKERLVDENLALTEQLNNVESEFGEIIGRSEAMHSVLKQVEMVAQSDSTVLILGETGTGKELIARAIHNLSGRNGRRMVKMNCAAMPAGLLESDLFGHERGAFTGASAQRIGRFELADKSSLFLDEVGDMPLELQPKLLRVLQEQEFERLGSNKLIQTDVRLIAATNRDLKQMVIDREFRSDLYYRLNVFPIHLPPLRERPDDIPLLVKAFTFKIARRLGRNIDSIPAETLRTLSRMEWPGNVRELENVVERAVLLTRGNVLQLSLPEMHIEQETLAPEVLPEEGEDEYQLIVRVLKESNGVVAGPKGAAQRLGLKRTTLLSRMKRLGINKDRLV

SEQ ID NO: 78691 - DNA, 2073 bp, Klebsiella oxytoca
  CDS (1)..(2073): transl_table=11
atgtcgtatacaccgatgggcgatcttgggcagcagggtctgtttgatatcacccgcattttattacagcagccggatctggccgcgctgagcgagacgctgaccggcctggtgcagcagtccgcgctcgccgaccgggcggcgattattctgtggcattccggcaaccatcgcgcgacaaggcacgcctgcgacgatgccgggcatccggtgagctatgaagatgaaaccgtcctcgccaacggcccggttcgtcgtctgctgtcccgaccggatgcgctgcattgcgatagcgccacctttgccgagacctggccgcagctggcccgaagcggactctatcccacctttggctattactgcctgctgccgctggcggcggaaggccgcatcttcggcggctgcgaattcatccgcgatgacaaccggccatggactgaaaaagagtaccagcggctgcacacttttacgcaaatcgtcgccgtggtgaccgagcagatccagagccgggtcagcaataacgtcgattacgacctgctgtgccacgagcgcgataacttccgcatcctcgtggcgatcaccaacgccgtgctctcgcggctggatatcgacgagctggtcagcgaagtggccaaagagatccaccgctacttccgcatcgatgccattagcgtagtgctgcgcagcaaccgcaaaggcaagctcaacatctactccacccactacctcgacgccagccatccggtgcacgaccagagcgaagtggatgaagccggtaccctgaccgagcgggtcttcaaaagtaaagagatgctgctgctcaatctgcacgagcatgacccgctggcgccgtacgaaaaaatgcttttcgagatgtgggataacaaaattcagaccctgtgcctgctgccgttgatgtccggcaataccctgctcggggtgctgaagctggcgcagtgcgatgagaaagtgttcaccaccaccaatcttaagctgctgcggcaaatcgccgagcgcgtctcgatcgccatcgacaacgccctcgcctaccgcgaaattcagcgcctgaaggagcggctggtcgatgagaacctcgccctgaccgaacagctcaacaacgtggagagcgagtttggcgaaatcattggccgcagcgaggcgatgaacagcgtgctcaagcaggtggagatggtggcgcacagcgacagcacggtgctgatcctcggcgaaaccggcaccggtaaggagctgattgcccgcgctattcataatctgagcggccgcaatagccggcggatggtcaaaatgaactgcgcggcgatgcccgccgggctgctggaaagcgacctgtttggccacgagcgcggcgccttcaccggtgccagcgcgcagcgtatcggccgtttcgaactggcggacaaaagctcgctgtttctcgatgaagtgggcgatatgccggtggagctgcagccgaagctgctgcgcgtcctgcaggagcaggagttcgagcgtctcggcagcaataagctgattcacaccgacgtgcgcctgatcgccgcgaccaaccgcgatcttaagcagatggtcgccgatcgcgaatttcgcagcgatctctactatcggctgaacgtcttcccgatccacctgccgccgctgcgcgagcggccggacgatattccgctgctggtgaaggccttcacctttaaaatcgcccgccgtctgggacgcaatatcgacagcattccggcggaaacgctgcgccttctcagccgcatggagtggccgggcaacgtgcgtgagctggaaaacgtcattgagcgcgcggtgctgctgacccgcggcagcgtgctgcagctctccttgccggaaatgaacatcgagccgcagccgctggcggcagaagtgctgccggaggaaggcgaagatgaataccagctgattgtccgggtgctgaaagagagcaacggcgtggtcgccggaccgaagggcgcggcccagcgtctgggattaaagcgcaccactttgctttcgcgcatgaaacggttgggcattcataaagaccagctgcagtag

SEQ ID NO: 78692 - protein, 690 aa, Klebsiella oxytoca
MSYTPMGDLGQQGLFDITRILLQQPDLAALSETLTGLVQQSALADRAAIILWHSGNHRATRHACDDAGHPVSYEDETVLANGPVRRLLSRPDALHCDSATFAETWPQLARSGLYPTFGYYCLLPLAAEGRIFGGCEFIRDDNRPWTEKEYQRLHTFTQIVAVVTEQIQSRVSNNVDYDLLCHERDNFRILVAITNAVLSRLDIDELVSEVAKEIHRYFRIDAISVVLRSNRKGKLNIYSTHYLDASHPVHDQSEVDEAGTLTERVFKSKEMLLLNLHEHDPLAPYEKMLFEMWDNKIQTLCLLPLMSGNTLLGVLKLAQCDEKVFTTTNLKLLRQIAERVSIAIDNALAYREIQRLKERLVDENLALTEQLNNVESEFGEIIGRSEAMNSVLKQVEMVAHSDSTVLILGETGTGKELIARAIHNLSGRNSRRMVKMNCAAMPAGLLESDLFGHERGAFTGASAQRIGRFELADKSSLFLDEVGDMPVELQPKLLRVLQEQEFERLGSNKLIHTDVRLIAATNRDLKQMVADREFRSDLYYRLNVFPIHLPPLRERPDDIPLLVKAFTFKIARRLGRNIDSIPAETLRLLSRMEWPGNVRELENVIERAVLLTRGSVLQLSLPEMNIEPQPLAAEVLPEEGEDEYQLIVRVLKESNGVVAGPKGAAQRLGLKRTTLLSRMKRLGIHKDQLQ

SEQ ID NO: 78693 - DNA, 22 bp, Primer
atgtttgccccgccacaaggaa

SEQ ID NO: 78694 - DNA, 22 bp, Primer
ttacaacacctcgcgaaccgag

SEQ ID NO: 78695 - protein, 710 aa, consensus
  MISC_FEATURE (1)..(710): consensus for the disclosure of xaa see table XV
DXXXXXLXXXXXXXLXXXXXXXXXXXXXXXXXXXXLXXXXXXXXXXXXXXXXXXXXXXXXXXXXXXXXXXXXXXXXXXXXXXXXXXXXXXXXXAXXXXXXXXGXXCXXPLXXXXXXXGXXXFIRXXXXXXXXXXXXXLXXXXXXXXXVXXXXXXXXXXXXXXXXLXXXRDXXRILVXITNAVLSXLDXXXLVXEVXXEIHXXFXXXXXSXXLXXXXKXXXXXXXSXXXXXXXXXXXXXXXXXXXXXLXXXXXXXXXXXXXXXXXXXXLXXXXXXXXXXXXXXXXXXCLXPLXXXXXXLGVLXLAXXXXXXFXXXNXXLLXXIAXRXXIAXXNAXAYXXIXRLKXXLXXENXXLXXXXXXXXXXXXXXXXXGXIIXXSXAMXXVLXQVXXVAXSDSTVLILGETGTGKELIARAIHXLSXRXXXXMVKXNCAAXPXXLLESDLFGHEXGAFTGAXXXXXGRFEXADXXXLFLDEXGDXPXELQPKLLRVLQEXEXERLGXXXXIXXDVRXIAATNRDLXXMVXDRXFRXDLYYRLNVFPIXXPPLRERPXDIPLLXKXFXXKXARXXXRXIDXIPAEXLRXLXXXXWPGNVRELENVXERAVXLTRGXXLXLXXXXXXXXXXXXXXXXXXXXXXXXXXXXXXXXXXXXXXXXXXXXXXXXXXXXXXXXXEXQXIXXVLXEXNGXVAGPXGAAXRLGXKRTTLLSRMXRLGI

SEQ ID NO: 78696 - protein, 44 aa, consensus
  MISC_FEATURE (1)..(44): consensus for the disclosure of xaa see table XV
RDXXXXLVXXTNXVXSXLXXXXLXXXVXXXIHXXFXXXXXXXXL

SEQ ID NO: 78697 - protein, 65 aa, consensus
  MISC_FEATURE (1)..(65): consensus for the disclosure of xaa see table XV
XPLXXXXXXXGXLXLAXXXXXXFXXXXXXLLXXXAXRXXIAXXNAXAXXXXXXLXXXLXXENXXL

SEQ ID NO: 78698 - protein, 128 aa, consensus
  MISC_FEATURE (1)..(128): consensus for the disclosure of xaa see table XV
GXIIXXSXXXXXXLXQXXXVAXSDSTVLIXGETGXXKELXARAIHXXSXRXXXXXXKXNCAAXPAXLLESXLFGHXXGAFTGAXXXXXGRFEXAXXXXLFLDEXGDXPXXLQPKLLRXLQEXEXERXG

SEQ ID NO: 78699 - protein, 105 aa, consensus
  MISC_FEATURE (1)..(105): consensus for the disclosure of xaa see table XV
VRXIAATNRDLXXMXXXRXFXXDLXYRLNVFPXXXPPLRXRXXDIPLXXXXFXXKXAXXXXRXIDXXXXXXXXXLXXXXWPGNVRELXNVXERAVXLTXGXXLXL

SEQ ID NO: 78700 - protein, 47 aa, consensus
  MISC_FEATURE (1)..(47): consensus for the disclosure of xaa see table XV
EXXXIXXVLXEXNXXVXGPXGAAXXLGXKRTXLLSRMXRLGIXXXXX

SEQ ID NO: 78701 - DNA, 1578 bp, Escherichia coli
  CDS (1)..(1578)
atgacggaaaacattcataagcatcgcatcctcattctggacttcggttctcagtacactcaactggttgcgcgccgcgtgcgtgagctgggtgtttactgcgaactgtgggcgtgggatgtgacagaagcacaaattcgtgacttcaatccaagcggcattattctttccggcggcccggaaagtactactgaagaaaacagtccgcgtgcgccgcagtatgtctttgaagcaggcgtaccggtattcggcgtttgctatggcatgcagaccatggcaatgcagttgggcggtcacgttgaagcctctaacgaacgtgaatttggctacgcgcaggttgaagtcgtaaacgacagcgcactggttcgcggtatcgaagatgcgctgaccgcagacggtaaaccgctgctcgatgtctggatgagccacggcgataaagttaccgctattccgtccgacttcatcaccgtagccagcaccgaaagctgcccgtttgccattatggctaacgaagaaaaacgcttctatggcgtacagttccacccggaagtgactcatacccgccagggtatgcgcatgctggagcgttttgtgcgtgatatctgccagtgtgaagccctgtggacgccagcgaaaattatcgacgatgctgtagctcgcatccgcgagcaggtaggcgacgataaagtcatcctcggcctctctggtggtgtggattcctccgtaaccgcaatgctgctgcaccgcgctatcggtaaaaacctgacttgcgtattcgtcgacaacggcctgctgcgcctcaacgaagcagagcaggttctggatatgtttggcgatcactttggtcttaacattgttcacgtaccggcagaagatcgcttcctgtcagcgctggctggcgaaaacgatccggaagcaaaacgtaaaatcatcggtcgcgttttcgttgaagtattcgatgaagaagcgctgaaactggaagacgtgaagtggctggcgcagggcaccatctaccctgacgttatcgaatctgcggcgtctgcaaccggtaaagcacacgtcatcaaatctcaccacaacgtgggcggcctgccgaaagagatgaagatgggcctggttgaaccgctgaaagagctgttcaaagacgaagtgcgtaagattggtctggagctgggcctgccgtacgacatgctgtaccgtcacccgttcccgggaccaggccttggcgttcgtgttctgggtgaagtgaagaaagagtactgtgacctgctgcgccgtgctgacgccatcttcattgaagaactgcgtaaagcggacctgtacgacaaagtcagccaggcgttcactgtgttcctgccggtacgttccgttggcgtaatgggcgatggtcgtaagtatgactgggttgtctctctgcgtgctgtcgaaaccatcgactttatgaccgcacactgggcgcatctgccgtacgatttcctcggtcgcgtttccaaccgcattatcaatgaagtgaacggtatttcccgcgtggtgtatgacatcagcggcaagccgccagctaccattgagtgggaatga

SEQ ID NO: 78702 - protein, 525 aa, Escherichia coli
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEASNEREFGYAQVEVVNDSALVRGIEDALTADGKPLLDVWMSHGDKVTAIPSDFITVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 78703 - DNA, 2082 bp, Gallus gallus
  CDS (1)..(2082)
atggcgctgtgcaacggagacgccaagccagagaacacgggaggagagctgaaggacgggcagcaccactacgagggagctgtggtcatcctggatgctggtgcacagtatgggaaagtcatcgaccgccgggtgcgtgagctcttcgtccagtccgagatcttccccctggagacgcccgcctttgccatcagggagcagggctttcgagctatcatcatatctggaggaccaaattctgtgtatgctgaagatgcgccatggtttgacccagcaatatttacaataggaaagccagttcttgggatctgctatggcatgcagatgatgaataaggtgtttggaggtacggtgcacaagaagagcgtcagagaagatggagtgttcaacattactctggataacacgtgttcactgttcaggggccttcagaaggaagaacttgtgctcctcactcatggggacagcgtggataaggttgctgatggattcaaagtggttgcacagtctgggaacattatagcaggtatagcaaatgaatctaagaagctgtatggagcgcagttccaccctgaagttagccttacagtgaatgggaaaatgatcctgaagaattttctctatgatatcgcgggatgcagcggtaccttcacggtggaaaacagagaacttcaatgcattcaaaatatcaaagagaaagtgggctcatcgaaagttctggttttactcagtggtggtgtggactcaactgtgtgcactgctctcctgaatcgagctttaaaccgggatcaggtgatagctgtacatatagacaatgggtttatgcgcaaaagagaaagtcagtcggtggaggaggcactgaagaaacttgggattcaggttaaagtggtgaatgcagctcattctttctataatggtaacacaactctaccaatctctgatgaagacagaactccacgtaaaagaattagcaagaccttaaatatgactacaagtcctgaagaaaaaaggaagattatcggtgacacgtttgttaagattgccaatgaagttatcggagaaatgaatctgaaacctgaagaggtttttcttgctcagggtaccctcagacctgatctcattgaaagtgcttcccttgttgcaagtggcaaagctgaagtaatcaaaactcatcataatgacacggagctgattcgaaagttaagagaagagggtaaagttatagaaccactgaaagacttccacaaagatgaagttcgagtgctaggaagagagcttggacttcccgaagagctggtttcaaggcatcccttcccaggtccaggtctggcaatcagagtgatatgtgctgaggagccctatgtgtgcaaagacttccctgaaacaaacaacatcttgaaaattgttgcagatttttctgcaagtgttaagaagccacatactttgttgcaaagggttaaagcatgcacgactgaagaagaccaggagaaactgatgcagattacaagcctacattcactgaatgccttcttgttacccatcaaaactgtgggagtgcagggtgactgccgctcgtacagctacgtgtgtgggatctccagtaaggatgccccacactgggagtccctcatgtttctcgccaggctcataccacgcatgtgccacaacatcaacagggttgtgtatgtgtttggtccaccagtcaaagagcctcccactgatgtcacacccacgttcctgacaacaggagtcctcagcactttacgtcaagctgattttgaggctcacaacattctcagggagtctggttatgccggaaaaattagccagatgccaataatcctgaccccactgcattttgatcgggacccgctgcagaaacagccatcctgccagaggtctgtggttatccgaacgttcattacaagcgacttcatgactgggattgcagcaactcctggtaatgaggttccagaagaggttgtattaaaaatggtggcagagataaagaagatccctggcatttctcgggtgatgtatgacttgacatcaaagccaccaggaactacggagtgggagtaa

SEQ ID NO: 78704 - protein, 693 aa, Gallus gallus
MALCNGDAKPENTGGELKDGQHHYEGAVVILDAGAQYGKVIDRRVRELFVQSEIFPLETPAFAIREQGFRAIIISGGPNSVYAEDAPWFDPAIFTIGKPVLGICYGMQMMNKVFGGTVHKKSVREDGVFNITLDNTCSLFRGLQKEELVLLTHGDSVDKVADGFKVVAQSGNIIAGIANESKKLYGAQFHPEVSLTVNGKMILKNFLYDIAGCSGTFTVENRELQCIQNIKEKVGSSKVLVLLSGGVDSTVCTALLNRALNRDQVIAVHIDNGFMRKRESQSVEEALKKLGIQVKVVNAAHSFYNGNTTLPISDEDRTPRKRISKTLNMTTSPEEKRKIIGDTFVKIANEVIGEMNLKPEEVFLAQGTLRPDLIESASLVASGKAEVIKTHHNDTELIRKLREEGKVIEPLKDFHKDEVRVLGRELGLPEELVSRHPFPGPGLAIRVICAEEPYVCKDFPETNNILKIVADFSASVKKPHTLLQRVKACTTEEDQEKLMQITSLHSLNAFLLPIKTVGVQGDCRSYSYVCGISSKDAPHWESLMFLARLIPRMCHNINRVVYVFGPPVKEPPTDVTPTFLTTGVLSTLRQADFEAHNILRESGYAGKISQMPIILTPLHFDRDPLQKQPSCQRSVVIRTFITSDFMTGIAATPGNEVPEEVVLKMVAEIKKIPGISRVMYDLTSKPPGTTEWE

SEQ ID NO: 78705 - DNA, 1578 bp, Saccharomyces cerevisiae
  CDS (1)..(1578)
atggctgccggtgaacaagtttctaacatgtttgacactatcttagtgttagactttggttctcaatactctcatttgattaccagaagattaagagagtttaacatctatgctgagatgttgccatgcactcagaagatctctgagttgggctggactccaaagggtgtcattctttctggtggtccatattccgtatacgctgaagacgctccacacgtagaccatgctatctttgatttgaacgttccaatcctgggtatctgttacggtatgcaagaattggcttggattaatggtaaacaagttggtcgtggtgacaagagagagtacggtcctgccactttgaaggtgattgacgattccaactctctattcaaaggtatgaacgactctactgtctggatgtctcacggtgataaattgcacggcttgccaactggttacaagaccattgccacctccgataactccccatactgtggtattgtccacgaaactaagccaatctatggtattcaattccacccagaagttacacattctacccaaggtaagactcttttgaaaaacttcgccgttgatttgtgtcacgctaagcaaaactggactatggaaaactttatcgacactgaaataaacagaatcagaaaactggtcggtccaactgctgaagtcattggtgctgtttccggtggtgttgattctactgttgcatccaaattgatgacagaagccatcggtgatagattccatgccatcttggtcgataacggtgttttgagattaaatgaagctgctaacgttaaaaagacccttgtcgaaggtttaggtatcaacttgatggttgtcgatgcttccgaagaatttttaagtaaattgaagggtgtcactgacccagaaaagaagagaaagattattggtaacacatttatccacgtctttgaaagagaagctgaaaaaattaagccaaaagatggtaaggagattcaattcctgttacaaggtactctttatccagatgtcatcgaatccatttctttcaaaggtccttctcaaaccattaaaactcatcacaacgtcggtggtttactagagaacatgaaattaaagctaattgaaccattgagagaactgttcaaagacgaagtcaggcatctaggtgaattattaggaatccctcatgatctagtctggagacaccctttccctggtccaggtattgctattcgtgttctaggtgaagttactaaggaacaagtcgaaatagcaagaaaagctgacaacatttacattgaagaaatcaagaaggccggcttatacaaccaaatttcccaagcctttgcctgtttgttgcccgttaaatccgttggtgttatgggtgaccaaagaacctatgatcaagttattgctttgagggccattgaaactactgatttcatgactgctgactggttcccattcgaacacagtttcttgaagaaagtcgcctcaagaattgtcaatgaagtcgatggggttgctagggtcacttacgatataacttccaaacctcctgcaactgttgaatgggaatga

SEQ ID NO: 78706 - protein, 525 aa, Saccharomyces cerevisiae
MAAGEQVSNMFDTILVLDFGSQYSHLITRRLREFNIYAEMLPCTQKISELGWTPKGVILSGGPYSVYAEDAPHVDHAIFDLNVPILGICYGMQELAWINGKQVGRGDKREYGPATLKVIDDSNSLFKGMNDSTVWMSHGDKLHGLPTGYKTIATSDNSPYCGIVHETKPIYGIQFHPEVTHSTQGKTLLKNFAVDLCHAKQNWTMENFIDTEINRIRKLVGPTAEVIGAVSGGVDSTVASKLMTEAIGDRFHAILVDNGVLRLNEAANVKKTLVEGLGINLMVVDASEEFLSKLKGVTDPEKKRKIIGNTFIHVFEREAEKIKPKDGKEIQFLLQGTLYPDVIESISFKGPSQTIKTHHNVGGLLENMKLKLIEPLRELFKDEVRHLGELLGIPHDLVWRHPFPGPGIAIRVLGEVTKEQVEIARKADNIYIEEIKKAGLYNQISQAFACLLPVKSVGVMGDQRTYDQVIALRAIETTDFMTADWFPFEHSFLKKVASRIVNEVDGVARVTYDITSKPPATVEWE

SEQ ID NO: 78707 - DNA, 1578 bp, Mycobacterium tuberculosis CDC1551
  CDS (1)..(1578): transl_table=11
gtggtgcagcctgctgacatcgacgtgcctgagacaccggctcgaccggtgttggtggtcgacttcggtgcccaatatgcccagttgattgcccgtcgggttcgagaagcacgggttttctccgaggtgattccgcacaccgcctcgatcgaggagatcagggcccgtcagccggtggcgctcgtgctttccggtggaccggccagtgtctacgccgacggcgctccgaaactcgatccggcgctactggacctcggtgtaccggttcttggcatctgctacgggtttcaggccatggcgcaggcgctcggggggatcgtcgcccacaccggcactcgcgaatacggtcggactgaactgaaagtccttggtggcaaactgcattcggatcttcccgaggttcagccggtatggatgagtcacggtgacgcggtcacggccgcgccggacggattcgacgtggtggctagcagcgccggtgccccggtggccgccttcgaggccttcgaccggcgcctggccggggtgcagtatcacccggaggtgatgcacaccccacacgggcaacaggtgctcagccggtttttgcacgacttcgccgggctcggcgcccagtggacgcccgccaacatcgccaacgcgctgatcgagcaggtgcgcacccagatcggcgacggccacgccatctgcgggctatccggcggcgtggattccgcggtggccgcggccctggtgcagcgggccatcggcgaccggttgacctgtgtcttcgtcgaccacgggctgttgcgcgccggtgagcgggcgcaggtgcaacgcgatttcgtggccgccaccggcgccaacctggtcaccgtcgacgcggccgagaccttcctcgaggcgctgtcgggcgtgagcgcccccgagggcaaacgcaagatcatcggccgtcagttcatccgcgcgttcgagggcgcggtgcgggatgtgctggacggtaagactgctgagttcctggtgcagggcacgctgtatccggatgtggtggagtccggcgggggcagcggcaccgcgaacatcaagagccaccacaatgtcggcggcctgcccgacgacctgaagttcaccctcgttgagccgctgcggctgctgttcaaagacgaggtgcgcgcggtcgggcgggagttgggtctgccggaggagatcgtggcgcgccagccgtttccgggaccggggttgggtattcggatcgtcggggaggtcaccgccaagcgggtggatacgctgcggcacgccgattcgatcgtgcgtgaggagctgaccgcggcgggcctggacaaccagatctggcagtgtccggtggtgctgttggccgatgtccgctcggtgggtgtgcagggtgacggtcgcacctatggccacccgattgtgctgcgtccggtgtcgagtgaagacgcgatgaccgccgactggacccgggtgccctacgaggtgctcgagcgcatctcgacccggatcaccaacgaggtcgccgaggtcaaccgcgtggtgctggacatcaccagcaagccgcccgccaccatcgagtgggagtag

SEQ ID NO: 78708 - protein, 525 aa, Mycobacterium tuberculosis CDC1551
MVQPADIDVPETPARPVLVVDFGAQYAQLIARRVREARVFSEVIPHTASIEEIRARQPVALVLSGGPASVYADGAPKLDPALLDLGVPVLGICYGFQAMAQALGGIVAHTGTREYGRTELKVLGGKLHSDLPEVQPVWMSHGDAVTAAPDGFDVVASSAGAPVAAFEAFDRRLAGVQYHPEVMHTPHGQQVLSRFLHDFAGLGAQWTPANIANALIEQVRTQIGDGHAICGLSGGVDSAVAAALVQRAIGDRLTCVFVDHGLLRAGERAQVQRDFVAATGANLVTVDAAETFLEALSGVSAPEGKRKIIGRQFIRAFEGAVRDVLDGKTAEFLVQGTLYPDVVESGGGSGTANIKSHHNVGGLPDDLKFTLVEPLRLLFKDEVRAVGRELGLPEEIVARQPFPGPGLGIRIVGEVTAKRVDTLRHADSIVREELTAAGLDNQIWQCPVVLLADVRSVGVQGDGRTYGHPIVLRPVSSEDAMTADWTRVPYEVLERISTRITNEVAEVNRVVLDITSKPPATIEWE

SEQ ID NO: 78709 - DNA, 1620 bp, Schizosaccharomyces pombe
  CDS (1)..(1620)
atgagttccactgaagtgcccggggaagtctctacttctgtttcttcatattttgataccattttaattcttgactttggctctcagtatagtcatttgattgccagacgtcttcgtgagattcacgtgtatgcagagttacttccttgcactcaaaaaatagaagctctcccatttaagcctattggtgttattttgtctggcggcccctattctgtttacgatgacattgcacctcatgtggatcctgctgtctttgaacttggtgttcctgtactcggtatttgttatggcatgcaagaaattgcatggttgaatggacgttgtgttgaaccaggtatcgagagagagtacggtccagctacagttagtatggaacctgaaatcaaaaccgaggtcttcaaaagcttttttaactccatgccaaaagaatttgaggtttggatgtctcatggcgacagactaagcgctcttcccaatggctatgaaacaattggacgcaccaagaattctcctttcgctgtcattgcacatgttacaaagcccatcattggtttgcaattccatcctgaagttactcacactccattaggtttgcaacttattaagaactttgccattgaaatctgccatgctaagcccaactggagtatggaaaatttcgttgataaagaaattcttcgtattcgtaaaatgattggaccaagtgatcatgtcattggtgctgtttctggtggtgtagattcaacagttgcttcaaaggttctgaaagaggctattggagatcggttccatgccattatggttgacaatggcttgctgcgtcttaatgaagcagagattgttcgtgaaaccctcaataagcatttaggaattcaattaacagtagttgatgcttctgaagagttcattggaaaactgaaaggtgttactgatcccgagaagaagcgaaagatcattggtaacacgtttattcatgtttttgaacgagaggctgagcgaattgttaaagaaaccaacggtaaagttgaatacttattgcagggaacattatatcctgatgtcatagaaagtatttctttcaagggcccttctcagacaatcaaaacccaccataatgttggcggtcttttgaaggacatgaagctcaaacttattgaaccccttcgtgagctcttcaaagacgaagttcgtgctttgggtgaattacttggtattgaacatagccttgtctggcgtcatcctttcccaggccctggtttgggcattcgtatccttggcgaagttaatgctgctcagcttgaaattgcgcgtaaagccgaccacatttttattactgaaattcgtaaccacggctattatgataaaatttctcaagctttcgctgctcttttaccggtaaaggctgtcggtgttatgggtgacaagcgtactcatgaacaagtaattgctcttcgtgctattaccacttctgattttatgacagctgattggtacgatgggtttagcattaagtttttgaagttggtcagctcccgtatttgcaacgaagtgtctggtgttaatcgtgtattgtatgacattagcagtaagcctccggcaactgtcgaaatggagtaa

SEQ ID NO: 78710 - protein, 539 aa, Schizosaccharomyces pombe
MSSTEVPGEVSTSVSSYFDTILILDFGSQYSHLIARRLREIHVYAELLPCTQKIEALPFKPIGVILSGGPYSVYDDIAPHVDPAVFELGVPVLGICYGMQEIAWLNGRCVEPGIEREYGPATVSMEPEIKTEVFKSFFNSMPKEFEVWMSHGDRLSALPNGYETIGRTKNSPFAVIAHVTKPIIGLQFHPEVTHTPLGLQLIKNFAIEICHAKPNWSMENFVDKEILRIRKMIGPSDHVIGAVSGGVDSTVASKVLKEAIGDRFHAIMVDNGLLRLNEAEIVRETLNKHLGIQLTVVDASEEFIGKLKGVTDPEKKRKIIGNTFIHVFEREAERIVKETNGKVEYLLQGTLYPDVIESISFKGPSQTIKTHHNVGGLLKDMKLKLIEPLRELFKDEVRALGELLGIEHSLVWRHPFPGPGLGIRILGEVNAAQLEIARKADHIFITEIRNHGYYDKISQAFAALLPVKAVGVMGDKRTHEQVIALRAITTSDFMTADWYDGFSIKFLKLVSSRICNEVSGVNRVLYDISSKPPATVEME

SEQ ID NO: 78711 - DNA, 1668 bp, Plasmodium falciparum 3D7
  CDS (1)..(1668)
atggaaggagaggaatatgacaagattttggtattgaatttcggttctcaatacttccatttgattgtaaaaagattaaacaatataaaaatatttagtgaaactaaagattatggtgttgaattaaaagatattaaggatatgaatataaaaggtgttatattatctggtggtccatattcagtaacagaggctggttctccacatttaaagaaagaagtgtttgaatattttttagaaaagaagattccaatttttggtatatgttatggtatgcaagagatagcagtacagatgaatggtgaggttaagaaatctaagacatccgaatatggatgtactgatgtaaacatattaagaaatgataatattaataatataacatattgtagaaattttggtgatagttcatctgctatggatttatattctaattataaattaatgaatgagacttgttgtttatttgaaaatattaaaagtgacattacaacggtttggatgaatcataatgatgaagttacaaaaattccagaaaatttttatttagttagctcaagtgaaaattgtttaatatgttctatatataataaagaatataatatatatggtgttcaatatcatccagaggtgtatgaatcattagatggagaattaatgttttataactttgcttataatatatgtaaatgtaaaaaacaatttgatccaatacgttatcatgaattagaattaaaaaatattgagaaatataaacatgatcattatgttatagcagccatgtctggaggtatagatagtactgttgctgctgcatatacacataaaatttttaaagaacgattttttggtattttcatagataatggattattaagaaaaaatgaagcggaaaatgtttatacctttttaaaatctacatttcctgatatgaatataacaaaaattgatgcttctgaaaatttcctatcaaatctacaaggagttacagatccagaacaaaaaaggaaaattatagggaaattatttattgaagaatttgaaaaggcagtaaataatattgatatagatataaacaaaacatttttattacaaggtactctatatccagatattattgaaagtaaatgttcaaaaaatttatcagatactattaaaactcatcataatgtaggaggcttaccaaaaaatttaaaatttaaattgtttgaacctttcaaatatttatttaaagatgatgttaaaacattatctagagaattaaatttaccagaagaaattactaatagacatcctttcccaggacctggattagcgatcagagttattggagaaataaataaacacaaattaaatatattaagagaagttgatgatatttttataaacgatttaaaacaatatggattatataatcaaatcagtcaagcttttgctgtacttttatcatcaaaatctgtaggtgtaagaggtgatgcaaggtcatatgattatgtttgtgttcttagagctgtcaaaacatcatcttttatgacagcaaattggtatcaaataccttatgatattctcgataaaataactactagaatattgagtgaagtaaagggcgtcaacagaatattatatgatgtatcatcaaaaccaccagcaacgattgaattcgaatga

SEQ ID NO: 78712 - protein, 555 aa, Plasmodium falciparum 3D7
MEGEEYDKILVLNFGSQYFHLIVKRLNNIKIFSETKDYGVELKDIKDMNIKGVILSGGPYSVTEAGSPHLKKEVFEYFLEKKIPIFGICYGMQEIAVQMNGEVKKSKTSEYGCTDVNILRNDNINNITYCRNFGDSSSAMDLYSNYKLMNETCCLFENIKSDITTVWMNHNDEVTKIPENFYLVSSSENCLICSIYNKEYNIYGVQYHPEVYESLDGELMFYNFAYNICKCKKQFDPIRYHELELKNIEKYKHDHYVIAAMSGGIDSTVAAAYTHKIFKERFFGIFIDNGLLRKNEAENVYTFLKSTFPDMNITKIDASENFLSNLQGVTDPEQKRKIIGKLFIEEFEKAVNNIDIDINKTFLLQGTLYPDIIESKCSKNLSDTIKTHHNVGGLPKNLKFKLFEPFKYLFKDDVKTLSRELNLPEEITNRHPFPGPGLAIRVIGEINKHKLNILREVDDIFINDLKQYGLYNQISQAFAVLLSSKSVGVRGDARSYDYVCVLRAVKTSSFMTANWYQIPYDILDKITTRILSEVKGVNRILYDVSSKPPATIEFE

SEQ ID NO: 78713 - DNA, 1551 bp, Leptospira interrogans serovar Lai str. 56601
  CDS (1)..(1551): transl_table=11
atgaaattattaggcggtgttgtagaacgttctggaactggagaatacggccctgcttctctacaacttcatggaaccaatggaaattctattttgaaaaatttcgtaggtggggagcaggtttggatgaaccacgcggatgaagttgtaaaacttccagaaggtttttctaaaattgctttttctaaagactgcggttatgcggttgttgcaaattcatctaagaaaatttttggaattcagtttcatgcagaagttagtcatagcgaaaaaggttcggttcttttagataatttcattcaaatttgtggggtttctaaaacttggggaatcgatcagtttttaaaagaaaaaatcaaagagattcaagaaacagttaaacaagaacagaaaatttttatgctcgtttctggaggtgtggattctacggtttcttaccttcttttgtgtaaggctcttggtgctgaaagagttttaggttttttgattgatactggttttatgagaaaagacgaagttgtttctcttcaaaaaaaattaacttttcagaatattcacctaacagtgagagacgaatcctctcttttttataaaagtttaaaagataaatccgatccggaagaaaaaagaaaaattgtaggtaatctatttttagaagcgagagatcgtgctgtaaaagatttagatctggaatacggagattggcttttaggtcaaggtactatttatccggatacgatcgaatctggtggaaccaaacattcgcataccattaaaacgcatcacaatcgggtagaagcgattcaaaaactgattgaacaaggaaaagtaatagaaccgattcgggatctttataaagacgaggtaagggatttaggtgtccttctgggtttggaatcggaatgggtagggcgtcatccgtttccaggaccggggcttgtggttcgtatgctcgcagtagaaaaaaaaggaaccgataaggatcagttggaaattgattcctatctttcgacccaagatgggttgtccggaaaaattcttccgattgcaagtgtgggtgtcaaaggagacagaaggtcttatgccaattgtgttgtgttaaacgacattgaaacagattggaacactttagatcgtgtagctactcatctttcaaaccgattttcttttatcaatcgagtggttcttttaccttttgaatcggatcttaaaaaatggaactttcaatttactggaatgcagttagataaaaaatgttcggacttactccgtgaagctgattttacagttgaatccgtgattcgtaaattgggactttataataaaatctggcagatgcctgtggttttacttccgattggagaaaaggagaatgaaaaaagtatcgtccttcgtcctgtagaatctcaagaagcgatgactgctaatttttttaggatggaacgttctgttttacaagaaattaaaatagaagttctaaaaattcctgaaattcgttatctattttttgatctcacgaacaaacctcccggaacgatcgagtgggaataa

SEQ ID NO: 78714 - protein, 516 aa, Leptospira interrogans serovar Lai str. 56601
MKLLGGVVERSGTGEYGPASLQLHGTNGNSILKNFVGGEQVWMNHADEVVKLPEGFSKIAFSKDCGYAVVANSSKKIFGIQFHAEVSHSEKGSVLLDNFIQICGVSKTWGIDQFLKEKIKEIQETVKQEQKIFMLVSGGVDSTVSYLLLCKALGAERVLGFLIDTGFMRKDEVVSLQKKLTFQNIHLTVRDESSLFYKSLKDKSDPEEKRKIVGNLFLEARDRAVKDLDLEYGDWLLGQGTIYPDTIESGGTKHSHTIKTHHNRVEAIQKLIEQGKVIEPIRDLYKDEVRDLGVLLGLESEWVGRHPFPGPGLVVRMLAVEKKGTDKDQLEIDSYLSTQDGLSGKILPIASVGVKGDRRSYANCVVLNDIETDWNTLDRVATHLSNRFSFINRVVLLPFESDLKKWNFQFTGMQLDKKCSDLLREADFTVESVIRKLGLYNKIWQMPVVLLPIGEKENEKSIVLRPVESQEAMTANFFRMERSVLQEIKIEVLKIPEIRYLFFDLTNKPPGTIEWE

SEQ ID NO: 78715 - DNA, 1305 bp, Arabidopsis thaliana
  CDS (1)..(1305)
atggagacgccgacgatgaagcctgatacggttttgattcttgattacggctcccaatacacacatctcatcactcgccgtattcgttctctcaacgtcttctctctcgttatcagtggaacttcatcgctcaaatcaatcactagctataacccacgagttgttatcctctccggtggtcctcactctgttcacgcgctcgacgcgccgagtttccccgaggggtttatcgaatgggcagagtcgaacggtgtttctgttttggggatttgctatggtttgcaattgattgtgcagaagcttggtggtgttgttgtggaaggagagagcaaagagtatgggaaaatggagattgaagtgaaaggtaaatctgagatttttgggtcagagagtggtggtgagaagcaaatggtttggatgagtcatggtgatgaagcggttaagcttcctgaaggatttgaagttgtggctcagagtgctcaaggagctgttgctgctttggagagtcggaagaagaagatttatggattgcagtatcatcctgaggtgacacattcaccaaaaggaatggagacacttcggcatttcctctttgatgtgtgtggagtatctgcggattggaaaatggaagatctgatggaagaagagatcaaagtgattaacaaaaccgttgcatctgacgaacatgtcatttgcgccttgtcaggaggtgtagactctactgttgccgcaactcttgttcacaaggcaattggagataggcttcattgcatctttgttgataacgggctattaaggtataaggagcaagaacgtgtgatggatacctttgagagagacttgcatctacctgttacttgtgttgatgcatccgagcggtttttgagtgaacttaaaggcgttgtggatcccgagacaaagagaaagataatcgggagggagttcatcaacatttttgatcaatttgcccaagagttagagaaaaagcatgggaagaaacccgcttttctagttcaagggactctgtaccctgatgtgattgagtcgtgccctcccccgggtactgataggactcattctcacaccatcaaaagtcaccataatgttggaggactccctaaagacatgaaattgaagctcatcgaacccctcaagcttctcttcaaagatgaggttcgtgagctcggaagaatcttgaatgtgccggtagggttcttgaagcgtcacccattccccggtccaggactcgcagttagagtcttgggcgatgtcacccaaggaaacgcccttgaggttcttcgttga

SEQ ID NO: 78716 - protein, 434 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVSVLGICYGLQLIVQKLGGVVVEGESKEYGKMEIEVKGKSEIFGSESGGEKQMVWMSHGDEAVKLPEGFEVVAQSAQGAVAALESRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASERFLSELKGVVDPETKRKIIGREFINIFDQFAQELEKKHGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLR

SEQ ID NO: 78717 - DNA, 1578 bp, Eremothecium gossypii
  CDS (1)..(1578)
atggctgctgttgaacaagtttctagcgtgtttgacaccattttggtgctggacttcgggtcccagtactcgcatctgatcacgcggcggctgcgtgagtttaatgtgtacgcggagatgcttccgtgtacgcagaagatcagcgagctgggctggaagccaaagggtgtgattttgtcaggcgggccgtactccgtgtacgcggcagatgctccgcacgtggaccgggcggtgttcgagttgggcgttccaattctgggcatctgctacgggctacaggagcttgcgtggatagccggcgcagaggtggggcgcggcgagaagcgcgagtacgggcgcgcgacgctgcacgtggaggacagcgcgtgcccgctgttcaacaacgtggacagcagcacggtgtggatgtcgcacggtgacaagctgcacgcactacctgcggatttccacgtcactgcgacgacggagaactctcctttctgcgggattgcacacgactcgaagccaatcttcgggatccagttccaccctgaggtgacgcactcctcgcaggggaagacgttgctgaagaactttgcggtggagatctgccaggccgcgcagacctggacgatggaaaacttcattgacaccgagatccagcggatccggacccttgtgggccccaccgcggaagtcatcggtgctgtgtccggcggtgtcgactcgaccgtcgctgcgaagctgatgaccgaggccatcggcgaccggttccacgcgatcctggtcgacaacggtgttctgcgcctcaacgaagcggccaatgtgaagaaaatcctcggcgagggcttgggcatcaacttgactgttgttgacgcctccgaagagttcttgacgaagctcaagggcgtcacggaccctgagaagaagagaaagatcatcggtaacaccttcattcatgtttttgagcgcgaggcagccaggatccagcctaagaacggcgaggagattgagttcctgttgcagggtaccctataccctgacgttatcgagtccatttcctttaagggcccatctcagacgatcaagacccaccataacgtcggtggtcttttggacaacatgaaactgaagctcattgagcctttgcgcgagcttttcaaggacgaggtgagacacctgggagaactattggggatctcccacgagttggtctggagacatccgttcccaggcccaggtatcgccatccgtgtgctaggcgaggtcaccaaggagcaggtggagattgccagaaaggcagaccacatctacatcgaggagatcaggaaagcaggtctatacaacaagatttctcaagcttttgcttgcttgctgcctgttaagtctgtgggtgtcatgggtgaccagagaacctacgaccaggtcattgctctaagagcaattgagaccacggacttcatgactgccgactggtatccatttgagcacgaattcttgaagcatgtcgcatcccgtattgttaacgaggttgaaggtgttgccagagtcacctacgacataacttctaagcctccagctaccgttgaatgggaataa

SEQ ID NO: 78718 - protein, 525 aa, Eremothecium gossypii
MAAVEQVSSVFDTILVLDFGSQYSHLITRRLREFNVYAEMLPCTQKISELGWKPKGVILSGGPYSVYAADAPHVDRAVFELGVPILGICYGLQELAWIAGAEVGRGEKREYGRATLHVEDSACPLFNNVDSSTVWMSHGDKLHALPADFHVTATTENSPFCGIAHDSKPIFGIQFHPEVTHSSQGKTLLKNFAVEICQAAQTWTMENFIDTEIQRIRTLVGPTAEVIGAVSGGVDSTVAAKLMTEAIGDRFHAILVDNGVLRLNEAANVKKILGEGLGINLTVVDASEEFLTKLKGVTDPEKKRKIIGNTFIHVFEREAARIQPKNGEEIEFLLQGTLYPDVIESISFKGPSQTIKTHHNVGGLLDNMKLKLIEPLRELFKDEVRHLGELLGISHELVWRHPFPGPGIAIRVLGEVTKEQVEIARKADHIYIEEIRKAGLYNKISQAFACLLPVKSVGVMGDQRTYDQVIALRAIETTDFMTADWYPFEHEFLKHVASRIVNEVEGVARVTYDITSKPPATVEWE

SEQ ID NO: 78719 - DNA, 2451 bp, Mus musculus
  CDS (1)..(2451)
atgaatgagaaagcctttagaacagattattctaagtcccagcctttgggctactctatcttcggcctggtagaggcagcctttagactgcttcagctaatacactatcacggagaaaagatgttcttgatggataaactctgccctaattgcagaaaaaagtctcctttaatgatcaggtttagagaggcggggccggttagaggaggtcgggcggaagctggaggcagggcctgcgcgcgcttctgtgttctgaggccgctgttaggttccgggctgctcttgttcttcacgcttctgccggtcccggtgttgagcctctggcgtccaggccttgccagcagtctgcacccgcggcgttggtccccgatggccctgtgcaacggagattccaagccggagaatgctggaggagatcttaaggatggttctcaccattacgaaggagctgttgtcattctggatgctggagcccagtatgggaaagtcattgaccgaagagtgcgggagctctttgtgcagtctgaaatcttcccattggaaacaccagccttcgccataaaggaacaaggatttcgggctattatcatatctggaggacctaattctgtgtatgcagaggatgctccctggtttgatccagcaatatttaccattggcaagcctattctaggaatttgctatggcatgcagatgatgaataaagtctttggaggcactgtgcataaaaaaagtgttagagaggatggagttttcaacattagtatggataatacgtgttcattattcaggggcctgcagaaggaagaaattgttttacttacacatggagacagtgtagacaaagttgctgatggattcaaggttgtagcacgttctgggaacattgtggcaggtatagccaatgaatctaaaaagctatacggtgtacagttccaccctgaagttgggcttacagaaaatgggaaggtaatactgaagaatttcctgtatgatatagctggatgcagtgggaactttactgtgcagaaccgagaacttgaatgcattcgagagattaaagagaaagtaggaacatcaaaagtgttggttttactcagtggtggtgtagattcaactgtttgtacagctttgctaaatcgtgctttgaaccaagatcaagtcattgctgtacacattgataatggctttatgagaaaacgagaaagccaatctgttgaagaggccctcaaaaagcttggaattcaagtcaaagtgataaatgctgctcattccttctacaatggaacaactactctaccaatctcagatgaagacaggaccccacggaaaagaattagcaaaacattaaatatgacaacaagtcctgaggagaaaagaaaaattattggtgatactttcgttaagattgccaatgaagtaattggagaaatgagtctgaagcccgaggaggtttttctcgcccaaggcactttacggcctgatctaatcgaaagtgcgtcccttgttgccagtggtaaagccgaactcatcaaaacccaccacaacgacacagaacttatcaggaagttaagggaagagggaaaagtaatagaacctctgaaagattttcataaagatgaagtcaggattttaggcagagagcttgacctgccagaagaattggtttccaggcatccttttccaggtcctggcctggcaatcagagtaatatgtgctgaagaaccttatatttgtaaagacttccctgaaaccaacaatattttgaaaatagtagctgatttttctgcaagtgttaagaagcctcatacactgttacaaagagtcaaagcctgcacaacagaagaggaccaggagaagctcatgcaaattacaagtctgcattcactcaatgctttcttgctgccaattaagactgtaggtgtacagggtgactgtcgttcttacagttatgtgtgtggaatctcaagtaaagatgaacctgactgggaatctcttattttccttgccagacttatacctcgaatgtgtcataacattaacagagttgtctatatctttggtccaccagttaaagagcctcctacagatgttactccaacttttttgacaacaggagtgctcagtactttacgccaagctgattttgaggcccataacattctcagggagtctgggtttgctgggaaaatcagccagatgccagtgattttgacccctttacatttcgatagagatccacttcagaagcagccttcatgccagaggtctgtggttattcgaacctttattactagtgacttcatgactggtgtacctgcaacacctggcaatgagattcctgtagaggtggtgctaaagatggtcactgagataaagaagattcctggaatttctagaattatgtatgacctaacttcaaagcccccgggaaccactgagtgggagtaa

SEQ ID NO: 78720 - protein, 816 aa, Mus musculus
MNEKAFRTDYSKSQPLGYSIFGLVEAAFRLLQLIHYHGEKMFLMDKLCPNCRKKSPLMIRFREAGPVRGGRAEAGGRACARFCVLRPLLGSGLLLFFTLLPVPVLSLWRPGLASSLHPRRWSPMALCNGDSKPENAGGDLKDGSHHYEGAVVILDAGAQYGKVIDRRVRELFVQSEIFPLETPAFAIKEQGFRAIIISGGPNSVYAEDAPWFDPAIFTIGKPILGICYGMQMMNKVFGGTVHKKSVREDGVFNISMDNTCSLFRGLQKEEIVLLTHGDSVDKVADGFKVVARSGNIVAGIANESKKLYGVQFHPEVGLTENGKVILKNFLYDIAGCSGNFTVQNRELECIREIKEKVGTSKVLVLLSGGVDSTVCTALLNRALNQDQVIAVHIDNGFMRKRESQSVEEALKKLGIQVKVINAAHSFYNGTTTLPISDEDRTPRKRISKTLNMTTSPEEKRKIIGDTFVKIANEVIGEMSLKPEEVFLAQGTLRPDLIESASLVASGKAELIKTHHNDTELIRKLREEGKVIEPLKDFHKDEVRILGRELDLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNINRVVYIFGPPVKEPPTDVTPTFLTTGVLSTLRQADFEAHNILRESGFAGKISQMPVILTPLHFDRDPLQKQPSCQRSVVIRTFITSDFMTGVPATPGNEIPVEVVLKMVTEIKKIPGISRIMYDLTSKPPGTTEWE

SEQ ID NO: 78721 - DNA, 1899 bp, Rattus norvegicus
  CDS (1)..(1899)
atggccctgtgcaacggagattccaagccggagaatgctggaggagaccttaaggatggttgtcaccactacgaaggagctgttgtcattctggatgctggggctcagtatggaaaagtcattgaccgaagagtgcgggagctctttgtacagtctgaaatctttcccttggaaacaccagcttttgccataaaggaacaaggatttcgggctattatcatatctggaggacctaattctgtgtatgcagaggatgctccctggtttgatccagcaatatttaccattggcaagcctgtcctaggaatttgctatggaatgcagatgatgaataaggtttttggaggcactgtgcataaaaaaagtgttagagaggatggcgttttcaacattagtatggacaatacatgttcattgttcaggggcctgcagaaggaagaaattgttttacttacacatggagacagtgtagacaaagtagctgatggattcaaggttgtagctcgttctgggaacattgttgcaggtatagccaatgaatctaagaagctatatggtgtacagttccaccctgaagttggccttacagaaaatggaaaagtaatactgaagaatttcctatatgatatagctggatgcagtgggaactttactgtgcagaaccgagaacttgagtgcattcgagagattaaagagaaagtaggaacgtcaaaagtgttggttttactcagtggtggtgtagattcaactgtttgtactgctttgctaaatcgtgctttgaaccaagatcaagtcattgctgtacacattgataatggctttatgagaaaacgagaaagccagtctgttgaagaggccctcaaaaagcttggaattcaggtcaaagtgataaatgctgctcattccttctataatggaacaactactctgccaatatcagatgaagacaggaccccacggaaaagaattagcaaaacattaaatatgacaacaagtcctgaggagaaaagaaaaattattggtgatacttttgttaagattgccaatgaagtcattggagaaatgagtctgaagccagaggaggggaaagtaatagaacctctgaaagattttcataaagatgaagttaggattttaggcagagagcttgacctgccagaagaattggtttccaggcatccttttccagactttcgtgaaaacaaccatattttgaaaacagtagctgatcttcatgcaaatattaagaagcctcatacactgttacaaagagtcaaagcttgcacaacagaagaggaccaggagaaactcatggaaattacaagtcagcattcattgaatgctttcttgctgccaattaagactgtgggtgtgcagggtgactgtcgttcttatagttatgtgtgtggaatctccagtaaagatgaacctgactgggaatctcttattttccttgccagacttatacctcgaatgtgtcataacattaacagagttgtctatatctttggcccaccagttaaagaacctcctacagatgttactccaacatttttgacaacaggggtgctcagtactttacgccaagctgattttgaggcccataacattctccgggagtctgggtatgctgggaaaatcagccagatgccagtgattttgaccccattacatttcgatcgagatccacttcagaagcagccttcatgccagaggtctgtggttattcgaacctttattactagtgacttcatgactggagtacctgcaacacctggcaatgaaattcctgtagaggtggtgctaaagatggtcactgagataaagaagattcctggaatttctagaattatgtatgacctaacgtcaaagcccccgggaaccactgagtgggagtaa

SEQ ID NO: 78722 - protein, 632 aa, Rattus norvegicus
MALCNGDSKPENAGGDLKDGCHHYEGAVVILDAGAQYGKVIDRRVRELFVQSEIFPLETPAFAIKEQGFRAIIISGGPNSVYAEDAPWFDPAIFTIGKPVLGICYGMQMMNKVFGGTVHKKSVREDGVFNISMDNTCSLFRGLQKEEIVLLTHGDSVDKVADGFKVVARSGNIVAGIANESKKLYGVQFHPEVGLTENGKVILKNFLYDIAGCSGNFTVQNRELECIREIKEKVGTSKVLVLLSGGVDSTVCTALLNRALNQDQVIAVHIDNGFMRKRESQSVEEALKKLGIQVKVINAAHSFYNGTTTLPISDEDRTPRKRISKTLNMTTSPEEKRKIIGDTFVKIANEVIGEMSLKPEEGKVIEPLKDFHKDEVRILGRELDLPEELVSRHPFPDFRENNHILKTVADLHANIKKPHTLLQRVKACTTEEDQEKLMEITSQHSLNAFLLPIKTVGVQGDCRSYSYVCGISSKDEPDWESLIFLARLIPRMCHNINRVVYIFGPPVKEPPTDVTPTFLTTGVLSTLRQADFEAHNILRESGYAGKISQMPVILTPLHFDRDPLQKQPSCQRSVVIRTFITSDFMTGVPATPGNEIPVEVVLKMVTEIKKIPGISRIMYDLTSKPPGTTEWE

SEQ ID NO: 78723 - DNA, 2175 bp, Anopheles gambiae str. PEST
  CDS (1)..(2175)
ttgaacaaatccactggcctaacggagaatggagggttacataatgaccgcgtggcaatactggacgccggatcacagtacgggaaggtaatcgaccgaaaggtgcgcgaactcaatgtaaaatcagatattttacctctggaaacatctgccttaaaactcaaagaactcggctaccgagcagttgttatatccggtggacccaactctgtctacgccgaggatgcgccaaagtatgatcccgatatttttaagttaggcttaccgatactaggtatttgctatggaatgcaaattatcaacaaagagtttgatggaaccgtacagaaaaaggacatccgcgaagacggcgaacatgcgatagaggttgaagaaagctgtccattgttcaaacgcatgcagcgttcacagaaggttttgctcactcacggcgatagtatcgatcgagtaggaagcaagctgaaggtgggagcttattcctcaaaccgcatcgttgccgcggtttacaacgaacaactgcgtatttacggtgtgcagtttcatccggaggttgacctaaccgtgaacggcaaacagatgctctctaatttcctgatggacattgcgggtatgcagccgaactttacgatgcgtaatcgcgaagaagaatgcattgcgtacattagggagcatgtgggtaacagtaaggtgttgctgctggtaagtggtggtgtggattctactgtttgtgcagcattgctaagacatgccttaaaaccggatcaagtcattgccgttcacatcgataatggttttatgcgcctgaatgagagtgcgaatgtggaaaaatcgttgcgtgagctgggggtcgatttgttcgtaaagaatgcgatctacaagttcatgaagggtacgaccacaatcaaacttcccggttccttatataatcaggacacacagatgctgtgccagacgatcagtccggaggacaagcgcaagattattggcgatgtttttgtgaaggtgtccaacgacgtgctgcgcgagatgaatctgaacgcggacgaagtgtacttggcccagggtacccttcggcccgaccttatcgaatccgcctccacgttggttagcgcgaaagccgacacgatcaagacgcatcacaatgatacagaactgatacggaagctgcgggaggcagggcgtgtgattgagccgttacgagactttcacaaggatgaagtgcgacaattaggctactcgctgggactgccggctcatttggtcgagcggcatcccttccccggtcccgggctagccatccgagtgctctgtgctgaggaagcattcatgaaagactattcagagacgcaagtcatcgttaaagtgatagtggactataaaaataagcttgagaaaaatcacgccctgttgaaccgtgtttccggaacaaccaccaaggaagatcaacagcagctttgccgtatatctagtaacatcaaattgaatgctactctactgccaataagaagcgtaggggttcaaggcgataaacgatcttacagctacgcggtgggtctctcgagcaaagatgttccaaattggcaagacatgctcttcctagccaagctaataccgcgtattctgcacaatgtgaatagagtatgctatatctttggggatgtggtccagtatccggtgcaggacataacccacacactccttacagaaagcgtcgtttgtcagttacgtcaagccgatagcatcgttaataaggtagttgaagatatacgtttttcgagcataaatctaaaaatgatctttgatatgctattttcagattttgatggaacatgtatgcgtaaaatttctcaaatgcctgtcatcctgataccaattcactttgatcgagatccggcgcaaaaaaccccatcctgcatgcgatcggtagtgttgcgacctttcgttacaaacgatttcatgaccggtgtgccagcgattcccggaaccgataggttaccgacaaatgtgattcgaaaggtaatcttaagcgaaaatgtgtttattgattactgcgttttcgaactgttgctacaggtactacaaaaaatggtagatgaattgtccaacatgccgggaatctctcgagtactgctagacctgacgtcgaaaccaccagggacaaccgagtgggaatga

SEQ ID NO: 78724 - protein, 724 aa, Anopheles gambiae str. PEST
LNKSTGLTENGGLHNDRVAILDAGSQYGKVIDRKVRELNVKSDILPLETSALKLKELGYRAVVISGGPNSVYAEDAPKYDPDIFKLGLPILGICYGMQIINKEFDGTVQKKDIREDGEHAIEVEESCPLFKRMQRSQKVLLTHGDSIDRVGSKLKVGAYSSNRIVAAVYNEQLRIYGVQFHPEVDLTVNGKQMLSNFLMDIAGMQPNFTMRNREEECIAYIREHVGNSKVLLLVSGGVDSTVCAALLRHALKPDQVIAVHIDNGFMRLNESANVEKSLRELGVDLFVKNAIYKFMKGTTTIKLPGSLYNQDTQMLCQTISPEDKRKIIGDVFVKVSNDVLREMNLNADEVYLAQGTLRPDLIESASTLVSAKADTIKTHHNDTELIRKLREAGRVIEPLRDFHKDEVRQLGYSLGLPAHLVERHPFPGPGLAIRVLCAEEAFMKDYSETQVIVKVIVDYKNKLEKNHALLNRVSGTTTKEDQQQLCRISSNIKLNATLLPIRSVGVQGDKRSYSYAVGLSSKDVPNWQDMLFLAKLIPRILHNVNRVCYIFGDVVQYPVQDITHTLLTESVVCQLRQADSIVNKVVEDIRFSSINLKMIFDMLFSDFDGTCMRKISQMPVILIPIHFDRDPAQKTPSCMRSVVLRPFVTNDFMTGVPAIPGTDRLPTNVIRKVILSENVFIDYCVFELLLQVLQKMVDELSNMPGISRVLLDLTSKPPGTTEWE

SEQ ID NO: 78725 - DNA, 1590 bp, Neurospora crassa
  CDS (1)..(1590)
atggctgccgctaccctcggagaggtgcctaccaaggccttcgataccatcctgaccttggatttcgggatcacccgtcgtatgagagagctcaacattctctctgagatgctgccatgcaccaccaagattgccgatcttgactacaagcccaagggtgtcattctctccggcggcccctactccgtctatgaggacggtgctcctcacgtcgaccctgccgtgttcgagcttgatggcatgcaggagatcgcctggcgcgccagccccgagaacgtcattgccggcgttcaccgcgagtacggccactccaacctgaaggccctcaagggcgacgacgctcacgtcgaccgcctcttcgccggtctcgaggactccatgcgcgtgtggatgtcgcacggtgacaagctcggcgccctgcccgagggcttccacacggtcgctgtgtccgacaactccgagtacgccgccatcgcgcacaagaccaagcccatctacggtcttcagttccaccccgaggtcacccactcgcagaacggcacccagctgctcaagaactttgccgtcgacatctgtggctgcgcccagaactggaccatggcgcgcttcctcgaccaggaaatcgcccgtatccgcgacctcgtcggccccgagggccaagtcctcggtgccgtctcgggcggtgtcgactccaccgtcgccgccaagctgatgaaggaggccatcggtgaccgcttctgggccgtgctcgtcaacaacggcgtcatgcgcctggacgagtgcgagcaggtcgagcgcgatctcaagcagcacctgggcatcaacctgaccgtcatcgacgcctccaaggacttcctcgagggcctcaagggtctccacgaccccgagcagaagcgcaagttcatcggcggcaagttcattgacgtgttcgaggccgaggcccagaagatcgaggaggccgccgccaagtccggcaagggcaccaagatcggcttcttccttcagggtaccctgtacccggacgtcatcgagtcgctctccttcaagggcccctcggccaccatcaagacccaccacaacgtcggcggtctgcccgagcgcatgaccaacggccagggtctccagctcatcgagccgctccgctccctgtacaaggacgaagtccgcgagctcggccgcactctgggcatccacgaggaactcgtcatgcgccaccccttccccggtcctggcattgccgtccgcattttgggcgaggtgacggaggagaaggtgcgcattgctcgccaggccgatcatatcttcatttccgagatccgcaaggccggtctgtacgaccagatctcgcaggcgtacgcggcggttgaccctagccgtgctgtgggtgtcatgggcgacaagcgcgtctatggctacattatcattctgcgcgccgtgacgaccacggacttcatgacggctgaggccttcaacttcccgtgggacttcctccagcgcgtcatgaacaggatcgtcaacgaggtcaacggtgtgtgcagagtcacttatgacattaccagcaagcctcctggcactattgagcttgagtaa

SEQ ID NO: 78726 - protein, 529 aa, Neurospora crassa
MAAATLGEVPTKAFDTILTLDFGITRRMRELNILSEMLPCTTKIADLDYKPKGVILSGGPYSVYEDGAPHVDPAVFELDGMQEIAWRASPENVIAGVHREYGHSNLKALKGDDAHVDRLFAGLEDSMRVWMSHGDKLGALPEGFHTVAVSDNSEYAAIAHKTKPIYGLQFHPEVTHSQNGTQLLKNFAVDICGCAQNWTMARFLDQEIARIRDLVGPEGQVLGAVSGGVDSTVAAKLMKEAIGDRFWAVLVNNGVMRLDECEQVERDLKQHLGINLTVIDASKDFLEGLKGLHDPEQKRKFIGGKFIDVFEAEAQKIEEAAAKSGKGTKIGFFLQGTLYPDVIESLSFKGPSATIKTHHNVGGLPERMTNGQGLQLIEPLRSLYKDEVRELGRTLGIHEELVMRHPFPGPGIAVRILGEVTEEKVRIARQADHIFISEIRKAGLYDQISQAYAAVDPSRAVGVMGDKRVYGYIIILRAVTTTDFMTAEAFNFPWDFLQRVMNRIVNEVNGVCRVTYDITSKPPGTIELE

SEQ ID NO: 78727 - DNA, 1632 bp, Magnaporthe grisea 70-15
  CDS (1)..(1632)
atgtcttcaacaactgagcaggcggcggcgcctcaccaaacatacgacaccatcctcactcttgactttggctcacaatacacccacctcatcacgaggaggttaagagaatgcaatgtctacagtgaaatgctgccatgcacaaccaagctctcagacttgacatggaagcccaagggtatcatcctgtcgggcggcccttactccgtctacgacaaggacgccccgcacgccgacccggctttctttgacctcggagtccccgtcctgggcatctgctatggtctccaggagctcgcttggcgtctgggcaaggacaacgtcgtggccggcactgagcgcgagtacggccacgccgacctcaccccgcagaagaacagccaggctgagaagctgttcaagggcatgggagacgactctctccaggtttggatgagccacggcgacaagctcagtcagctacccaccggattccagaccattgcgaccaccgcaaactcgccatttgctgccatcgcccacgagtcccagaacatctttggtgtgcagttccacccagaggtgactcacacccgccgcggcctggatctgctgcgcaactttgccgtcggtatctgcggcgcccaacagaactggaacatgcacaacttcatcgaacaagagatttcccgcatccgaaatctgatcggcgacaaggctcaggttattggtgccgtgtcgggtggtgttgactctactgttgccgccaagctgatgaaggaggcaattggcgacaggttccacgccgtacttgtggaccagggtgtcatgcgccacaatgagtgtgccgaggtcaagaaggcactccaagaccacctcggaatcaaccttacggttgcagatgcctcggagcggttcctttcgggcctgaagggcgttgaggacccggagcagaagcgcaagttcatcggcaacaccttcatcgacatcttcgaggaggaggccatcaagatcgagaaggcggccgagaacacgcccaacgccggtaaggtcgagtggttcttgcagggcaccctgtaccccgacgtcatcgagtccatctcattcaagggcccgtctgccaccatcaagactcaccacaacgttggtggtcttcccaagaggatgatggagggccagggcctcaggctgatcgagcccctgagggagcttttcaaggacgaggtccgtgccatgggccgcgagcttaagattaacgaggagctcgtcatgaggcaccctttccccggccctggcattgccattcgtatcctgggagaggttacccgcgagcgtgttgagatcgcccgcaaggccgaccatgtttttattagcatgatcaaggaggctggcatctacaacgaaatcagccaggcgtatgccgcgcttgacacgagcagggcagttggtgtcatgggcgacaaacgcgagtacggatacattgtcattctccgtgcggttgtcaccaccgacttcatgactgccaccgtctaccacatgaagccggagcttcttgacaggatctcgacccgtatcgtcaacgaggtcgacggtgtgacttgcgtgacgtacaacatcaccagcaagcctcctggaacgatcgagatgcagtga

SEQ ID NO: 78728 - protein, 543 aa, Magnaporthe grisea 70-15
MSSTTEQAAAPHQTYDTILTLDFGSQYTHLITRRLRECNVYSEMLPCTTKLSDLTWKPKGIILSGGPYSVYDKDAPHADPAFFDLGVPVLGICYGLQELAWRLGKDNVVAGTEREYGHADLTPQKNSQAEKLFKGMGDDSLQVWMSHGDKLSQLPTGFQTIATTANSPFAAIAHESQNIFGVQFHPEVTHTRRGLDLLRNFAVGICGAQQNWNMHNFIEQEISRIRNLIGDKAQVIGAVSGGVDSTVAAKLMKEAIGDRFHAVLVDQGVMRHNECAEVKKALQDHLGINLTVADASERFLSGLKGVEDPEQKRKFIGNTFIDIFEEEAIKIEKAAENTPNAGKVEWFLQGTLYPDVIESISFKGPSATIKTHHNVGGLPKRMMEGQGLRLIEPLRELFKDEVRAMGRELKINEELVMRHPFPGPGIAIRILGEVTRERVEIARKADHVFISMIKEAGIYNEISQAYAALDTSRAVGVMGDKREYGYIVILRAVVTTDFMTATVYHMKPELLDRISTRIVNEVDGVTCVTYNITSKPPGTIEMQ

SEQ ID NO: 78729 - DNA, 1569 bp, Gibberella zeae PH-1
  CDS (1)..(1569)
atgagcgacgcctttgaaaccgcggccccgccgcatgccacctacgacctcatcttgagacgactacgatctctgggtgtctactctgagatgcttccctgcacccaaaagattaaggatctgggctggaagccagttggtgtcattctcagcggaggtccttcaagtgtctacgccgatgatgcccccggcgtggaccccctcgtgtttgagctcggtgttcctgttttgggagtctgttatggcaaccaattgattgcttggagggcaaaccccaaaagtgtggctcgaggagtcaaccgtgagtacggtgagacccagatggccatccacaagattggcacccatggtgatcgacttttcgagggattgggagactctttgatcgtcgtcatgagcgatttcgacaaggtcgtccagctgcccgatggcttccagaccattgctaccaccaagaacagcgagtttgctggtatcgcccacgagactcagcctattttcggcatccaatttcaccccgagatctctcacaccgagaagggaactgacatcatcgccaacttcgccaccaagatctgcggagcccgacctgactggaagatggacgacttctcagcccgtgaaatcaagcgcattcgggagctcgttggcgataaggcccaagttattggcgccgtcagtggcggagtggacagcaccgttgctgctaagctcatgaaggaggctatcggagaccgattccatgctatcttggttgaccagggtctcatgcgcttgaacgacacctgggcattaacctcactggttgtcgacggatccgagctcttccttggccgtcttgctggtgtcactgagcctgaggccaagcgaaagatcattggaggaaccttcattgatctctttgagattgaggcgctccgcatcgagaaggaggctgagaacacagaccgtgctggcaaggtcgagtggttccttcagggaacactctatgccgatatcgtggaaagcttgagtttcaagggagccgccagctccaccatcaagtctcaccacaacgctggaggacttcccgctcgcatgcaaaatggcgaggcccaattgaagctccttgagcctctccgagaacttttcaaggacgaagtgcgagcattcggacgtcaactgggtatccacgaggagctcattggccgacaccccttccctggccctggtctgggtatccgaattatcggcgaggtcacccctgagcgagttgagattgttcgcaaggccgatcacatcttcatctccatgatccgtgaggccggaatctacgacgaggtcacccaagcctacgctgctcttgactccagccgagcggttggtgtccagggcgatgcccgagtctacggctacatctgcattctgcgtgccgtgaccagcttggacatgatgagcgccgagccctacgagttcacatggagcctcatgaaggctatcagcaggaggatcgtgaacgaggttgacggcatcgcaagagtcgtctatgacactacctccaagcctcctggcaccattgagttggagtaa

SEQ ID NO: 78730 - protein, 522 aa, Gibberella zeae PH-1
MSDAFETAAPPHATYDLILRRLRSLGVYSEMLPCTQKIKDLGWKPVGVILSGGPSSVYADDAPGVDPLVFELGVPVLGVCYGNQLIAWRANPKSVARGVNREYGETQMAIHKIGTHGDRLFEGLGDSLIVVMSDFDKVVQLPDGFQTIATTKNSEFAGIAHETQPIFGIQFHPEISHTEKGTDIIANFATKICGARPDWKMDDFSAREIKRIRELVGDKAQVIGAVSGGVDSTVAAKLMKEAIGDRFHAILVDQGLMRLNDTWALTSLVVDGSELFLGRLAGVTEPEAKRKIIGGTFIDLFEIEALRIEKEAENTDRAGKVEWFLQGTLYADIVESLSFKGAASSTIKSHHNAGGLPARMQNGEAQLKLLEPLRELFKDEVRAFGRQLGIHEELIGRHPFPGPGLGIRIIGEVTPERVEIVRKADHIFISMIREAGIYDEVTQAYAALDSSRAVGVQGDARVYGYICILRAVTSLDMMSAEPYEFTWSLMKAISRRIVNEVDGIARVVYDTTSKPPGTIELE

SEQ ID NO: 78731 - DNA, 2148 bp, Apis mellifera
  CDS (1)..(2148)
atggaaaaaagcgcggacggattattgtttcgcgcagagagaaataatggggctaatgaaggaaccttgggcataccatgtgttaatgaaaaagtggctattttggatgcaggggcacaatatggtaaagtgatagatcgaaaaatccgtgaattaaatgtgcatagtgaaattctgcctttggacacatctgcatttacccttcaagaaaagggttataaagctattataatttctggagggccaagttcagtttatgcagaagatgcacctaaatatgatgcagacatcttcagaataggaattccagtactaggtatttgttatggaatgcaaatgatgaataaagaatttggtggtacagtgataagtaaagagggtagagaagatggtcagttcccaattgaaatagattccaagtgcttattatttaagggtttggaaaaagaacaaatggtactgttaacacatggagacagtatagatagggtagctgataattttcatattactgccagatcatcaaactttatagcaggaatagcaagtgataaaatgaatttgtatggagtacaatttcatccagaagtagatcttacacctaatgggaaaacaatgttacataattttttgtttggcattgctggccttaccggtaattatactcttcgtggccgggaagctcaatgtattcaattcatcagagatacagttggcaacaaaaaagttttgttattagtgagcggaggtgtggattctacggtatgtgcagcgctattacataaagctttaaataaggaacaagtcatagctcttcatatcaataatggctttatgcgaaaaggagaaacgcaatttgtggaacaaagcttggcgcaattaggaattcgattaagagtcgttaatgccggacgctgctttatgcaaggaactacgtctgttcccttggataatgtcacaccagtagccaatgcaaatactataaataataaaggaatatatggaacagcaactagcccaagaactagattaactaaaatgttgtgtgcaacaactaatccagaagaaaaacgaaaaatcataggagatgtttttgtcagagtagctaatgaagcaatggcagagatgggtttgaaaccagaagaagtgtttcttggacaaggcactctcaggcctgatcttatagaaagtgcgagtgcattagctagtggtaaagcggatgcgataaaaacgcatcacaatgatagtgaactcgttagagcattaagagcacaaggtcatgtagtagaacctttaaaagatttccataaagatgaagtacgacaattaggatgtgatcttggattaccagcatcgctagtagctcgtcatccatttcctggtcctggacttgctgtacgcattttatgtgcagatgaaccttatatggataaagatttttcagaaacccaggtgatagttaaaataatggctgaatatgaacaaatgcttcaaaagaaacacggattgttaaatcgtgtagaaggtgcaactagcgaatctgaacgccagtatttgcgacagctttccagttatcgacatatttcggcaacacttttgcctatacgcagtgtaggagtgcagggtgatcgaagaagttatagttatgtagtaggattatctagcgaagaaaacttatccgagggaatagaatggaaggatctcttgttccttgcaaaattaattccacgagtgtgtcacaatgtaaatcgtgtgtgcttcatttttggacctcaattacatcatcctgtaacggatatcacaccgactcatcttacatcgaatgtgatagctacgcttcgacaggcagatcatgtagcaaatctagtattagctactagtggctgtatgggagcgatcagtcaaatgccagtagttttaattcccatacatttcgatcgtgatgctgcttctcgaataccttcatgtcaacgttcagttgttcttaggccattcgttactaatgattttatgactggtactccggctattcctggaaaggagttgccactccacaaattggtaaccgaaatatcttcaacattcggtatctcgcgtgttttatacgacttaacatctaaaccgccaggaactaccgaatgggagtag

SEQ ID NO: 78732 - protein, 715 aa, Apis mellifera
MEKSADGLLFRAERNNGANEGTLGIPCVNEKVAILDAGAQYGKVIDRKIRELNVHSEILPLDTSAFTLQEKGYKAIIISGGPSSVYAEDAPKYDADIFRIGIPVLGICYGMQMMNKEFGGTVISKEGREDGQFPIEIDSKCLLFKGLEKEQMVLLTHGDSIDRVADNFHITARSSNFIAGIASDKMNLYGVQFHPEVDLTPNGKTMLHNFLFGIAGLTGNYTLRGREAQCIQFIRDTVGNKKVLLLVSGGVDSTVCAALLHKALNKEQVIALHINNGFMRKGETQFVEQSLAQLGIRLRVVNAGRCFMQGTTSVPLDNVTPVANANTINNKGIYGTATSPRTRLTKMLCATTNPEEKRKIIGDVFVRVANEAMAEMGLKPEEVFLGQGTLRPDLIESASALASGKADAIKTHHNDSELVRALRAQGHVVEPLKDFHKDEVRQLGCDLGLPASLVARHPFPGPGLAVRILCADEPYMDKDFSETQVIVKIMAEYEQMLQKKHGLLNRVEGATSESERQYLRQLSSYRHISATLLPIRSVGVQGDRRSYSYVVGLSSEENLSEGIEWKDLLFLAKLIPRVCHNVNRVCFIFGPQLHHPVTDITPTHLTSNVIATLRQADHVANLVLATSGCMGAISQMPVVLIPIHFDRDAASRIPSCQRSVVLRPFVTNDFMTGTPAIPGKELPLHKLVTEISSTFGISRVLYDLTSKPPGTTEWE

SEQ ID NO: 78733 - DNA, 1632 bp, Ustilago maydis 521
  CDS (1)..(1632)
atgaccgaggccattcactcgcagtacgattcgattctcatccttgatttcggctcgcagtactcgcacctcatcacacgacgatgccgtgaactcaacgtctactgtgagatgcttccatgcactcaaaagatcaaggatctcgattggaagcccaagggcatcattctctccggttcgccctactcggtctacgatgaggtagctccacgcgttgacccggatgtcttcaccgccggtgttcccgtgcttggaatctgttacggcctgcaagagattgcttggaaccacggtgggaaagtcgatcctcacgacaagcgcgagtacggccacgcgatggtcgaggtcgtcaagcacggcgtgccgcatctcgatgctcttttcaaaaactgggagggcagtgttcaggtatggatgtcgcacggagaccagctctccaaggctcctgaggactttgtggtgatcgcaaagacgcccaccgctccgtttgctgctatggctcacaagagcaagcccatctacggtgttcagtttcacccggaagtcacccactcgttgcgtggtgtcgagctgttcgatagctttgtcgacatctgcgcctgccgacgcgactggactatggaaacgtttatcgacaaggagatcaagcgtatccgcgagatcgtcggtcccaagggtcaggttcttggtgccatctcgggtggtgtcgattcttcggtcgctgctaagctcatgcacgaagccatcggtgaccgcttccatgccgtcatggtcgacaatggtgtgctgcgaaccaatgaggccgcccaggtctacgaaatgctctccaaggacctcggtgtcaacctgaccgtcgtcgacgcatccgaacaattcctgtccaggctgaaagacgtcgaagaccccgagcaaaagcgaaagatcatcggcaacactttcatccacgtcttcgaagccgaggtcgccaagctcgagaagcaagctgaagacgaagaggcagcagcgttggcggctggaaagccgcaggaggccaagggcaagttcgagtatctgctccaaggaaccttgtacccggatgtgatcgagagtatctcattcaagggtccttcggccaccatcaagacgcaccacaacgtcggaggattgttggaggacatgaagttgaagctcatcgagcctctgcgcgagctcttcaaggatgaggtgcgtgcgttgggcaagctgctggggattccggcccatctggttggacgacatcctttccctggacctggcttggccatccgcattttgggaccagtgacccgcgaacaggtcaagattcttcagcacgccgacagcatctacattgacgagattcgagcagcgggcttgtacgatcagatttcgcaggcgttcgccgtcttgttgcctgtcagggcggtcggtgttcagggagacaagaggacctatgaccaggtgatcgcacttcgtgcggcagctaccaccgatttcatgacggccacttggtaccccttccccgccgagttcttgtccaaggtcagcaacaggatcaccaacgaagtgcagggcgtcaacagggtcgttctggatatctcgagcaagcctcctgctacgatcgagtggttgtag

SEQ ID NO: 78734 - protein, 543 aa, Ustilago maydis 521
MTEAIHSQYDSILILDFGSQYSHLITRRCRELNVYCEMLPCTQKIKDLDWKPKGIILSGSPYSVYDEVAPRVDPDVFTAGVPVLGICYGLQEIAWNHGGKVDPHDKREYGHAMVEVVKHGVPHLDALFKNWEGSVQVWMSHGDQLSKAPEDFVVIAKTPTAPFAAMAHKSKPIYGVQFHPEVTHSLRGVELFDSFVDICACRRDWTMETFIDKEIKRIREIVGPKGQVLGAISGGVDSSVAAKLMHEAIGDRFHAVMVDNGVLRTNEAAQVYEMLSKDLGVNLTVVDASEQFLSRLKDVEDPEQKRKIIGNTFIHVFEAEVAKLEKQAEDEEAAALAAGKPQEAKGKFEYLLQGTLYPDVIESISFKGPSATIKTHHNVGGLLEDMKLKLIEPLRELFKDEVRALGKLLGIPAHLVGRHPFPGPGLAIRILGPVTREQVKILQHADSIYIDEIRAAGLYDQISQAFAVLLPVRAVGVQGDKRTYDQVIALRAAATTDFMTATWYPFPAEFLSKVSNRITNEVQGVNRVVLDISSKPPATIEWL

SEQ ID NO: 78735 - DNA, 1602 bp, Aspergillus nidulans FGSC A4
  CDS (1)..(1602)
atggccgacacaatccctcacaacaccttcgacacgattctcgtgttggacttcgggtcccaatacacccacctcatcacccgccgccttcgcgaaatcaatgtctactccgaaatgctcccgtgcacccagaaacttgccgacctaggctggaagcccaagggtatcattctttcaggcggcccatactccgtctacgaagagggtgcaccccacgccgacccggcgttcttcgagcttggcgtcccaatcctgggtatctgctacggtctccaagagctcgcccaccgcctgcacgcggataacgtcgttgccggaaccgcgagggaatacggccatgctgatctgaaggccaccaagtttggcggtcacgttgacaagctcttcgagaatattgagggcgatatgaccgtttggatgtcgcacggtgacaagctccgcaacttgcccgagggctttcacaccatcggtactacgcagaactcggagtacgcggccattgcgcacaagtcggatcctatatatggcattcagtttcacccagaggtcacacacactcctcaaggtggacagctgctgaagaacttcgctgtgggcatctgcggcgctgagcagaagtggacgatggcggaattcattggtcaggagattcagcgcattcgttctctcgttggccctgatggccaggtgctcggtgctgtcagcggcggcgtcgactcgaccgttgccgcgaagctgatgacagaggccattggcgaccgattccacgccgttctcgtcgacaacggctgcatgcgattgaacgagtgcgagaaggtccaggaggttctccaggagcagcttggaatcaacctgacggtcgttgacgccggtgagcaattcctcgctggtttgaagggcgtgcacgaccccgaacagaagcgcaagttcatcggcggcaagttcatcgacgttttcgaggatgaggcgcgcaagattgaggccaagagcaacggaaaggtcgagtggttcctccagggtaccctctatcctgacgtgattgaaagtatctctttcaagggcccctcccaaactatcaagactcaccacaacgttggcggcattgccgagcgcctcatgcgcggccacggcctcaagcttattgagcccctccgtgaactcttcaaggacgaagtccgcgagctcggccgccaactcggcatctctccggagcttgtcggtcgtcaccctttccctggcccgggcatcgccatccgtgtccttggcgaagttactcgcgaaaaagttgaaatggctcgccaggccgaccacattttcatctccatgatccgcgaagcgggcatctacgacgagatcggccaggcttatgcggcactcgatccctcccgcgccgtcggcgtcatgggcgacaagcgcgtctacgcgaacattatcctgctccgtgcaatctccacgaaggacttcatgactgccaccccgtacccattctcgtacgagttcttgtccaaggtgtcgacaagaatcgtcaatgaggttgcgggcgtttgccgcgtttgctacgattacacgagtaaaccgcctgggactatcgagatggaatag

SEQ ID NO: 78736 - protein, 533 aa, Aspergillus nidulans FGSC A4
MADTIPHNTFDTILVLDFGSQYTHLITRRLREINVYSEMLPCTQKLADLGWKPKGIILSGGPYSVYEEGAPHADPAFFELGVPILGICYGLQELAHRLHADNVVAGTAREYGHADLKATKFGGHVDKLFENIEGDMTVWMSHGDKLRNLPEGFHTIGTTQNSEYAAIAHKSDPIYGIQFHPEVTHTPQGGQLLKNFAVGICGAEQKWTMAEFIGQEIQRIRSLVGPDGQVLGAVSGGVDSTVAAKLMTEAIGDRFHAVLVDNGCMRLNECEKVQEVLQEQLGINLTVVDAGEQFLAGLKGVHDPEQKRKFIGGKFIDVFEDEARKIEAKSNGKVEWFLQGTLYPDVIESISFKGPSQTIKTHHNVGGIAERLMRGHGLKLIEPLRELFKDEVRELGRQLGISPELVGRHPFPGPGIAIRVLGEVTREKVEMARQADHIFISMIREAGIYDEIGQAYAALDPSRAVGVMGDKRVYANIILLRAISTKDFMTATPYPFSYEFLSKVSTRIVNEVAGVCRVCYDYTSKPPGTIEME

SEQ ID NO: 78737 - DNA, 1578 bp, Candida glabrata CBS138
  CDS (1)..(1578)
atgtcttcaattgaacaagttaacgaagtctttgacaccattctggtgttggatttcggttctcagtactctcatttgatcactagaagactaagagagttcaacatctatgccgagatgttgccatgcacacagaagatcgctgacttgcacttcaagccaaagggtgttatcatgtctggtggtccatactctgtgtatgccgaggatgccccacacgttgaccacgccatcttcgacctaggtgttcctatccttggtatctgctacggtatgcaggaacttgcctggatcaacggtaagcaagttgcccgtggtgagaaaagagagtacggtccagccactttgaatgtgttggacaaggaagacgctttgttcaagaacgtcgaccactctaccgtctggatgtcccacggtgacaagttgcacggtctgccaaccggtttcaaagtcatcgctacttctgacaactccccatactgtggtattgtccacgagtccaagcaaatctacggtatccaattccacccagaagtcacacactccagcaacggtaagactttgttgaagaacttcgccgttgacttgtgtcacgccaagcaaaactggaccatgaagaacttcatcggtaccgaagtgcaaagaatcagagacctagtcggcccaactgccgaagtcatcggtgctgtctctggtggtgtcgactccaccgtcgcttccaagttgatgactgaggccattggtgacagattccacgctatcttggtcgacaatggtgttctaagattgaacgaagccgccactgtcaagaagactttggttgatggtctaggtatcaacttgaccgttgttgatgctgccgacgagttcttggacaacttgaagggtgttactgacccagaaaagaagagaaagatcatcggtaacactttcattcacgtttttgaaagagaagctgaaaagatcaagccaaaggacggtaaggccatcgagttcttgttgcaaggtaccctatacccagatgtcatcgaatcaatttccttcaagggtccatcccaaaccatcaaaactcaccacaacgtcggtggtctattggaaaacatgaagttgaagttgatcgaaccattgagagaactgttcaaagatgaagtcagagaattaggtgagcttcttggtatctctcacgagcttgtctggagacacccattcccaggtccaggtatcgctatcagagttctaggtgaagtcaccagagaacaagtcgaaattgccagaaaagctgaccacatatacattgaagaaatcagaaaggctggtttgtacgacaagatctctcaagcctttgcttgtttacttccagtcaaatctgtcggtgtcatgggtgaccaaagaacttacgaacaagtcattgctttgagagctatcgaaacgactgacttcatgaccgctgattggtacccattcgaacacagcttcttgagaaaggttgcttccagaattgtgaacgaggtcgacggtgtcgctagagttacctacgatatcacttcaaagccaccagctacggttgaatgggaatag

SEQ ID NO: 78738 - protein, 525 aa, Candida glabrata CBS138
MSSIEQVNEVFDTILVLDFGSQYSHLITRRLREFNIYAEMLPCTQKIADLHFKPKGVIMSGGPYSVYAEDAPHVDHAIFDLGVPILGICYGMQELAWINGKQVARGEKREYGPATLNVLDKEDALFKNVDHSTVWMSHGDKLHGLPTGFKVIATSDNSPYCGIVHESKQIYGIQFHPEVTHSSNGKTLLKNFAVDLCHAKQNWTMKNFIGTEVQRIRDLVGPTAEVIGAVSGGVDSTVASKLMTEAIGDRFHAILVDNGVLRLNEAATVKKTLVDGLGINLTVVDAADEFLDNLKGVTDPEKKRKIIGNTFIHVFEREAEKIKPKDGKAIEFLLQGTLYPDVIESISFKGPSQTIKTHHNVGGLLENMKLKLIEPLRELFKDEVRELGELLGISHELVWRHPFPGPGIAIRVLGEVTREQVEIARKADHIYIEEIRKAGLYDKISQAFACLLPVKSVGVMGDQRTYEQVIALRAIETTDFMTADWYPFEHSFLRKVASRIVNEVDGVARVTYDITSKPPATVEWE

SEQ ID NO: 78739 - DNA, 1575 bp, Kluyveromyces lactis NRRL Y-1140
  CDS (1)..(1575)
atgtctcctgttgaagtgtccaacgtgtttgacaccatcttggtgttggatttcggttctcagtactctcatttgattaccagaagattgagagagttcaatgtgtacgccgaaatgcttccatgtactcaaaagattgccgatttgcactggaaacctaagggtgtcattctttctggtggtccatattctgtctacgagaaggatgctcctcacgttgacaaggctattttcgatttgggtgttccaattctaggtatctgttacggtttgcaagaaattgcctggattaacaataccgaagttggtcgtggtgaaaagagagaatatggcccagctactttgcgcgttgaagacaagagctgtccattatttgctaatgtcgaccactctaccgtttggatgtctcatcacgataaagttcacaacttgccagctggtttcaagatcactgctacctctgaaaactctccattctgtggtatcgctaatgaagacaagcaaatctacggtattcaattccatccagaagtcactcactccactcaaggtaagactttgttgagaaactttgctgttgatatctgtaaggctagtcaaagctggaacatggaaaacttcatcgacactgaaatcaacagaatcagagaattagttggtccggatgctgaagttattggtgctgtatctggtggtgtcgactctactgttgctgccaaattgatggacagagcaattggtgatagattccatgccattatggtcgacaacggtgtgttaagattgaacgaagctgctactgtcaaaaagactttgggtgaaggtttaggtatcaacttgactgttgtcgatgcttccgatgaattcttggacaaattgaaaggtgtcactgacccagaaaagaagagaaagatcatcggtaacacttttatccacgtcttcgaaagggaagctgcaaagatccaacctaagaacggtaaggaaatcgaattcttgttacaaggtactttgtaccctgatgtcatagaatccatttctttcaagggtccttctcaaactatcaagacccaccataacgtcggtggtttgttggagaacatgaaattaaaattgattgaaccattgagagaattgttcaaggatgaagtcagagaattgggtgaacttttgggtatctctcatgaattggtatggagacatcctttcccaggtccaggtattgctatccgtgtccttggcgaagttactagagaacaagtggccattgctagaaaggctgactatatttacatcgaagaaatcagaaaggctggtctctacaacaacatttcacaagcctttgcttgtttgttaccagtcaagtctgtcggtgttatgggtgatcaaagaacttatgaacaagtcattgcattgagagccatcgaaaccactgatttcatgactgctgattggtatccattcgaacactccttcctaaaaaaggtcgcttctagaattgtcaacgaagttgatggtgttgccagggttacttacgatatcacatcaaagcctccagctaccgtcgagtgggaataa

SEQ ID NO: 78740 - protein, 524 aa, Kluyveromyces lactis NRRL Y-1140
MSPVEVSNVFDTILVLDFGSQYSHLITRRLREFNVYAEMLPCTQKIADLHWKPKGVILSGGPYSVYEKDAPHVDKAIFDLGVPILGICYGLQEIAWINNTEVGRGEKREYGPATLRVEDKSCPLFANVDHSTVWMSHHDKVHNLPAGFKITATSENSPFCGIANEDKQIYGIQFHPEVTHSTQGKTLLRNFAVDICKASQSWNMENFIDTEINRIRELVGPDAEVIGAVSGGVDSTVAAKLMDRAIGDRFHAIMVDNGVLRLNEAATVKKTLGEGLGINLTVVDASDEFLDKLKGVTDPEKKRKIIGNTFIHVFEREAAKIQPKNGKEIEFLLQGTLYPDVIESISFKGPSQTIKTHHNVGGLLENMKLKLIEPLRELFKDEVRELGELLGISHELVWRHPFPGPGIAIRVLGEVTREQVAIARKADYIYIEEIRKAGLYNNISQAFACLLPVKSVGVMGDQRTYEQVIALRAIETTDFMTADWYPFEHSFLKKVASRIVNEVDGVARVTYDITSKPPATVEWE

SEQ ID NO: 78741 - DNA, 1590 bp, Debaryomyces hansenii CBS767
  CDS (1)..(1590)
atggttaatcctgctgacgttccaattgaagtttcgaaggttttcgacaccattttggttttggattttggttcccaatactcccatttaatcactcgtcgtttgagagaatttaatgtgtacgctgaaatgttgccatgcacccaaaagatttcagaattgacctggaaaccaaagggtatcattttgtctggaggaccatactctgtgtacgaagacggatctcctcacgttgaccacgatattttcaagttgaatgtgcctatcttgggtatatgttacggtatgcaagaattagcttggattaacggtaagggtgttgctagaggtgacaagagagagtacggtccagccactttgaatgttgaagattcatcttgttctttattcaagggcgttgatcactctcaagtctggatgtctcacggtgacaaattgcacgctttaccaactggtttcaaggttgttgctacctctgacaactctccattcgctgccatttccaacgaaaaggaaaacatttttggtattcaattccacccagaagtaacccacaccaagcaaggtaaggttttattgagaaactttgctattgacatctgtcaggcctcaaacaactggactatggaaaatttcattgatactgaaattgccagaattcaaaaattagtcggtccaactgccgaagttattggtgctgtttctggtggtgtcgactctaccgtcggtgctaagattatgaaagaagccatcggtgaccgtttccatgcgatttacgttgacaatggtttaatgagattaaatgaaactgaacaagtctacaagactttaaccgaaggtttaggtatcaatttgactgtcgttgatgctaccgatttattcttgggtaaattacagggtgttactgatccagaaaagaagagaaagatcattggtaacaacttcatccatgtttttgaagctgaagctgctaagattaagccagcatctggtcaagaaatcgaatatttattacaaggtactttatacccagatgtcattgaatccatttctttcaagggaccatctcaaactatcaagacccatcacaatgtcggtggtttgttagaagatatgaaattaaaattgattgaacctttgagagaattatttaaagatgaagttcgtcacttaggtgaaatcatgggtgttcctcacgacttagtctggagacatcctttcccaggtccaggtttagctattagagttttaggtgaagttaccagagaacaacttaagatcgctcgtgaagctgataacattttcattgaagaaattagaaaggctggtttgtacaaggacatttcccaagctttcgctgctttattacctgttaagtctgttggtgttatgggtgaccaaagaacttatgaacaagttatcgctttaagagctatcgagacaactgatttcatgactgctgattggttcgtttttgaagctgctttcttgaagaagaccgcttcaagaattgttaatgaagttgatggtgttgctcgtgtcacttacgatatcacttctaagccaccagcaactgtcgaatgggaataa

SEQ ID NO: 78742 - protein, 529 aa, Debaryomyces hansenii CBS767
MVNPADVPIEVSKVFDTILVLDFGSQYSHLITRRLREFNVYAEMLPCTQKISELTWKPKGIILSGGPYSVYEDGSPHVDHDIFKLNVPILGICYGMQELAWINGKGVARGDKREYGPATLNVEDSSCSLFKGVDHSQVWMSHGDKLHALPTGFKVVATSDNSPFAAISNEKENIFGIQFHPEVTHTKQGKVLLRNFAIDICQASNNWTMENFIDTEIARIQKLVGPTAEVIGAVSGGVDSTVGAKIMKEAIGDRFHAIYVDNGLMRLNETEQVYKTLTEGLGINLTVVDATDLFLGKLQGVTDPEKKRKIIGNNFIHVFEAEAAKIKPASGQEIEYLLQGTLYPDVIESISFKGPSQTIKTHHNVGGLLEDMKLKLIEPLRELFKDEVRHLGEIMGVPHDLVWRHPFPGPGLAIRVLGEVTREQLKIAREADNIFIEEIRKAGLYKDISQAFAALLPVKSVGVMGDQRTYEQVIALRAIETTDFMTADWFVFEAAFLKKTASRIVNEVDGVARVTYDITSKPPATVEWE

SEQ ID NO: 78743 - DNA, 1635 bp, Oryza sativa (japonica cultivar-group)
  CDS (1)..(1635)
atgggctccgcctccgcttcctcgctcccggcctccgccggcttcggcgagaacctggtcctcatcctcgacttcggctcgcagtacacccacctcatcacccgccgcgtccgccagctgggggtcctctccctctgcgtctccggcacggcgccgctcgcctcgctcgcgggcctccgcccccgcgccgtcgtcctctccggggggccccactccgtacacgcctcgggggcgcccacgttccccgaggggttcctcgagttcgccgccggcgcgggcgcccacgtcctcggcgtctgctacgggatgcagctcctcgtgcagtccctcggcggcgccgtcgaggccggcgagaagcaggagtacgggaagatggaggtggaggtaaccgcccgctcctcggcgctgtacggggagggggaggtcgggaagcgccagacggtgtggatgagccacggggatgaggtggtgaggctgccggaggggttcgaggtggtggcgcgcagcgtgcagggtgccgtcgctgccgtcgagaaccgtgagaagcgcttctatgggcttcagtatcaccctgaggtgacacattcaccccaaggaatggaaacactgcggcgcttcctttttgatgtttgtgggataaaagctgattggaagatgcaagatgtgctggatgaagaaattaggacaatccaaagcatggttgggcctgatgaacatgtgatttgtgctttatctggtggagttgattcaactgttgctgccactctggttcacaaggcaataggggatagacttcactgtgtttttgttgacaatggcctattaagatacaatgagagggaacgggtaatgttaacctttgaaagtgacttgcaccttcccgtcacatgtgttgatgcatctgagcaatttcttagcaagctaaagggtgtcaaagatccagaaatgaagagaaagataattggaagggaattcatagcagtttttgatgattttgctcacaaattagaacagaagataggaaaaagacctggatatttagttcaagggacactgtaccctgatgtgattgaatcatgcccacctcctggaagcggaaggacacattctcataccatcaaaagccatcacaatgttggtggtcttccaaaagatatgaagttaaagctaattgaaccactcaagctcttatttaaggatgaggtacggaagttggggagtattttaaatgtcccagagtcattcttgaagcgacacccatttcctgggcctggtcttgctgtacgtgtcctaggtgatgttacagaaggcaatgctttggaggttcttcgtcaggttgatgaaatatttgttcaagccattaaagatgcaggtctctatgatataatttggcaagcatttgctgtgtttttgcctgtacaaacagtgggagttcagggtgaccagagaactcactccaatgcagttgctttgagggcaattactagtgaggatggcatgactgcagattggtattattttgagcgtgagttcctggtagatgtggtcaacaagatctgcaacaatgtgcgaggtgttaaccgtgttgtccaggacatcacgcaaaagccacctgcgacagtggaatgggaatag

SEQ ID NO: 78744 - protein, 544 aa, Oryza sativa (japonica cultivar-group)
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLRYNERERVMLTFESDLHLPVTCVDASEQFLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNVRGVNRVVQDITQKPPATVEWE

SEQ ID NO: 78745 - DNA, 1584 bp, Yarrowia lipolytica CLIB99
  CDS (1)..(1584)
atgcccgccccagtgaacatcccctccatgttcgacaccattctggtgctcgatttcggctcccagtactcgcatctcatcacccggcgtctgcgagagttcaacgtctacgccgagatgctcccctgcacacagaagattgccgagcttccctggaagcccaagggcgtcattctgtctggaggcccctactctgtctacgctgagggttctcctcacgtcgaccatgccgtttttgaccttggtgtccccatcctcggtatctgttatggtatgcaggagcttgcctggatcaacggtaagggtgtccacgctggtgagaagaaggagttcggccacgccaccattcacgtcgaaaagccctccgatcctctgttccacggcattgacaacttccaggtctggatgtctcacggtgacaagctcaacgctctgcccactggctacgaagtcgttgctacctccgacaactccccttacgccggtattgctcacacctccgagaagatctggggtatccagttccaccccgaggtaactcacaccaccaagggtaagcagcttctgcagaacttcgccgtcgacatctgtggcgccgcccagaagtggtccatggagaacttcgtcgacactgagatccagcgaatccgagaccttgttggcccccacgccgaggtaattggtgccgtttccggaggtgttgactctactgttggtgccaagctcatgaaggaggccattggagaccgattccacgccatcctcgtcgacaacggtgtcatgcgactcaacgagtgtgagaacgtcaagaagaccctcggagagggtcttggcatcaacctcaatgttgtcgatgccgccgatctgttcctcggcaagctgaagggcgtcaccgaccctgagaagaagcgaaagatcattggcaacaccttcatcgaggtcttcgaggaggaggccgctaagatccagcccactcaccctgaggctggtgagattgagttcctgctccagggaaccctataccccgatgtcattgagtccatctctttcaagggcccttcccagaccatcaagacccaccacaacgtcggaggtctgctcgacaacatgaagctcaagcttatcgagcccctccgagagctgttcaaggatgaggtccgaaagctcggtgagattatgggaatccctcacgaccttgtgtggcgacaccccttccccggtcccggtattgctatccgagtgcttggagaggtcactccctcccaggtcgagattgcccgaaaggcagatttcatctacattgaggagatcaagaaggctggaatctacgaggagatctcgcaggcctttgcctgtctccttcccgtcaagtccgttggtgtcatgggtgaccagcgaacttacgaacaggtcattgctctgcgagctatcgagactgttgacttcatgacagctgactggtacattttcgatgctaacttcctcaagacagtggcccgacgaatcgtcaacgaggtccccggtgtcgcccgagtggtttacgacatcacctccaagccccctgctactgttgagtgggaataa

SEQ ID NO: 78746 - protein, 527 aa, Yarrowia lipolytica CLIB99
MPAPVNIPSMFDTILVLDFGSQYSHLITRRLREFNVYAEMLPCTQKIAELPWKPKGVILSGGPYSVYAEGSPHVDHAVFDLGVPILGICYGMQELAWINGKGVHAGEKKEFGHATIHVEKPSDPLFHGIDNFQVWMSHGDKLNALPTGYEVVATSDNSPYAGIAHTSEKIWGIQFHPEVTHTTKGKQLLQNFAVDICGAAQKWSMENFVDTEIQRIRDLVGPHAEVIGAVSGGVDSTVGAKLMKEAIGDRFHAILVDNGVMRLNECENVKKTLGEGLGINLNVVDAADLFLGKLKGVTDPEKKRKIIGNTFIEVFEEEAAKIQPTHPEAGEIEFLLQGTLYPDVIESISFKGPSQTIKTHHNVGGLLDNMKLKLIEPLRELFKDEVRKLGEIMGIPHDLVWRHPFPGPGIAIRVLGEVTPSQVEIARKADFIYIEEIKKAGIYEEISQAFACLLPVKSVGVMGDQRTYEQVIALRAIETVDFMTADWYIFDANFLKTVARRIVNEVPGVARVVYDITSKPPATVEWE

SEQ ID NO: 78747 - DNA, 2097 bp, Canis familiaris
  CDS (1)..(2097)
atggccttagaaatctcaagtatccatttctcagctcaaaaaaggctggagaatgctggaggagacctcaaggatggccaccactatgaaggagctgttgtcattctggatgctggtgcccagtacgggaaagtcatagatcgaagagtgagagaattgtttgtgaagtcggaaatctttcccttggaaacaccagcatttgccataaaagagcaaggattccgtgctattatcatctctggaggacctaattctgtgtatgcagaagatgctccctggtttgatccagcaatattcactattggcaagcccgttcttggaatttgctatggcatgcagatgatgaataaggtatttggaggtactgtacacaaaaaaagtgttagagaagatggagtcttcagtattagtgtggacaacacttgctcattgttcaggggccttcagaaggaagaaattgttttgcttacccatggagatagtgtagacaaagtagctgatggattcaaggttgtggcacgttctgggaacattgtggcaggtatagcaaatgaatctaaaaaattatatggagcacagttccaccctgaagttggccttacagaaaatgggaaagtaatactgaagaatttcctctacgatatagctgggtgcagtgggaccttcaccgtgcagaacagagaactggagtgcattcaagaggtcaaagagagagtaggcacatcaaaggttttggttttactcagtggtggagtagactcaacagtctgtacagctttgctgaatcgtgctttgagccaagatcaggtcattgctgtgcacattgataatggctttatgagaaaacgagaaagccagtctgtagaagaggccctcaaaaagcttggaattcaggtcaaagtgataaatgcggctcattctttctacaatggaacaacaactttaccaatatcagatgaagatagaactccacgaaaaagaattagcaaaacactaaatatgacaacaagtcctgaagagaaaagaaaaattattggggatacttttgttaagattgccaatgaagtaattggagaaatgaacctgaaaccagaggaagttttccttgcccaaggtactttacggcctgatttaattgaaagcgcatcccttgttgcaagtggcaaagctgaactcatcaaaacccatcacaatgacacagagcttatcagaaagttgagagaagagggaaaagtaatagaacctctgaaagattttcataaggatgaagtaagaattttaggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaagaagccgcatacactgttacaaagagtcaaagcttgtaccactgaagaggatcaggagaagctgatgcaaattacaagtttgcattcattgaatgccttcctgctgccaattaaaactgtgggggtgcagggtgactgtcgttcctacagttacgtgtgtggaatctccagtaaagatgagcctgactgggaatctcttattttcctggctagacttatacctcgcatgtgtcacaacattaacagagttgtctatatatttggcccaccagttaaagaacctcctacagatgttactcccactttcttgacaacaggggtgctcagtactttacgccaagctgactttgaggcccataacattctcagggagtctggctatgctgggaaaattagccagatgccagtgattttgaccccattgcattttgatcgggatccacttcagaagcagccttcatgccagagatctgtggttattcgaacctttattactagtgatttcatgactggtatacctgcaacacctggcaatgaaatccctgtagaggtggtgttaaagatggtcactgagattaagaagattcctggtatttctcgaattatgtatgacttaacatcaaagcccccaggaactaccgagtgggagtaa

SEQ ID NO: 78748 - protein, 698 aa, Canis familiaris
MALEISSIHFSAQKRLENAGGDLKDGHHYEGAVVILDAGAQYGKVIDRRVRELFVKSEIFPLETPAFAIKEQGFRAIIISGGPNSVYAEDAPWFDPAIFTIGKPVLGICYGMQMMNKVFGGTVHKKSVREDGVFSISVDNTCSLFRGLQKEEIVLLTHGDSVDKVADGFKVVARSGNIVAGIANESKKLYGAQFHPEVGLTENGKVILKNFLYDIAGCSGTFTVQNRELECIQEVKERVGTSKVLVLLSGGVDSTVCTALLNRALSQDQVIAVHIDNGFMRKRESQSVEEALKKLGIQVKVINAAHSFYNGTTTLPISDEDRTPRKRISKTLNMTTSPEEKRKIIGDTFVKIANEVIGEMNLKPEEVFLAQGTLRPDLIESASLVASGKAELIKTHHNDTELIRKLREEGKVIEPLKDFHKDEVRILGRELGLPEELVSRHPFPGPGLAIRVICAEEPYICKDFPETNNILKIVADFSASVKKPHTLLQRVKACTTEEDQEKLMQITSLHSLNAFLLPIKTVGVQGDCRSYSYVCGISSKDEPDWESLIFLARLIPRMCHNINRVVYIFGPPVKEPPTDVTPTFLTTGVLSTLRQADFEAHNILRESGYAGKISQMPVILTPLHFDRDPLQKQPSCQRSVVIRTFITSDFMTGIPATPGNEIPVEVVLKMVTEIKKIPGISRIMYDLTSKPPGTTEWE

SEQ ID NO: 78749 - DNA, 1635 bp, Cryptococcus neoformans var. neoformans JEC21
  CDS (1)..(1635)
atggcaacagaggagatccatagcttgtacgacaccattctcatcttggattttggatcccagtactcccacttgatcactcgacgatgccgagagctcaatgtgtactgtgaaatgttgccttgcacgcaaaagatctccgacttgtcctggaagcccaagggtgtcatcctttccggctccccttactctgtttacgccccggacgctccccacgtcgaccctgaagtcttcactctcggtgtccccatcctcggtatctgctatggtctccaggagattgcccgtgttcacggaggcaccgtcgatgctcacacccacagggagtacggttacgccaagatcgaggtcgtcaagactggcaagaaggaacaggatgcattgttcgagggtattgagatggaagcagacggtggcttgcaagtctggatgtctcacggtgaccaacttacctccctcccccccaactttgtcaccatcgcttccacccctacttccccttacactgccgtcgcccacgaatccaagcctatttacggtgtccaattccaccccgaggtctctcactcccccaagggtaaggaggtcattgctgcatttgtgaagaacgtctgtagtgtcagggacggctggagcatggagagctttatccccaaggagattgctaggattaggcaaatctgtggtgagaagggtcaggttatcggtgccgtcagcggtggtgtcgattctactgtcgccgccaagttgatgcacgaggccatcggtgaccgtttccacgctatcatggtcgacaatggtgtcctccgaaaggatgaggccaagaaagtccacaagatgcttaccgttgacctcggcgtcaatctcaccgttgttgacgcttccgaactcttccttgctcgtcttaagggtgtcgaggaccccgagcgtaagcgaaagatcatcggtaacacctttattgaggtctttgaggccgaggctgccaagcttgaggctgccgctgagaaagagcttgccgagaagggcggtgaggccaaaggcaaaatcgagtggttgctccaaggtaccttgtaccccgacgttatcgaaagtatctctttcaagggccccagtgctaccatcaagactcaccacaacgtcggtggattgctggaggacatgaagttgaagttgatcgagcctcttcgagagctctttaaggacgaagtccgtgcccttggtcgtctcctaaacatccccgagcatcttgtcggccgacaccctttccccggtcctggtctcgctattcgaattctcggtgaagtcacccgcgagcaaatcgccatcctccagcacgccgacgacatttacattgaggaagttcgtgctgctggtttgtacgaccaaatctctcaggcctttgttgccctcttgcctgtcaaggctgttggtgttgctggtgatgcgagaacatatgaccaggttgttgctgtcagggccgtctctacagaagactttatgactgccgactggtttgtgttccccccgcaagtcttgaagaggatctcctctagaattaccaacgaggtcaagggtgttaacagggtcgtctacgacattacttccaagcctcctggaactgttgaatggctctaa

SEQ ID NO: 78750 - protein, 544 aa, Cryptococcus neoformans var. neoformans JEC21
MATEEIHSLYDTILILDFGSQYSHLITRRCRELNVYCEMLPCTQKISDLSWKPKGVILSGSPYSVYAPDAPHVDPEVFTLGVPILGICYGLQEIARVHGGTVDAHTHREYGYAKIEVVKTGKKEQDALFEGIEMEADGGLQVWMSHGDQLTSLPPNFVTIASTPTSPYTAVAHESKPIYGVQFHPEVSHSPKGKEVIAAFVKNVCSVRDGWSMESFIPKEIARIRQICGEKGQVIGAVSGGVDSTVAAKLMHEAIGDRFHAIMVDNGVLRKDEAKKVHKMLTVDLGVNLTVVDASELFLARLKGVEDPERKRKIIGNTFIEVFEAEAAKLEAAAEKELAEKGGEAKGKIEWLLQGTLYPDVIESISFKGPSATIKTHHNVGGLLEDMKLKLIEPLRELFKDEVRALGRLLNIPEHLVGRHPFPGPGLAIRILGEVTREQIAILQHADDIYIEEVRAAGLYDQISQAFVALLPVKAVGVAGDARTYDQVVAVRAVSTEDFMTADWFVFPPQVLKRISSRITNEVKGVNRVVYDITSKPPGTVEWL

SEQ ID NO: 78751 - DNA, 1557 bp, Bartonella quintana str. Toulouse
  CDS (1)..(1557): transl_table=11
atgagcatatcacatccagacactgttcttatcattgattttggttcacaagttacgcaacttatcgcacggcgggtgcgagcaatgggtgtttattgtgaaattgttccttttcaattagctttagaaggtgtcaagcggctaagacctcaagctgttattttatcaggcagtccttattcagtgattgatgacggttcaccgcgtgcgccgatggaaatttttgaaattggtgttccagttcttggtatttgttatggtgaacaagtcatgtgtgttcagcttggtggaaaagttgaatcaggacatcggcgtgaatttggacgggcttttttggaggtgcaagaaaagagtgcactttttgatggtgtatgggaaaaaggttcctgttatcaagtatggatgagtcacggtgatcatgtggcagctttaccagaaggctttcgtgtaataggaacatcaaaaggcgctccctatgctgccattgctgatgaaaaaaggtgcctttatgcagtgcagtttcatcctgaagttgttcatacacccgatggtacaaaacttttgcaaaattttgttcataaaatttctggtcttaaaggcaattggtcaatggcttcttatcgtgatcaggcaattgctacgatacggaagaaagttggaaaaagtcgtgtcatctgtggtctttcaggtggtgtggattcatcagttgtggctgtacttctccatgaagcaataggagatcaactgacatgtattttggtagaccatgggttaatgcgcaaaaatgaggctgaagaagttcttaaattattccgagatcattataatatcgagcttattcacgttaatgctgctaatatttttctcaatgctttagaaggtgagacagatccagagaaaaagcgcaaaacgattggccgcctttttattgaagtttttgaagaagaaaccaaaaaaatagaaggtgtagaatttttagcacagggcacgctttatccagatgtcattgaaagtgtatcagctattggtgaatcggtaacaattaaaagccatcataatgtagggggattgccggagcggatgaacatgaaacttgtggagccgttgcgtgagctctttaaggatgaagttcgttctttggggcgagagttaggattgccggagcagtttcttggccgtcatccttttccagggcccggtcttgcaattcgttgtccaggtgcagtgacacgtgaaaaattagaaattatacgtgaagcagacgccatttaccttgatgaaatctgtaaagctggtctttatgatgaaatttggcaggcatttgttgttcttcttcctgtgcagactgtcggtgttatgggtgatggacgcacttatgaatttgtttgtgctcttcgcgcggtaacatctgtagatggaatgaccgctgatttctatccctatgatatggaatttttaagtaaaacagcagcacgtattattaacgaagtgaggggaattaatcgggttgtttatgatataacgtcaaagcctcctggtactattgaatgggaatga

SEQ ID NO: 78752 - protein, 518 aa, Bartonella quintana str. Toulouse
MSISHPDTVLIIDFGSQVTQLIARRVRAMGVYCEIVPFQLALEGVKRLRPQAVILSGSPYSVIDDGSPRAPMEIFEIGVPVLGICYGEQVMCVQLGGKVESGHRREFGRAFLEVQEKSALFDGVWEKGSCYQVWMSHGDHVAALPEGFRVIGTSKGAPYAAIADEKRCLYAVQFHPEVVHTPDGTKLLQNFVHKISGLKGNWSMASYRDQAIATIRKKVGKSRVICGLSGGVDSSVVAVLLHEAIGDQLTCILVDHGLMRKNEAEEVLKLFRDHYNIELIHVNAANIFLNALEGETDPEKKRKTIGRLFIEVFEEETKKIEGVEFLAQGTLYPDVIESVSAIGESVTIKSHHNVGGLPERMNMKLVEPLRELFKDEVRSLGRELGLPEQFLGRHPFPGPGLAIRCPGAVTREKLEIIREADAIYLDEICKAGLYDEIWQAFVVLLPVQTVGVMGDGRTYEFVCALRAVTSVDGMTADFYPYDMEFLSKTAARIINEVRGINRVVYDITSKPPGTIEWE

SEQ ID NO: 78753 - DNA, 1653 bp, Acinetobacter sp. ADP1
  CDS (1)..(1653): transl_table=11
ttgctgattgaaagaacgtgcgcgatacttggaaaaatgctagaatattgcgcttctctcgttgccttgcatagttgcgtaatcatgacaaccaatactcacattactgatgatcgtatcttaattctggatttcggatctcaatacagccagctcattgcacgtcgtgtacgtgaagcgggtgtatattctgaaatgtatgcttttgatatgtctgaagaagacattcgtgcatttaatccaaatggcattattttgtcaggtgggcctgaaagcgtgcatgaagaaggcagcccgcgtgcgccacaagtggtgtttgagcttggtgtacctgtcttagggatttgttatggttttcaaaccatgtctgagcagttgggcggaaaagttgagcctggtactgtacatgagtttggctatgccgaagtggatattcagcagcgcgaccaacttgttggaaacttgcaagatcgtgagaatcaactgcatgtctggatgagccatggcgacaaagttagtcgtttaccagaaggttttagtaccactgcaagtaccccaagctgtccattcgcagcagcatcggatgaagctcgccgtttttacggtgtgcagttccatcctgaagtcacgcatacagcgaaaggtgccgagttactggcaaactttgtgcataaaatctgtggttgtggcggtctttggacaccagaacacattatcgatttgcgtgtagaacagttacgcgcccaaattggtgacgaaaaagttttacttggcctatcgggtggtgtggattcatctgtcgttgctgcattgttgcataaagccattggtgatcagttgacttgcgtatttgtggacaatggtttgcttcgtttaaacgaaggtgaccaagtgatgcaaatgtttgctgataacatggggattcgtgtgatccgtgcagatgcagaagaacgtttcttgactgcgcttgcaggtgaagttgatcctgagaaaaaacgtaagatcattggtcgtgaatttattgaagtatttgcagaagaagcacgcaaactggatggcgtgaaattcttggcacaaggtacgatttatcctgacgtgattgaatctgctgcaagcaaacagggtaaagcacacgtgattaaatcacaccataatgtgggtggtttacctgatgatttagaatttgaattggttgagccattacgtgatttattcaaagatgaagtgcgtaaattgggtaccacactcggcttgccgcacagcatgatttaccgtcatccgttcccaggtccaggtttgggcgtgcgtattttgggtgaagtgaaaaaagaatatgcagatattcttcgccttgccgatgacatctttatgcaagagcttcgcgcaagtggttggtatgacaaaactgcgcaagcctttgcagtattccaacctgtaaaatctgtgggtgtggtcggtgatggtcgtcgttatgcatgggtgatcgcacttcgtgcagttgagactgttgactttatgacagcgcgtttcgctcacttgccatacgagttggtggataaaatctcaacccgtatcatgaatgaaatcaaagatgtttcacgtgttgtgtatgacgtgtcatctaagccaccagcaacgattgagtgggagtaa

SEQ ID NO: 78754 - protein, 550 aa, Acinetobacter sp. ADP1
MLIERTCAILGKMLEYCASLVALHSCVIMTTNTHITDDRILILDFGSQYSQLIARRVREAGVYSEMYAFDMSEEDIRAFNPNGIILSGGPESVHEEGSPRAPQVVFELGVPVLGICYGFQTMSEQLGGKVEPGTVHEFGYAEVDIQQRDQLVGNLQDRENQLHVWMSHGDKVSRLPEGFSTTASTPSCPFAAASDEARRFYGVQFHPEVTHTAKGAELLANFVHKICGCGGLWTPEHIIDLRVEQLRAQIGDEKVLLGLSGGVDSSVVAALLHKAIGDQLTCVFVDNGLLRLNEGDQVMQMFADNMGIRVIRADAEERFLTALAGEVDPEKKRKIIGREFIEVFAEEARKLDGVKFLAQGTIYPDVIESAASKQGKAHVIKSHHNVGGLPDDLEFELVEPLRDLFKDEVRKLGTTLGLPHSMIYRHPFPGPGLGVRILGEVKKEYADILRLADDIFMQELRASGWYDKTAQAFAVFQPVKSVGVVGDGRRYAWVIALRAVETVDFMTARFAHLPYELVDKISTRIMNEIKDVSRVVYDVSSKPPATIEWE

SEQ ID NO: 78755 - DNA, 1578 bp, Erwinia carotovora subsp. atroseptica SCRI1043
  CDS (1)..(1578)
atgactcaaaacattcatcaacaccgcattcttattctggatttcggctcgcagtacacgcagctggttgcacgtcgcgtgcgtgagctgggcgtttactgtgaactgtgggcatgggatgtcacggaagcgcagattcgcggctttaatccgaacgggatcatcctgtctggtggcccggaaagcaccaccgagtttggcagcccgcgtgcgccagaatacgttttcaacgctggcgtaccggtattaggcgtgtgctatggcatgcagacgatggcgatgcagctgggtggccacgttgaaggttccaacgagcgtgagtttggttatgcgcaggtagaagttaaaactaatagcgcgctggtgcgtgatattcaggatgcgttgagcgccacgggcgcgccgctgctggatgtctggatgagccacggcgacaaagtaacggcgatcccagaagggttcgagaccgttgccagtacggatacctgtccgttcgctatcatggctaacgaagagaaacgtttttacggcgtgcagttccacccggaagtgacgcacacgcgtcagggccagcgcatgttagagcgttttgtccttgatatctgccagtgtgaagctctgtggacaccagccaagattatcgacgatgcggtgaaccgtattcgcgagcaggtgggtaacgacagcgtgattttgggtctgtctggcggcgtggattcttccgttaccgcgatgctgctgcaccgtgcgattggtgaccgcctgacctgcgtgtttgtcgacaacggcctgcttcgcctgaacgaagccgatcaggttctggaaatgttcggcgataattttggtctgaacattgttcatgtggcggcagaagatcgcttcctgaacgagctggcgggtgaagatgagccagaagccaagcgtaaaatcattggccgcgtgtttgttgaagtgttcgatgaagaagccaacaagcaagccgaagtgaaatggctggctcaaggcaccatctacccggacgtgatcgaatctgcggcgtctgcgacgggcaaagcgcacgtgatcaagtcacaccacaacgtgggtggcctgccgaaagagatgaagctgggtctggtcgagccgttgaaagagctgttcaaagatgaagtgcgcaagattggtctggaactgggtctgccgtacaacatgctgtaccgccatccgttccctggcccaggcctgggcgtgcgtgtactgggtgaagtgaagaaagaatactgtgacctgctgcgtcgtgcggatgcgatcttcatcgaagaactgcacaaagctgacctgtataacaaggttagccaagcattcaccgtcttcctgccggtccggtccgtaggcgtaatgggtgatggccgtaaatacgattgggttgtcgcgctgcgcgcagtagaaaccatcgactttatgactgcgcactgggcacacttgccatacgatttcctcggccgtgtatccaaccgcatcatcaacgaagtcgacggcatctcccgcgtcgtttacgacgtatcgggcaagccgccggcaacgattgagtgggaatga

SEQ ID NO: 78756 - protein, 525 aa, Erwinia carotovora subsp. atroseptica SCRI1043
MTQNIHQHRILILDFGSQYTQLVARRVRELGVYCELWAWDVTEAQIRGFNPNGIILSGGPESTTEFGSPRAPEYVFNAGVPVLGVCYGMQTMAMQLGGHVEGSNEREFGYAQVEVKTNSALVRDIQDALSATGAPLLDVWMSHGDKVTAIPEGFETVASTDTCPFAIMANEEKRFYGVQFHPEVTHTRQGQRMLERFVLDICQCEALWTPAKIIDDAVNRIREQVGNDSVILGLSGGVDSSVTAMLLHRAIGDRLTCVFVDNGLLRLNEADQVLEMFGDNFGLNIVHVAAEDRFLNELAGEDEPEAKRKIIGRVFVEVFDEEANKQAEVKWLAQGTIYPDVIESAASATGKAHVIKSHHNVGGLPKEMKLGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVALRAVETIDFMTAHWAHLPYDFLGRVSNRIINEVDGISRVVYDVSGKPPATIEWE

SEQ ID NO: 78757 - DNA, 1542 bp, Mesoplasma florum L1
  CDS (1)..(1542): transl_table=4
atgaaaaatactcaaatcttgattttagattttggaagtcaatatacacagttattagctagaagagttagagaagctaatatttatacagaagttttaccttttgatacatcaattgaaaaaattaaagaatatccacttttaaaaggtatcattctttctggtgggccttcaagtgtatatttacaaaatgcttataaaatagattctgaaatcttaaatttagatattgctattttaggtgtatgttatggtatgcaattattaactcaatattttcaaggtgctgttgaattggctgatgaacaagaatttggtaaagcaatcataactattgatgataaaaaaaatccactttttaaaaatgtaactactgagtctcaagtttgaatgagtcatgctgatcatgttacagagttaccagtagattttaaacagattgcacattctaacgcaagtattgcagctattgctcataatactaaaccaatttatggtattcaattccatgctgaagtgactcattctttacaaggtaaagaaatgttagaaaacttcttatatgatattgctaaatgtaataaagactgaaatcttgatgactttattgatcaacaaatcaaagaaatcaaagaaactgttaaagataagcaagttattttgggtttaagtggtggagttgattcatcagttgctgctgctattattggtaaagctattggtaaacaacttacttgtatctttgttgatactggtttattaagaaaaaatgaaacaattgaagttatgaaagcttatgaaactaattttgatattaatattaagttagttgaagcaagtgatcttttcttttctgaattaaaaggaattaaagagcctgaagctaaaagaaaaattattggtaaatgttttatagacgtttttacagatgcggctagacaacataaggatgctgatttcttagcacaaggaactatttatccagatgttattgaatcttcttctcatggagctagttctaaaacaattaaatctcatcacaatgttggtggattaccagaagatttaaaatttagattaattgaacctttaagaaacttatttaaagatgaagtaagacaagttggttttaaattgggattacctgaagaaatgattaatcgtcatcctttccctggacctgggctaggaattagagttattgaagaagtaactaaagataaagttgaaattttacaagaagcagatgctatatttattaaaaaattaagggaatgaaatttatataatacagtttcacaagcctttgttacattattaccagttaaaacagttggtgtaatgggtgataatcgtacttatgattatgttgttgctttaagaagtgttaatacaattgattttatgacagcaactagcacacatcttccttgagaatttttagatgaagtagtaaatgaaataataaataaagtagataatgttaaccgagtagtttatgatgttacatctaaacctccaggaacaatagaatgagaataa

SEQ ID NO: 78758 - protein, 513 aa, Mesoplasma florum L1
MKNTQILILDFGSQYTQLLARRVREANIYTEVLPFDTSIEKIKEYPLLKGIILSGGPSSVYLQNAYKIDSEILNLDIAILGVCYGMQLLTQYFQGAVELADEQEFGKAIITIDDKKNPLFKNVTTESQVWMSHADHVTELPVDFKQIAHSNASIAAIAHNTKPIYGIQFHAEVTHSLQGKEMLENFLYDIAKCNKDWNLDDFIDQQIKEIKETVKDKQVILGLSGGVDSSVAAAIIGKAIGKQLTCIFVDTGLLRKNETIEVMKAYETNFDINIKLVEASDLFFSELKGIKEPEAKRKIIGKCFIDVFTDAARQHKDADFLAQGTIYPDVIESSSHGASSKTIKSHHNVGGLPEDLKFRLIEPLRNLFKDEVRQVGFKLGLPEEMINRHPFPGPGLGIRVIEEVTKDKVEILQEADAIFIKKLREWNLYNTVSQAFVTLLPVKTVGVMGDNRTYDYVVALRSVNTIDFMTATSTHLPWEFLDEVVNEIINKVDNVNRVVYDVTSKPPGTIEWE

SEQ ID NO: 78759 - DNA, 1593 bp, Propionibacterium acnes KPA171202
  CDS (1)..(1593): transl_table=11
gtggcgccaggtggggtcgtgggccatagactcgccttcatggaacaacttcacgacgtcgttctggtggtcgacttcggcgcgcagtacgcccagctcattgcccgccgggtgcgtgaggcgaatgtttactccgagatcgtcccgcataacatgccagtgcgcgacatgctcgctaaggaacccgccgccattattctttcgggtggtccggcctcggtctacgtagagggcgctccgagcgtcgacccggcgttgtttaacgctggtgtgccggtgctgggcatctgctatggattccaggccatggctcaggctctcggcggtcaggtggctcataccggagcatcggagtatggacgcaccagcctgtgcattacgtccgcggggcagcttttgtcccgtattccccacaccatcagcgtgtggatgagtcacggcgattccgtctcccgtgccccggagggattttcgacgttggcccgcactgcgggtgctccggtggcggcgtttgaagacgttgagcgcagactcgttggcgtgcagtggcaccccgaagtgcaccacacggagtccggacagacggtgctcgagcacttccttttcgacattgccggatgccgtcctgactggaatgccagctcgatcgtcggcgaccagatcgcgcagattcgtggccaggttggtgaccggcgtgtcatctgcggactgtcgggtggcgtcgattccgctgtcgccgcggctttggtgcagcgtgctgtgggcgaccagctcacctgtgttttcgtcgatcacggactgctgcgtcaaggggaggccgagcaagtcaagaacgacttcgtcgccgccacgggcgcagatttggtggtggctgatgagtcccagcgtttcctggatgcccttgccggggtcaccgatcctgagaccaagcgcaagatcattggacgcgagttcattcggacctttgaggacgttgccaagcgtctcaatgctgaccagccgatcgacttcttggtgcagggaactttatatcccgatgtcgtcgagtctggtggcggtgagggcgctgccaatatcaagagtcaccataatgttggtgggctccctgacgacttccagttcagtctcgttgagccattgcgcaccctctttaaggacgaggtgcgagccgtcggactcgaacttggtctgcccgaggacatcgtctggcgtcagcccttcccgggcccggggctggctatccgcattattggcgaagtcaccgcggagcgtctggaggtgctacgcactgccgatgccatcacgcgtgaggaaatgggggccgcaggcctggatcgcaaggtatggcagtgcccggtcgtcctcctgagcgatgttcattcggtaggggtacagggtgacgggcgtacttatggttctcccattgtgcttcgcccggtgacgagcgaggacgccatgactgcggactgggcacgtatcccatatgacgtactggaaaagatctcgactcgcattacgaatgcgtgtccgcaaatcaaccgggtggtactcgatatcacatctaaaccgccggccaccatcgagtgggaatga

SEQ ID NO: 78760 - protein, 530 aa, Propionibacterium acnes KPA171202
MAPGGVVGHRLAFMEQLHDVVLVVDFGAQYAQLIARRVREANVYSEIVPHNMPVRDMLAKEPAAIILSGGPASVYVEGAPSVDPALFNAGVPVLGICYGFQAMAQALGGQVAHTGASEYGRTSLCITSAGQLLSRIPHTISVWMSHGDSVSRAPEGFSTLARTAGAPVAAFEDVERRLVGVQWHPEVHHTESGQTVLEHFLFDIAGCRPDWNASSIVGDQIAQIRGQVGDRRVICGLSGGVDSAVAAALVQRAVGDQLTCVFVDHGLLRQGEAEQVKNDFVAATGADLVVADESQRFLDALAGVTDPETKRKIIGREFIRTFEDVAKRLNADQPIDFLVQGTLYPDVVESGGGEGAANIKSHHNVGGLPDDFQFSLVEPLRTLFKDEVRAVGLELGLPEDIVWRQPFPGPGLAIRIIGEVTAERLEVLRTADAITREEMGAAGLDRKVWQCPVVLLSDVHSVGVQGDGRTYGSPIVLRPVTSEDAMTADWARIPYDVLEKISTRITNACPQINRVVLDITSKPPATIEWE

SEQ ID NO: 78761 - DNA, 1563 bp, Streptococcus pyogenes MGAS10394
  CDS (1)..(1563): transl_table=11
atgactgaaatttcaattttgaatgatgttcaaaaaattatcgttcttgattatggtagccagtacaatcagcttattgctagacgtattcgagagtttggtgttttctccgaactaaaaagccataaaatcaccgctcaagaacttcgtgagatcaatcccataggtatcgttttatcaggagggcctaactctgtttacgctgataacgcctttggcattgaccctgaaatctttgaactagggattccgattcttggtatctgttacggtatgcaattaatcacccataaattaggtggtaaagttgttcctgctggacaagctggtaatcgtgaatacggtcagtcaacccttcatcttcgtgaaacgtcaaaattattttcaggcacacctcaagaacaactcgttttgatgagccatggtgatgctgttactgaaattccagaaggtttccaccttgttggagactcaaatgactgtccctatgcagctattgaaaatactgagaaaaacctttacggtattcagttccacccagaagtaagacactctgtttatggaaatgacattcttaaaaactttgctatatcaatttgtggcgcgcgtggtgattggtcaatggataattttattgacatggaaattgctaaaattcgtgaaactgtaggcgatcgtaaagttcttctaggtctttctggtggagttgattcttcagttgttggtgttctacttcaaaaagctattggtgaccaattaacttgtattttcgttgatcacggtcttcttcgtaaagacgagggcgatcaagttatgggaatgcttgggggcaaatttggcctaaatattatccgtgtggatgcttcaaaacgtttcttagaccttcttgcagacgttgaagatcctgagaaaaaacgtaaaattattggtaatgaatttgtctatgtttttgatgatgaagccagcaaattaaaaggtgttgacttccttgcccaaggaacactttatactgatatcattgagtcaggaacagaaactgctcaaaccatcaaatcacatcacaatgtgggtggtctccccgaagacatgcagtttgaattgattgagcccttaaacactcttttcaaagatgaagttcgagcgcttggaatcgctcttggaatgcctgaagaaattgtttggcgccaaccatttccaggtcctggacttgctatccgtgtcatgggaccaattactgaagaaaaacttgaaaccgttcgcgaatcagacgctatccttcgtgaagaaattgctaaggctggacttgatcgtgacgtgtggcaatactttacagttaacacaggtgtccgttctgtaggcgtcatgggagatggtcgtacttatgattataccatcgccattcgtgctattacgtctattgatggtatgacagctgactttgctcaacttccttgggatgtcttgaaaaaaatctcaacacgtatcgtaaatgaagttgaccacgttaaccgtatcgtctacgacatcacaagtaaaccacccgcaacagttgaatgggaataa

SEQ ID NO: 78762 - protein, 520 aa, Streptococcus pyogenes MGAS10394
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGPITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 78763 - DNA, 1512 bp, Leifsonia xyli subsp. xyli str. CTCB07
  CDS (1)..(1512): transl_table=11
gtgcgcgaggcgaacgtctactccgagatcgtgccgcacaccgtcactgctgccgacatcgcggccaaacgccctgcgggcatcatcctctccggcgggccgtccagcgtctacgaggagggcgcgcctcgtctggacgagggcattttcgagctcggcgttccggtgctcggcatctgctatggctttcaggtcatggcggtcgcgctcggcggcgaggtcgcgaagaccggccaccgagagtacggttccacggcggtgcgtgtctccgcgggcgcccggggcggagcgggctttttgctggacggccagcccggcgatcagactgtgtggatgtcgcacggcgactcggtcgccaaagcgcccgagggcttcgacgtcctcgcctccacggacgacaccccgatcgccgcgttcgcgaacgacgggcggaagctctacggcgtccagtggcatcccgaggtcaagcactcggagcacggccaggcggtgctcgagaacttcctgcaccgtgctgcgggcatcccggccgactggaactccggcaatgtcatcgccgatcaggtcgccgcgatccgcgcccaggtcggctccggccgcgtgctgtgcgccctgtccggcggagtggactccgcggtcgccgccgcgctcgtccacaaagccatcggcgaccagctcgtgtgcgttttcgtggatcacggcctcctccgccgggacgaggcgcggcaggtccaggaggactacgtttcggcgaccggggtccggctcatcacggtggacgcggaggagcagttcctcgccgcactggagagcgtgagcgaccccgaggccaagcgcaagatcatcggccgcgagtttatccgcgttttcgagcgggctcaggccgacctcgtcgccgaagccgcgagcgaaggcgacccgatccgcttcctcgtgcagggcacgctctatccggatgtcgtggagtcgggcggcggcgcgggaaccgcgaacatcaagagccaccacaacgtgagcggcctgccggaggacttgcagttcgagctcgtggagccgctgtgtacgctcttcaaagacgaggtccgcgccatcggccgcgagctcggcctgcccgaggtcattgtcggccgccagcccttccccgggccggggctgggcattcgcatcgtgggcgatgtgacacgcgagcgtctcgacctgctgcgcgacgcagacgccatcgttcgcgccgagctgaccgctgccggtctcgacagtgagatctggcagtgccccgtcgtgctgctggcggacgtgcgctcggtgggcgtgcagggcgacggccgcacttacggccacccgatcgtgctgcgccccgtttccagcgaggacgcgatgaccgctgactggacccgcctgccctaccatctgctcgcgaagatctccaaccgcatcaccaacgaggtggaaggggtcaaccgcgtggtcctcgacgtcacatcgaagccgccgggaacgatcgagtgggagtga

SEQ ID NO: 78764 - protein, 503 aa, Leifsonia xyli subsp. xyli str. CTCB07
MREANVYSEIVPHTVTAADIAAKRPAGIILSGGPSSVYEEGAPRLDEGIFELGVPVLGICYGFQVMAVALGGEVAKTGHREYGSTAVRVSAGARGGAGFLLDGQPGDQTVWMSHGDSVAKAPEGFDVLASTDDTPIAAFANDGRKLYGVQWHPEVKHSEHGQAVLENFLHRAAGIPADWNSGNVIADQVAAIRAQVGSGRVLCALSGGVDSAVAAALVHKAIGDQLVCVFVDHGLLRRDEARQVQEDYVSATGVRLITVDAEEQFLAALESVSDPEAKRKIIGREFIRVFERAQADLVAEAASEGDPIRFLVQGTLYPDVVESGGGAGTANIKSHHNVSGLPEDLQFELVEPLCTLFKDEVRAIGRELGLPEVIVGRQPFPGPGLGIRIVGDVTRERLDLLRDADAIVRAELTAAGLDSEIWQCPVVLLADVRSVGVQGDGRTYGHPIVLRPVSSEDAMTADWTRLPYHLLAKISNRITNEVEGVNRVVLDVTSKPPGTIEWE

SEQ ID NO: 78765 - DNA, 1587 bp, Borrelia garinii PBi
  CDS (1)..(1587): transl_table=11
atgaaatacgctttaataagaaaacttttatttgttttaaggacttatatgatgaatgttcgtgcaatacttgtattagattttggatcccaatatagccaactaattgcaagaaggattagagaaattggagtttatacaaaagtaataccttactatacccctttaaaagaaattaaaaatatgaacatcgcaggaataatactaagtggaggccctgcctctgtttacgcaaaagatgcccctaccttgaacatggaaatttttaatttaaaaatacctgttttaggcatatgttatggaatgcaattaattgttaaattatttggaggcctagtatctaaagactacaaacaagaatatggaagctctgaaatctttctaaaaaatgaaaaatctcttttattctcagagcttccaaacaaattccaaattattatgagtcatggggatagtattgaaaaaattcccaataatttcaaacagttggcttttacaaaaaactgtattgcttctatatcaaatgaagatcaaaagatttatggtctacaatttcacccagaagtaactcattctgaatttggcgatcaaatacttaaaaattttgtttttaaaatttgtcaatctcaaactaattggtcattagagagcaatgtagaaaccattgtggaaaaaattaaacttaaagtaggtagtaaaaaggttattttaggactttctggtggtacagactctttggtttgcgcattacttataaaaaaggcaataaaagaaaatttaatctgcgtttttgtaaatactggattgttgcgtaaaaatgaagataaaaaaatactagaattaaagcatcaatatgatttaaatataaaatacatcgatgcttctgaaaaattcttaaactatttaaaaaatataagtgatcctgaggaaaaaagaaaaataataggaaaagaatttgtaaacgtttttgaaaaaattactctagaagatcaaaatatagaatatttagcacaaggaacaatttattccgacgtaattgaatctaaatcaaaaaataacgcttcttcaaaaattaaatctcatcacaacgtagggggacttccagataagatgcgtttaaaacttttagaacctttgaatgaattttttaaggatgaaataattcaaatcggaataaatttaggcattaaaaaagaagctctttatagacacccattcccaggcccaggactagccataagaataattggagaagtaacgcaagagaagatcaatatcttgcaagaagcagaaaatattctcacagaggagctttttacaaatgacttatattatgaaataagacaagcatttgttgtattgctgcctgttaaatctgtaggcgtaatgggagatcaaaggacatatgaatatacagctgtcattagatgtgtcaatactcaagacttcatgactgcagaatggactgaacttccttataattttttaagaaaagtttcttcaagaataattaatgaagttagaggtataaatagagtttgttatgatatatcttctaagcctccatcaaccatagaatgggaataa

SEQ ID NO: 78766 - protein, 528 aa, Borrelia garinii PBi
MKYALIRKLLFVLRTYMMNVRAILVLDFGSQYSQLIARRIREIGVYTKVIPYYTPLKEIKNMNIAGIILSGGPASVYAKDAPTLNMEIFNLKIPVLGICYGMQLIVKLFGGLVSKDYKQEYGSSEIFLKNEKSLLFSELPNKFQIIMSHGDSIEKIPNNFKQLAFTKNCIASISNEDQKIYGLQFHPEVTHSEFGDQILKNFVFKICQSQTNWSLESNVETIVEKIKLKVGSKKVILGLSGGTDSLVCALLIKKAIKENLICVFVNTGLLRKNEDKKILELKHQYDLNIKYIDASEKFLNYLKNISDPEEKRKIIGKEFVNVFEKITLEDQNIEYLAQGTIYSDVIESKSKNNASSKIKSHHNVGGLPDKMRLKLLEPLNEFFKDEIIQIGINLGIKKEALYRHPFPGPGLAIRIIGEVTQEKINILQEAENILTEELFTNDLYYEIRQAFVVLLPVKSVGVMGDQRTYEYTAVIRCVNTQDFMTAEWTELPYNFLRKVSSRIINEVRGINRVCYDISSKPPSTIEWE

SEQ ID NO: 78767 - DNA, 1551 bp, Desulfotalea psychrophila LSv54
  CDS (1)..(1551): transl_table=11
atggatattcataaggaaaaaatcattattctcgactttggttcacagaccactcagctgattgctagacgggtgcgtgaaatgaaggtttacagtgaaattcacccattttctctacctctggagaagttaaaggagctgaacccgaccggaataattctttctggtggcccatgttctgtttacgatgatgatgcaccgcattccgatgcgggtctttttgagttgggtgtgcccgtattcggtatctgttacggcgctcagttgatgattcagcagcttggcggcagtgtagaaaaggcagaaaaacgagagtttggtaaggccgagatccagattctcaacgatagtgacctctttgccggtcttgatgtagccaggagtcaccaagtatggatgagtcacggtgatcgtgttgaggttatccctgaccagtttgaggtaagtgcagaatctgcccactctccctatgcagctctgcgtcacaggtcaaaaccatttgttgccgtacagtttcacccggaggttgtgcacagcattatcggtactgatctgttgagaaactttgtctttggcctttgtaaatgtcaggcaacctggaccatgcagggttttatcgagtccaatgttgcggctattaaagagaaggtgggcgatgcccatgttatctgtgccctttcaggtggtgttgattcctccgttgtggcggcgatgattcacaaggccattggctctcagttgacctgtgtttatgtaaacaacggtctcatgcgtattggtgagtccgagggtattatcaagttctttaaagagaataccgatcttcacctcattgatgttgatgccagcgattatttcctgggtaaacttgaaggtgttactgatcctgaggttaagcgtcagcatatcggtcttggctttatcaagatctttgaggaagaggcacataagattgatggcgatgtgaagtttcttgctcaaggaactctctatcccgacgtggtagagtctgtctcttttcgtggtgcagcacctattaagtctcaccataatgtaggctgcctgcccgatatcatgaagcttagtcttattgagccccttcgtgagctcttcaaggatgaggtgcgtgagcttggtgtagagcttggtctgcccgatgaggcggttcatcgtcagcctttccctggtcctggtcttagtattcgtatcatgggcgaggtaactcccgagcgtttggatatcgtccgtcgtgctgatgttatcgtcctggatgagatgaaaaagcatggctactataacaaggtatggcagtcatttgccgtgcttctgcctatccagacagtcggcgtaatgggtgactttcgtacctatgagcatgttgttgccctgcgggtagttgattctcgtgatgctatgaccgcggattggagccgggtaccctatgatattcttggtgatatttccaccaggattattaatgaggtgcggggagttaatcgggttgtctacgatatctcttccaaaccacctgcaacgatagagtgggagtag

SEQ ID NO: 78768 - protein, 516 aa, Desulfotalea psychrophila LSv54
MDIHKEKIIILDFGSQTTQLIARRVREMKVYSEIHPFSLPLEKLKELNPTGIILSGGPCSVYDDDAPHSDAGLFELGVPVFGICYGAQLMIQQLGGSVEKAEKREFGKAEIQILNDSDLFAGLDVARSHQVWMSHGDRVEVIPDQFEVSAESAHSPYAALRHRSKPFVAVQFHPEVVHSIIGTDLLRNFVFGLCKCQATWTMQGFIESNVAAIKEKVGDAHVICALSGGVDSSVVAAMIHKAIGSQLTCVYVNNGLMRIGESEGIIKFFKENTDLHLIDVDASDYFLGKLEGVTDPEVKRQHIGLGFIKIFEEEAHKIDGDVKFLAQGTLYPDVVESVSFRGAAPIKSHHNVGCLPDIMKLSLIEPLRELFKDEVRELGVELGLPDEAVHRQPFPGPGLSIRIMGEVTPERLDIVRRADVIVLDEMKKHGYYNKVWQSFAVLLPIQTVGVMGDFRTYEHVVALRVVDSRDAMTADWSRVPYDILGDISTRIINEVRGVNRVVYDISSKPPATIEWE

SEQ ID NO: 78769 - DNA, 1578 bp, Yersinia pseudotuberculosis IP 32953
  CDS (1)..(1578): transl_table=11
atgacaaaaaatatccataagcatcgcatccttattcttgatttcggctcgcagtacacccaattattggcgcgtcgtgtgcgtgagattggtgtctattgtgaactatgggcatgggatgtcaccgaagcccaaatccgtgaatttaatccaagcggtatcatcctctctggtagccctgaaagtacgatagaaaacggtagcccgcgtgcaccagactatgtgtttacggctggtgtaccggtattgggtgtgtgctatggcatgcagaccatggcgatacaattgggcggtaaagttgagagttcaaatcagcgtgaatttggttatgcgcaagttgaaattaaagctgacagcgcgctgatccgtgatatcaaagatgccatcaatccggcaggcgaagccgtattggatgtttggatgagtcacggtgacaaagttgcggagatccctgctgattttgtcacggttgccagcacggatacctgtccgtttgccattatggctaacgaagaaaaacgtttttatggtgtccagttccatcctgaagtgacacacaccaagcaaggcctgcgtttgttggagcgtttcgtgctgggtatctgtggctgcgaagcgctatggacatctgccaccattatcgaagatgcaattgtccgtttgcgtgagcaaattggcgacgatcatgtgatcttggggttaagtggtggtgtcgactcttcagtgacggccatgttgttgcaccgcgctatcggtaaacgcctgacctgtgtattcgtggataacggcctattacgcttaaacgaagcggatcaggtcttggaaatgtttggcgataaatttggcctgaatattgtccatgtggcggcagaggatcgcttcctttcggcactggcgggtgtggacgaaccagaagcgaaacgtaaaatcattggccgtgtctttgtcgaactcttcgacgaagaagcctgtaaacaagagcaggtgaaatggttggcacagggtacgatttaccctgatgtgatcgaatcggctgcatcagctaccggtaaagcgcatgtgattaaatctcaccacaatgtgggcggtttgccaaaagagatgaagctgggcctggttgagccgctgaaagagctgtttaaagatgaagtgcgcaagattggtctggagcttggcctgccatacgacatgctgtaccgccatcctttcccagggccgggcttaggtgtgcgcgtattgggcgaagtgaaaaaagagtattgcgatttgctgcgccgtgctgacgctatctttattgaagagctgcataaagctgatttgtacaataaagttagccaggctttcactgtcttcctgccagtacgttcagtcggtgtgatgggtgatggccgtaaatatgattgggttgtctctctgcgtgcggtagagacggttgatttcatgactgcacattgggcacatctgccatacgacttccttggccgcgtttcaaaccgcatcattaatgaagtcaatggtatctcgcgcgtagtttatgatatcagcggcaagccacctgcaacgattgagtgggaatga

SEQ ID NO: 78770 - protein, 525 aa, Yersinia pseudotuberculosis IP 32953
MTKNIHKHRILILDFGSQYTQLLARRVREIGVYCELWAWDVTEAQIREFNPSGIILSGSPESTIENGSPRAPDYVFTAGVPVLGVCYGMQTMAIQLGGKVESSNQREFGYAQVEIKADSALIRDIKDAINPAGEAVLDVWMSHGDKVAEIPADFVTVASTDTCPFAIMANEEKRFYGVQFHPEVTHTKQGLRLLERFVLGICGCEALWTSATIIEDAIVRLREQIGDDHVILGLSGGVDSSVTAMLLHRAIGKRLTCVFVDNGLLRLNEADQVLEMFGDKFGLNIVHVAAEDRFLSALAGVDEPEAKRKIIGRVFVELFDEEACKQEQVKWLAQGTIYPDVIESAASATGKAHVIKSHHNVGGLPKEMKLGLVEPLKELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETVDFMTAHWAHLPYDFLGRVSNRIINEVNGISRVVYDISGKPPATIEWE

SEQ ID NO: 78771 - DNA, 1542 bp, Symbiobacterium thermophilum IAM 14863
  CDS (1)..(1542): transl_table=11
atgagtcagcaacgggacctgatcgtggttgtggacttcggcgggcagtacagccacctgatcgcgcgtcgggtgcgggaggcgcaggtgtactgcgagatctggccgttcaccgcaccggtgcagcgctaccgggaggccggggtgaaggggatcatcttctccggcggcccggcgtcggtggaacaggctgacgcgccccgcatcgatcccgccatctacgagctgggcatcccgattctcggcatctgctacgggatgcagctcatggcgctgcagctgggcggcgaggtccgtcgggggcagcagggcgagtacggccgggccacgctgcgcctggccgacgcggagcatccgctgctcaggggactggggcgtgagagtctcgtctggatgagccacttcgattccgtgacgagggtgccgtccggcttccgcgtgctgggcgccaccgagaacacggccgtggcggtgatgggggacgacgcccgacggctgtacggcgtgcagttccatcccgaggtcgtgcacacggcccagggccgggagatcctccgaaacttcctctttaatatcgccgggtgcaggggggactggaccaccgagtcgttcatcacccgccaggtggaggagatccgccggcaggtcggcagcggcagggtgctctgcgccctgtcgggcggcgtcgactcgtcggtcgcggcggtgctggtccacaaggccgtcggcgaccagctcacgtgcatcttcgtcgaccacggcctcatgcgcaagggcgagccggagcaggtggtccgcaccttccgggaccacttccacatccatctggtccacgtggacgcctccgagcgcttcctcagcaagctgaggggcgtgacggaccccgagcagaagcggaagatcatcggcaacgagttcatccgcctgttcgaggatgaggcccgcaagctggggcagatcgacttcctggtccagggcaccgtctatcccgacgtcatcgagtccggcaccgagaccgcccgggtgatcaagtcccaccacaacgtgggcgggctgccggaggacatgcggttccagctgatcgagcccttccggcagctgttcaaggacgaggttcgcgccgtggggcgcgccctgggtgtgcccgaggagatcgtcggccgccacccgttccccgggccggggctcggcgtccgggtgctgggggaggtcacccccgagaagctggagatcctccgggaggccgaccgcatcttcgtcgaggagatccggaaggccgggctgtacgacgagctctggcaggccttcacggtgctgccggacgtccgcagcgtcggggtgatgggcgacgaacggacgtacgcttaccccgttgtcctgcgggcggtgacctctgaagacgcgatgacggccgacttctaccggttgccctgggatctgctggagcgcattgccagccgcatcgtgaacgaggtgccgcacgtcaaccgggtggtgtacgacgtcacctcgaagccgccggggacgatcgagtgggagtga

SEQ ID NO: 78772 - protein, 513 aa, Symbiobacterium thermophilum IAM 14863
MSQQRDLIVVVDFGGQYSHLIARRVREAQVYCEIWPFTAPVQRYREAGVKGIIFSGGPASVEQADAPRIDPAIYELGIPILGICYGMQLMALQLGGEVRRGQQGEYGRATLRLADAEHPLLRGLGRESLVWMSHFDSVTRVPSGFRVLGATENTAVAVMGDDARRLYGVQFHPEVVHTAQGREILRNFLFNIAGCRGDWTTESFITRQVEEIRRQVGSGRVLCALSGGVDSSVAAVLVHKAVGDQLTCIFVDHGLMRKGEPEQVVRTFRDHFHIHLVHVDASERFLSKLRGVTDPEQKRKIIGNEFIRLFEDEARKLGQIDFLVQGTVYPDVIESGTETARVIKSHHNVGGLPEDMRFQLIEPFRQLFKDEVRAVGRALGVPEEIVGRHPFPGPGLGVRVLGEVTPEKLEILREADRIFVEEIRKAGLYDELWQAFTVLPDVRSVGVMGDERTYAYPVVLRAVTSEDAMTADFYRLPWDLLERIASRIVNEVPHVNRVVYDVTSKPPGTIEWE

SEQ ID NO: 78773 - DNA, 1572 bp, Mannheimia succiniciproducens MBEL55E
  CDS (1)..(1572): transl_table=11
atgaacaacattcacaaccataaaatcctaatcctcgacttcggttcccaatatacccagctgatcgcgcgtcgcgtgcgtgaaatcggggtttactgcgaactttgggcgtgggacgtaacggaacaacaaatccgtgaatttaatccgaccgggattattctttccggcggtccggaaagcaccaccgaagacaacagcccgcgtgcgccggaatatgtatttaacgcaggcgtgccggtgttaggcatttgctacggtatgcaaaccatggcaatgcagctcggcgggctgaccgaaccgtccagccaccgtgaattcggctatgcttccgtttctctcgaaaattccaccgcactttttgctcagctgaatgatgatttaaattcctccctgccaaaactggacgtctggatgagccacggcgataaagtaacccgtttgccggaaggttttcagctgaccggtaccacgtcgacttgcccaatcgccgccatgtctgacgaaagccgtcatttctacggcgtgcagttccaccctgaagttacccacaccaaaagcggtttggcgttattaaccaactttgtggtgaatatttgcggatgtacaaccaactggacgccggaaaacatcattgaagatgcggtagctcgcattaaagcgcaagtgggcgacgatgaagtgattttaggcttatccggcggtgtggattcttcggtaaccgcattattattacaccgcgctatcggcaaaaatttacactgtgtgttcgtggataacggcttattacgtttaaacgaaggcgatcaggtaatggaaatgttcggcgataaattcggcttgaatattatccgcgtcaacgccgaagatcgtttcttagacgcattgaaaggcattgacgaaccggaatccaaacgcaaaatgatcggtaaagtatttgtggatgtattcgacgaagaatcccacaaacaaaccagcgttaaatggctggcacaaggcaccatttatccggatgtgattgaatccgccgccagcaaaaccggcaaagcacacgtgattaaatcccaccataacgtaggtggtttaccggattatatgaagctcggcttagtggaaccgcttcgcgaattattcaaagatgaagtacgtaaaatcggcttggccttaggcttgcctgccgaaatgctcaaccgccacccgttcccgggcccgggtttaggggtgcgcgtattgggtgaaatcaaaaaagaatactgcgatttactgcgcaaagccgacgccatctttatcgaagaactttacaactcaggctggtactataaagtcagccaggcgttcaccgtattcctgccggtgaaatccgtcggcgtaatgggcgacgggcgtaaatacgactgggtggtatcgttacgtgcggtagaaaccatcgattttatgaccgcacattgggcgcacttgccttatgatctattaggcaaaatctcaaaccgtatcatcaacgaagtggacggcatttcccgcgtggtgtatgacgtcagcggaaaacctcctgcgacgattgagtgggagtag

SEQ ID NO: 78774 - protein, 523 aa, Mannheimia succiniciproducens MBEL55E
MNNIHNHKILILDFGSQYTQLIARRVREIGVYCELWAWDVTEQQIREFNPTGIILSGGPESTTEDNSPRAPEYVFNAGVPVLGICYGMQTMAMQLGGLTEPSSHREFGYASVSLENSTALFAQLNDDLNSSLPKLDVWMSHGDKVTRLPEGFQLTGTTSTCPIAAMSDESRHFYGVQFHPEVTHTKSGLALLTNFVVNICGCTTNWTPENIIEDAVARIKAQVGDDEVILGLSGGVDSSVTALLLHRAIGKNLHCVFVDNGLLRLNEGDQVMEMFGDKFGLNIIRVNAEDRFLDALKGIDEPESKRKMIGKVFVDVFDEESHKQTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELYNSGWYYKVSQAFTVFLPVKSVGVMGDGRKYDWVVSLRAVETIDFMTAHWAHLPYDLLGKISNRIINEVDGISRVVYDVSGKPPATIEWE

SEQ ID NO: 78775 - DNA, 1578 bp, Legionella pneumophila subsp. pneumophila str. Philadelphia 1
  CDS (1)..(1578): transl_table=11
atgaatgatttgaaaaaaagcccattattaatattagattttggttctcaatacacccaattaattgcaagacgcgttcgagaaatgggggtttattgtgaaatttatccttatcatattaatcatgaacaatttaagaaattaaatccctgcggtgtgattttatcagggggtccttcgacagtaacgcatgatgccaatcccagggctcctcaatggctatttgatagtggtttgcccttgctgggtatttgctacgggatgcaaaccatggctgtacaactcggtggccaagtgcattcatcggcgttaagagagtttgggtatgccgagttgcgcttgcatggccatagtcaattattaaataatatcgaagatcgcatcctggcggatggcagcgcactattggatgtatggatgagccacggagataaagttaccgagttaccgccaggatttaaaattatatgtgaaacacgcaatgcgccaattgcaggtatggctgatgagagtcgtcaaatgtatggtttgcaatttcatccagaagttactcataccttgcaaggtttaagaattttacaacgttttgtcgtagatatttgtaaagcatcaacagactggactccagagcatattattgatgaagccattaataaaatcagagaacaggtaggaactgaaaaagttttactgggcctatccggaggcgttgactcttctgttgtagccgcattgctgcatagagccattggagagcaactggtttgtgttttcgttgatacgggtttactcagacttaatgaggcggagcaagtgctgagcatgttcggtcggcatatgggaatacgcattattgcagtcaatgccgaagataaatttttaactgctttgaagggagtaacttgcccagaggaaaagagaaaaattattgggcgtacatttattgaagtctttgatgaggaagcacagaaactgactgagataaagtggctggctcagggcacaatctatcccgatgtcatcgagtctgcagcaacaagtactaatgatgcggctgtggtcataaagtctcatcataatgtcggtggcttaccagatacattaaatcttaaactgctggaacctattcgtgagctctttaaagatgaagtacgtcaagtaggtctggaattgggactcccacatgatatggtctatcggcatccctttcctggacctggattgggtgtaagaattttagcggaagtaaaaaaagaatatgcggatatattacgtaaagccgatgctatttttattgaagaactgcataacgcgcagctttatcataaaatcagccaggcatttgctgtttttttaccagtaaagagcgtaggtgtgatgggggatggacgccgatacgattacgtaatttgtttaagagctgttgagacagttgattttatgacagcacattggtctcaattgccctgggattttttaggaaaagtatccaatcgaattattaatgaagtagagggagtatcacgtgtcacttacgatatttctggcaagccacctgctaccattgaatgggaatga

SEQ ID NO: 78776 - protein, 525 aa, Legionella pneumophila subsp. pneumophila str. Philadelphia 1
MNDLKKSPLLILDFGSQYTQLIARRVREMGVYCEIYPYHINHEQFKKLNPCGVILSGGPSTVTHDANPRAPQWLFDSGLPLLGICYGMQTMAVQLGGQVHSSALREFGYAELRLHGHSQLLNNIEDRILADGSALLDVWMSHGDKVTELPPGFKIICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTEIKWLAQGTIYPDVIESAATSTNDAAVVIKSHHNVGGLPDTLNLKLLEPIRELFKDEVRQVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 78777 - DNA, 1524 bp, Bacteroides fragilis YCH46
  CDS (1)..(1524): transl_table=11
atgcaagagaaaattataatacttgatttcggttcacagaccacgcagcttatcggtcgccgggtgcgcgagttggatacgtattgcgagattgtcccctataacaagtttcccaaaggcgatgaaaccgtcaagggagtgattctgtcgggaagccccttctccgtatatgacgaaagtgcgttcaaggtcgatttgagcgaaatcagaggtaaataccccatcttgggcatctgctatggtgcacagtttatggcgtataccaatggtggcaaagtagaaccggcaggtacccgtgagtatggacgtgctcacctgacttctttctgcaaggacaatgttttgttcaaaggtgtgagagagggtacgcaggtatggatgagccacggtgataccattactgctatccctgagaattttaaaaccattgcatcgacagacaaagtggctattgccgcctatcaggtagagggcgaacaggtatggggagtacagttccatccggaagttttccacagtgaagacggtacgcagatgcttcgcaatttcgttgtcgatgtatgtggctgtaaacaggactggagtccggcgtcattcatcgagagcacggttgccgaattgaaagctcagctgggtgatgacaaggttgtactgggattaagcggaggagttgactcttctgtagccgccgttttgctgaacagggctattggcaagaatttgacttgtattttcgttgaccacggtatgcttcgcaagaacgagtttaagaacgtgatgcacgattacgaatgccttggcttgaacgtgattggtgtggatgccagtgagaagttcttctctgaactggaaggcgtcaccgaacctgaacgtaaacgtaaaattataggtaaaggatttattgacgtattcgatgaagaagcacataaactgaaagatgtgaaatggctggctcagggtacgatttatccggactgtatcgagtcgctttctatcaccggtactgttatcaagagtcaccacaatgtgggaggacttcctgaaaagatgaatctaaaactttgtgaaccgcttcgcttactgtttaaggacgaggttcgtcgtgtaggtagagagttaggtatgcccgagcacttgattacccgtcatcctttccccgggccgggacttgctgttcgtatcttaggtgatattactcctgagaaggttcgtatcttgcaggatgccgatgatatctttattcagggtttgcgtgattggggattgtacgatcaggtgtggcaggcaggtgttatcttgcttcctgttcaatcggtaggcgtaatgggagacgaacgtacttacgaacgtgccgttgctttgcgtgccgtgacttcaacggatgctatgacagccgactgggcgcatttgccttatgaattccttggtaaagtgtcgaatgatattataaataaggtaaaaggtgtgaaccgtgtgacctatgatatcagttcgaagccacctgcaactatcgaatgggaataa

SEQ ID NO: 78778 - protein, 507 aa, Bacteroides fragilis YCH46
MQEKIIILDFGSQTTQLIGRRVRELDTYCEIVPYNKFPKGDETVKGVILSGSPFSVYDESAFKVDLSEIRGKYPILGICYGAQFMAYTNGGKVEPAGTREYGRAHLTSFCKDNVLFKGVREGTQVWMSHGDTITAIPENFKTIASTDKVAIAAYQVEGEQVWGVQFHPEVFHSEDGTQMLRNFVVDVCGCKQDWSPASFIESTVAELKAQLGDDKVVLGLSGGVDSSVAAVLLNRAIGKNLTCIFVDHGMLRKNEFKNVMHDYECLGLNVIGVDASEKFFSELEGVTEPERKRKIIGKGFIDVFDEEAHKLKDVKWLAQGTIYPDCIESLSITGTVIKSHHNVGGLPEKMNLKLCEPLRLLFKDEVRRVGRELGMPEHLITRHPFPGPGLAVRILGDITPEKVRILQDADDIFIQGLRDWGLYDQVWQAGVILLPVQSVGVMGDERTYERAVALRAVTSTDAMTADWAHLPYEFLGKVSNDIINKVKGVNRVTYDISSKPPATIEWE

SEQ ID NO: 78779 - DNA, 1644 bp, Burkholderia pseudomallei K96243
  CDS (1)..(1644): transl_table=11
ttgttcctttccccgtccgctgccatgcacgacaaaatcctgattctcgacttcggttcgcaagtcactcaactgatcgcgcggcgcgtccgcgaagcgcacgtctactgcgagatccatccgaacgacgtttccgacgacttcgttcgcgagttcgccccgaagggcgtgattctgtccggcagccacgcgagcacctacgaggaccaccagttgcgcgcgccgcaggcggtatgggatctcggcgtgcccgtgctcggcatttgctacgggatgcagacgatggccgtacaactgggcggcaaggtcgagtggagcgaccaccgcgagttcggctatgcggaagtgcgcgcgcatggccgcacgcgcctgctcgacggcatccaggatttcgcgacgcccgaaggccacgggatgctgaaggtctggatgagccacggcgacaaggtcggcgagatgccgccgggcttcgcgctgatggcgtcgacgccgagctgcccgatcgccggcatggccgacgaggcgcgcggctactacgcggtgcagttccacccggaagtcacgcacacggtgcagggccgcaagctgctcgagcgcttcgtgctcgacatcgccggcgcgaaacccgactggatcatgcgcgaccacatcgaggaggcggtcgcgcggattcgcgagcaggtcggcgacgaggaagtgatcctcggcctgtcgggcggcgtggattcgagcgtcgcggcggcgctcatccaccgtgcgatcggcgatcaattgacttgcgtgttcgtcgaccacggcctgctgcgcctgaacgaaggcaagatggtgctcgacatgttcgaaggccggctgcatgcgaaggtcgtccacgtcgacgcgtccgagcagttcctcggccatctcgcgggcgtcgccgatccggagcacaaacgcaagatcatcggccgcgagttcgtcgaagtgttccaggcggaagcgaagaagctgacgaacgcgaagtggctcgcgcaggggacgatctacccggacgtgatcgaatcgggcggcgcgaagacgaagaaggcgacgacgatcaagagccatcacaacgtgggcggcttgccggagacgctcggcctgaagctgctcgagccgctgcgcgatctgttcaaggacgaagtgcgcgagcttggcgtcgcgctcggcttgccggcggagatggtgtatcgccatccgttcccgggcccgggcctcggcgtgcggattctgggcgaagtgaagcgcgactacgcggagctgctgcgccgcgcggatgcgatcttcatcgaagagctctgcgggacgctcgcgaccgagcaggatgcggcggcgggcctgtgcgagccgtcgcaggtcggcaagagctggtacgacctgacgagccaggcgttcgcggtgttcctgccggtgaagtcggtcggcgtgatgggcgacggccgcacgtacgactacgtggccgcgttgcgcgcggtgcagacgaccgatttcatgacggcgcactgggcgcatctgccgtatgcgctgctcggccgcgcgtcgaaccggatcatcaacgaagtgcgcgggatcaatcgggtggtgtacgacgtgtcgggtaagccgccggcgacaatcgagtgggagtga

SEQ ID NO: 78780 - protein, 547 aa, Burkholderia pseudomallei K96243
MFLSPSAAMHDKILILDFGSQVTQLIARRVREAHVYCEIHPNDVSDDFVREFAPKGVILSGSHASTYEDHQLRAPQAVWDLGVPVLGICYGMQTMAVQLGGKVEWSDHREFGYAEVRAHGRTRLLDGIQDFATPEGHGMLKVWMSHGDKVGEMPPGFALMASTPSCPIAGMADEARGYYAVQFHPEVTHTVQGRKLLERFVLDIAGAKPDWIMRDHIEEAVARIREQVGDEEVILGLSGGVDSSVAAALIHRAIGDQLTCVFVDHGLLRLNEGKMVLDMFEGRLHAKVVHVDASEQFLGHLAGVADPEHKRKIIGREFVEVFQAEAKKLTNAKWLAQGTIYPDVIESGGAKTKKATTIKSHHNVGGLPETLGLKLLEPLRDLFKDEVRELGVALGLPAEMVYRHPFPGPGLGVRILGEVKRDYAELLRRADAIFIEELCGTLATEQDAAAGLCEPSQVGKSWYDLTSQAFAVFLPVKSVGVMGDGRTYDYVAALRAVQTTDFMTAHWAHLPYALLGRASNRIINEVRGINRVVYDVSGKPPATIEWE

SEQ ID NO: 78781 - DNA, 1575 bp, Methylococcus capsulatus str. Bath
  CDS (1)..(1575): transl_table=11
atgaccgacatccacgcccaaaaaatcctgatcctggatttcggctcccagtacacccagctcatcgcgcggcgggtgagggaactcggagtgtacagcgaaatccatccctacgactgtggcgacgatttcataaccgaattcgccccgcagggcatcatcctgtccggcggccccgaaagcgtcaccggcactggcacgccccgcgccccggcttcggtgttcaccctcggcgtgccggtgctcggcatctgctacggcatgcagaccatggcggcccagctcggcggcaaggtggaagccgtcgaacaccgcgaattcggctatgcccaggtccgcgcccatggccactcacagcttttgaatgggatcgaggaccacaccactcccgaaggtcatggactgctcgacgtgtggatgagccacggcgaccaggtcgtcggcctgccgcccggcttcaagctgatcgccagcaccgaaagcgcgcccatcgccggcatggcagacgaggaacgccggttctacgccctgcagttccaccccgaggtgacccatacccgccagggcaagcgcatcctggaacgcttcgtgcgcaagctgtgccagtgcgaggcccgctggaccacgggcaacatcgtcgaagacgccatcaccagggtacggaatcggatcggcgccgaacgggtggtgctcggcctctccggcggcgtggactcgtccgtggtcgccgccctgctccagcacgccatcggcgaacaactgacctgcgtgttcgtcgacaccggcctgctgcggctcaacgaaggcgaccaggtcatggccactttcgctgaacacatgggcgtgcgggtgatccgggtcaatgccgaagaacgtttcctgcaggcgttgcagggtatcgccgaccccgaagacaagcgcaagatcatcggccggctgttcgtggagatcttcgacgaagaagccgcgaagatcgaagacgcccgttggctggcccagggcaccatctacccggacgtgatcgaatccgcgggctccaagaccggcaaggcgcatgtcatcaaatcccaccacaacgtgggcggcctgccggagaccatgaagctgcaactggtcgagccgctgcgcgaactgttcaaggacgaggtgcgccagatcggcctcgaactgggcctgccctatgagatggtgtaccgccatcccttccccggccccggtctcggcgtgcgcatcctcggcgaggtccggaaggaatacgccgacctgctgcgccgcgccgacgccatcttcatcgaagagctctaccgccacgacctgtacgacaaggtcagccaggccttcgccgtgttcctgcccgtgaaatcggtcggcgtcatgggcgacggccgccgctacgactacgtggtcgcactgcgcgccgtggaaaccatcgatttcatgaccgcccgctgggcccacctcccttacgacttcctcgacctggtctcgcgccgcatcatcaacgaaattcccggcatctcccgggtcacctatgacatctcggggaaaccgccggcgacgatcgaatgggagtga

SEQ ID NO: 78782 - protein, 524 aa, Methylococcus capsulatus str. Bath
MTDIHAQKILILDFGSQYTQLIARRVRELGVYSEIHPYDCGDDFITEFAPQGIILSGGPESVTGTGTPRAPASVFTLGVPVLGICYGMQTMAAQLGGKVEAVEHREFGYAQVRAHGHSQLLNGIEDHTTPEGHGLLDVWMSHGDQVVGLPPGFKLIASTESAPIAGMADEERRFYALQFHPEVTHTRQGKRILERFVRKLCQCEARWTTGNIVEDAITRVRNRIGAERVVLGLSGGVDSSVVAALLQHAIGEQLTCVFVDTGLLRLNEGDQVMATFAEHMGVRVIRVNAEERFLQALQGIADPEDKRKIIGRLFVEIFDEEAAKIEDARWLAQGTIYPDVIESAGSKTGKAHVIKSHHNVGGLPETMKLQLVEPLRELFKDEVRQIGLELGLPYEMVYRHPFPGPGLGVRILGEVRKEYADLLRRADAIFIEELYRHDLYDKVSQAFAVFLPVKSVGVMGDGRRYDYVVALRAVETIDFMTARWAHLPYDFLDLVSRRIINEIPGISRVTYDISGKPPATIEWE

SEQ ID NO: 78783 - DNA, 1575 bp, Nocardia farcinica IFM 10152
  CDS (1)..(1575): transl_table=11
gtggcagaaacccagagaccggtcctcgtcgtcgacttcggtgcccaatacgcccagctgatcgctcgccgggtccgcgaggcgagcgtctactccgaggtggttccccataccgccacggtggaggagatcgcggcgaagaagccgctcgcggtgatcctgtccggtggcccggccagcgtgtacgccgagggcgcgccgcagctggatccgcggctgttcgacctgaacctgccggtcttcggcatctgctacggcttccaggcgatggcgcaggcgctcggcggcacggtggcccacaccggcacccgcgagtacggccgcaccgaactcaacatcgacggtggcgtgctgcacggcggcctgcccacgattcagccggtgtggatgagccacggtgacgcggtgaccgacgcgccggagggcttcgaggtgaccggcaccacggcgggtgcgccggtcgcggcgttcgaggaccgcgcgcggcggctggccggtgtgcagtaccaccccgaggtgttgcattccccgcacggccagcaggtgctgagccggttcctgcacgagctggcgggtatcccggcgagctggacaccgtcgaacatcgccgatgtgctggtggagcaggtgcgcgcgcaggtcggcgacggccacgctatctgcggcctgtccggcggcgtggacagcgcggtggcggcggccctggtgcagcgcgccatcggcgaccggctgacctgcgttttcgtcgatcacgggctgctgcgcgcgggcgagcgcgagcaggtgcagcaggatttcgtcgcgtccaccggtgccaagctggtgaccgtcgacgcggtggacaagttcctcggtgagctgaagggcgtgaccgatcccgaggagaagcgcaagatcatcggccgggagttcatccggtccttcgaggacgcggtgcgccagatcgtcgacgagcagggcgcggccgagggcaagcagcccgaggtggaattcctggtgcagggcacgctctacccggatgtggtggagtccggcggcggcaccggcaccgcgaacatcaagtcccaccacaatgtcggcggactgccggaggacctggagttcgagctggtcgagccgctgcggttgctgttcaaggacgaggtgcgcgcggtcggccgcgagctcggcctgcccgaggagatcgtggccaggcagccgttccccgggccggggctggcgatccgcatcatcggcgaggtcaccgcggaccggctggcgacgctgcggcaggccgacgcgatcgcccgcgaggagctgaccgcggccgggctggaccggcagatctggcagtgcccggtggtgttgctggccgacgtgcgcagtgtcggggtgcagggcgacggccgcacctacggtcatccgatcgtgctgcgtccggtgtccagcgaggacgcgatgaccgcggattggacccggctgccctacgaggtgctcgagcggatctcgacccggatcaccaacgaggtcgccgaggtgaaccgcgtggtgctggatgtgacgagcaagccgccggggaccatcgagtgggagtga

SEQ ID NO: 78784 - protein, 524 aa, Nocardia farcinica IFM 10152
MAETQRPVLVVDFGAQYAQLIARRVREASVYSEVVPHTATVEEIAAKKPLAVILSGGPASVYAEGAPQLDPRLFDLNLPVFGICYGFQAMAQALGGTVAHTGTREYGRTELNIDGGVLHGGLPTIQPVWMSHGDAVTDAPEGFEVTGTTAGAPVAAFEDRARRLAGVQYHPEVLHSPHGQQVLSRFLHELAGIPASWTPSNIADVLVEQVRAQVGDGHAICGLSGGVDSAVAAALVQRAIGDRLTCVFVDHGLLRAGEREQVQQDFVASTGAKLVTVDAVDKFLGELKGVTDPEEKRKIIGREFIRSFEDAVRQIVDEQGAAEGKQPEVEFLVQGTLYPDVVESGGGTGTANIKSHHNVGGLPEDLEFELVEPLRLLFKDEVRAVGRELGLPEEIVARQPFPGPGLAIRIIGEVTADRLATLRQADAIAREELTAAGLDRQIWQCPVVLLADVRSVGVQGDGRTYGHPIVLRPVSSEDAMTADWTRLPYEVLERISTRITNEVAEVNRVVLDVTSKPPGTIEWE

SEQ ID NO: 78785 - DNA, 1584 bp, Streptococcus thermophilus LMG 18311
  CDS (1)..(1584): transl_table=11
atgcaaaaagaaagggtaataatgactaacatttctactttgaatgatgtgcagaaaatcattgttctagactatggtagccaatacaatcagctgattgcacgtcgtattcgtgaatttggcgttttctctgaattgaagagccataaaattactgctgatgaagtacgtgccatcaatcccatcgggatcatactttctggtggtcccaactctgtttatgccgaagatgcatttggtattgacgaagaaattttcgagcttggtatcccaattcttggtatctgttacggaatgcaacttttgacccacaaactcggtggtaaagttgttccggctggtgaagcaggtaaccgtgagtatggccaatcaacacttcgccttcgtgcccaatcagagctctttgctggaactcctgaagaacaagtcgttctgatgagccacggtgatgctgttacagaaattccagaaggtttccatcttgttgctgactcagtggattgcccattcgctgcgatggaagatactaagaaaaacttttatggtatccaattccacccagaagttcgtcacactgtatatggtaacgacattttgaaaaacttcgcttttagtatatgtggtgccaaaggtgactggtcaatggctaacttcgtagatatgcaaattgcacagattcgtgaaacagttggcgaccgcaaagtccttcttggactatcaggtggcgttgattcatctgttgtcggtgtactcttgcaaaaagctattggtgatcaattgacatgtatctttgttgaccacggtcttctccgtaaaggtgaaggcgaccaagttatggagatgctgggaggtaaatttggccttaacattatccgtgttgatgcttctaaacgcttccttgatctcttggctggtgttgatgaccctgagaaaaaacgtaaaatcatcggtaacgagtttgttcacgtttttgatgacgaagcaagcaaacttaaaggtgttgacttcctagctcaaggaacactctacactgatatcattgaatcaggtactgaaacagcgcaaacaatcaaatctcaccacaacgttggtggtcttccagaagacatgcagtttgaattgattgaaccacttaacactctctttaaagatgaagtgcgcgctcttggtactgaactgggaatgcctgacgaggtcgtttggcgccaaccattcccaggaccaggacttgccatccgtattatgggtgaaatcactgaagagaaacttgaaaccgttcgtgagtctgatgctattcttcgcgaggaaatcgctaaggctggtcttgaccgtgatgtatggcaatacttcactgttaacacaggcgtacgttctgtcggtgttatgggtgacggacgaacttacgactatactattgctatccgtgctatcacttcaattgacggtatgacagctgactttgcgaaacttccatgggaggttctccaaaagatttctgttcgaatcgttaacgaagttgatcatgttaaccgtatcgtctacgatattacaagtaaaccacctgcaactgtagagtgggaataa

SEQ ID NO: 78786 - protein, 527 aa, Streptococcus thermophilus LMG 18311
MQKERVIMTNISTLNDVQKIIVLDYGSQYNQLIARRIREFGVFSELKSHKITADEVRAINPIGIILSGGPNSVYAEDAFGIDEEIFELGIPILGICYGMQLLTHKLGGKVVPAGEAGNREYGQSTLRLRAQSELFAGTPEEQVVLMSHGDAVTEIPEGFHLVADSVDCPFAAMEDTKKNFYGIQFHPEVRHTVYGNDILKNFAFSICGAKGDWSMANFVDMQIAQIRETVGDRKVLLGLSGGVDSSVVGVLLQKAIGDQLTCIFVDHGLLRKGEGDQVMEMLGGKFGLNIIRVDASKRFLDLLAGVDDPEKKRKIIGNEFVHVFDDEASKLKGVDFLAQGTLYTDIIESGTETAQTIKSHHNVGGLPEDMQFELIEPLNTLFKDEVRALGTELGMPDEVVWRQPFPGPGLAIRIMGEITEEKLETVRESDAILREEIAKAGLDRDVWQYFTVNTGVRSVGVMGDGRTYDYTIAIRAITSIDGMTADFAKLPWEVLQKISVRIVNEVDHVNRIVYDITSKPPATVEWE

SEQ ID NO: 78787 - DNA, 1584 bp, Streptococcus thermophilus CNRZ1066
  CDS (1)..(1584): transl_table=11
atgcaaaaagaaagggtaataatgactaacatttctactttgaatgatgtgcagaaaatcattgttctagactatggtagccaatacaatcagctgattgcacgtcgtattcgtgaatttggcgttttctctgaattgaagagccataaaattactgctgatgaagtacgtgccatcaatcccatcgggatcatactttctggtggtcccaactctgtttatgccgaagatgcatttggtattgacgaagaaattttcgagcttggtatcccaattcttggtatctgttacggaatgcaacttttgacccacaaactcggtggtaaagttgttccggctggtgaagcaggtaaccgtgagtatggccaatcaacacttcgccttcgtgcccaatcagagctctttgctggaactcctgaagaacaagtcgttctgatgagccacggtgatgctgttacagaaattccagaaggtttccatcttgttgctgactcagtggattgcccattcgctgcgatggaagatactaagaaaaacttttatggtatccaattccacccagaagttcgtcacactgtatatggtaacgacattttgaaaaacttcgcttttagtatatgtggtgccaaaggtgactggtcaatggctaacttcgtagatatgcaaattgcacagattcgtgaaacagttggcgaccgcaaagtccttcttggactatcaggtggcgttgattcatctgttgtcggtgtactcttgcaaaaagctattggtgatcaattgacatgtatctttgttgaccacggtcttctccgtaaaggtgaaggcgaccaagttatggagatgctgggaggtaaatttggccttaacattatccgtgttgatgcttctaaacgcttccttgatctcttggctggtgttgatgaccctgataaaaaacgtaaaatcatcggtaacgagtttgttcacgtttttgatgacgaagcaagcaaacttaaaggtgttgacttcctagctcaaggaacactctacactgatatcattgaatcaggtactgaaacagcgcaaacaatcaaatctcaccacaacgttggtggtcttccagaagacatgcagtttgaattgattgaaccacttaacactctctttaaagatgaagtgcgcgctcttggtactgaactgggaatgcctgacgaggtcgtttggcgccaaccattcccaggaccaggacttgccatccgtattatgggtgaaatcactgaagagaaacttgaaaccgttcgtgagtctgatgctattcttcgcgaggaaatcgctaaggctggtcttgaccgtgatgtatggcaatacttcactgttaacacaggcgtacgttctgtcggtgttatgggtgacggacgaacttacgactatactattgctatccgtgctatcacttcaattgacggtatgacagctgactttgcgaaacttccatgggaggttctccaaaagatttctgttcgaatcgttaacgaagttgatcatgttaaccgtatcgtctacgatattacaagtaaaccacctgcaactgtagagtgggaataa

SEQ ID NO: 78788 - protein, 527 aa, Streptococcus thermophilus CNRZ1066
MQKERVIMTNISTLNDVQKIIVLDYGSQYNQLIARRIREFGVFSELKSHKITADEVRAINPIGIILSGGPNSVYAEDAFGIDEEIFELGIPILGICYGMQLLTHKLGGKVVPAGEAGNREYGQSTLRLRAQSELFAGTPEEQVVLMSHGDAVTEIPEGFHLVADSVDCPFAAMEDTKKNFYGIQFHPEVRHTVYGNDILKNFAFSICGAKGDWSMANFVDMQIAQIRETVGDRKVLLGLSGGVDSSVVGVLLQKAIGDQLTCIFVDHGLLRKGEGDQVMEMLGGKFGLNIIRVDASKRFLDLLAGVDDPDKKRKIIGNEFVHVFDDEASKLKGVDFLAQGTLYTDIIESGTETAQTIKSHHNVGGLPEDMQFELIEPLNTLFKDEVRALGTELGMPDEVVWRQPFPGPGLAIRIMGEITEEKLETVRESDAILREEIAKAGLDRDVWQYFTVNTGVRSVGVMGDGRTYDYTIAIRAITSIDGMTADFAKLPWEVLQKISVRIVNEVDHVNRIVYDITSKPPATVEWE

SEQ ID NO: 78789 - DNA, 1512 bp, Thermus thermophilus HB8
  CDS (1)..(1512): transl_table=11
gtggtcctggtcctggatttcggctcccagtacacgcggctcatcgcgaggaggctccgggagctccgggccttctccctcatccttccgggggacgcccccctggaggaggtcctcaagcaccgcccccaggccctcatcctctcgggggggccgagaagcgtctttgaccccgacgccccccgacccgaccccaggctcttctcctcgggcctgcccctcctcgggatctgctacggcatgcagctcctcgcccaggagctcgggggacgggtggagcgggcgggccgggccgagtacggcaaggccctcctcacccgccacgagggccccctcttccggggcctcgagggggaggtccaggtctggatgagccaccaggacgccgtgaccgccccgcccccgggctggcgggtggtggcggagacggaggagaaccccgtggccgccatcgcctccccggacgggcgggcctacggcgtccagttccaccccgaggtagcccacacccccaaggggatgcagatcctggagaacttcctggagcttgccggggtcaagcgggactggaccccggagcacgtcctggaagaactcctccgggaggtgcgggagcgggcggggaaggaccgggtcctcctcgccgtctccgggggggtggactcctccaccctggccctcctcctcgccaaggcgggggtggaccacctggccgtcttcgtggaccacgggcttttgcgcctgggggagcgggaggaggtggagggggccttaagggcccttggggtgaacctcctggtggtggacgccaaggagcgcttcctgaaggccctaaagggcgtggaggaccccgaggaaaagcgcaagatcatcgggcgggagttcgtggcggccttctcccaggtggcccgggagaggggccccttccgcttcctcgcccagggaaccctctacccggacgtcattgagtccgccggggggcacggggcggccaagatcaagagccaccacaacgtgggcggcctccccgaggacctggagtttgagctcctagagccctttcgcctcctcttcaaggacgaggtgcgggagctcgccctcctcctcgggcttcccgacaccctgcgcctccgccaccccttccccgggcctggcctcgccgtgcgcgtcctgggggaggtgacggaggagcgcctggagatcctgaggcgggcggacgacatcttcacgagcctcctcagggagtggggcctctacgagaaggtggcccaagccctggcggtcctcacgcccgtgaggagcgtgggggtggcgggggacgaaaggaagtacgggtacgtcctcgccctcagggccgtcaccaccgaggacttcatgaccgccgactgggcgaggcttcccctggagttcctggacgaggcggcccggcggatcacccgcagggtcccggagatcggacgggtggtctacgacctcacctccaagcccccggccacgatagagtgggaatga

SEQ ID NO: 78790 - protein, 503 aa, Thermus thermophilus HB8
MVLVLDFGSQYTRLIARRLRELRAFSLILPGDAPLEEVLKHRPQALILSGGPRSVFDPDAPRPDPRLFSSGLPLLGICYGMQLLAQELGGRVERAGRAEYGKALLTRHEGPLFRGLEGEVQVWMSHQDAVTAPPPGWRVVAETEENPVAAIASPDGRAYGVQFHPEVAHTPKGMQILENFLELAGVKRDWTPEHVLEELLREVRERAGKDRVLLAVSGGVDSSTLALLLAKAGVDHLAVFVDHGLLRLGEREEVEGALRALGVNLLVVDAKERFLKALKGVEDPEEKRKIIGREFVAAFSQVARERGPFRFLAQGTLYPDVIESAGGHGAAKIKSHHNVGGLPEDLEFELLEPFRLLFKDEVRELALLLGLPDTLRLRHPFPGPGLAVRVLGEVTEERLEILRRADDIFTSLLREWGLYEKVAQALAVLTPVRSVGVAGDERKYGYVLALRAVTTEDFMTADWARLPLEFLDEAARRITRRVPEIGRVVYDLTSKPPATIEWE

SEQ ID NO: 78791 - DNA, 1533 bp, Geobacillus kaustophilus HTA426
  CDS (1)..(1533): transl_table=11
atgaaccaagaaatgatcgtcgtcttggactttggcagtcaatataaccagctgattacccgccgcatccgagagtttggcgtctacagcgaactgcatccgcacacgatccgtgctgaggaaattcgtgcgctgaacgccaaaggaatcattttctcgggcggtccaaacagcgtgtatgatgaacaagcgtttacatgcgacccagcgatttttgagctggggctgccgattttagggatttgctacgggatgcagctgatggcgcatcatttaggaggtaaggtggaaaaagcgacgcaccgtgaatatggcaaagcgctcatccaagtgaaaaacgattctttgctttttcatggtttgccggacgagcaagtcgtttggatgagccacggcgatttggtgaccgctccgccggctggtttcgctgtcgatgcgacgagcccttcgtgcccgattgctgcgatgagtgacgaacggcgaaaatggtatggagtgcaattccatccagaagtgcgccactcggtatacggcaatgatctattgaagaaatttgtctttgaggtatgcggctgccggggcgactggacgatggaaaactttattgatgagcaggtgcgccgcatccgtgaacaagtgggcggaaaaaaagtgctgtgcgccttaagcggcggagtcgattcgtcggttgctgccgttttggtgcaccgcgccattggcgatcaacttacttgtattttcgtcgaccatggccttttgcgcaaaggtgaagccgaaagcgtcatgaagacgttccgtgagcagttccaaatgaatgtcattaaagttgatgcgaaagaccgctttttggcgaaactcaaaggggttacggacccggaacaaaagcggaaaatcatcggcaacgagtttatttacgtatttgacgacgaggcggccaagcttgaaggcattgaatttttggtgcaaggcacgctctataccgacattatcgaaagcggcacggcgacggcgcaaacgatcaaatcgcatcataatgtcggcggtttgccggaagatatgaaattcgaactgatcgaaccgctcaatacgctgtttaaagacgaagtgcgtgcactcggcacgcaactaggaatcccagacgaaatcgtctggcggcagccgttcccggggccagggcttggcatccgtgttcttggagaagtgacggaagaaaaattggaaatcgttcgcgaatcagacgccattttgcgcgaagaagtgaaaaaagctgggttggaccgcgaaatttggcaatactttaccgtccttcccgacattcgcagcgttggggtgatgggggatgcccgcacgtacgattatacggtggccatccgcgcggtgacctcgattgacgggatgaccgccgattgggcgcgcatcccgtgggatgtgctcgagcggatttcaacgcgcatcgtcaatgaggtgccgcatgtcaaccgcgtcgtctacgatattacaagcaagcctccggcaacgatcgagtgggaataa

SEQ ID NO: 78792 - protein, 510 aa, Geobacillus kaustophilus HTA426
MNQEMIVVLDFGSQYNQLITRRIREFGVYSELHPHTIRAEEIRALNAKGIIFSGGPNSVYDEQAFTCDPAIFELGLPILGICYGMQLMAHHLGGKVEKATHREYGKALIQVKNDSLLFHGLPDEQVVWMSHGDLVTAPPAGFAVDATSPSCPIAAMSDERRKWYGVQFHPEVRHSVYGNDLLKKFVFEVCGCRGDWTMENFIDEQVRRIREQVGGKKVLCALSGGVDSSVAAVLVHRAIGDQLTCIFVDHGLLRKGEAESVMKTFREQFQMNVIKVDAKDRFLAKLKGVTDPEQKRKIIGNEFIYVFDDEAAKLEGIEFLVQGTLYTDIIESGTATAQTIKSHHNVGGLPEDMKFELIEPLNTLFKDEVRALGTQLGIPDEIVWRQPFPGPGLGIRVLGEVTEEKLEIVRESDAILREEVKKAGLDREIWQYFTVLPDIRSVGVMGDARTYDYTVAIRAVTSIDGMTADWARIPWDVLERISTRIVNEVPHVNRVVYDITSKPPATIEWE

SEQ ID NO: 78793 - DNA, 1590 bp, Anaplasma marginale str. St. Maries
  CDS (1)..(1590): transl_table=11
atgtctaccgttgccatagtcgactttggttcccaagtaacccagctcatagccagaagggttagggagctgggtgtgtacagtgaagtatttcctcccagtacagattttcaggctatggccagccgcggaatcaaaattgatgcctttattctctccggaggcccaaattcggttcagcagttgcatggcgttcccaatgcagtgtcagacgtgctgaatctcaatctccaaaaaggcgtacctgtgctgggtatatgctacggttttcaaatgctggcccactattttggggctgacgtggcacagagtgtagccagggaatttggcagagcttggttagacgtcattgagccctcgtctatcactgaaggggtgtggtcattgggcagcaaggtagacgtgtggatgagccactctgatagcatagttggtgaggtgccgcagggttttagggtggtggcgcgcagcgcggataccggggctgtagcgtttatgtgtaatgatgagcgcaaaatttatggtgtgcagtttcacccagaggtggctcacaccccgggtgggcgtgaaatgctagacaacttcttaaagattgcaggctgcaccagagactggactatggggtcattccttcatacccaaattggcgccataaagtctgctactgacggtggacgcgtggtggcagcgatcagtggcggagttgattccagcgtggcatcagtgttggttcacaaggcaataggggaaaggctggtttgcgtatttgttgatactggcctgctgcgcaaaggtgaggctggcgtggtgcgagaccttttcgtgggcaagctcaacatgcatgttaacgttctggacaaaagcgccctattcatgcaacgtctcgctggtgtgcaagatccagaggtaaagcgtaagatcatcggcgagacattcattgaggtgttcgagcaagaagctaagagcttaggcgatatcaaattcctaatgcaggggactatatacccagacgtcatagagtctggcgtaggagaatctggaacaaaaattaaatcacatcacaatgtcggtgggcttcctgaaatcatgaacttgtcgctcgtggagccgcttcggcacttgtttaaagatgaagtacggttgctgggcaaagagcttggtttgccatctgcgatactcgataggcacccgtttccgggtccggggttagcggttaggattatgggagaggttacggcagagcgggttgagttgctgcgagaaatagacaacatctacatagatatgatgcgtgatagtgggttgtatgaccacatatggcaagcgtttgcggttttggtgcccgtgcgtaccgttggtgtgatgggtgatggcagaacctacgggtatgtgtgtgcactcagggcagtcacctcgagtgatggcatgactgcagactgctttcccttcggtgaaaccgatgaaaggaagttggagtttcttgcgtttttacaaaaagttagtagggctattgtaagcaatctgcagggggtgaatagggttgtgtacgatatgacctcaaagcccccagcaacgattgagtgggagtaa

SEQ ID NO: 78794 - protein, 529 aa, Anaplasma marginale str. St. Maries
MSTVAIVDFGSQVTQLIARRVRELGVYSEVFPPSTDFQAMASRGIKIDAFILSGGPNSVQQLHGVPNAVSDVLNLNLQKGVPVLGICYGFQMLAHYFGADVAQSVAREFGRAWLDVIEPSSITEGVWSLGSKVDVWMSHSDSIVGEVPQGFRVVARSADTGAVAFMCNDERKIYGVQFHPEVAHTPGGREMLDNFLKIAGCTRDWTMGSFLHTQIGAIKSATDGGRVVAAISGGVDSSVASVLVHKAIGERLVCVFVDTGLLRKGEAGVVRDLFVGKLNMHVNVLDKSALFMQRLAGVQDPEVKRKIIGETFIEVFEQEAKSLGDIKFLMQGTIYPDVIESGVGESGTKIKSHHNVGGLPEIMNLSLVEPLRHLFKDEVRLLGKELGLPSAILDRHPFPGPGLAVRIMGEVTAERVELLREIDNIYIDMMRDSGLYDHIWQAFAVLVPVRTVGVMGDGRTYGYVCALRAVTSSDGMTADCFPFGETDERKLEFLAFLQKVSRAIVSNLQGVNRVVYDMTSKPPATIEWE

SEQ ID NO: 78795 - DNA, 1578 bp, Idiomarina loihiensis L2TR
  CDS (1)..(1578): transl_table=11
atgactagagatatccacgaccaccgaatattgattctggatttcggctctcagtacactcagctgatagcccgccgcattcgcgaaattggcgtttactgtgaactttgggcctgggatgttgacgaagctgacatccgcgaatttgcgcctaaaggcattattttatcgggtggcccggaaagcgtagctgaagagggttcgccgcgtgcgcctgaatatgtctttaacgcaggcgtaccagtatttggtatttgctacggcatgcagaccatggcacatcagctgggtggttcggtgcaatgctcgctggagcgcgaattcggttacgcgcaaattgagctggtagagcaaagcccgctgtttaaagctattgaagacgctgtgtctgagtctggtgcgccgttactggatgtgtggatgagccacggtgacaaagtggaaatgattccggaaggctttcacaccgtagcgaaaacctcctattgcccgtatgccgcaatggctgacgaagaacgccagttttatggtgtgcagtttcacccggaagtgactcatacgcggcagggacagcgtatgctggagcattttgtcagcgatatctgcggttgtgagaagcaatggacgccggcaaaaatcattgatgacgccattgagcgcatccgtgaacaggtaggtagtgacaaggttattcttggtttgtctggcggtgttgattcgtcggtaacggctatgctgctgcaccgggctattggcgagcagctgacctgcgtatttgtcgacaacggattgctgcggctgaacgaagctgagcaggtgatggaaatgttcggcgaccactatggtctgaacattttgccaatacgtgcagaagaccgcttcttagatgcgttggcgggtgagaatgacccggagaaaaagcgtaaaattattggtaataccttcattgaaatttttgatgaagaagccggtaagctgaccgaggttgactggctggcgcagggcactatttaccctgacgtaattgagtccgctggttctaaaaccggtaaagcgcacgtgattaaatcacatcacaacgtgggcggtttgccggaagacatgaagttaggtttggttgagccactgcgtgaattgtttaaagacgaagtgcgtaaaattgggcttgagttaggcctgccgtacaacatgctttaccgtcatccgttcccgggacctggtttgggtgttcgtgtgctgggtgaaattaagaaagaatactgcgacttattgcgccgtgccgatgcgattttcattgaagagctgcacaacgcggactggtacaacaaagtcagccaggcctttgcggtattcctgccggtacgttcggtgggtgttatgggtgatcagcgtaaatacgactgggttattgccatacgcgccgtagagactatcgactttatgaccgcgcgctgggctcatttgccgtatgagttgctagagaaggtatcaaaccggattatcaacgaagttaacggaatttcccgcgtaacctacgatatttcaggtaaaccacctgccaccatcgagtgggaataa

SEQ ID NO: 78796 - protein, 525 aa, Idiomarina loihiensis L2TR
MTRDIHDHRILILDFGSQYTQLIARRIREIGVYCELWAWDVDEADIREFAPKGIILSGGPESVAEEGSPRAPEYVFNAGVPVFGICYGMQTMAHQLGGSVQCSLEREFGYAQIELVEQSPLFKAIEDAVSESGAPLLDVWMSHGDKVEMIPEGFHTVAKTSYCPYAAMADEERQFYGVQFHPEVTHTRQGQRMLEHFVSDICGCEKQWTPAKIIDDAIERIREQVGSDKVILGLSGGVDSSVTAMLLHRAIGEQLTCVFVDNGLLRLNEAEQVMEMFGDHYGLNILPIRAEDRFLDALAGENDPEKKRKIIGNTFIEIFDEEAGKLTEVDWLAQGTIYPDVIESAGSKTGKAHVIKSHHNVGGLPEDMKLGLVEPLRELFKDEVRKIGLELGLPYNMLYRHPFPGPGLGVRVLGEIKKEYCDLLRRADAIFIEELHNADWYNKVSQAFAVFLPVRSVGVMGDQRKYDWVIAIRAVETIDFMTARWAHLPYELLEKVSNRIINEVNGISRVTYDISGKPPATIEWE

SEQ ID NO: 78797 - DNA, 1566 bp, Azoarcus sp. EbN1
  CDS (1)..(1566): transl_table=11
atggcacaccaaaaaatcctcatcctcgatttcggctcccaggttacccagctcatcgcgcgacgcgtgcgcgagcagcaggtgtattgcgagatccatccgttcgatgtctccgacgacttcgtccgcgagttcgcgccggccggcgtgatcctctcgggcggcccgaactcggtctatgaggcggtcggctggcacgcgccgcaatcggttttcgagctcggcgtgccggtgctgggtatctgctacggtatgcagacgatggcgcagcagctcggcggcagcgtcgaaagctcgggcaagcgcgagttcggctacgcggagatccgtgcgcgcggccattccgaacttttccgcagtatcgaggaccgcacgaacgacgaaggccacggcctgctcgacgtgtggatgagccatggcgacaaggtcacggctctgccgccgggcttcaaggtcatcgccagcaacgaatcctgcccggttgccggcatggccgacgaggtgcgcaagttctatgcggtgcagttccatcccgaggtcacgcacacgatcaaggggcgcgatatgctcgcgcgcttcgtgcatgagatttgcggttgcggacgcgactggaacatgcccgactacgtgaacgaggcgatcgagaaggtgcgtgcgcaggtcggccaggaagaggtaatcctcggcctgtccggcggcgtcgattcttccgtcgttgctgcactgctgcaccgggcgattggcgagcagctgacgtgcgtgttcgtagacaacggcctgctgcggctcaacgaggccgaacaggtgatgctgacttttgcccgcaacctcggtgtcaaggtcatccacgtcgatgcgaccgagcagttcatgggccacctcaagggtgtgtccgacccggaagcgaagcgcaagatcattggccgcgaattcgtcgaagttttccaggccgaggcgaacaagcttccgaacgcgaagtggctcgcgcagggcacgatctaccccgacgtgatcgagtcggccggctcgaagaccggcaaggcgcacacgatcaagagccaccacaacgtcggcggcctgcccgagacgctgaatctgaaactgctcgaaccgctgcgcgaactgttcaaggacgaagtgcgcgagctcggcatcgcgcttggcttgccccacgagatggtgtaccgccacccgttccccggccccggcctgggcgtgcgcattctcggcgaagtgaagcaggagttcgccgagctcctgcgccgcgccgacgcgatcttcatcgacgaactgcgcgccgccgactggtacgataagaccagccaggcgttcgcggtgttcctgccggtcaagagcgtcggcgtcatgggcgacggccgaacctacgagtacgtcgtcgcgctgcgagccgtagaaacgcaggacttcatgacggcgcactgggcggagctgccgcacagcctgctcggcaaagtgtccaaccggatcatcaacgaagtgcgcggcattaatcgcgtcgtgtacgatatttccggcaagccgccggcgacgatcgagtgggaatga

SEQ ID NO: 78798 - protein, 521 aa, Azoarcus sp. EbN1
MAHQKILILDFGSQVTQLIARRVREQQVYCEIHPFDVSDDFVREFAPAGVILSGGPNSVYEAVGWHAPQSVFELGVPVLGICYGMQTMAQQLGGSVESSGKREFGYAEIRARGHSELFRSIEDRTNDEGHGLLDVWMSHGDKVTALPPGFKVIASNESCPVAGMADEVRKFYAVQFHPEVTHTIKGRDMLARFVHEICGCGRDWNMPDYVNEAIEKVRAQVGQEEVILGLSGGVDSSVVAALLHRAIGEQLTCVFVDNGLLRLNEAEQVMLTFARNLGVKVIHVDATEQFMGHLKGVSDPEAKRKIIGREFVEVFQAEANKLPNAKWLAQGTIYPDVIESAGSKTGKAHTIKSHHNVGGLPETLNLKLLEPLRELFKDEVRELGIALGLPHEMVYRHPFPGPGLGVRILGEVKQEFAELLRRADAIFIDELRAADWYDKTSQAFAVFLPVKSVGVMGDGRTYEYVVALRAVETQDFMTAHWAELPHSLLGKVSNRIINEVRGINRVVYDISGKPPATIEWE

SEQ ID NO: 78799 - DNA, 1581 bp, Zymomonas mobilis subsp. mobilis ZM4
  CDS (1)..(1581): transl_table=11
atgtccgtttcttcaatcgccgataaaattgtttctgaatcgattctcattgtcgatttcggaagccaagtcacccagcttatcgctcgccgtgtccgtgaagccggtgtatatagcgaaatcgtcccttttaaccgtgcagaagaagcctttcagcgcttgcagccaaaaggtattatcctttcgggtagtccggcttctgttgtcgcagaaggcagcccgagagcgccggaatccttctttcaggcaggtattccgattttcggcatctgctatgggcagcaggttatgtgccatcaattgggcggcaaagttaccgccaatgatgttgatggcgaatttggccgtgcctttattgatgtaatcgccccctcgcctctgtttgaaaatttgtggaaggtcggcgaaaagcatcaggtatggatgagccatgccgatcgggtcgaggctttgcctgaaggctttaagcctattgcggtttctgatggtgcgcctttcgctttgatcgctgatgaaaagcgccgtttctatggtatgcaatttcatcctgaagtggtgcatacccctgatgggggtaagctgatcgctcattttgtccatgacatctgcggtttggccggtgattggacgatggcggaatttcgtcagacaaaaattgctgaaatccgcaaacaagtcggcgatggtcgtgttatttgcggcttgtctggtggtgttgattcttctgtgactgccgttttggtgcatgaagctattggcgaccagttgacttgtgtttttgtcgatcatggtttgatgcgtcagggcgaagccgagcaggtcgtttccctgttccgtgagcattatggtatcaaactggttcacgtgaatgctgaagaccgcttcttggctggtttaaagggcgtaactgaccctgaaaccaagcgaaaattcatcggcaaaacttttatcgaaatttttgaagaagaagccaaaaaaatcggtggtgccgacttccttgctcaaggcacgctttatcctgatgtgatcgaaagcgtgagcttccttggaggcccgtcggtaacgattaaaagccatcacaatgttggtggcctgcccgaacgcatgaatatgaagctggtcgagccgcttcgtgaattgttcaaggatgaagtccgcgatttagggcgcgaattggggatgcctgacgtcttcgtcgatcgtcatcctttcccaggtcctggtctggctatccgtattccgggtgaagtgaccaaggaacgctgcgatattttgcgtaaggcggatgcggtttatcttgaagaaatccgtaatgctggtttgtataatgcgatttggcaggcttttgcggtattgttacccgtcagaaccgttggtgtgatgggtgacggcagaacttacgattctgtttgcgccttgcgtgcggtgacttcgaccgacggaatgaccgctgaaatctatcctttccagccggaatttcttgccaatgtcgccacccgtattgtgaatgaggtcagaggcattaaccgtgtgacctatgatttcacctctaagccacccggaacgattgaatgggaatag

SEQ ID NO: 78800 - protein, 526 aa, Zymomonas mobilis subsp. mobilis ZM4
MSVSSIADKIVSESILIVDFGSQVTQLIARRVREAGVYSEIVPFNRAEEAFQRLQPKGIILSGSPASVVAEGSPRAPESFFQAGIPIFGICYGQQVMCHQLGGKVTANDVDGEFGRAFIDVIAPSPLFENLWKVGEKHQVWMSHADRVEALPEGFKPIAVSDGAPFALIADEKRRFYGMQFHPEVVHTPDGGKLIAHFVHDICGLAGDWTMAEFRQTKIAEIRKQVGDGRVICGLSGGVDSSVTAVLVHEAIGDQLTCVFVDHGLMRQGEAEQVVSLFREHYGIKLVHVNAEDRFLAGLKGVTDPETKRKFIGKTFIEIFEEEAKKIGGADFLAQGTLYPDVIESVSFLGGPSVTIKSHHNVGGLPERMNMKLVEPLRELFKDEVRDLGRELGMPDVFVDRHPFPGPGLAIRIPGEVTKERCDILRKADAVYLEEIRNAGLYNAIWQAFAVLLPVRTVGVMGDGRTYDSVCALRAVTSTDGMTAEIYPFQPEFLANVATRIVNEVRGINRVTYDFTSKPPGTIEWE

SEQ ID NO: 78801 - DNA, 1560 bp, Silicibacter pomeroyi DSS-3
  CDS (1)..(1560): transl_table=11
atgagccagacatcccacgaccgccttctgatcatcgacttcggcagccaggtaacgcagctgattgcccgccgcctgcgcgagctgaacgtctattgcgaaatccacccctatcagaatgtcacgatggacttcgtgcgcgaaatggcgccacgggccgtgatcttctcgggcgggcccgacagcgtcacgcgcgagggttccccccgcgcgccgcaggaaatctttgactatggcgtgccgatcctgggcatctgctatggccagcagacgatgatgacccagctgggcgggcgcgtcgaatccggccacggcaccgccgaattcggccgcgcctatgtcacccccaagggcacgctcgacattctcgacggctggttcaccgacggccgcgaacaggtctggatgagccatggcgaccacgtggccgaaatcgcccccgggttcgaggtctacggtacctcgcccggcgcgccctttgccatcaccgccgacaccagccggcatttctacgcggttcagttccaccccgaggtgcaccacacccccaacggcgcaaaactctacgagaatttcgtgcgtctggcgggattcaagggcgactggaccatgggggcctatcgcgaggaaatgatccgcacgatccgcgaacaggtcggcgacaaaaaggtcatctgcggcctctcgggcggcgtcgacagttcggtcgccgcgatcctcatccacgaggcgatcggcgaccagctcacctgcgtctttgtcgatcacgggctgttgcgcaagaacgaggcgaccgaggtcgtcggcatgttccgcgacaattacaacatccagctcatccatgccgacgaatccgatctgttcctgggcgagcttgacggccagtccgaccccgagaccaagcgcaagatcatcggcaagctcttcatcgacgtgttccagaaacatgccgacaccatcgagggcgccgaattcctggcccagggcacgctgtatcccgacgtgatcgaatcggtttccttctcgggcggcccctcggtcaccatcaaatcgcaccacaatgtgggcggcctgccggagaagatgggcctgaaactggtcgagccgctgcgcgagctgttcaaggacgaagtccgcgcgctgggtcgcgagctgggcctgccccagtcgtttatcggtcgccaccccttccctggaccgggcctggccatccgctgccccggcgagatcacccgcgaaaagctggagatcctgcgcgaggccgacgcgatctatatcgaccagattcgcaagcacgggctctatgacgagatctggcaggcctttgtcgccatcctccccgtccgcaccgtcggcgtgatgggcgacgggcgcacctatgattacgcctgcgccctgcgcgcggtgacctcggtcgacggcatgaccgccgattattacccgttcacccacgaattcctgggcgagaccgccacaaggatcatcaacgaggtcaagggcatcaaccgctgcacctatgacatcacctcgaaaccgcccggaaccatcgagtgggagtga

SEQ ID NO: 78802 - protein, 519 aa, Silicibacter pomeroyi DSS-3
MSQTSHDRLLIIDFGSQVTQLIARRLRELNVYCEIHPYQNVTMDFVREMAPRAVIFSGGPDSVTREGSPRAPQEIFDYGVPILGICYGQQTMMTQLGGRVESGHGTAEFGRAYVTPKGTLDILDGWFTDGREQVWMSHGDHVAEIAPGFEVYGTSPGAPFAITADTSRHFYAVQFHPEVHHTPNGAKLYENFVRLAGFKGDWTMGAYREEMIRTIREQVGDKKVICGLSGGVDSSVAAILIHEAIGDQLTCVFVDHGLLRKNEATEVVGMFRDNYNIQLIHADESDLFLGELDGQSDPETKRKIIGKLFIDVFQKHADTIEGAEFLAQGTLYPDVIESVSFSGGPSVTIKSHHNVGGLPEKMGLKLVEPLRELFKDEVRALGRELGLPQSFIGRHPFPGPGLAIRCPGEITREKLEILREADAIYIDQIRKHGLYDEIWQAFVAILPVRTVGVMGDGRTYDYACALRAVTSVDGMTADYYPFTHEFLGETATRIINEVKGINRCTYDITSKPPGTIEWE
